United States Patent 7,868,149 (PLANT GENOME SEQUENCE AND USES THEREOF) - sequence listing, part 119

SEQ ID NO: 65869 - DNA, 2522 bp, Oryza sativa
tcggaggcgagatctctccggccgtcggcaggttgaagggcatcgtctcgatgtatggaagacgtggtggtgtactttgttgttgtttggaaatgtggcttgctggtgcttggactcgcagtaacttgtgagcttgggtttgtacctgcagtgacttgaagtcgaatgggctgtctgggcagatccctgatgagattggcgattgttcatcactaaaaactctgtgagttgtgtggagtgtggacggcattatcgatttcttcttaacttacggagagaatgtgggttgatacatgtgtttggttcagggatttgtctttcaatagcttggatggggacattccgttctcagtatcgaagctgaagcacattgagagcttgtatggcctattcttgctggaattcatttattataagcagtgttgtatggacatgccgatcgtgttctgtgaaatagttttattcatgtgccggtgtttgtggttttctaggatattgaagaacaaccaactgatcggagtgatcccatcaacgctctcacagctcccaaatttgaagattttgtaagttgcgcgaaacttcttatttttgtggtgtttaattaccgtgctcccagttttctaattgttgtgtgccctgcagggacttggcacagaacaaactgagtggagagataccaagactgatatattggaacgaggttcttcaatacttgtaagtcatccttattttgcgctggaagtttgaagattgtgcagtagttctagtatatcagtattttattgtattttagttatgtacctacttgaatgcgatttctttttttttcttttttttgaaaatcatttgaatgtatttaagagcatgtcaaaagtttgttaagctggtaaaaatctatattgactttatgtgaattcactagcattttacgcaagttgcgttatgtaaaatactcatattttttttatgaattgtggctgaattaatattatcctcaggggattacgcggtaataatttagaaggcagcatctccccagatatatgccagttgactgggctttggtacttgtgagtatatgcatactatgttttcggcaaaatttgcctcgagtccaccgtattgtacttatgtttcaatcatttggaccagtgacgtaaagaacaacagcttgactgggccgataccagaaaccattgggaactgtacaagttttcaggtcttgtacgtatttgcagcttacccctcttaattacaacttttctgcttctgtgtttgtgaggttttcctaacatttctttcatgttagggatttgtcttacaataaactttctggatcaattcctttcaacattggtttcctacaagttgctacactgtatgtggtgattatcttgacaaaaaaaaactcaattaaatgtttaatacagtttttgctgatctgcatgattattcacattgtttgaattagatctttgcaagggaacatgtttactggtcctattccatcagttattggacttatgcaggctctcgctgtactgtaagtacaatgatgaactgaatattcatcatacaattggttattgataaatgaagctttcaagatattttaattcatcaatataactttactcttccagggatctgagttacaaccaattgtctggtcctattccatcgatactaggcaatttaacatacactgagaagctgtaagttttcttttctcctaaatcgttaggttgtgaatattttccctgatagattttctactgccagttcatagttaaaaaacaaaagccttagaaggttctgcttaggaatatttcttgtgtaaattaatatgttatatttgttccaataggtatatgcaaggcaataagttaacaggtccaataccacctgagcttggaaatatgtcaacccttcattacttgtaagtgcacgttttattttattcccatagcatattctgatttgttgcgacctgatttatgtcattgttgactaatttcagagaacttaacgataatcaacttagcgggttcattcctccagagttcggaaagctaacagggttatttgacttgtaagctcttttttcaaactcttcaaaatttgttatgttttctataatttattagtaaaacaagcggcttatcttactctttgcttcacagaaaccttgcaaacaacaactttgaaggtccaatccctgataacataagctcatgtgtgaatctcaatagcttgtaagcatgatttaattataattgttatggtggaacttacaatttcagatgcatgtatctaatgtggattttctttacagcaatgcttatggcaacagattaaatgggaccattcctccttcattgcataaacttgagagcatgacttatttgtaagttgtaacaattttaatttcttaaattgtgttgttacattatttttccttttgaacttctatacttgtttaatttttgtatttcacatagaaaaaccttgtttcccatgtt

SEQ ID NO: 65870 - DNA, 3802 bp, Oryza sativa
ttcctgcagccctagtgtttttgtgcactcgtcgttgccctgtgcacttccatcagttcttaaactgaaactgatgtcacattctctgtgaacaacaaatgatctctgacctagtttcctgattttgatattgagggtgggagtcagcagcttgctgatgcgatcatggacgagtctcccgtagtctgtaaccttctgttgttactgtgtttttctctgaaaactggccttccaatgatcgactggcatgttgcgtgtgattgtgtatggatcaatggagccaggcagccagcaaatgcttggtcccctgaattatgtagcttttgttgttcttgtgtcatctggaacatcgtccccgctggctggtatgtagccgcttctgttggaggcttgcagtacctactagcggctaggtgtcaacttccattctcgacatgtttgttaggagtggtacataagcagccatcgctttgacttggtagaaaataaaaatacaggaacaagggatgggctcaacaatcatacctaatacttcctccatccaaaaaatataaggtgctcgtcgtctaataatagtatgaatctggataagctttttcgtttactattgtttatcttaaccagttaaaggccctctttgtttaggcttttaagccaacttataagtcgaaaagtctaagccaaaacaaacaagcaaccttttcatttggtttttttaagccataagtcactctaacactattaagccaaaagttaggttggagaagcttttttgggcttatatgagatagatgtatgactccaccactaaacttaggacattaaatccactggcttataaatcatataagccaataagctgacttaaaagtctaggccaataagcctaagcctaaacaaagagggccaaactatggatcatccggttaaagtatgggtgtatatactattccctttgtcttctagcattcaaaacttattaaaactagatgggtatcccgtgtgttgctgcggaagaattgtgtgataatatagtatacacgagttctaaaattttctttgttacctactataccattttttttcatgtgtttatatatttctttacctttactaattatccaaaggttataaataggttataaatgattaggttgtatgatgtgccttttaggaggaagagatgtaatttacactcctgatgaatcatccaaaagacttaaaacaattaaggtgatgtgaagagatgcattttacacccttgataaatcatccaaaagctaaaaacaattaagttgatgtggcttcatgagagaaaagagaattagcattaactatacttagtggggatcaactttatacatatacatgatacataaattttagcctatcgtacaaatcaaaatttattactttcttatcatttaatatcacttgcctactcaattgccatattttttttactactccctgtttctaaaatataagcattataaaattgtttagcaaaaaataaggatgagacgaaagattctctgagtcaccttggtagttaaattttaaattttgaattgatttgatttcccttttaagcacctgatttgctaaaaatgctgagattttggtgcattgattttgaattgatttgatttcccatgtttcaaattatctatcattttaggtttattttaagtcaaacatgcttatctgtaactattaattttttaagttaatgtagttaaataatacatgaattgttgaaaatattttttatataaatcttgaaatacaaatattacgatattaaactatatgaatttataaaaaaaatgatggtgaaaattaaaatgtttaactttaagtctgaatgaagaagcatttaaaaatcgagaagtcaaaagtgacgtagagtcctactgtatccattccaaaatattacaacctaaaaccggatgatactacgaatatggatacgcccctatctagattcataattttatggtatgttctatctaatcataggtttttatattttgggaaagtaatatgtgaaatcaaattatcaaattactaggagaagccaacacgtgtccagaaggaagaaagacaaaataacggtccattttaaacgtgtttcaggcgccgtccacgccccgtctccacggtcgacgcggatcaattccccttattattaacctgtcgcatctccgtccaccatcggctccccaccgtccgatctcccccgccggaatatcccccccgcaccgcaccttctccgaaaccatcggggattcttacgcataaccccctaaacttatccaaaaacaaaactattccccatcccctggaccagttcgcacgtgacgaggacctatatgtaaataacaatttgttctagaacttttgtggaaaacaaaaagggagggaacttttattgagctctttgtcgccttctcctcgaattaggaagagcaaaacagagagaggagaggagaggagaggagaggagaggagagaggaggaggaggagcacgcgttcttcgcctcgcctctctcgcctcacgggaggagaggaggagggcgattcggaggagggcggttgcctttgatcccattcccctcccccatcttctcccccgggttcggattcggtcggtcggttggttgatccgcaaccgatcgatcgagggggggtggcactcgcggatcctctcgtgttcttcctccagtgcgctgatctggacacggcgcgatttatagtctatcggccaggtttggatcgttgcgaatgcatccagttcaggagaaattggattttcttttttcctcttttctttttttacgggaatgcttattattgttctccggggcttgtagggcgtaaatttgtgcatttgctggcgtagttacagggtccgattagattgattgaattgatactgtttgtcaatatttgcaaatggtatttgcatttcatataatgggggcattcttagtattcccaaagtaaagttctatttgctgatatgagaacaaagaaagctagtgttattttttatcatttaatcctggcaattgtaagggtaaatttgaaggacaactcattttcaggtccattttcaatagatgatgtgaaatttgttttttttttaaatttcacaaaatatgtatcacctccttattagatgctgtttgtgcaattcacggtgtaaaagaggttttatagctgacttccatagttttgttaaaattttcagatcacaaagtttttcctcgccgtacattcaaaagctttctctgaagactttctacattctgaagattatattgggaataacattttaacatgaaggccgatcggttaatgttgtccaatctcgaccatgatttgggatacctacacaagtttccctcagattttccaatgtctcatgatcttgggttgagcttgtttacgcatgccggtacaatggtgggaagttctttgcgacagcacaggcagatctgttcttcaggaaatttgattgttcaggaagcatttgatcgcctcaacaagtttgccagagctttctgctactggctttctagagtgtctaatcccaagaatttacgtaggctaatgagtatggaaggccctagctctggagcttgccagtcacatatcaatcatttgagctcccgtatgcaaaatttggctgtattgcagtttggttatctagtaagagaagagcatgctgtacaactgcttttagctaacttcgcaagcacaacacttgggcgactctggaatgattttcagcag

SEQ ID NO: 65871 - DNA, 1840 bp, Oryza sativa
tttctgacaattttgaatcacatagttttattttatgtgttgatttaatatgtatacagaaaattgtacactactacaaatgatctgtggacaattgaattgagttagttcagtttagtcttcattttacatataatgtgatacttctgaactatcagcatatcatttttctctgaattcttagtgtgacgtctccatgtaacattattattgataattaattgcaggtccttgttgggatgggtttcaaaggtgtgaaagtaatgagggtcaaaaatttggatctgtacgcttttggtttatgtgagtaaatattttttgtgcttctattatgttgtttacctgtacattctacaaaaaaatgtttctctgatgttccatcatttctttttaacggtgcaccatgcatttttcttgatagatctgcaaccgaatactatttctgagaagctgggacctaagtatgcttctgttccaaccatcaacttgaaggacaacccagatttctatgatgatcttttgaggtaggacctcgatatatatctccagtcttgtcctgttgttacaattctgcctattcatatgcttagcacacataaatgtggtagtgcttgcaccttttttttggcaactgtttgcacaagtttagtttccctcacaagatccacaggatgtattaaaaattgaactgtttgtgttattgtgctagttgatctacgtacatttcaaaacatgtgtacacacttgtccattcatgtgccatacatatatccatgacattattgatattttgatcttatgaaagtctatatgaatctacttgttatgaaaagtgattcttaacttgatacttcttgtgcatgtgacacttctttccaaaaaaggatgattacatgtgcaccggggactaatgaagttttgtatcttcaatttccagggaaaaccttcctatgagagttagattggtacttcactacaacggccttagcattggtgcagtgcgagagtaagtagtactctcattttatgtttacagagatctgcttgaatgtttctttgatttgtcatgtttgtaaagatctgtttgattgttactttctcataaaaaaaaatgactttagtctattcaagacgtttcattttacctttttgtgtttttctcgcagtgtatttgagaagtcacttggcctgcgcctccagaaggtacttgttggttgctgcttcagctgatacttttaattcttttacgagttcttcatactgatgtgacttctgtatttgtattttcaacagatgaatcccaacactgattatcattgcttgaaaacttttggttcttacttcaatgaagacattcctattcctgcggtaaggttgaacacaggatttggctaccgtatgtttataacttttagatacaagtaaacactgttaatataactgcagggtacaaagatcgacttctgccaaacttctgatggccagctaataacagaaagtaagtaccgtagaccgtaactgaatcttctgtatgtcttgaggagtgagttttctactgccacatccacatattttgacaaaaaaaaacattttcatgcagttgatggcagacaaattggtgctgttaagagcaaagacctctgcagtaagtgtatacttgtcacaccaaaacttatacaaatttacttcattacttcacactttctcaatattttccacccgcttcacttggatcactgtccatgacttgcatctggataagtactttcttgcctagtgcatctttatggtacgataaagttcattgtttttaactgtacttaactcatgcttggtgaac

SEQ ID NO: 65872 - DNA, 8350 bp, Oryza sativa
gaagaatcacagaaaaattcaaatgcagaatttttgaattcagagccattatcactgcgaattgctcgaagagcaccaggaaactccaaagccaaactacgagcaagagactgaaagaagccaaacgtttcctcttttgatcaagaaatagacccaagagtagcgagagaaatcatccacaacaaccaagacataccacttccccccaattgactggacccgagcaggaccaaccgtatccatgtgaagcagttatcccggtccatctgtcataaccattgtaacaggcttgtgggaggaagatgtcatttttccatgacgacatggtgcacacataagacctttcggagctttcaacttaggcgaaccccgaatcaaatccataccactaatgcgagacaagtagtcaaagccaatatgaccaagacgacgatgccagaaaaacaaatccctattctctgaggcaatgagacaacgagaaggaccaggagcagaagagtcgaagttagcaaagaaaactcgaccaactcgagaaatgtcaaaaataggagattcagaagcatcaagaactcgagacctgtccttttcgaaacgaacttccagattttcatcacagagttgtgaaacagagagcgaattgtacttaagcttacttacaagcgcgacatccttcagcatgaatttgtcattgaccttgattgttcctttagccatcacgcgtccactgctcgcatccccaaaagtgatggtctcatcaccggatgcacgagtgagagaagtaaaccacttggcttcactggtcatgtggcgtgagcaaccggagtccacaagccaagaattacttctccccactccaaaatcctacaagaaagacaaagcagatcttgatgattcagtactggggttagtgagaaatgacataggaatccagtactgaaccatgcgaggagtacaagcatctttagtgttatgagcataattatatgcaagatgaccatgtctgttttgccccaaccctgctaggccacgtcgagggtgcgcatctcggcgaggaaagcgagatacaccacttgaacgacaatgacacgcacactcgaacctctcagggactctagtagctcttctagtcctaagacgttcttgtcgctcttttctagcctttctaaagcagaaacctaccaaatgaccagctttcccacaataggtgcactcatacttggttttctctacaggcttggtttgtttctggttttgcttgtgctcaacttgttttggatttttgggtctaggtaactctataggcttagacttgctagtcataggtaccatctttggttctgaggttttgggtgaactagaactagtgtttccaatgaaacctgcagacttgaaggttataggtttttgagctagttatatcatcccatctgtgacacctaaaatttcatgggtacttatcctcaaagactcagcaaaattatagcctataccttgattgtttatggacactttggattggtctaggatcatgttcaactttttctttccttgagcaaacctctctaaagattgttgtaggtatgagttctctctcttagcagactcaagatcaactttcagagaaatgcatgatgaacaagaatcaatagatttgatagaataaatgacagttttagcatcttttagttcagtatccaggatagcacaattagcacatgaagaatgaacaggttccttagtagcaaaagattctaacaaatcattattggtcctaagcatggcaacttgttgtcttaattcatcattgtcactagtgaaaatgggacaattttcacacctaccaatcctatcatgaacaaatttttcttttaattctttcaattccatctcaagcaaacccatatcaactttcattttatagcaagtagagcaagcagcactagcactagaaggattcccagctcctaaagcacatgatttcaacttattcttgaggagattaatttcagaaagatatgaagcacaagtagaacatgtatcctcctcaggaatcatggatcgaagcctagcaatttctagcgccattccatcattttcagattttagtttctcaattttatacttagaagacctatacttgtcactaatttcaatcatcaagtgtgccattctttctttgcttagttcatcatcaacagagtcattatctgagcaagaatcatcacaaggagaaccatccaaggaagggatatcatcaagacatacctcaagatgctccgatgagtcatccttatcctcaagtgccatgagacacaggttgatgaagtcctcgttgttggcgagatagcacatcctggagaagtccttgtcccccttttcttgatcatcgtcatcggagtcgatgtcgctaagctgcacctcctcaagagtcgccaagaccttgtggatcgccttcttcatcaaatcctttctcccctttcgcccttgtccctcgggcttcttggtcgtcttgtcactcttcttcttcaacttgggacaattcactcttatgtggttaggctctccacactcaaaacacacaaatggttcattggtttttctcctttctctctctctcacattcttgtaagctcttgagaattttctagcaaaaagagcaagatcatcttcagggatcttctctaattgctcctcagtgactgagtgtaaagcggcaagagagaagccaccacacacaaaagctgagtcattagaagaagtactaccagagggatcagctaccaaagccatcgagtgtttgaggcctttccgatggaaaacatccatctcatgggtttttagctttgagtaaagcttgtccatggtaaggtcactcagaggtgcactatctgtgatggaagtaactttcatttcccaaacaccataatcaagacaattcaaaagatggcgagcattatcattatcagaaaattcttttccaacagatcacaacttcgaaacaatttctccaaaacgcttgaaataagaatcaatggactctcctgggtgcatctcaaatctttgatattctttatgaaattgattctgacgaaccaattgaatatcattgtttccctcatggaaatttcacagagcagtccacatgtcatgagcggacttgtggtgttaaacacgattaaattcaccaaaagaaattccaccaatgattgcatttcttgcacgataattaaaatcaacctgagccacatttgcaggcgtgatgtcatcatcatcgggcacagtgtaaggagatttaaccttattccacacattattcccttgcgactggaggtaggcctccattcgtgccttccaaatgacaaaattgtgtccatcgaaaacaaatggtttcgcagagtatttttcctccatagcggcattcgttgccacggttaggttacaacgaactaaccgggctctgataccaattgaaagaccaagaacggctatagagtggggggtgaatatagcaattcaaaacttgtccccaaaaatactcatcaagccggatttctcaaaattcttactagaaccgcggctattagagaagccggatctagaaaagaagagagatggaattctcgaatctagaagtgaggtgaggagaagatagcaaaactcgtcatcgcgaaattcaaatcgcaagcggaatttaaattgcggaatttaaaaggcgaagacaaaacgaaatgcttcaaatcattttattcatcggtgttgcaaaataaccgctcaactaggagcaaacatacacctttagaggaacattaacacaaactttaaaatctctcggacaaacacactccaaactaatcctaatacaaaagcctctcgggcaaacacactccaaactcacaccgaaactctctcaccgagcatctcaaaaggattacaaaagaagcaaccttcacccttgcatccacctctccatttatagcctaagacctcgtaagacattgtcacaaatgtctttagggcgaaaccctaactcagatgcaatctgggccttaggttgttccttacatcctaaggaagtagcctggattgaagccacgtcgcttgccacatcgggatcctcttttcacaaagagtctgcaccaaattcctcccatgtgcgtgcccgcgtgctcctcaacgtgggccccgtgatctgtgagaaggctcctctgagccaatcagcatgcaccgatcgggagatcgatccgcgtcgtctccgtcttgccgaatcgaaacttgccacgttgcccagccgtgccatgcgcgtcctgtctccttttcctcagcgcgcgcgcatgcccgcgccctgtccggagccgccacgcgtctcgccgagccgctccgcgcgcgctcgcgaaaaccgcgtgggtcccacccccgtgcgcaccgaattccttgccgccgcgtgtccactgcgcgcgcatgcctcgcgcgatttcccgcgcttgcccatgcatggtgtcgatgccatgggccgtcgtcttgtcttgggcctgctcggcctggcctccctgccagctgatccatccatcatcttgagccacgaagaagggctggattggcttggcctccctgccaaccaatcacaacacacatgcacccatgggctagcaagctcctcatgcacacatgcatgtcttgagcccgtgcatggcattcggccatgtgcacgcatgcataaccgaagcaccactgcccatgcttgcatatgcacataccagtgcatgtatacaagctcctcttccattctccattttcttcgcgaacccggcacttgcacttgaccttgcgaactccgttgcgaagacctcctcacatggtgtccgtccaccgtgtgcaaccttgtgtccaatcttgtcacccagcatccttgatcgctctggacctcaactcctccctgagtctagtaccgatccgtcgttgactaagatcgaccccgatcacctgcacacacatgaatcaaacaaccgttgtcttggcacagatgtcgcaacctgaccaatgttagtctacgcacacacttcttgcacttccggtacttgtcaatttcccatcacaaaagaactataaccacacatggtttcacatcactagagtcttgaatagggattccttggaaaattttcagcatagtggataaatccacaaagctactcggctaattgtggactatgcaagattgttttggggatacgagggcttgttgcgtcacatcctgctttccaaatgggatcctcactcggacgaccgatgctctcaacttccgatcaccatgattcagcaaatgctcatcaactttgaagatcagctggagaagaactcagagtcattctctgaccctagcctgaggtaccagttcctgcttaacaattcctacttcgtaagagaagagtttcttgagcccagcaattacgtgtacatccttccgtcaggcacaacgctcaaatttatgcagtaccaagagaagtacatgcttgcctcctgggaacctgttctgtattgcctacaggataagatgccgctgtggtttcctaaacactcctcacagctgtcaagattcaagtcagaatttcagaaaacatgtactccacatcagaagctatggaaggtccccaacccaaggctcaggcagaaactgcgagaagccatcactgataaggtcattactggatacaaaaggtacctggaggaccatccggagctggagaaatgcagcagtgatctacaggacatggaagacatggtcaacgagctatttgaaggatgaataaggattattccagttttagactgacatggccatgcgtatatggagtgtaaactttaaatcagctacgacgagaagagacaaacaagttcacacttgatgccttttttattgtattttgatgttctatcctcattctacttttttctaggaaatcctcattctaccttactaggaataaaatgtatcaatataaaaaaagaataaaatgtatcgacagtttaatacaagcttcttcctgtattattatctcctcagctctttaaaatttacagtggctttataatataagtgtacgtactttacactgtaaaaatgatttgactattttttagtaaaaaaagtggcttcgtaaatattgtattcccttcggttttgctctaaatttgttctacaaatggactctttcacggctagttccctttagcaccgtgtgataccctaaaaaattgatgaaaaagaaaaggaaatagaggagagaaaagctagtgggctgtgttgaggcctagatgaccataggcccagcccactcttgagaaggaagagctaggaataagtctatttgtagtccctgaattattgtccttggttgaatcgtatccctcaaccataaaacagggcatacaggccgaaacttctaatggtcgatcgatcgccatggagatcaggattcgcccccgtctcccctccctctttccacctagtttccttttttggcaccgtattactttcctattttagtaaatttatgcacctaaagtttatagacctcaagtttacatatctaaagtttagagaccaaaagtttataagtcaaaagtttatatatccgattcaaatttgaatttaaattcaaatattttttatatatagtatctatctatctattatattattaaaacagctttgaaaggagtcaccacgttcgccgtgagggctagaaattcccaaattaatcggagaaaaagaaaaggagagtccaagtagaaatacaatttaaaaatagctgaaattcagaattaaaaataagcaatattgaaagaagagtccatataagaacccaatacgagattaatcaaaatttggaataaaaataaaataaaatccaaaattagaaaagaataggagagtccatgtaagaatacaattaaaaaataactgaaattcgaaattaaagataaggaatattgagagaagagtccatataagaacccaagacgagattaataatattcagaataaaaataaaaataaaatccaaaattagcaaaaaaaaaagaagagttcaagtagaaataatatttaaaataaaccgaaattcggaattaaaaataagcaatattgaaaaaagaatacatataagaacccaatacgagattaattaaaattcaaaattaaaaataaaataatatctaaaattagaaaaattaaaagagagttcaagtagcaatatattttgaaacaactgaaattcaaaaataaaaatattataagaacactatacggtattaattaaaatttgaaaaaaaatctaaaattagaaaaagaaaaaaatatttcaattaggaatagaatttataaataactaaaattggtgataaaaaaaataaagactactgaaaaaaaagaccatctgaaacacatgacaagataaattaagtaacatgcttagaaaggagtagagtggtgacgattgatacgacatataaaaattgttaataaaacaccaaatagaatcctaatgacgattaaaaggagcgacgacaggcaagccgtgaagcaaatgggcaagacagttgccgggacttctagaaagtaaaaaaataaacctcattgataatcatattcaatttttaaaatctcagtggcaataaaaaggagaagcagtgggcggggtgtataggagtatagttgtagagccgtggacggttagcgggacttatagaaaataaaaaatgaatttcaacgatagttatatttgatttttagaatcccaatgacaataaagagtaggcggcggatggaccgtagagaagtattgtggcatcgtttgacgggacttgtaaaaattataaaaaatggaacctaacaagacaataaactctaaaaactacaaaactacaagatccaattgttaaaggttgggaactactaaaaagtaaaaaaaaaatacaataataatcatgttcgattttaaaatctcaatgacaataaagaagagagacagcgggcgagccataaaggagtacaatggcaaagtcgctgacagtttggcgggacttctagaaagtaaaaaattaaacccgaacgataattatgttcgatttataaaatcacaatggcaataaagagaaaagacagtgtacggtccgtataggggtataatggcagcgtttgacgggacttctagaaattataaaaacgaaacccaacaagacaataaactctaaaaactacaagtccaatttttaaaggtttcaaggagaatgaatagaactagtggtagatcgagcaagcaaataaagaagaatatgacagaagtaaggg

SEQ ID NO: 65873 - DNA, 23150 bp, Oryza sativa
ctataaaaacaggatcaatttgtctcctcgagctgtttgaacggtggttttatcctacgtgagacgttgaccaagtctttatttgacgtagcacctacatgcaacgtactaaaaaaaaaaaggtgggaccaaagaatgctgccctccctgatctagctggccagcgccgtagccgtccccgtcatcccaagcattccgcaatgcgggatgggagcggctgccccagcgtgccgacctggccatgcaattccatcgggagatgttgcaccgacaccgccgccgctgcctgctgctactgctgctgttgccggttgaagttgatcatgtcgtcgcggacgcgtagctcctccgcctgcttcgccatctctaggactcaagctgttgcagcgatggcgaatgcgagagggagagagcccctggtcttcaccacgctgtccgcaccggcgccgagctgcaccggcgccgccgaacgcagggaatgcttcgtggtgctggtggatagccgacagcgtgtccgactgcggcggtgacgtcgatgaccgggattgctgctgctgtgtgggttcatcaagaagaggtgcatcgccatagctgggtcggtggcaaggccaaccatggcaaagttcatcgcaattttagtaaacaacacaaagcacaacaatccgtcatcatcgatctgctctgctcctctcatggtcaggcatctcagtaatccgtcggtggttggttgccgtcaatgtcataggtctctgccacagcatgatccctttgtagctgctgttcttggtcctgatctcgtcggtgcaccttcttgctcaccttcattcagattgcagttgggttagtggagaagggatttcaaaagattaattattggttgcaaagtgcaaaatgttgcatcaatggagaagtagtttgcaaagattgattcttagagtgactcgattaatttgcttgtttgattgattgatcaccttgtgtgatcttgcgtggaggcggtgatcggaggacaccaccttccggcgaggtaggctccagcagccgcccctgagggggctcttgctgccgggcttgtaccagttgacaatggacatgtcgttgaccctgcaacgctccttctcctcgccggcgccggcgaggtcgcgccgccactgaaccatgatcacctgcgcaccgcgattcctgggagtgggacatatatagaagaactcatcatggccgccgatcagatcctcgcgcagccttggtgggttggctcacgaacatggcggtttggcctagctgagacgatggtgctgctatttccactgccaacatcgtcggctgatggaaaagagaggagagaggaagatagtgaggggaaaagaggagagtcattgatatataggacccacattttatgttagcaaaccattaaaaaagtctatttataccggtttttaaagataggggagctcttatatctgattttacggttgagagatgagattcaagtattcaaccaagagttaagtagccatttgggcaaccagcgagcagcatgcattgatgcatagcaggagaagtgcgacacggcagcaagcagcagatgcatgcacatgtagtggcaccttgataattgctcggaggagtggtttaaagaggatgaataatttggaccttttacacgaaacgataaataactatagtgtgttgtaatgaaagtaaactaccggagaaataatctttattaggtcggttctaatataagctgggactaaaaaattttatttagtcccggttaaaaatttgttgatctttatcaactgggactaaagacatctttagtcctggttcatcccctgtcagaggcctgtcaggggaccgagaatctttagtcctggttgatactactaaccgggactaaagattaccaatttaatcccagtttaaaaatctatctttagtaactccaaccgggagtaaatatttctctcctatctctgatcggttaagtcctagacgagacttttctcctcaccaagatatttagataagattagatcgatctcattccctctccacctaactcctcagatccccttcctcctcctcctccctcatctcctcctccccctctcctccccctcctcccctcccatccggcggtcggcggcggcaggtaggcagggccgcgcggcggcggctggcgggaccgcgcacgggcgtggcgagcggcggcaggcaaggccgcgcgcgggcgtgatgagcggcggcaggcggcagccgtggtgggcaatagcgtcgattctctttttttttagataatttgtgattcactgagatgtataatttctttttttttagaatttgttattcattgcatagatctgagatgtatttgatttgtgtgtaatttttgtaggatttgtgatgtatttgatttgtgtgtataagtaacttaggatttgtgatgtgaatggtttgtgatgttactctgatttggggatttgaggtttgatttgaagatatgactggcactcgatttgggagaaaatatagggattaactctgtcaattagcaaagaaataatgaaaaaaaaagaaaaggggaccaaccgggactgtcctaccctctctttactcccggttggtaatactaaccgggactaaagattcaactttactctcggttatttcacctggaactaatgatgggtattttagtcctggttagaaaaccgggattatagaggttctcaatcaggagtaaaaacggttttcccagtggtggtataatctaataaattgtgttggatctaaaaccattaattttcagggatgcagctactctgacgtaaagtcataggaatatagatccctgatagatgagattcaccaatatagatccattcccgagtgaccgatgttactctgacgtaggccctgtttgggagagcttctcctagctgtagctttttctaaaagctgcttctgctgaagctgccacaaacggtccacagcttctgagaatctgtagttacagattctgaaaaatgaactaagaagacagaagctggagaagctgggtttcagagcttttccagattctcagaatctaaaactcccccaaacagggcggccgtagtatgttagaggagcctagcattttcaggtgttaacagttatgcattgttcgggtcttaggagtgacacatcgtacgagcatatggaccacagcaaactagatagttcttggggtaagttgccaatattactaagttttggcatgtttgcttatgtatctactaaagtttgataaaaaactaaatatatgtatatttttagtaactttattagaaaatggtatagtttaaaatgatattaatctgaacaacctatttatatggaccgttgaactgagcaattaaaaagtgtggtctatacagaaattatgatacttagggggtgtttcgatctagatactaaactttagtccttgtcacattaaatatttggacacctatttagagtattaaacatagactaataataaaactaatttcacaaatgagagctaattcgcgagacgaattctttaagcctaattaatccataattagcagatgtttactgtagcatcacataggctaatcatagattaattaggctcaatagattcgtctcgcgaataagtgcagggttataaaatgggttttgtaattagtctatattgaatactctaaattagcgtcaaacatccgatgtgacagggacaaaaagaaaatttagccccatccaaatacccccttaagagacctaggttcggcctttcaaccttctcatatttcatctggattaactgatggcttctcctatcttattatcattggatggctagcttcttctggctatcccaatattttttaggatttgatatcctggatttttcaccttttagttcttttagaaaaactcattatttttaaaaaacttattctataaatagatgtcacgcccggaatttctatccaaaattccaaacgcttacatgtgtgtgaaccctcgtccaggaatcagccgagacacacaataacaaattgataatagagtacaattattactctaattaataagcgaataaaatgtcattacagaggtagatagttcctctcaatcaataaatatctaagcagcggaaaataaaataaacggcgcagacgactccactccactggcagcttgaccagggctacgcctaatcctccacaccatcagcatcattgtagaactcttcctctgatgaatgattgcaaggtgagtatatgacatactcagcaagccacgcagcaaatatgcaagtgcacaaggataccaaagaatggcataatatagggctcatttgcaaaagcagcatttagcaaacatttgagaattataaaacagttaagtaataattaaacaatattaatccaacactatacaacataccctgttgcataggcccaaccattctgaacaaccatcccggctgcacaattctatctccaaacaaggaatataccattccaaaccaggagctaaacaaattaataccagttataacatcttctattatgatgagaagtgtgaaactaatcacgaaagacattgtttgacccgcccataactgcgggcacggctattcgaatagttttactctgatcagaggtgtaccactgtacccacaagacacagccccacatcatgtcaccatgtgcctcaataccaccacggtaccttggaaaggagctgtgacagtacccctcgcacaacacaatccaccacagcgcaccattcctggatcataatcacccccttataaacaaggcatggactccccagcgacccccgtgggcttatctccgccacttctcagtctggtgccccgcaatgaaccatgctatacaaaaggtaaagccgttgcccacgctggcttgtggttggcacgattaacgtttcacaaccgaaactcgtgaactggtccttaattgtcatgagcacgactctcaaaaccatgtgctcacaacccaccattatcaagttttagttggcaattaattaattaaccaatcacgattgaccatcgcgaactatcattaagccatcattaaataatagtgagtcataagttatcccaatagtgtgctaatgtttctaagcatgactaagcaatcacatctaatatctagctgaaccaatatatataaagctcaactagtcaagttataataacccaaggtatcaaggaataaagtaatcaagaacaaaagggctataacaaataataggttaattccacccaatgacattcgaaaataaatgcaatagttgaatagaaacaatagctttaaacgggatcaacatgctcaaagggttgtttggaatctgtgtgacttgccttgctggccttggaactcttcaaattcttctcctgcgaaaacggactctccggaaacgtcggaatctaagcagaaagaagcaaaatcaccaaaacagcacataaacaagcatgaacagtatatgtggatatttttaaaatgtagatctcaattttagaaaaatttagagacttgaaccaactaaatccgagctaagatgaattagttatgaattttagaagattaaatcggattaaaacacttatatggattttaattgaattatgacgcaataatgaattattttagaaaaggaaaagggatttattgcgtcagcggctagggtttgcggtggaccgggcgcacggcagcggttcacgggaacggacggccgagatcaatccatccaaaacggacggccgagatcgatcgggtctacggcggctcacggaaaaacgacgacgatgacgtcggcgatgacgtcaccaccggcgacggctcggcggctcgagcgcgcatgctcgctggcgaacgacggcacggcggtgcaaacggaggacaccaaaacggtgcgggcatcgcggcgaactcaccggtgaccaaagcaacggcggaggagcaacgaacgacgtcggcgacgaggtcgaagcggcggagaaggtcgggtcgacggcggcgacggtgctccggcggttgacagcgacggcgaaggggcggacgaggacggcgacgacttggcgaccacgatggcgatcttcccgaacgacgacgacgaccggaacggcggcggcgcacggctggagcggcggcgacgacggcggctcgaggtttcacggcgctagggcgctcccgacggcgagagacgaaggcgagggtggcggcgggtagaggagacaccggggatccttttataggggcaaggaggcggcggcgaaggcccacggcgaccggcaacgcgaaggaaaggtgaggatccggaggaaagagacgaatccgactcgagatcgaatccacggatttccaaacgattttagccggtgattccaaaagagaaaagatagaggagatcccgaagatcatttcccctctattgatttcactggaaacggaaaggatcggccgaatttggaaggagacggcggcggcacggcgctagggtttcgggcgacgggcggccggaggaagacgacgaccccgacaggcgggccccacctgtcagcgagcgaaagcgcgcgcgcggctgcggcggactgggccgacttgggccgggggagagagagaaggttttgggccgactttcggcccaaagccaaaagagacttttaaaatcatttttcaatttaaattattcattaaatgcaattccatttattaaaaatacttccttagctcaaataaatcccagaaaaatctaggaattatagaattaagcaaagtatttaatgaaattttatctggccccattttacattggaatttattaattaaaattagatcttctcttctaggcttttaaaataaattctaataattccaattaaacaacaatttatatatttttggatttttagggtgtgacaatagacctcagaaaaaaatttattttaaaaattttctttttcttcttcgtactgattcgtatggaattagcctgactcggcgcacgatgccaatgttattagtgtcgtggtcaaatatgaagacggtcattggcaccatcccctccatccccaggtggaagctatggcactgatgtgagagggagaacgtcaatatcattggtgtcgatgatttatttgtaaaaaaataaaaattatctatttataattaaaaagtatatacaaataggtcatcagcgtcaatgctgaggatctatttgtaaatattattttattgcaaataggaccatttttgttacaaatagatcttttttatataaaaaagtgcgatttggttatcctttacattagtgacttagctttcacctagaagtggagggcgctgtcttattggactacgacaccaatgatattggtgcagtgaatgttatgaaaatagatgcataatggagacacgaattttacgtggaaaaaccttacgagaaaaaaccatgggtggcgatcggcaatgatcactattgagcagttgattttaaacgtaggggaataacaatgagaacccaccccttcccatacaacttacaagagtatatataggagataaaagaaagtcacataataagaaaagacatagagtcctattaggaaactaattcgaatacattgtaggcctaaaatttgtatcacataccgtatttaacaatctgcaccttgagacgaatttcctcttgtaacataaaaatcatcaatcaccagaatacctcatgtaggtaaaatcaccgtgcaccaaataatctgtaggactataatgcaacacgaaccaaacttgagcaaagctcaaacttagtagcatgaattagctttgtcatcatatcagataggttatcatgattacttatcttgcataacttgacatcaccttcagcaatcacacctcgaataaagtgatatctcacattaatgtgctttgttctctcatgaaatatctgatccttagtaaggcatatatcacccatcaaaatagtaccaccttgcacaacttcatagttggcaaaccaatccctattcgagcacatgtgataggtgcaagcagtatcaaaaatccattggtcactactttatgcacaaccagcataagcaataagcaattctgcattagacttctcattaataacaaccgcggctttaccttccacttctttattactttttggtatgtactttccggttcttttgtccttgttctgtagcttccaacactcagagatattatgtccatatctcttgtagtatttgcatgacttatacatgcatttagactttgatctcccacgatagctacttgaactttcatctcttgattggttctttatgttcttctcctattgcctgccccgaacaaccaaaccttctgcttgtgaacttgaactttcagagggtaacatcttcctttcttttgaattcaaagcttcataaacttctttcaaagttagagtataacgactataaagaatagtatctctaaaatttgcatatgagctaagcaacgaacacaacagaataagacctaaatcctcttcatcatactttacctccatggagtcaaggtcaacaacaattaagtggagagataatccatcacatattcatcatattgcaacttgtgcaaaaaaaaaaacttttgctttaggtgcatcttattggtcaaatcgtttgtcatgcatatcttctagcttcaaccacaacccaacggttgtcttctccttgagcacctccaacaaaatattgttagatagatgaagatgaatatgtgacatagccttatgtccattttcttcttattgtcggactaatcctgagtcctcttgttaaatccagataacacatcatcgaggtcttgctgtgcaagaacggttcgcatcttcacttgccatagtgagaatcttgtgtttcggtccaggagcggtagatcatatttcaaactcgccatgggaattgatcctgaatttgctactaagaaattaatgtaaacctagcaaaacgtgaacctctggtgcacttgtcatgtgcacgtactgtagatctggaatcctcatgttaagcaggctgtgtgtgcgtagcaatttctaaccgtgaaaattaattcagccctgccttttctctttctcgatgcgcatgctgctggatggttttccttgctgctctgctttttctcctgctacgcgtgatcattctttttttttttttttgagaaacgcgtgatgagtcaacagatgactccggttcggcctgcgacgagaactacgcgtaacgccgctgcagccgatgagatggatttcttcgaacggagaaacacgccggtaaccggaatagtagatcagattttcaatggatatcacttattatgaaaatagatgtataacggagacacaaattttacgcggaaaacatttatagaaaaaactatgagcgccgaccggcaatgatcaccgttgaggaattgattataaacgtagaggaataacaatggaacgtcatccctctctgttcggcttacaagagtatatgtaaaaaaaaaagacatctagtagaaaaagatatgaagtcctatttaaaaaactaatacaaatatattgtaggcctaaaattcagatcacatatttaagtgtgaaaataatcattttaaaataagtttttaggatctatttgtagaataattattttaaaaggatcaaaatataaaaatccagctttgacctcccctcattagtcagttctcaccaaatctggtaaagaacagcatcactcagatcggatccactgcctagagctagcttagcacctactgcagatatcgcgcaagcgagcatggagacacagctgccgaccgtgatggagctggatagctccgagccggccaatttcacgcagccgtcacggagatacagctacctggagaagatccgtagcctgtccgtcgtctcgggcgaggtcgccgggtggtcgtcgtcggcgtcggcgtcgtcgtctcggtcggcgagatccagttactacagcagcagcatgtcaagcaacgcgtcgggtggccctcataatcatcggtacgccccttactcaaactcgtcgccgggtgacattgacctccacggtgctcaggacattgcgcggcagatggtccacgacgggttcatggtgaacttgatcagagagttcgaccgagcgcccgggccagcgctggagaggtggttctccgagctcgacgtcggctggttactccggtcggcggcggcggcggataaggagcaatccgagctcggcttggctgatctcgtgcggcggtggacgcgaggatataccgtgatggccgaagcactcagcgccacgcagactaaggttgcaggtgtacccgccataatacttccgcaggcccagcgggaccataacaatattatgtgtgatcaagagctggaagacgacctccgacttcaattcgcgcggttcgttgaggcgacagtatccaagatgcttgcctttgttgatgccctcgccgctgaaaacactcggctgtcaatagacaacctctcgagactcgtgggcctgtgcagctgcatctacagctgcttctacaagtgcaatgtagtagtaataactgattcagaagaaatagttgattcagaattgcaatgcctaggccgcaaagtggttggtgctttcataattacaacgacaaccttgtgcaatgcgatagagagtatggcgatggtcgccgaagctgttacccctgtcttaattggttgggattcctgtgaaaattttaagcagaatgcagaaatccacgaagctactaggctaattgttgactatgtaagattgttttggggataccagagcttgcggagtaacatgcggtatcttaaatgggttcaaattccgatcaccatgattccacaaatgctcatcaactttgaagatcagctggagaagatctcagagtcattctctgaccctagcctgaggtacctgttcctgcttaacaattcctacttcgtaagagaagagtttcttgagcccagcaattacgtgttcatccttccgtcaggcacaacgctcaaatttatgcagtaccaagagaagtacatgcttgcctcctgggaacccgttctgtattgcctacacgaaaagatgccactgtggtttcctaaacactcctcgcagctggcaagattcaagtcagaatttcagaaaacatttagacatcagaagctatggaaggtccccaacccaaggctcaggcagaaactgcgagaagccatcattgataaggtcattactggatacaaaaggtacctggaggaccatccggagctggagaaatgcagcagtgatctacaggacatggaagacatggtcaacgagctatttgaaggatgaataaggattgttccagttttagactgacatggccatgcgtatggagtgtaaactttaaatcagttacgacgataagagagggcgaggctaaggttaaataagttcaactgtattttgatatgttcccacctcattctacttttttcctaggaaatcctcattctaccttactatgaataaaatatatgggcagtttatttttttttacgccagatctgttgacagataacaatacagatcttcttcctacattatttcctccacggctccaccctttgattcttcaccataccgctaataacttgctcaggcctcacagcctccaacggttggggagagagacactacagggcaattgctattttctcctctaatcccctccataatcaccagtggttagcggcggcagcagcaaattgcattggtcgccttgcctgttctcccgtgggtgcggcagtgttgcaaaatctgcaacaattagttgtgcgcgtgttgctggagcggctggtgatttccatgatctgctatatcttgttcgtctcaactcgcgtgtttgcgtggcccgcgcgtgctgcacgtacgtcccttggcgttactgtgctgcttctcttaggcctcaaatttgttgagcagtagatataccatagtggtgtcgtatatatatatccgtggacaggtggctaggtggcagataattgtttctctggaaccgtgactttgtcatgctttgctaggcttctgtatagttgggagtgtccttatttgtgacaaaaaaggtccctctctatcttgtgatattatgtttgagacttgctaagtgctagtactgaatcaattattgttagttgttagctttctattgtggagtaaattgagagccatagcttgaaaggcatgttcggcattaacattataaaattatgagtgaattacactttagaccatgttttattgctaaagtttcactttgaaccatcctgtacacaatctttttactttggactaggtaactttacttttgttgcataatggacgaccaccctaactcttttcgctagtgatgtctagcgtctctttcaacaataactcttttcgctagtgatgcctagcgtctcattcgacaaaggtatggcatgtatataggtatgaaaatttgctggcatgtcgttaataatttgctcgaagtcatcgaagaactgaaggcgtggtttagggtggtccattgtgtaacaaaggtaaagttacctagtccaaagtgaaaatactggacaaagggtagttcaaagtgaaactttggcaataaaatatggtccaaagtgaaattaactataaaattattgttggttcttcttgactaaccacacggagacttaattagtagtgtagggcgaatccaccccatttcccacgcacgcacattcataacgaacgacgttgtgactggaggcacactttcccttctgggctagcccccgtgtaactatcaccaggcaccagcgctacatacaaaagtagagaaggccccgtgcatggagacatggcgatatttcgcaccgtatgtaccctactatcgaaagagatttgctccggtccaataaaaagtaacttgaggtacccactactacggaaatcatctttcgtggcggtcattttgtatttttgctggtggaatttggagccgccacaaagcaaaggccagtgaagatctaagattttcgctggcggttttattccgcttgcgaaaatctattttcgccagcggacaaacgatttttgctggcagttgaggtccactagcgaaaacccattttcactggtggttgcctaaagagaactgctagtgaaaatcaacctaccccaccaaaaatccccaagcccaaattcaaaattctctgcccggccaaattcaaaacagtccatatctgaaaatggacataaacatcattcaagcatcaatccaaatccagagcatcacaaatacataatattggcatcaattcaaacacaacacattggcattatcaacaaaacagattaacaacacacagattaacctaacatccttacaaaccaaaacacacaagagaaccctagccgctgaagccatcggggacgagccgccgccgctgccatctgttggctgcctcccctccagccagatctggaagaggggaggggagggggggaggggaggggagggcagtggtgccaccgctgcaggcctcctccagaagggtcgcgcgtggtcaaggtcactgagcccggcaggcagcgtcgttgtcatcgtcgttgttgccgcggtcgcggtcgtcgtcgtcagctccgctgtcgcccgcgccgcgtgctccccgcgccgccgctgaggcagatccgtcctccccaccgccgcctttgttgcgccgccggcggcggcctcctcccctcggacagatttgggagaggggatgggacggcaggggcagtgcagggagccgccggtcaccgccgccagagccgccgccaccgtcgccggtgggaaggccgggagggaggaggagagtgaggaggagagaagaggagtggataatgtgactggatatggagagaagaggaggggatatggagagaaggagaagaggatgaggtaggtgggtggttttaatgtgaccagatatttttggatcactgagctgggttttctctggcggttttgtttattagccgccaggaaaaattcgaccgctaacgaagattatctatttttgctggcagcgcacctaagtgaccgccagtaaaaatagacatattttcgctggcggccgcgttagacaggccgccagtgaaaattcattttctctggcggtcggtgcccctcatccactcgttacgactttgcggtggttttcacatttttccgccagcgaaaataataggccaacgccatgaaaaatcgtttttctagtagtaccagtacctcacggtaccaaatcatttctgatcgttggatctagcaatgcacatcctgcccagctagatccaaagatcggaaatgatttgataccgtgaggtaccggtacctcgaggtactttttgttggaccggagcaaatctcggtacttgtaaattgcttttcgttaagcaatttctgttcgaatgatttttttttgaaaagtcatggttgtggtctgcagacttgttgatcatatggcgtatccatgtaaatggaggaagaaacctttagaggatatggtaaacaaataagaaaatttgcaggtgaagaaatgttaaagccataaaaaggtaagttcgctatcaatctgtcataataattcattcaactttgcacttttctgatttcatatctgataaatttcctgagacatcactaacatgataatattcaatatttatctgtttaaaatggaagagactgatagacaagggcacaacaacatctatagttctagactccaaacataatatttttacagtccttgaagtaggtatcaagagataccaaatttataatagaaaaggtggtatttcatggtaaaattgttctattatttaggatatggagaatgttttactacatatactcgttggtttcagatattccacatcccctacatgagtcttcttgttctcttgagtttgtgagagctagctctgcgttggtttggttatgtaccctacccaaagttgatggagccaaaacattggcattgttaaatttgttaggatagagatgaagaatatgtttgatttagtgctaaaattgtgaatatatggcattgccaatttgctataatttttgcagggtggcattgtgatggagaccataccaaaattctagcactaccaagttttggtaggttagcaaactgaactagataaacatcacactgaacatgaactgcctgtctctgttctcccatatctgtcggagcccctgaggccgagcgggacaagccatgaacaaggaaaggaggatctaatacaagaggaagcacgcattgcaatgtgccaacaaatctggcacagcaagactgaagtacatattattccttgtcaaggtagaatgaagatttccttaaaaaaaatcagaacactagaaaaaagaggcatcgaatgaacttgtttaaccttagccccttgtcctgttagctgcttcaaaatttatcctatacgcatggccaattaggccatgtaattctaaaacaggaattagtactccttcatccttcaaatagctcgttcaccatgtcttccatggccagcagatcgctgctacttttctctggctccagatggccctccaggtactttctgtatgcagtgatgaccttgtcactaatggcttttcgcagcgagttcctgtgctcggtgttcgggactttccacagcttctgatgcctgcacgctttctgaaattccgactggaatctggccagcagctgcggggagtgtttggggaagaactttggcatcttattgtataggtaaaggaaagacagcacgggctcccatgagacatcgaggtaacaattctggtagtgccaatatctgatccctttgctcgatgggaagctgtaatcggtgttggtggcaagaaactggtcctgtatgaagtaggagttgttaatcaagaagatgtacctcaggctagggtcagagaatgactcggatttcttctcgagctggtccaggaaggtgatgatcatttgctcaatcaggctttgtactatctcccaacaattctggctactttcactcctgtaacaacataggatggactccagcactctacggtatccccagaacaaacttgcatagtccacgattaaccgagtagccctgtggattccttcagtctgtgtgaatttttcccaggaatccatggcgctcaagacaggagtaacagcttcagcatccttggccgtcttccgtatggcttcacccaagctgtcctgtgtgttcgccatggcttcaccgatcttgttgactaggctttgcatttgttctgaatcaggtagccggagatcgagagcctcctgtttcaaggcgggcatgaggatctctgacacgtcggagatgcaggtgtgcacctccatgagcccaaagaagctatccgcggttggagttgggcaagtcccggccttaccggcggcggcgagggcggcggcgaaggcgatcatcttggagatggtcgtgtcagtgaaccgcacgaggcagaggtcatcgccgccgccgacgacgccgcgtagcagcagttcatgatcggaggaagaagctaccgcgggcgccgtgtgatgtggcggctgggagattgcgaattccacacctccaacgacggcgacggcggcggcggcggcggcggcggctgacctctcgtcgtggaggtggccctgcgtggcgctcagcgcatgggccatcacggtgagcgctcgcgtccaccgccataccagccgctcggcctcctcctcctcctcctcctcctgctgctgctgatcagttggccggagcacccagccgacgtcgagctcggagaaccacctctccagcacgggtcccggcgcgcggccgaacgctccgatcagggcaagcacgaagccgtcacggaccatttggctggcgatatcgcgagggcctgggacttggaaccctaccactctcaggaaggagccgccggaggcagcgccggttttgcagcgacgacggtgagagccggcgccggactcggtgctggagacggtgctgctgtagttactggatcttgccgagcgagacgacgacgacgacgacgatgacccgacgacggacatgctccggatcttctccaggtagctgtagctccatctccacgacggcagggagaggctggcctcggtggcatccaactccgacagcgccgccattaattctagctctactgttttgtagtgcactgtatgtaggtgtagagaatttcggatcgggcgattgagaggtcgacttcagaagttcagaattcagattggagttcagtatagcttagcttaatttgctggctttcgatttcctgacacgcaactaaccgccttaagcgatagagacgaatataaatgacgtcgttgttgattggcaaccgcaacaataaaattacgaaacagacaaatgcatgcgtgcgactttcacaggaaacgctgcaaagtttggcggcgccaaatcgactctgtgtgcttgctcaacacctttgtttgccaggtgttcgtccatcatcttagtcttggtagctaattgtttttataaatataatatttttttcttttccaccactctcgtttccagtctctaccgaaataattaattgtctaattgtaaactcacagtggttctcttttcttgagttggtacataatacttacttcaggaaattaatagaatgtcatctagctactaactgtgttgtaatcccttgccaagaaaaaaagaatgactgttgtgtaatctggaagtcaagggtagcaatgtttagttgcctagctacttatgagttatgacttgtgaattgtttacgtggtgttttctgttttgtgcaacttccgttgtttacatacggtgtcgctttctgttttgttttaagagatgtagtatttctatcgactacctccctttatcccaaaatataagaacataagatcggattagacagaatttagataggttttctgtctagattcgtcttattaggatatactccatccatttcataatataatgtacaaccacttttctcagatgttccataatataagagcaggtacaatagcaggctataagccagctgcaaatatattttaaggagataactgaggagagagaagggtagcgggctacagatttgtagccagctgtagcacgaactccaagacgcagtgtgtgtatgacaggtgggaccagatattaatagtgtagtatataactattgtatgaatgagctattagattggctatagatgaattggagtatactattgaacttgctctaagacatgcatgcaagcatgcaattaattatgacatcttctctattagataacatgagagtgtaggatttaaaaaagtatagagaagatgtcataattaattagagaagatgtcataattaattgcatgcttgcatacatctcatgttatctaatagagtttaccactgtgccttatattttggaatggatgaagtatatgtcttgtctggttttagttttagattcttatattttgagaattgggatggatgtagtactcagttagaagtaactttaacttgcatacatttcattgtttcattaatcaacttcagttagaactagtttttttttgtgaaaaaaaatattcatggttgacttgttatattacggagtataatccatttaataggaaaatcgaggccactaggttgacgacgatcgaggtggttcttggtgatagatcagcgggcatcggctgaccatgagaggtcaccggtgatcaatttgcagatcggtttctttcaagcatctcctgcaaggccttgaatcggtccttagggtcccttccagcaccctaatgattgggcgataagagttaaggtttgggagagtagggtacttacggtgcgagatatcgccatgtccatgcacggggccttctctccttttgtatgttaccctggtgcctgatggtagttactcgggggctagcccaaaaggaaaaaagtgtgcctccaatcacaacgtcgttcgttatgaatgtgcgtgcgtgggaaattgggtggattcgccctacaccactaattaagtctccatggctagccatgatcaaccaacaataatttaacatggcaatgccgaacatgcatgtaaagctatggctcgcaatttactccacaatagcaagctaacaactaacaataattaattcaggactagcatttagcaagtctcaaacataatatcacagttcaacagtgtgctagtaggtgttcgcaagctaccagtgacggccatagtatcgtttaccttcataaagtgcaacgagcttttcacactacactagataaggtcacatgtgacgggcccaaccctcacctttgacgggtttaggcttggtcagtgatcagtggtcactggtgactccagtcgcctttgacgggtggccggccgtcacctctgacggacaaataactagaggaccgtcagaggtgttggtctctgctagcctagggccagttaggacccatcacaggtgacccatctctgatgggcatgtaaagaaaggccgtcagaggtgatggtctttggtagatagaagccgtcacaggtgatccacctgtgacgggcccgaaagtaaaggcccgtcacaggtgggtcacctctgacgggccgcgatttgcgtatccgtcacgggcatggttacctttgacgcattttgtttccgacatgtcactaatgagttaattccagaaaaaaaatgctaaatattggctagcctcaggatttgctagccatgccctctgaaaaacagaaacatcacagatacatgccagtcatcacccaatatcacatattccccaacatcacagatccatctcaaaactgacatcattcacatatgcagttcaaatgccacaattttgcacagcaaattcataccccatgaaagccacaatttcgaaattcataccccatgaaagccacaatttcggtcgttgctcatagaaccgcatacttaccaaactttcttgtatcctgttccttgtgaacctccacgacctgctattgtaaaaaatggagaaaacaattgaatagtacaacgtaaatcgtagttgatcaaatttgatgacaatttagcaaactaccataaatattgcacatataaaagtaaattacattgcattccataccacagaatcatagaaacaactttttttacatcacaagaaattagataattgtattgttcatgacttaacatctaccccgttcaatcatctaactggcatgaaaacgtcctttcttgttcattatttcggcaagaatgaaggcgcacacttcgcctttgatagcgccggggggggggggttgatgggtgaaatcttcaagccaactctacctttatgttcaataaatcaaaggttagcatgtttagaagattaatgttggtattgaaatgagcttatttgccattagcaacaatctcagagtcgaaatctttcacctcttagaagtgttgacatgttgtggcacacgtggaaaccacactggtctccgatctgttgtgtgcatgcgaacttggtgtcatgataaagtttgtccttgccctccttatgcctaccagccttttccacatatgggccccaagccatatttaaggccttggtgattgcagtgaaattataatcttttgccttatttgagttaagataggagaccctactccatttagggtctccgtcatcggcgccttacggagctccgccaccgtccttagcatcgcacggagcttagccaacgtcgtcgacgccgcggagctcagctgcgtccgtgtgtccaccgtcatcgaagacgcacggagcttgctgctgccgtcgtcgatgccgcgcgaagttcctacgcgcgtccgtgtggccgcctctgccttctccatcgccgcatgcacaccatcgtcgatgctgccatcgatcgcctgcgtctgcctccgttgatgaaagagtagagagagaagaagaaaaggataaggatgcggtttgctggaaatgagataagcgtgtgggagaccgatatttccttcccgcatcggtcgcccgataataagcattttcgtatggattaggttgtgaattgggcaatgctcactaggaaaataaggatataattcaagtagtccttatcggatccaaatcgaactctatatctctctttttcttatctaggacttctttcttatctactcatcactttatccatatgtacgagggttatttttgtataggacttagtatatgatgatcccatcgagctaagaatacatgtatagggtatcccatatctagaacactgatgtaaagatcatgcaaatatgttggatcatctacaatttattaccccctccaaaacacagggacttttaggttgtttaggaaatataaggttacatttcttttagtcgcttcagttgttaatttaaaaattttgaattgcttagattccatttgcaagcatgtgattggcttcggaattattgaaatgattagaaccgtgggaatcaatgcaagaatccttatagcaagtttaatagtatagccaactattagctttaaattatctatagtcaatttaatagccaattcattcaatagttatctataaacatatactacactattaatacttggtcccacctgtcataccatattacatcttggagtctgtgttgtagctggctataaatctatagcccgctgctcttatctctcctcttttatctacttgaaatgtatttatagctggcttatagtcctgttattgtacgtgctcttatattgtgagacagaatttgaattatagagatccttatattttaaaacgatcctcattattgtgatacaaaatttgaggtatagaaatccttatattctaaaatgagggggagtatattttaaggcccaattaatatacaagtatgtcaaaacatcatctcccacatccttttcataatattttaaaatatatccatccaccatccatttcctctaaaatatttaatatatatttattcatatatttcgtaacaaagcacgagacattattggtatttctagttttaaaacgcgattacggccctgtttgagggagtttaagattttgagaagcagttggttggggtagccagcttctgagaatctgaaaaagctggattttccggcttctaacttctagttcattttcttgattccataactacaatttttcataattcggactaaaagttagactgtctagggaattcctgattcggaaagaagctgctgtagctacaagcttcccaaatacggagtatgtcctatatgttaaacgtgcatggcacccggcacgcgtactagctagtggataaattaaatatggagtaactttaaaagagtgggttggagatagaaagagagattttttagggatcacttggagacagtgtcccttggagatagtgaacagtcatctctatcacattttacgcggttataattagttaatcgcactcttagagcaagtaaatataatatagagtaagttcaaaagagtgggttggagatataaaagagtgaatttattttagggatccatggagtcagtgagtccctcttagacagaacggtcgtcggtcaagtctatcactttttacgcggttataatttagttaatcgctctcttagagatagtactgaaagcaaaagcaagtactgaagtacttgccctaaataccttgtagagtaatactccctccatcctaaaatataaaaatattgattagatatgacatatcctaatactatgaatctagacatgatagtattagaatatgtcacatccaaccaaaatccgttatatttagggacagagtgaatatgctgatatggaaaaaaaaggagaaattggagccacctctcatgtaaggataacttaaactagaaaaaaatacacgt

SEQ ID NO: 65874 - DNA, 1555 bp, Oryza sativa
tttccaaaagcaaacggaattaaaaaccgactcatacacggatgacgtaccaaaataccggcaaaaacatttttaatttttataatagtagatatatgagtattaaagttattgagttttatgtgttagaggtaacttaaggttacccttaatttatagggggtgacaagaataaagttagagatggtagccgtctcaaatactctctccgtttctaaatatttgacgtcgttgatttttttaaacatatttagctatttgtcttattcaaaaacttttgtgaatattatttaaaaattttagtagtagtatatttaacaatgaatcaaatggtagaaaaataattaataattaattaaattttttaaataagacgaacggtcaaacaagtttaaaaaagtccagcgtagggacggagggagtataagggtctgtttggggagctttagattataagaagcagttgtttgatagccagcttctgagaatctgaaaaagctctgaaacccagcttctctagcttctggcttcttagttaaagctgtggattgtttgggacagcttctagcagaagcagcttttgagaaaaactgcagctggaataacatcccccaaactttctcaccactgcggctctaaacctctcctatctatatatccgtgctcgatctgagaactccagtagtcgatccactgctaacccctaccgagttaacacttaacacctagtcatatcgcagatcgagcttagctagaatggcgcgaatgcttgagaccgtgtcggagatggagaacaccgaggcggccgatggagatggagctacagctacctggagaagatccggtgcatgtccacgggtggcgggtcgtcgtctcgctcagtgagatccagtaactacagcagcgcgtcaagcaccgcgtccagtgcgcgtcctaggtacgtcccctgctacgatgatgctgatttcgtgacctactccttccagagggcagtaggacttggagcccccggacctgctcgagatattcgtgggcagcttggtgagtgagttcagccgggcatccggatccggccctgcgctggacaggtggttctcagaactggacgtcagctgtgtactccgcaatgatcaggaggaggaggaggcgaccgggagcctggtggggaggtgggcgcgagctctcactgtgatggcgcgcgcgctgatcgccacgctccaggaccaggaggacaacctcaccggccgactctgccaactcgggcggcttatggaggcgagtttctccaagatccaacttgcacagttcgcgcaggcgactttctccaagatgcttgcctttgccaacgccctcgctgataagccttggacgcggccaacggacaagttctcggggctcatgcaactccgcatctgcatcaacgacgtctcagatatcctcgtcccgctgtacaatgaggttttcttactagctgattattcaaaagaaataattgaaagcatagtaaaggagatcgatgatgttttctgggtagagccatattgatgatgacgac

SEQ ID NO: 65875 - DNA, 1773 bp, Oryza sativa
acctgtaacttctcatatgtatttaccatatcctataaattactttcctccgtttacatggatttgatcacttctgaaatcaacaagtgtgcagattacgaccatgagtatttttcagaacagataatgtcactcataactaaaattgtctaagtaaatcagctcccgtagcgtcgccaacacgcaggagacacgggggtgaaaccatagcgtcgccgccccctcccctcccccctcccccacctcaccgccactggagctcattgccggaaagccgattggcaagctaggatggcggcggtagggcctacttcgtggcggcgctccatatcaggcgcgggggaggcggcggacacttggcgatggggagtggcggtggcgagccctcccagcgaggaggcagcagatccagcaccgccatcacccacgggctgccctaggctagatccggctgggcgcagctagggcagcgggctggcagcgacgctgtggagcagtggcaacacgacgcgaggaggcgcggtcggcggtgtcggaggccggcacggccggcggcggtagtggagctcctaaaatcagcggtggtggagttgaggcgacgtgatcgttagacgcgggttttgttcctggacctgtggacggcggaggccgatgcagcgaaaggaggcgcggaggtcaacgtggcgcgaggaggcacggccggcagtgatggaggccggctcggtgtgaggaggcgcagccatcgaagaggcccatcgactatgggagaccagtgcggagagcggatggccgcatggtggcacacgcaggctaaccggtggggggcgccggtgcaacagtgcccacacaccgatgaaggatggatggtggtggagcaatggagcatcaattgttgataggcaggtggcggccagcggagcaatggagcatcaatatgttctatcactttctttgggagtttgagtgtgcacatataaaaggttggcggcgaagagaggacaaaattgacaagggtaacaagggtaagtctttggccatgattaagaaacatggtgattgccataagtctctttcaactctatcaattaggggggagggggggaattcaacaattcttggctttgttgttccaaccggaagacccaaataagtgaagggcatcgaaacaatattacatcgaaaagtaccagtaaggatttctagtttttcttcattgacatgaattggcatcgtacaagatttatggaaattctcaaatactccctccgtttacaatgtaagtcattctagcatttcccacattcatattgatgttaatgaatctagacataatgtgggaaatgcttgtctagattcattaacatcaatataaatgtgggaaatactagaatgacttacattatgaaacggagggagtagtagagtaagcaaatggttgggtaatacctttgagacaaaaagctctttttgacaagctttcagaatgatgagaatatcatctgcatattggataattgggaattttcccttccacttgtgggattggcatagataagattccctgagaatgagctttgtttatccttgaagtgttttctttgttggtcaacataaactgtgggagtactagtagtggctttccgttgtttctattcccatctaaagtgctgacatcgcaggtaaacaattacctcatgagaaaacccaacctatagggtggggaaagaaggattttggtcttcaccatcctcactaatgtcctgtttggatcca

SEQ ID NO: 65876 - DNA, 1150 bp, Oryza sativa
  unsure (1)..(1150): unsure at all n locations
agcctagggtagggacacatggatgatttttttttaaaccacccttgcaatgtcattctgcaaaatgtaaagtcgtacaagacaagaaaaatcaccagtagtctttgcatgaacattttccatccttgaagtgatgaaatcggttcgtatctctaatatatatctccctcccctcgaaagatgatatgaacttcattgcttcatggcagtcaccacaaatccggagattctttatcacctgaatcaaatatcccttgcatctcagcatcctcacttcaccatccttcaccatcctcacttcattgcttctcagttattgcagccatcatggggtttgaactatcgccagccaacaacatgtgtaccttgttcttgatctctatccaactacagcctttttctttcttcaaccctacagtcttcatcatatccctcagcctattgaccccatcccacattttcttgtatgcataaatgttggaaagcaggacataattactagcattttctggctatagttgaaatagattttctgctgcaacctcagcaaggaccacatttccatgaaccctgcaagggcccagcaatgacccccaaatacaaccgtctggctcaaacggcatctgatttatgatatcatacgcatcatcaagcttaccagcccgaccaagcagagtaaccatacatgagtagtgctccatcctcggagaaattccatgcttgtgctgcatttcattaaagtaactacgcccctcctctgtccagccagcttggctgcaggcaccaaggacacaagtgaaggtgactaggtcaggcttctcttcggaacttccgcacagcattctcagcctctccatgcatagcatagccaccaatcattgcattccatgaaaccacattcctagatggcattgcttcaaagatcatccttgcatccctgaccctgccacacttagcgtacatgtccaccaaagaactcacataaagatctttctttccatgtacttgtttgtaaagtggctccattgtccatgaagttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 65877 - DNA, 902 bp, Oryza sativa
taaaatgaggattacctaagggtcgaacgggggaacatcagagtagccatcacaattcttaccctccttttttttttttgaactccaatggtttttttgccctcatttcttttcaacggaagcttgtgttttctctcatccattaaaaggatttaatggtgtcaaagacatctgtgcacttgcatatttgcccctactttgctaaggactttgtgattttgccgctattttaacatgactttgtgttttgaatgaattttcacatattcagttaaaaaaaaggagggcgagtacaagcttaacatgaagtttgccccttttgacatgaacttttacaactttaagtcctcttaatggaatgggcgcaggcacaagcttcaactaaaaatgatgataaaatcacaaagttaaaatggtaggggtaaaatcaccgctggagttaagaaacaagggataagaacacaattgcacccgacatcaaaatacggtaaaagtaaaaaggacatcaagaacacctatttaaccttggcctcctcttcgtagctgctttaaaacttatactctatttgtgcgggcctgtcattctgaaactgtagcaaccccttcatccttcaaatagatcattcaccatgccttccatgtccagtggatctctgccgcatttctcctgctctggatggtcctccatgtactttttgtatctagtaatgatcttattaatgatggtttctcgcaggctctgcctaagattcggaagcgggaccttccacagcttctgatgactgcatgttttctcaaattccaactcgaatcttgacagctccgaatgcgatgagagcttagggaagcacggtggcatcttatcgtgtaggcaagacagaacaggttcccaggaggcacgc

SEQ ID NO: 65878 - DNA, 1528 bp, Oryza sativa
ggtgggggggggggaactgaaatttggagattgtttgtattttgttctttttttgtgtgtgtgtgagagagatgtttgagtttgcttctgatggttcagcagcattggtggctttgttcacaacgtcttctctggcaagtccaagcagcacggcgaggagccgtctcatgtcgaggtaatctttgcttctgaattttctgcacatgatttccttgttaatttttggtctgccatgccttctatcttgtgttagtttcggggtaaatagccatatcatcaaacattacatgtgctgtttgatattcaaattttcattttgttctgttcttgatgtttgttcagagtgacaaggagttcagtaacagtaagctccctcctcatgacgacatgtaggagaatggtactgcaacaagtacttggggtggtatgatatgtgcataactctaaattgtttcttctcaaaagttcattcaaaatttatttatttatttatttgtcactctgatctgtctctgcattttcatgtcttgctcttccgatttacagtgttgatccgtggtgtcaactgtcaactgctcagcaggaagttggaaggaagcctatctactaaagcaagaaggttaacttgcataagcctgaaggtttaggaggatcatgctgtcaagctgaataattgtagcagtctagttcatgtcttagcttcctctaattatcacaatctggaacgagtgaaacttgcacaatcatatcactgtgatatttcaatttgcttgctactaaattgatgtgggtttttattcaggcatgattagaagacagtactagcatttcacaggattttaactacaataagtatctgattattttcagctcagctgtaaagagtcatcacaacatgaacatgattatctaccactgaggaacatataaccaaataacccatcagtaaaaaccagactgtgagcaatggctaactattaggaaaccagaaaagagagttttttttttaaataagagaaagataacaactgaatatcatgcactgctgacaagctcactgataataagcgtgttcatgttcatcgggactaaccattttttctatgtttattccaatttcactcctcaagaacttggagtaccactgagcagagagctttggctgccttggcaaactggggtcctcaaaatcgacatggtgcaggccgaatggcgaatgatatcctgcgaacagctcgaacacatccaggaatgaccacacaaagtaacccttcacattggctccattcctgcatcagcatatgcacaaacacccatatatatgttcagataaaatccagtgttcttttaaagtttctgaaaggaacataacttaccttagtgcagctaatgtgccgcccatgtagctactcaagtactccactctttcggtgtcattcagtgaatcctccttatcgaactgcccgaaacctaaaatttggtaaatagataaacactgtttttagaagataatttaaatcagtaaaga

SEQ ID NO: 65879 - DNA, 5789 bp, Oryza sativa
  unsure (1)..(5789): unsure at all n locations
ctatttacttgtgaaaaaggggtcatgtctctcgattcacaagtctcagattctcataggtgtaatatggcatacatggtaaaccagctttcaccgttaacttaaaacttattccctccatctcaaagtgaacttaatttgggacggagatagcagtacctctgaagtgtgcagccatatcagcattataatcccgaagtcctgccttttcgcggttcgatccatcgctaacatacaacgatttgtaatggtttataccaatgaaatcggcactcccacggatcaactcagattgttcttttgtgaaggatggaatccgggaaccggcttgcttcttcatgatttcagggtagtctccatacaccaaggggtccagtatcctaatcaggaatggtcaatttcaagtctcctcatcatctcattgcatataatcccccccaccccccaaaaaaaaaatctcattgcatatataacttttgtatgaaaaatctcatcgtatatataattgtatatggtcaatttttctttttaaacaaatttaagaagtaaaagaacgtaaaagaaacggatcactcaccaaccaatcgtgaagtccaatactctctgaactgcgtcaatgtctgcacagctgcgggagagcggatagggccagaagctgtagatgttcgtgccaacgacgcccttctgcttagcctgcaatcgttgacgcatgttggtaacaatagagcaatctgcacagatcttttcgagctatctttcagttctgaaaatctgaacagagttcagctgtgcgttcaggtcttcaaattccctaaattttaagtagcaaaaagtccaaatatccttctaaattttggatggaagttcatgtaatcatgagctttaaaatcggacatacaacctcttaaactttacataccgttcatattaccttctaacatggttttagatagtggttttgcatatttgggatcttaaaccagtggctttaaataactaatataatatatgtatcgtcaattgcaggttgtcaatttatacagtgatgtcatactattgttacgctggtacttttcttctaaatacgagcaaacaagaggtaaaagaaaagatttaagtgaaaattttaacatatgtgcaatgcgtatgttacatgataaaaactcagccaacttatatgcaaattaaataaaaacgactttataaaaccaacttagagggcattgaatggtattgtaaactttaaaagttgaatgtccaatttaaaacttcgggatgctagatagattttcaatcaaaatttaggagggttatttggacgtttttctttcaggtatagcggtaggatgtgtttcaggcaagtgatatctaaatttataaatttagtaaaatgaatgctcagatttggcaaaaaaaaatagctgttcaaaatttagcattttgaaaagttggtttaaattcagtagaaatttattcaaatttcaaaatttttccatcgtaagttccaaaattcagaaaatttcggtcccccatgaatgttcttaattacattccgaaatgtttttgctcactcgttcactcacctggtacttgtcccagtacagcctgacagcggaggcatgagccaagatggagttgtgtgcggcgaagtacggctccacggtggagtcgccggcggcgcagctggtcccgaacggcggcgagcagcggcacggcgggatgacaccgctgtcgtagccggcgatggacagcacgttgggctcgcccacggtggtccagtgcctcaccaggtcgccgaactccctgaagcacacgtccgcatacgccgtgaaatcctcactgcacaatttttttttctccaagttattacaatttcagagcctcagctcatcagagctgggtggtgatcatcatcggggggttgatcaaagatcgaagtgtatatcttacatgatccttgggctgagccagccattgtactcatcttgaagagcttgagggaaatcgaggtggtagagagtcacatgtatctcaatccccatagaacaatcacaaatttctcctttcttagggattgcgcaaaagatttgtgcaccttagagtttagcaggaaaccaccaagaatggattgagtgatatataaatatacgatattattctgtcgaacttttgaaattttatctatcaacaattctcgaaatattaagattgaaaaaaaaataaaagttgtatgcgtagatttttctttataagcactttagaatattataattttgttacaaattattcttatattctaatagaaaaatagatgtcaaagttacatactaaagacccaataaaatcaacaaagtctatatttaaatatggagctattacaatgtttcactaacaattttgctatatatttatcgacaaattttcccccaaaaatttgacagatgtaattacagcacaatcgtagtgtaattacactgtaactataatgtaaattgtatgtaactttcaaaaatctctccataacatgttatttcggtaaaatggaggttgtgggaacaaattctttcacatatatgtgtgctgtaattttttttgttcctcaccaaaacaaatcttgtaatagatctagcgattcaaaattacgtgaaacttacatataagttacactgtagttacatgcaaattacagtgtaattacactacgattgtactataattacatctgtcaaatttttaggagaaaatttgtcgacaaatatataggtggtcccttcactaacagctttaaaaaaacttcaagggcaccataatttctgaagaaaattggggagataatttgaattaaaaaataatttttgagcatactattccgttgttaatttatatgaactgaaaaaattatatatggtaaagatatgttgaagaaaaatcaagtaaaccagaaaattctgttttttctcttatgatcataaacagagggacttaaatcctaaaatccagtctgatatcacaaaaatcctagaaatacagcactatctgttcagagttaccccttttgactagcttatctatcaggtcattgtagtactcgagtcctttaggattgatgggtcctcttcctcctgtgtgatcatagaaaccatagattaaaagttaaaattacttaacagtaagggccagacgcatttttttgcaagttccccaagttaattgcggttagtatatattttcttactcggaataagcctagaccaagagatggagaacctgtaggcctccaatccagtatcactcatcaacttaacatcctcctgaaaaattcagatatatacttccaattagtatatattttgattagtactgcttggcaaaatttatttcaagcatacgattccgttgttacttctggctggtctctccatctttttaaatgtgcattaagcatatgtgagtgtgttgtaggcgctttgtgtgggtttaatgttaaaaacaaatatgcgagccattatcttattgaaaaagaaagagtcgattgatatccatatccaatactgctaggtaactacgcatctgattgggtcagagaattcatcaaatcccagaacaaacacacggcatttaaaattacaaactactccttccgtcttaaagtatattgttctagtattgaattagacataatcaacccctctatccagatttacccgtgccaaccaaattaaaacctaacaacattttgagcttatcgattgtgcatcaatgtgatgtgctgtacactgtgcatgccttctgcctaccttgtatttgtggtatccggcggcagcccgatcaccagtgctattgtccgccatcctccctgcaaatatcacaaccagatggtcggaaaatctcaaagatcgatgtagcgcactccctatgattccaaatagaggaggttttaggcttgtacataacaattaagaaaattgactcaaattatagttgccctaaattttaactaataggaaatgtaaaccattggcttgtgcgaggagaagcatttatttgagaagggtaaacatgaaagaaaatatgataaaaaaataactaaaagttctaaaacaacatagggaacctttgaaatggaggattgacaaaggattttggaggattcaattttcttaggatcctgtaggccactttgattcatatatatgaagaaagtatgaaattttgcatagaattgcattcctacaatcaattccatatgaaaataagtaagagaacaaaactcttgaaaactttactttggcttaattctttctttgatacttcgatgccttcgttttttctgttctcacgtttttcatatcttatgtttcaaagtgacctcatgctcaaaacgactttgaggagctacaattacctttatgtttgggaccatagaaaatataaactttctgttggacacatatatgaattttcttgatcatgtaacttactctcccatcccataaaagacagacctattacgggatacgacacattctaatagagtctatcattcgtattactaacatgtgccacatgccatattagatttgtttttttatgggagagaagagtagagattagtagctaggtagcttgatcatatatgcatggatgcaggtcctctgcagtactggatctcaattgtatatgcattcgctacatgaacttacaagtagtgatttaattagtaataatggatgaaattaagatcgattacctgaatgagtaaaagtgtcccagatgcttggggtccttccgtcttcaccggtagccccctcatactgtaataaaaaaaataggaagcaaaaactacatacatttatgcacagctaattaagaaccaaggctccaagcaataaaaacttttttttttttttacaaaaactcaatggttgactgatccaaagtcatgtacaattaaaacgatgagtatatccgcggtctcagaaaatcaattaatggcatatatagttatacactacgtacagtccgtctaaatctggattgggattcgatgacattgcgccggtgacattccccgtgacattgagtcactgacgtgtgggacccacgtggatccagacacatgtgggtcccacatgtcagtgactcaatgtcacgggggaatgttattgaatctgcgtccctaaatcctatatatatatgtaaatatatcatatatgaaaattaattaagcttcgtcatgttaatgtgtatactccctaattaacatacctggtaagcagatgtgccggcgccgaagacccccggggaaatcctgcctcgtgaagttgagagctgcctccgccgtcgcctcgccggcgacgagcaagagaagcagcagcagcagcagcagcaggagagagacgagcgaggaggtgcaggcagccatggcaaaggtatagtattaattacctcctctcactggtggagaaactatctttcgtcggccggccgatttccacaatagtcccgcatacaataaaaaccggggctaaagatgatctttagtcccggtttaaaagggtaacggacatatttgatctttagtcctggttggtaacaccaaccgggactaaagatcatctttagtcccggttcgaatgctgtcagggcatgtatatatgtcttcttcctcctccagctgcccgagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 65880 - DNA, 2429 bp, Oryza sativa
ttaaggtgatttatacgtgcatatgctctgcgtcccaaaatcaaaatttatctcaaaatataataacttatttatctatattttctttttttttttgactgaagaaggtagagcacgcctccaccttgcaatcatttcattaatagaaatgaggttttcaggttacaagttagaggttatagttaacctagaacagaaagggaaaaaaacgataaggaagaagagaagaaacaaaaacaaaaagaaaagagaactggggggggggggggtggatttacaaagatataaacaagggttcttatatgtggtactggtacaccaggattgaattttctgcctgtttgatttattggttctcatgctccaaagatcaagggtgtctcagacttgttgtgtgatgtgctgtaggttgtcaagctgaccttcaaacactctgttgttgcgggatttccatagcgtgtaggtgcaagcagcgaaccaaattggttctattccttttgaagaccgattgctatctatgattgcttgaagaaaagccgagcttgattctaagttgttggccaactgcagtaagtttagttttttcatctatattttcttacgacctttcatcatttaagtttcatatctatcttattttctcaaccaatcgtaacatttcctcatttagtttcatcaactttctactcgtgtccaattctaaaacttcttatatcacggacacattagtactttgcctttgcaaattgcacggttgtaacgtactccctttgtccaaaaaaaacccaacctcgtactagatcccatccttcgtcctatatcccaacctcgtactagatcccatccttcgtactatatcccatcctagtatgaggttgggtttttttggatggaactacgatgcgtcccatcctagtacgaggttagtttttttttttttttggatggaaggggtacgtgtttgttggtgccttggtgggtccaaaaaataataagacgcccctgggaaacatttttcaggcgcataacggtgtaacatgaggcaagaaggccagcttgctctgcatctctcagggcaatgtcactgcagaaaaatataccaacggatgtgggcatgtggcattctagacttgtactattattgttttccccagctgacaaccatatatcaggtcgttcgaacagctaatgcatagtatacacaatataagactaaaatgtactccatatctcagttcgcatttcatgtcaacaatcatagtcattaacatcaggtacctactgcataagtgcaaatgcagacttgagaatgtagaccatttcatacaagtaacattacagcaaacatcagcgatgctatctcatattagtatcaaagcagaccatgaatacaaagctgttgacttagcagttatatccgtgcaacaaaaatcacagcgagaccagaaggaccagacaaatccaccttcctgatcatctcttcttaaaaccatatttcttgcgctcatagaagagatcggtcttggcgcttccaaggttgacaatcttaggacatccatctcggtccttttcttgctgagtgcactccttgcagtagtaagcatctgagatgccaacccctccacagataacacaccttccctggaaggatccatagttgcactcatcacagacccgaacaagcgtacacgggcgcacgtaggagtcacagatgacacacttgccatcacatttctcacataaacgaccaatcgcaatgccaggctgcttcctgcacatgatgagatcaggatgatgctttgccatggctgtcaaatgctaacctgcagaaccataacagagtgcaaatatagattaatgctggtaataagtcagtcaggaataacaagcaatactgactacagactttcaagtgtataatttaataggcacatcaatcaaacagcacaatttctaaaaaaaaaaaaaaattcaagacacatggttgaacaaatgggttactgacttactggtactgctagaccacaaaggaaaatacatccatattgctattcagctattggtttaaagactcttatgatctctgcatgtaataccccaagagattacggactttccagtggaaaatttaacatgcacatcaattgatcggaacaatttaaagaaaaaaaatcaagacgcatggttgagcaaatgggttactaactcatggctcccatcggttgcccatttggccaaaatggcttatttggcttattagaaaattaaaattaatttataagtaaaacttttgtagatttgttcgtagcgacttaaaagccaacattaacaaaaattacgttaaaagcatttcaaaatcaacttcaaaatcaagttcaaaaattcaaattttagcttattctttggctgtttaggccaaacgatggggc

SEQ ID NO: 65881 - DNA, 14456 bp, Oryza sativa
gaaggaatttaagcacgcatctacagactgcagagtagagatgctaaattatcgaagcgctacagctcttacttctatagcgcatcagtgagcaggattcttggcacaatctctctaaaacccaacctaattcaaacatccaaaaatatatatataacgcacgaagcctcaatgcaaagatatttgccgcccgcatgccaagttcccctacccccgcccgcactaacacatcatcggaaggcagtgcggatctagggtttggtaccggtggcggtggtgctcggcgtcttcggctgggaacaacgggacgccgccgggatgaggcgaagatgccagcggcgcggtggcgtccggaggaggaagagaggatgggggagggaggtcgtgcgtacctggggatggagggagtggggacttggcgaagctgcgaggccgctcgccgccgccgccggggaaccgggggagagaggatgatgctgcggggaggaagaggcgaggcgaggcggccggcggcgaagaagaagtggggtttcgcggcggcgcgacctcgcgacgcgttgtgtcctttaattgctccgcgagaaggagagtgggggaatcgcgagggagcgagaggggtcccgaactcgcgacggtgagatttggactttggagacgaaggcccgattcctttactttttcctttctcggagctttgattgctactactatcctatcttcgttgatttttatcacatgtttagggctcctttaattcagaggaaattcataggaattttagaggattttattcctataggaatttttcctacaaaaccctttgaatcaaaggaataaaccctatgaaatcctatgaaattactatgaaatgcctcttcccatataagttttggaggaattttaacaagaggtagaacctcatggaagaaatcctttgagtctttatctcttctcaaattcctatgtttttcctgtggtccaatcaaacggtcatttctacgtttttcctgtgttttgcaatcctctattttatactttcagggcccctttgattcgtaggaaaagtgtaggaaatttgaaggatttcaatcctatgaaaaaaattcctatgaaagcctttgaaacaaaggattgaatcctatactatcctttaaaattcccatgtaatggctaatcctatagagattttggaggaaagttagcaagaggtccaacctcttagaaaaattcctttgagtctatctctctcatccgattcatgcgtttttcctgtggtccaatcaaacggttattcctgtgttttttctgtattttccaatcctctgttttacacctgcattcctgtcagaatcctacgtttttcctatttctccgttttatcattcctgcgattcaaaggggccctcattcatgtcagaatcctatgtttttcctattcctccgttttttcattcctgtgattcaaaggggcccttaaccattcgtcttattaaaaaaaattacgtaattataatttattttattgtgagttgttttatcgctcaaaatactttaagcatgatttatatctatacatttatataaattttttttgaataaaacgaatagtcaaacatatgttcaaaagtcaacggcgtcatctattaaaaaacggagggagtatattctaatgtaccaaaacagtttattagggagtaaaaattaatttttagataaaatttttatttatttgttcttatcgacttaaaagtcaatgtaaattatagcttttgctttgacttattaggccaaccgatgggactctcgaacaactgtccttttgtttttttttatataggccatcgttttgttctatttcttgtaaaaattgctaaatcttgtttacatttgtgttataacgttaagacagcaattttcagatttgttttgcaacctcattttaagatatagtgatttttatctatatatttggaccgacgggtttactacggtaagatttctttgattccaattacgaagactgcgaaataaccccacctccagattttcagatccaaactggtccatttctctagtttttaccagctcttatttggtaagggataggttgtcatgctgtaacctacggagaagaaaaacatcaatgattaatgagcaaacgagcatgcattggcatgaaacttgaacaaacaagtggcgtttcatctttcaaattataaacctaattcatcatcaatatgcctccatagggcaagaaaaatctacagaatgcggaatccaggactgcgaaagccagttgttccagtagctgaaagtgacctgaagcaatctactatacttccagaaataaataaataaaaacaaggaacagaactagacaagagtgatcttcatcactcttaagtgcaacaaggtaggaactgcacacttgtcagatgcacatgaagagataaaaagcaggcgattacagggacgtttgagaataaatcacagggtaagttgttggtgccagcaaattataagttgctagtaatcatggcaatcatatcagctgaattcacacgaccccaagcaaaagagtacagaacaattctgaattagttacgactttcatgattttcctcgaggtacagagcgcacgccatcttctctgatagtaatctcaaaccacagtagtacagtaatgcatacaccaattttcataggcaaaattttcttcccattagtgggagcaagaggaatacggtacacagtgaaagagaatcctaaacactcgtatgatactacttcagaggatggatgatgctcttgccaacaacatggtatctttcacatagctttttcagggtaccaaccgagtgttgcatcgtgttcagcttgatatccatgaacatggcctgcaaacataatatcttttcagttcacattttcaaaattcaagtatccattgattatgaactccattgagaagtaaaattgaacatagcacccaatgtaatttgaatactttcatataccttgtagtcatcaccatgcttctctattaatctgccaatataaatccgttgaacttttgtcagtggttccaaaggtgcagatttcccatcccgcctctgctttccaagtgcagatttcagatctacagtccaaagaaacttatgcatgagtttacaaagcgttgacgttctgctagtaagatcacaagcatattcttatgcaaaattctgtgtcataactaagtaacaaattaatgaatgataatagcataccttgaccactatgacaagcatgatcacatgaactgctaatcaaagaacatgcaaaactataccaattgaacttctaacatgttctactgccatatatcaacatgcccaaagaaagcataaaagaactataatgtgatcgcacagctggggtgagtatttcagtttaatactgcagatataaattagcaacagaaaagagaaaaagattatttaaaacaatgtctccaataattttcaggtctacatgaaaataaaacaggccactgacacttttgaaatggaaaggtggggaaaaactataatatcgtaacattgaaagaaaatgttaaaagcatctgttttccaatacattgcatgtttacacatataaagcaaattccgcccatgggacttgtattattatcttcagtggcgaccagtgtattattcacattctatttacagagtattatctttggtcaacatatcatcttaaacatttcttaagcaaatgctcataattcataaatacatgatactggcctgcttactctgggtaaacaatcaatagatatatttcagatcgaatgtgcatataatcagaaatcaatatggttcgattccaatcagcatactatggtgcttctttgattttcacaggtatggttttcttgtccacagactactggctgaattcaagatgatcccaacctgacatgacctgtaatttatccaaacattacatacatacactgccaataattttgcataccaattggtctatctctttttgatgctatgtcgatgtttaaagttgatcaagcattgctgtattgaagcatcacatcagccacagtgattatgcttgcccaaagctcagaactaatcagattagtaccaatttcttgccaaaatgctcaaaatcaaggatcccagagcatattagattcaaatgagcatgttttcgtaatggcctcatcatactgcgcgttttagccacttaaaaacaatcgttcaaagttcaaccgaaatcgaatatactccagcatcatatcccacaaaccatacccaaccacaaatatgatttaaacatgaagctatcagctttcacaaggcaggaacgagcgagtggaaaggggaaccgggggaggactgaccgtcggactcgaggtcgctgccggagtcgacgggctcgaactcgtcaacgggggcgcgcgccgcgtcgatgtcgggcgcctggagcggcgcgctctggacgaggcgcggcgtgccgcgggcgtgcgcgccgaggaggttcgggttcgcgacgaccccgaacgcggcgtagttcttcaccacgcttccctccgcgtcccagctcggcgcgtggccgccgccctcggccgcggcggcggcggcgagcgcctcgggcaggtcgaaggccggcttgaactcccgcggcttcttgcgcggcaggcccaccttcacctgggcgcgggagcgcttgagcttgcggcgcgatccccccatgctcctcctcctcctcctcgatagctagctagggtttggacgcgcgagccgagcggctagggttttgggtggagggagacgaaagaggaagaagaagaagaggagatctttaatgggcctccacgagaaaattatgaggcctggaggcccattaggttgtcttaggctttgggttaattggatccttgaaacttgacggggtattttaatttggacatcttttaaaatcatttttttcattcaaaaaagttgaaaggaatttaccattgcaaagacacaacttgtctctatccttcgaaaacgttacctattaagcccccaatgaataagaaaatatcgtgctctttccaaccactcattccgcgtatctcgtgtcccctctctctctctctccctcccgtctctctcccacgtaggtcctcagcagtcaacagcggagatagaggaccggcgtggcggttaacggtggtggaggggaggcagcaccggggaagatggacatagggagtcatctccctagtgtcggtggccctggcaaaaggacggcggagaagcggtgaagaggaggtccatctcctggtcgatggcagagctaatggcgatgcagaggggatggggccggcaggggtcgatgacggccgtggggtgggagggggcgtccttcctatgcagctccccagcaagaacttgcagatatcggcacgagtggaagctgcaggaagacaatgacccttacatagatccgtatgtggcatggctcctattcgtcggcgatgatggggtgacgaaagcttaggcaatagcagctacccgccttgggggagtagaaggcattgcaggatcctggtgtgaaagagaatagacaaattgtaaaactccaattgcacggctacaaatagactaataattgtaatgacatttatctgaataggcacatttgcaatgatacggtgttgcattttgctaataagtatattattccagaggaaacacctgtaatacgatgatgtagtcatgggatgtgcacaactttacataccaggatttaaatcctagtacttacgaatattacaaacatgtaactggacttttaacaagtttttagtgaggtccgggaaaagcctctgattttcgtctctttgagcgtatattaggagactcgtttgcatgtgtgtctacggtgtaagcgaaaaaaaatattataccaaaataatatggagttattttaagaccaaatcaaaacagtggctttgtgagcgcacagacttgtgtgcctataaattttctcaaggaaaaaacagcactaacttttgaaagcacaaataacttataccaaactagccaagcgcccgtaagttgcaacggaacagaactgctacgaatgcataaagacaaaattctccaaatttgcttataatcacattccatgacttcatctaaacaaacttgatcgaagctacgctttggcagttggcacacgtctttctcaccactcccatccaccaaatatgcttatatgcccgtcagctctagctctgcaccctgtttatgctccattgtgccttgtcctattctgtttttgcaactggtcatcataaaggcaacaaaaaaaagtcatggaaaatattagagttataaaatgtggaaattgctcaaatttattatttgatatttgggatgctttgaaagtgaggtgcaaaattatttgtgagggagaaagactaaggaaaatctccataggattttattcctacaaaattcctccattttaagtttattccaaatgagcccttaacaaaaggaaccgactataaagcttataattttagggcaataaaattataatactacctgcactttaatcttagaagggagaagacaccattaccacaactagaaaggtagcccgcgcattcgcacaggcatgcgtcatacgttaagtttgagacacttataagagcgaaatattaaacggagaatatctgtcacgatttctccataaattattttcgtcggcattaattgcttttataattttctaacctattagctttatattatatcatatttaagtaatatctataagcaattatatataatctactttatcatttgaaaagaaggtagacttattttctttagaaaacatgtcaacgaaagtaaaagtaagtgtaaagcaaaagtaaggcgtttttcgttttttagttgcatatatattatcatatttgacctacttttttctttctgtgtagaatgtctgatttagttatgaatgtttgcaaaacaatatatgatggtgcaatgtatgttgttgaattatttttatagtttcttatggtaatgtgaatgacatgtaaaatggaagggatggtgtccatcggtaaaaacataaacatgaatttatcatttttgtttggatactattgatttaatttagttatacatatttctatattgatgtataatgacgaaatatacgttgatattatcttaagtatttcatggctatttggttgacgtgcaaagtacacggtcgagtatgcccagatgccatatatttatatagtaaaatgttagcatatagatcttcagttgttcgtttaattagaaataaagtaataatcagattagaaattatacgtgtagcttaaaatcatagtccttttaatatctacaattattgattgtttttatttttagtttaatagctgaaaataaaaaaagaagacttgagaggaatgaaaagcatagagctttaagacagagatgggaggaggtgggcagtgtcgtagtgttgtgtgaatgtgatgtgggtctgaggtggaggggacattatttttctaatctttctgaatgatccaagtgaaaaaaatatttttttctcatatttctaagtttttctttgatatttatgacatgtcatgttgcggcttatattttctcaaagagaaagaagatctaatgtttaaaaataattggtcatcgatttatattgaaactaatggatagatgttttttctttgaatttctatttttttccaacttttaaaatgtgacacgtgatgacttacaaaacgctatagaggaagtttaattgatctttatattgtaaaacgatctagatgacatagtatatattgacttttttaattgagtgtggctatgtaagtacattacgtgcttactccaggataagaggtggggttttacatgaggatgatgtgtgtctaattaatctaatataacggtttataaggttggactcaccgatttaattgaaaatcgagggatggatgttttgctttttctcaaattttgtacaattttctttagtttattagatctaatccaatggtgtaaaataacgggttcaccaatttaagtgaaaatcgacgatgagattaaatattgccacatggtggtctaggagcgtttgtatgagtgccacgtggcggcttaagagcgtttctaggaagtttaatggacttttaatatataatataatagaaagaatagaatagatagatagataatcaatcacattgcgagctttccattgaactacaagtctaaaattatcttgacaacacaggaatatatagcttcttcactcttcagtccttccactgtctatgaaaatttccaaccaaaggccgagacgtttgatcaaaatcttcacttttccatgtgccgcagaaccagaacagagaagcaagaagggcttaactctaaagatgacaaattattgctacacagaaaacaaatggattctaagtagtatagtagtacatatttgcacacaatagctaaaattcatatccgcattgtcatcaacagcataaaaaaatgtcaactactggagagaaaaccagagtaaaactaaataattcattacagaagacaagcaaagtgtgtataaatatagcatcagttacgcaaaccatttgatacaccatggtcctgaataaagtgaagatgtgagcaagcatcagttcatctgctggtaagagaagtagagaactcatacatgtatgcacgttgaaccatcactctatttaaaaaccaatcaggaaagtactggtgaattgtgaagtcagcattaaaaattaacacatcatgctgtcaatgggtaccgtcgaagaacgagcagaaactaaaaggctaaatatgaacatagggatactgaaaaaactgtttcactaaaaggataacatacttgccattggttcatcatacactcggtatcataacttcaatttgactaccaacatgcttgtagggcttactgaagtcatcttaaagtaatatcagcagtattttgttccaaaattatggtaaacaatgtgaaatagaagataatttgactaccaaggcggcaacaatatgcacttttgtgatacacaaatactaatatacgcctcaaagccacctgtgtagtagacttcttctgtatcactctttcagctcacctaagaagcagaaagacaaaaacacaaaactgagtaatggtcgaggagttgccacgaaattagtgcaattgaaaatcaaaagaagaacagcagctctgagcatttcatagaatcgagatgtaatatgtaaacaagttagaggttgcattacttcatagataggataagtcaaggtgacggaaccagagtaccagactgccagagctctgtacatactatactggcagtcagtgagctgagctacaccctacaacagatactatcagcccatctcatctcagagtactactagagatgagatcaaaagaaactaccctaacttaatgcggttcaggcattgttcctttgttactgtctgctggttttcctggctctttggtagctccagaatctctccatccactgccttcaaccatcttggccaaccgctgctccatggagtcgacaacttgagagatcagggagtggaactcaggcccctgcgagcggacaaactgacgggtatccatacccgacggctcgcgcaggccctcaatgcccctttctcgacacagcaatgccgcaatcccaaccgtcaggctgctcctggctagactcaagctatggctgtgagacacagggccgaggagagacacgagggctgtcatctgcttaatgctcttctccagagagtcagccgcattgggtggggggtccagtattgtgcccagcctagcgaatgaagctcccatgcgcatggcaaggctgttcatggcagtaatggcggtcgctcggtctgattgtgcctctagcatggcagcctgggtctctttcaacattgcattggtcacctcaagctcatcctcagtgctacacagcttcttggacagctcctccacctgctgctcaagccctgagatttgggtcaccaaagcagcagtttgtccacgtatttgtagagggacttcatcatggaggccggcagctatagaggtggcctgcacaagaaggataattgcatgtgacttgcttcctaggataggcaagccagaaggattcttaggaagatcacctgaacaaggaatgaggtgattttagacaaacgactctgcaggactcctggctctgagacaccttccattagctctttgactttctcattgacaaaagttctcgcaagttgtattgcatccttgtcttgaacaaggggaattgactggagaggcttgccagggccttcactatccacagtgatcacttcattatccctcaaatcttcaacaggcaggtcctgtacatcagctactgccatcttcaccacagaatctccctcataaaaaggagaattttcaaaactcagcaaggaaactaaatatgattaacacaaaagcaacagaaccggcaaacctaaacataccagtcttagatagaaccacacccggagagtactcccctttcccataatcatcctgctgaagcgtagctttcgtgctgtcaggggtcaagcagccaagaccatctgaatctgcaggctccacatatcatgaaggtcatttcacaaaaaaagaatgcccatctgacaaagatacagcttttcaactcaacaagtgacaaaggcatattttgacctgagctggtaacagcaaggttaatccccatccaacaaagatgcaacttttcaacttagcaagtgacacaacacaaaagcatatttgaacccgagcttctaacagcaagattaatcgatccgcctcatttattatcctctcatttcactcaaattttgaagaaaaatgatatcagcacaggaaaatgctataaatgttagttacccgattgatagcaataaaaaataatgagctactggaacaaataatctgtatgtgcattgtagattgaggttgaagcaaaaggtcaccactactatagtttaggtttccaagcaagggctctgtacagtaatctgcatacatctctaggcatttcgagcaatttctcagtactgatctcagtagctcagggtccttaccatcagagtcaaggtcgctgccagggccacagccgcatgaaccatggaggccaggattaccagacacgaaaagaggagttccctgcggcacatctcacattttcacacctcagctcagaggtgggggcgggggcaagtggaagcaccagacggtcagagtcctttggagttttgggcagcagccccacatccaacttgttgtgcgagcactcgtgcttgtgccccagctgccctattcgcactaggttttgggggcagggagacgacgagaaggacatttctttgctttagtaaatttcactttgagccacctttactgacttgtgaaactttggttaataaaggtgagcaatgtgaaatttactgtcttttttttttgcctgatagaattggttctaaacttacagtgttaaatggaccatggacctgactagaagtaaaaactagcttttctagtggttgaaaatattggtagtagttgaaacatactacctccgttttttttaatagatgacgccgctgattttaaggcacatgtttgaccattcatcttattcaaaaaatttacgtaattactacctctgatttttaatagatgagttgactttttatcacacgtttgaccattcgttttattaaaaaaaagtacgtaattactacctccgtttttactagatgacaacgttgactttttatcatacgtttgacaaacttttgaataagacgaatggtcaaacatgtgttcaaaaatcaacaacgtcatctattaaaaaaggatagaatataatttattttgttgtgagttgttttatcacgcaaagtactttaagcatgatttatatcttataaatttgcaaaaaacttttgaataggacgaatggtcaaatgtgtgttaaaaaacaacgtcatctattaaaaaaggatggaatataatttattttgttgtgagttgttttatcattaaaagtactttaagcatgatctatatgttatgcatttgcaaataattttttaataagatgactgattgtgtccgaaatcaatggcgtcatctattaaaaactggagggggtataatgtactagctctcttttttcctaatctttctttttttttgcaaagtttttttttctaatctgaaatctccttttcttgctgtctatccagattaaccacgtcataccaataacaccacagtatcaaaagcgttgccgctcgatctttatacagcaaccatacattaaaaaaaaaagtgaggaatcggcatacatcgaagcaaaggggggagacggcgtgaggggcctataaccttccgtctcgaggtcgctgccgggggcgacggggccgcgatcgctcgaagccgaggatttcctcgccgcgggtctcaccacgtcacgccttggcttggcggtcgtcgtggcggcggcgagcggtgccaatggccgctcggtgctcctcggcttcttcggcggcggcgcgtccaccttgccgtgcgagccctcgtgcttgcgcacctgccgccccattcgcgctctagggttttgtggcggggggaaaggccgaggaggactggaggaggacactactccatttttgtgttcttttaacttttttttcgagtttggggagactttggagacgaggacgagccggcctgtcggggaaatcgaggcaagccgccgggcccacctgtaagtgataggaggctcgctaaggccatcagcaatgggtaaccccaggtcttgccactagcgacggccgttcgcttttccgtccgccctgttcccccgtgatggagcgcgtccctctgctgggggtgctagggggcgcggctctctacacgttcgccggtttttcgtggggagtcgtaggcaggcgacacgttgggggcttggggcgctcgtggacacgactaccgcacctgcgatttcccattctaccctcgatctcgttgctagaaggagggcgacggcggtggggaggaacccgaggcggcggcgcgagagagagacgccgacaagagagacaggaggcgtcaccagagctgcgagaagggaggcggcgtcaagagagagaggagagagaggcgatggcgacgacaaccggatctggcggagaagcaaccgcaccgcaccgccgccgccatcgccactgcttgaggcgcccgtgctcgccaccgaggagcacgcggacaacttcgtggtggtggtcgctgccgtcggccaccgggcagagacgggcagcggcgagcgtccgtcgcgaccttctccacctctatcttggactcctccgcacggagagagaggcgagcagcggcaggagagagaggagaaagtggcggcggcggcggctgggaagggcgaggagggaggtggcactggtgctcgcgagatagagagggagagggagggggaggacgacgacggcgccgagcggagggagtgaaacccggcgaagaaaaaagaagaggaggggaaagaggcggagaaaaaagaggagagggaaagagagatagggagaagagaggggtagtataggaaaacacacactgtgggttttttggttgagacacccattgtgggcttgagtactttcatccagttgcctcatggggagcccatctagggtgtcctccattgcgaagggagtttcccagagagtaccctcagtagagtgtccctgattgtagatgtcctaaccgatgctgacacatcctatactatgaatgtagactgaggccttgtttagttcgcgaaaagaaaatttttgggtgtcacatagggtgtttgaccagatgtcggaatgtgtttttggacaggaatgacaaaactaatttcataactcgccaagaaacgtgagatgaatttattaagcttaattaatccatcattaacacatgtgggttactgtagcactttatggctaatcatggactaattagactcaaaagattcgtctcgtgattttcatgcaaactgttgaattagttttttattttatctatatttaatgcttcatgcatgtaactaaagatttgatgtgacgtatttgggaaaaaaaattgagaactaaacaaggcctgagtacaaatatccaaattattagtactaggatgtgtcctatccacccaatcaacccaaaatcccttatattttgggacggagggtgcatactttaggcctggtttagttccccaaaattttttcccataaacatcatatc

SEQ ID NO: 65882 - DNA, 5334 bp, Oryza sativa
atatagattaaaaaatcaaattgcatagttagggggaaatagcgagaagaatcttttgagcctaattagttcatgattagccataagtgctacattaacccacatgtgctaatgatggattaattaagctcaaaagattcgtctcgcggtttccaagcgagttatgaaattagtctttttattcgtgtccgaaaaccccttccaacatccgatcaaatatactatataacataccaaaaattttcttttcgcgaactaaacaggctcttagtattgatggtgtccattcccacatcactcactgacatgtcacatgtgggccgcataacctgtgctagtattacatcatctttcaatgaatcatctcactgtttcaccattggttctccccaaattttaaaatcaactacttgttcaataaataaaataatagtattatttcaactaaataagtgtttattaattgatttaataagataaaaacttaatttgttttctgttgcaactcatgggcactaggctagttaaaacaaagcacgtgatagtgtgtcgtttcgtattggtagattagtaaaaaagattataagtctacagtcttgaaaaaccataccaaagaaaatgaaaaaaaaacagccacatcatacgtctatgaccaaatcccgcatttcaagattaagtcatgtttgtttcagcttaatattattgtaatctagattattaaatcagattactctaagctggattataataagctgacataaaataagctatgagttgtttatttctctggattattagaggcatccaaatgtagtgggtctttagccactcaataatctggaaaaagctcctctagaggagattattggattatagtaatctggcttatagattataataatctatttgtttgtttcagcttactcctaataatccagattataataatcctaagctgaatcaaacagcgcctaaattagatcgcatccctaagggatgagagtgtctctgcacacccgccctaacgtgctaggatgtaattttcatctaaagatacctatcggagagaacaaaaaagttcacgcaacaatgccctaagaggaaagtaggggtcgtaggcatcgccgttgccaaccgcccaacccaaagggctaggctttcacctataatctttttgccatcccgtatcaaggtcacctactagaaacagtggccaccaccgacagtataccttcaatgcgctttcaccactccagtgtctcgccgtcgaccggcccaagcaagagctcaacatttggtgcgctccaaattcatccacacagttgggttgcagaggaagagaatgagagagaaggatagaacctctcgcttgcactagcccacaaacttggctatcttgtgccggcaaggtgccgctgcaagaggactaatgactagatcggaggccgccgcaggcaaccgatgctgcttctgtatgttttctttagctgcaaaagtacgtattctatcaaaggaagcgtaaagtgcaagctgaaactaatgcacacttccgaagcccataaacggattatcacaaaataaaataatccattcagctgaaaagaagtaggcgattgaatcgacgtcacaaaaagacaaattaaactataacaaaaaaataatcttgctggaataagtgaatgttcctactaactgaaatccatgttatagcagaacaaccataactgatactaaccattaacagggccaatctttacttcgtctcactcttaccatgcgttgccagtgtagaatttcctgagtacaaaaccacaaatgaacgaaaatttgaacttgtgttgtcagtgtagaatttcctgaatacaaaaccacaaataagcgaaaatatggagtttgcttaacaaatacaactggttctttacattacaggtaatttggtgacatgtttacaaaaaaaaaaaattgtgcaattacagtgcaaggtatatatttagagacgtgccaagtcctctaagttacatattaacatttcaccaggtttagccacatcagatgccatgtatgttttcactcttctactaagggtagaactcaacgacgtaaaatagatgagacaaaattggaactatgatacaattgtgttacgtatttcaagagtggtgccggagcgatattgtccaaatcaggtcagaatctgaagtgatcgtaacaacagtactctcctctctcacaatgtttgatgtgctaataagtccaccaaagctcatgctggtattatctggagatgaaatttacagatttttaggcaccaattatttgtcgatgtcgaattgatgaagtgggaggcttacctaaattccattgaagcccagtggttgtggtggtggccgaaggcgcgccgatgggaatcaatccacagtggggcccctcaatagaccgttcaatatggatgttatgagtgtgtgttcttggcagcagaaagatcaagcaatcatccgataggagtatgatcctgttgtttgggaagagatgaagtacgttgatgtttcccatctcgtggtcaaaccttcccccaagggccccaagagcaaagatacacagctgcagttaaaagacaaatatggcagtaaattttgtgaagatggtgggtaatgacaccacgttatcgagcttaagaagtttacattagatttgttggggatggccgaattctcagtgataaaagctacacatttgtgtaaatcggtggtgtcctgatcatgtgactcatcgactatttgagtaccctgcaattttcacaagaaaaacaattgtttcatcagataagcatgagaaaggaatatttttgtttgaagtcctataccaagatacttcatgccatctgatgaccgaagcatgaaacatatcaatatgaatatttgcaaaaatagatactaccgtggcaatgtgagctatatcctatagaagataccagcagctgtctatattagacataagaatgaaactaaatgttcttaagtaatctaagacaactcttaacactgttcttttgttcctaccagaaaaactattctgagacagagaatataccagcttgaatgctcatacggcatgtaattactttatcactttctgtaaaaacgcaaaatgccatgatgtgcccattaaaaataatctggaatatgacttccatttagttcagttgtgtcagtcattggttttaaataagctgtcatagtcatttggtttttctttctcattgctacaatagatactctgtttgttaggcttctgactgggcaatactaaccattctagtgcacgccatggtttgaaactgtcttattttgttctgattaaaaacaaaacatgtgccaagaagaagcagtagcaccatagtagtgaggctcatgaaattccaagagaacataaaaattaactagcaagaatagttgaaaataatattactagataatatggctgaaataatcatactgttttgactaacgaaaactggatggaacatattaaagaagtttatgaattagagtaatatcctgttattgctggttatacttgagtccatatcccaaactagttacatctggttttaattaaccgtgactaaatggaaaatattgaattactttaccatattggaataatattccttcacttctggtcgaactgagtccagatctcctttgattacatctggtttgtatctgcaccaaaacacttgtgaattttacatgagaaatctttttgtaaaaaaaggcaaacccaaaatacttcgatatttgtttccgattatcagccattaagatcatctgaaatatgtgaccatctctcaaactctgattccgcataagcaatttggaacataagacggattcttgttcaacctttgtctgtgcggatataataaacttgagaaaattcgatccatagcacaagaaagaaagcggtaccaaaaaatagcacaaaaagtttccacttttgatccatagcataggtcaccgatttttcttcgccccgtagcacttccgtcacattttgaagtaacggcgttagatcggagtggagaaaattttcgtcggactcatttgcccttcgttccccatcaggtctcctctttcgctccctcatggacggcggcgcggcagccatcgggcgaccgcctcgtctccccgccgccgctgagcgagctgctgcgcatgctcttcaacggcgtggacgcgtagctcgccgtcaccgctgacggagaggtggacaccgacagctgcgccacaccagccgagcctcgcgggcccctcgaacagccgcctcagcgccgccgtctgcagcatgcccagctctgccatgcacgtgcggatgtggtcgtcgctgccgtagagcgccgggtactggtcgatttcacccgtcctgccgtagaactcgtacaccggcttgtccagccacaggaacccgcgcatcagcgccggccaccaccatgttctgatgtactccctccggctcttccagagctccgacgaggcaccaatgccgaacacaatatggcccagcccgatcgacgcggcatcatcagctggcatcggtttcagccgtgccaccggcagcgacgaggcgttgcgcctgttgccagcatggccggcggccgtgagatgtgcaacggcaccactgccaaggctctcctccaggcatgagctacccgagtagaaaggggacacggcgagggcaacgacgtacagggcgagcaccaggaggagcaagtagaggaggctgcagaggaagaaggaagccttgcacttgggcgccatgctaggggcaaattagtattttgaactccttagtcacggctaaacactccatcacaactccaaacctgacggaagtgctacggggcaaagaaaaaccggtggcctgtgctatagatcgaaagtgaaaattttttgtgctattttttggtaccgttgtttttcctgtgctatgattcgaattttctcaataaacttggtataaaagcttctcatagctcaaggatattcatacataatatgacaataaataataaatagggtaatgcatcaaccactagttctgaaaccactgcacctcaaccagtaagtggaagttctaacatactagaataaccacttgccggtaacagttgtattaggaaaaaaggcctttggtgtacccaatagccattaagatgggattaggctacctataaccccccaatctcagcaccagcataagcagtttaccgaataggccatccgatgggagccacaattagaaaggcagcttgatcctacgactgaattctca

SEQ ID NO: 65883 - DNA, 6163 bp, Oryza sativa
ttttaaattttatcccataagtcattttgttgtaaatgctcacctctatttattcatgttgcaaaaaccatccagtctgcacgtgcttaacaaaattaatatattttcataaatcgtgaaccatcaatttggtatttaccaaaattaaatacttctagagtatagttttgagaactttgttttaggttccagaaataaaattgcttatgagagcttaaacgttgttgcactgatatgcacaaataaattcaatgaaacatgaagaataattttaatgcaaacacttcgacgagattgactcagctaggttagcctgtgatggctctacatcagtgataagggaatgatttggttaatcacgtggatcctgggacacttttcacatacttgcaacaaattaaataacttatgagatgaatgtcaaacttcaaatgacttatgatgtggttttacatttatcccttaccaaaatttagacacagtttggttttgattactgaatggattattatcgcatattatttacttattttactaagactgagtttaaaagtgagtttatatatacatttctcaacagctaaacgatacaaattttacaaatagtttttgtataagtttctttaagaaaattaaacaaactcatttccgaagtttgtccctagtacttaactaattatgagcaatgactcaattgttttgtgtggaactgaaatctacgccacacttcaacttcaaacttacataagtaatcatgtatatgtaatgtacttttttaacattacatatggatcatcttaacattttgcagcagaaattgtgtatgcaaggcggttccttttcatccaataataaaataaagaaattcaagctttatttttatttccagtaagactaaaattggagaaaaaaagacaacatattatggcgtacgaccagagtacaataatgcacatggaataattccaggtacaaccaaagcaaaccagtacacacggaattatgatgaagcaaagaaataaagaagaaatatacaagcttatagttgagtcaaatatataatcataaatatgcaattcttccatatagttccaaccagaagtacattgttatatgtgtcccttaatccccttttatgactttttcctatagaatccacaatgatgtatgacattaatgcgatatatatgtctaaagaaggggggccttttaagatcatgtgccactaaacatggatacaccctcaagcacataaggaacccagcatgcatatggataggactaccaagttcgaaccggagatgaccaagactgctcagatgtttcctaccatgatatccagacataagcctacatcagcctcatcaagttgatatcttgagtaaccccacaatcctccatggaccgcatcacaaaattcccatctctcctgattaggtgaatatgcaatattagagttccattcacatacttgtactcggtgtgatctccaaggcaatacctacaaggagtcaacggtattatgatgggtttagcggtgttggacttgaagttgtaataaatgaaggataaagttagagtcgaactttgtcatacgctttatcttaaatagagaggggggcaccacattgtacaatggtgactgcaatgtagcgtagacaagcaaggaaatgatggtggcgaggccatgaactcgtagcggctaggtgatatattgattagggagaagtgcccatgaaaagagtctcaaagatgtaggtttcgactgaacttcgttaacaaatattgtgtgttcctgtgtcgtcatctggcgtatcttgggtgatcaataaccgaggagatcgagaaggttagtcactatttcgctatatcgactaacttttataataagtggtattagagccgaaagtttcagaattgtggaagaggaaacacgaggtgagatcatgcattgataagagatcatcaaccgtggcgatgagatcgattgcgacaacgagaacgttgtggaggcaacgacctcccttgcgattagaccggcgatggtggaacgtggccgaaagatggggtcgggtgtggctaaaagcaaccagagagatcggatgggtagcgccatggacgacgtgcccaacacacacggtggtcgtagatccgtagcagcagggaggctatagcagaagggcgaagccggcgagcgtggtgaggcacagtggacttgcagggcctgaggacgacgtgatcgtggatggtgaacacaagcgttatgactgcagtgagtgcggaaacacaaacaacacatatggagaatgtgctatacacacgcaggatgagcaaggcacaaaatggcagttgacaacaaacaacgtcgtgtagcacaagcagaaggcagaccatatgagatcgaaatcggggcaatgttggactcatgagcatgaacgcaagtccgaggtggacttgtccatgcagtggccgggctcgagttggaagttgttttcagactcacaaggcaacaactattctgaaggatgagcaaagagtgcacgagaatggtctagacttgttgacgcaagggtcaaggaggatgtggatgcgtttgagagcatcacaaagagaagaaaataatctcttttttttcaggtatattttccaaactgttaaacagaaggagcattaactgcatgcacatgtgcaagtgcatggtgttgtgtagtggtgcatgcatatgaggcttggcaaaactacgacgttggttcacgagtaggactagcacagctagttgagttggattaaagtcaatatgagcagtggactaataagtatttggtggcatggacttgggtgcacttggcgactcgatcgtgtggaagatgcagcatggtaaaggagaggttccgcgaattgagccgtcttgcagcgtagaggcagatggtggcatatggtgtaggcaaggcagttgcttgaattggactcagggcatagccaggatgcataggtactcggacatggctaggtggatactcgatcggttgatagcttgatggaaatgatatatgcctaaacattgaaatcattcgttgtttgttattacagtgtacactactacagaatggcatattggtgtcggttgggaaccggtcttagctgccggatttcccaaccggcaccctataggcggcatagatgtgggggaatcaaaggggcacctttgaggttccaggattggaaaaaaggtcggctcgaatgcatcgagccgattcgagccgacactgattccatcaagaacacacatgaacaaaactttcaaccaagaacacacacgaacacacatgaacctccgctacctccatgccatgcaccgcgcgcgcgcgcgcgcacacacacagagagagatagatagatagagagaaagaggtggcgccgtcgccccttcaatctccgccgggcaacagctgcctccatgtcgccagatctagcggaggcgaggcccggccggccgcctccacgccgtccgggccgccgccccctcccgcccccgctgagccgtagccgcctccacgctgctagatctggcagaggcgaggtccggcccgccgcctccatgtcgtccgccgccgctggacctcctctctcgtccgaactggcggaggggaggttcgggccaccgcctccacaccgtccgccgccgccgccaccgcacctcccctcccaccaccaccggagagagagagagaggagaggagaagccaatagaaggggagaagtggatagagagagagaggagaggagaagccaagagaagagaggaggggagaagccgagctcggccttatctcctgcaggtgtgggtgtgggccccaccgggaggaaaaatatctcccttggctggctcggctcgattttatcggtggcacctataatatatggtaggtgccgttttttttaaaaacgacacctataatatattataggtgtcatttttttttaaaaaaaagcgtcacctattatagatgccggtttttctctaaaaccgacacctatctccgtttaaaggtgtcggttttaatttttttttttcatcttatgaaggtgggaaaagcactataggtgtcggttttaccacttccggcacatatagtgccgacatctatttgatgttttgtagtagtgatgtattagtgatttcctttcgtagatttctaaaatcgagatctttgatatcaccaaacaaattctttttatttggttttcatctggaattcttgtttactcccttcttttttaattataattcaagccttttttactcaaggattaagaatggtgtgaaactaagagaaaaggaaagaaaaatgaccatggcatcgctatatatttaaataaatcatttctaaatatagctaagagattatgctccacattaaagtagatcagcataagttctaaatatagctactacatttatcccaaaatttagtaatatttagttatatatctagtcatagctatgtatttggacttatgtatgtctagatacataccctaaagttattatagttcaggacagagagagtaagagattatgctccacattaaagtatatcacattttccgaaagaccaggaaacaagggcagctaagataagaaggtaataagaatagcttatctagacagtatatgtagtaaaagcatacattgatgtattgcctaaacatattttgaggatacaaatcaatgcaaaagattaggatatcataacaatcctttgagatctctatatatatcagtttgcgtgagcacttcttgcttacaacgaaacataggaagatacatacaaagtagaagaaaaatggcatcgatgtcctacttcatcgttgctatgctcatatccaattgcttgggtttcattgcaacaccaattgctcaagttgtaggtagcagttcctcctcgggtgttggtggtcgaaaagttttatctgcgggaggtttgcaccaaatctaccaccatggaggtactgttccaggttcgagtgaccccctaggtcctccaagtgatgagatatatcatcatggtggtaccgtcccaggtccgagtgaccccttatgtcctacgagtgatgagatatatcgccatggtggtggccaccatactaccccgggcccgagtgaccccattggtgatcctccaattgatgagatatatggtcatggaggtggccaccacactgcaccgggcccgagtgaccccatagatcctcctccaagtgatgagatatataaccgtggtggtcatcacactgctccgggcccgagtgaccccatagatcccataggccctcctccaagtgatgagatatataaccatggtggtcatcacactgctccgggcccgagtaaccccatagatcccataggccctcatccaagtgatgagatatataaccgtggtggtcatcacactgctccgggcccaagtaaccccatagatcccataggccctcctccaagtgatgagatatataaccgtggtggtcatcacactactccgggcccgagtgaccccatagatcctataggccctcctccaaatgatgagatatataaccgtggtggtcatcacactgctccgggcccgagtaaccccatagatcccataggccctcctccaagtgatatataaccgtggtggtcatcatactgctccaggcccaagtgaccccataggtcctcctccaagtggtgtaatatcatagtacctgattagacattcctcatatattagagatgtacaacactgtttttcagattcggactattgtaaccgtgcatctccaactcatgccgaaataataaagcatatcttcgttttcaattttctcttgatgttctactgtttcctccctataagagtgactacttgtatattctacttggttcctgctttatacacatgatatatattttcttcttcgatgtattatctattgtatttcagatatgctaatacaaagtgaaagcattaatatattatttttatttatattttagcataaagccaatatcagtgtcaacacaacagctgacttcattcgcatagtatttcttatgatattagttggggtaacacctttatgatcaaattgtcttgtactcacggtgcaaacg

SEQ ID NO: 65884 - DNA, 21808 bp, Oryza sativa
  unsure (1)..(21808): unsure at all n locations
gttgaaggacggtggtgggccggcgttggtggcgggggcatctccccattgacggctcgaggaggaaggaggggggagggggaggaggctaccagctaggggggcctcgccgacgctgttgacgccctccggccagccggcgaggcgggtggcggcaggggatcgggcggtggcgacgtgcgagggtagcggcggcggcggaatgcgcaaagaggtggggaatgggagaaaaaaagttagggttaaagctgtgtacgaatcctaaaacatatctaacggtccaaaatttaaaagatgagaggtgggattgtctgtcatgtatagacagtcccaataaatattccagtatctcgggactagattggtggtctggagattttcatagaaaaatacctggcactgagatcgtagcagggtagtattgtttctcgagctccagcagtaggttgttttttcttttcatatgtacaatatgctctgtagcaggctattatttatttttccaacattaatcggtgttatttgtcctaaatctctcccactagtttaattttgtttcgcaagaattcgcaacatccgttgtgaaaatatcaaaagaacgaggctttgcccatggataagattatatcagatttttcctcccaaagacatctgttcacaatcaagttctgcttatctctgtatttctcccgattaaccaagtcatgttctatatgtgctctggaggccggagctattgttaaaatgattctcgactccctcgctttatggattgtctatttcagtcagtccttaaataaaattcagttcacatgttcaatccgtcttgaatatattgtgttagcatgccgaaatgtagatgatgattttcgctaagagacttctggatgggagcaaatccctcacgcatggaaaacagggcgatctattaacacgtaattaagtaagtatgagcaaattattttttaaaaaatagatcaatatgattttttttaataactttcgtatagatactttttgcataaaacacaccgtttagtggtttgaaaagcgtgcgcacggaatatgaggggagaagttgggaacctgtacgtgttgccgaacacacccttaatgatgagttgatcatatgggtccgtgaaaattacatcatacagttctcaggtttgttactcagagtttctgcagatgttccgtttggagcctgctggacagagcttcctggtgcagattatgttttgtttgaatttggtcaataagagttataatttgaaattttggattgaccagtgttttcaatgcaaatccggttcgatttgagaattaggatacatcaaattgttatatatgttttccttttcttcccctttctgttctgaaaacaaagggaaattgcaagactgccagtatcggaatgactgaggctttgctttgcttttcagggctacatgtgccgaatagcttgttaggattggcagtaaccaaacaactaatcgggtcataaacacaaaccattgtcggttatacgccctcatatgttcagaaaatcttcataacattgattgaattgcaaatgtgcagaagctagactaaactcttccactatcttaaaaatatatgaaatgcaagtaagtagtaaatatcactactcccttcatctatttttaatagttatgttttcaaatctgaaaaatttatttgtgatagtcatatttcaattcaacaacggaacaacatatcattttaatgactttctcggatttaatgcatgactctccattcttacacacaagtaatgaatcgcttgtttacgaggaatgactagcagcatgtttaaatggatgataagtagaacggaattgcttatcattggtctgtgcgtcaagatgaaatattactatcaaaaatagatggagggagggttattatctgcctataattttctacagaaaaaaaacaacaaaaataaattctagctagccggcggcctaaagctcatcgtgatcgtcgtcgccgccgccgtcgccatctcgccgtgagccgccggacctctggtacaccgccgacatgaccgggttgcacacgtcctccagctcccggagcttctcctcgtactcctccttgccgacgtcctggttgccgtcgagccactcgtacgcctccatcaccgccgcctccaccttctccttctcgccgccgtccatggcgcccgccatctcgccgcccaccacggcgttcttgacgccgtagacgtaggcttccaggctgttccgggcgccggcgcgctccctgtggcggcggtcctcgtcggcgaactcctccgcctcgcccagcatccggtcgatctcctcccggctggtcttgcggtcgtcgccggagatggtgatcctctccgacctgccggtggccctgtcggcggcgctcacgctgnnnnnnnnnnnnnnnnnnnnnnnnnnnnnnnnnnnnnnnnnnnnnnnnnnnnnnnnnnnnnncgcgatgccggcgaggtcgaacctgccgagcagccggttgtcccgcgtcatgctccgctcgccctcgaacaccttgacggtcaccgtcgtctgcttgtccttgtaggtggagaacagctgcgccctcttcgtcggcaccggcgtgttgcgcgggatcagggtggccatgacgccgccggcggtctcgaggccgagggtgagcgggtgacgtcgaggacgaccatgtcgcgggttttgttgtcggtgtcgccgccgacgatgttggcctggatggcggcgccgtaggccacggcctcgtcggggttgacgccctggttgggctgcttgccgccgaagtagtccctgagcagctgcctcaccttggggatcctcgtgctgccgccgacgaggacgatctcgtcgatgtcggcattgctcagcctggcgtccgccatggccttcctcaccggcgccatcgtcttccggaacaggtcgttgttgagctcctcgaaccgcgccctggacagcggctccgacaggtcgacgccgtcgaacagagactccacctcgacgcgcacctggtgctggatgctgagcgcgcgcttggcgcgctcgcactcgcggcggagcttgccgagcgcgcgcgcgtcgccggcgatgtcgcggccgtgcttgcgcctgacgagctccacgaagtgctccatgacgcgctggtcgaagtcctcgccgccgaggtgggtgtcgccgttggtggcgaggacctcgtacacgccgccgtcgatggcgaggacgctgacgtcgaacgtgccgccgccgaggtcgaagacgaggacgttcttcccgccggcgccctccttgccgacgccataggcgagcgcggcggcggtgggctcgttgaggatgcgctcgacggcgaggccggcgatggtggcggcgtccttggtggcctgccgctgcgcgtcgttgaagtaggccggcacggtgacgacggcgcgggtgacctcctccccgaggtaggcctccgccgtctccttcatcctggcgagcaccatggcgctcacctcctcggggctgagcagccgcacgtcgccgcccctcacctcgacgcggacgtgcggcttgccgcccttgtcgacgacagcgaacggcagcagcctcatgtcgcgctgcacctcggcgtcggcgaaccggcggccgatgaggcgcttggcgtcgtacaccgtccgccccgggttcgccgccgcctggttcttggcggcctcgccgatgagccgctcgccgccgccggtgaaggcgacccacgagggtgtgatccggttcccctggtcgttggcgatgatctcgacgtggccattccggtagacaccaacgcacgagtaggtggtgccgaggtcgatcccgatcacggtgccgccgccgccgccggcggccgcggtggagcccgccggcaacgtgaggaggaggagcacggcgaggaagaggccgtgcaggtgcagccgccgcgtccacgttgcgccgcgcgccatggctgtgtgtgagagacgagacgcggggggggcggctcaatatatagctttgggtgtggccgcgccggcgcggcgccgcgcgtgcgtgtagcgtccaatgggaggctctgcggcggggcgtacgcgtcagcggcgtgatctgagccgtccgttgttccgatcgggcggtgaggtgtaggggaagcgtcgtgttaacacgtggcctttgggcgtcgttccggacatggaaggggcgcgcgtggcgcgcggaaatttcatgttggttttccatctcggtgtttggatccggcctggcccatacagacggttcgacacaccggaaattacatgttgggcttgatttgctggatccagacatcctgccgggcccgtaaataaatggatgaacggctatggaacgtcgatgaacggctatgggccagttcagctcagctgccacaaaactaaggcccaattatctagtcaacttctttgggaaaaaatccactttgacaccctcattatacctcggatctgatttgtatcccttaaacacaaaaccggttataataacttctccaactgttaacaccattacaaaatgactcctaggataatattgaagttggtattagctgacgtggctatccaatcataaaaaaaattaaaaagaacagtgggacccacatgtaagtgctaagggaaaaaagccagaagaaaaagtcgcttcctcctcgccgaggtcgtccgcgcgttcctctccggcaattgggacgcctccttcacaacaccgtcccctccgcgcaagccgctgcctgcaataggcggtggtcccatcccgcgctccatagtgcttgtacttcgtggcgttgtccggtgtggagctccatgccctcgcgtggtctacggcctagggctgggcggtggtggggtcgccagtaaagccgtggagcaattcacaatcgaattgtgaggcagaggtggtcctctgttgcgactctccccctcccccctcctccctaatcctcctatcttctacccgaagcaatcaaagtaggcccatctcctcaattcctcatgcaaaccaccgctaagcctaccatcttgatctaccgttacgagccgtctcatgccatcccactgtgacaccggctttgcgctactttggtgaggattccctcacaatcttctgttgtctttcatcgtcattaatgtcgccatgagcccatggctgctcctctactctagatccactccacagccactagcctcacccacacctcctcaacatctccaacatagaaagcgagttccttgtcacaggggacgcgtgatgacacccttggaaggccgagatccatatctgagcttgttggcatctcttctctctccaccgaaccgagcccttgactgccgtgcttatgctatcttcctcgctggaaacctccacctttggatgagccgagtcgtaggacacactcaatcgctcttgttccatcgtcggagcaccaacacttgagccccatctcctctaacctcccaaggctcctccactgagagaatcgtgatactgagagtgtgaataggaggcggaagagggaggaggaagaagacatgtgggcctgtgtctatttttttttatttttgtgatgattgggatgtcacatgttagcgaaaactgcctttaaaacagccgagcgagtctatttacacggttttaatggttgaaggagtcataataactggttttaaggttgagggatatgaatcaaatccgacctatattatgaaggagttaaagtggactttacctatattataaaggagttaaaagtggactttttcacttcttttctgatgattaattcattggatcggttacttgaggacttttggagtcaatttccttgcaagctactctttacgtcgttaaaaataacttctagagaaaaatttgaacttgtactcgtcgaagttgatttttttttttgatgagaatggtgtatacttgtttgaaaactgcatgtttcatcgaacggagtagctcgatcaccgtaggtcgattttgcttaaggttttgaatatttggacaacctgcgcgtggatttttgtgaagctatttctgcgtgtttttacatgcatggaccacctgaataaaacttaaggttttacgacccaagttaacttgaattttggagtccatagaacacctacatttgtgtacacagtaacacagatgctccaatcgaaagctgaaagattatggaacccaccacctaggttagtgcaagcatcagatgcccagcccgaccacttaaccgcaacgtcatctaccagaatctttcaactcgaaagaaattcgacctgatcctaaactcactcagtgaaatttcagatgtcaccgctgctgatcaattcatcctggacatcctttgacatattagaggaaaaaagcaacacgatatatttacaaatataaaatagtttataaataaaacttttatatacgtgctcttaacgatataaaatcaaagactaaaaataaactatgctgaaaaaaaattccaaatcaactccaaatataagattattgaaaattcaaatgtttttcatcgttgccgttttcgaagagtgacataggcggggtgggtgcgttcgtgcagacagctcgatcgatcgagcggtgatcggatccaaacaacgccgctccatcgatcccctcgacgcgcgcaaactccacgcaccgccaccgcccgtgcggcgcgcacacgtcactctacctagcttacacctacccacatcaaccttacacacagctcgatccacactgacacacagagcgcgccgcgcgcgacagcaaggcgagagcatggccgagcaccacctcccgccggagccagccgacgagccccaccaccacaaccatggcgggaaggcggccgtccacgccgacgacctcaagcccggaggccgccgccgccggtacggatactactatggcgacgggtacggctctgccgaccccgcccgcacgctctgcttcgtcgtcctcgtcgtcatcctcctcgccggcatcaccgcgctcgtgctctacctcgtctaccgcccctcccgcccggccttcgccgtcacctccgtcgccgtctactccctcagcctcaacggcaccggcaccggcaccggcgccgtcgccggcgggccggccacgctggccgcgtcgttccagctcaccctcgtcatccgcaacccgaacgagcggtcggcggcgcggtacgaccggctggcggcgtacgtggcgtaccgcggggagcccatcacggcgcccgccccgatgccgccgctggtgcaggacgcggacagcgcggtggcggtggcgcccgtgctcggcgccggcgccgcggcgccgcccgtcccggtgtcccccgacaccgcggcggcgctcgccacggacgtgtcgtacggcgtggtggcgctcagggtggtggtgctcggccgcgtccggttcgtgtccggcccgttccggagcgggtggcactccatgtacgcccgctgcgacctcctcgtcggcgtccgcaagagcggcggcggcggcgcgggtggcggtccggaggcgccgctgctcggcaaccctacctgcgccgtcgacatgtgatgccaggcagctggatagcttcgtcacacctcgcctgtgtacgcgtagaaaatttacctatacagctagacgacgacgtacgtgtatctgtgggtgaccacgtgtccgtatgtatacgtatattggcaagcatacgtgtctccgcttctggatacctttgcaaaatatacgtgtaaaatatcgaaaaataatgataccatatcacatatgctaatgttcgacagaattttcatcaggatcgatgcagaatttatgctaagctgctttgctgtgtgatgagatttataattttaattggagttatgcgaaatccatttggaacatgacattgaatttcagcggctaacttctgcagcaatggccggtaaaacactaaaactgacgtagaaatggtgatgggaactgcacaagtactgggcaaccccgtttcagggttgaagcccagtaggaacagcggcaaccggggatgggccgagcaacggagcaagcgaaggacgcacgacctctggactggatttggcccaaaacaagacgcatgctcaacacaccacaaaccaaacaattcttcgaagatttgggccaaattttactacccaagttttaatctggacaaccgtaaaactaatattttcagtatgaaccgaaacactttgtcatggttgcggtttggaccattccaaacatcttcaatacacatcgacagcatcaatcaaatcggtttgggaataccggtgaacttttccatctattgatctatacgcaggccatatctttgtgaatagaggctagacatggatataaagagagttgggcgatcgaaatcatgataaaattaattgaaagtgaaatgattggtttaaaagtaatcaaaggtaaaactttagcaataaaagatggctcaaaccgcaatttttctattgtttaataactagtcaaatgcacatactttgttgtgtcatgggtaaaagaaaatatataatactatgtcatagataaaatattttcctatcaaatatggtagtattattcgtctgtttatttgaacatatggtacttgattcaaataaatattacactattataaaatattagaaagtatcataaataaatttataaaagttacaaaagtaatggtggtggctgactattaatgtttgtgtagaaaacatgaggcatatctctctctaccctcaaagttattgttttgatgttcaaattagtttggtactccctccgtactcataaaggaagtcgtttaggacaatgtttaagtcaaattttgggaatataaatcatgaataactctcaagttgttgagtttgaaaatatacaaattatatgaatagatttgtcttgaaaaatactttcataaaagtatacatatatcatttttcaataaatattttcatagaaacaagaagtcaaagttgtattttaaagaccgtgtcgctgtccaaaacgacttctgatgacgctctctctcgtggcccgatcttctggtgaggggataactctcgctttaatcgagtgcgacgtttttgacgtggctaccaaccagaacaagtccaggacgccatgcaatcgctacaccacaaacgatgtcgtaccaaccgtgacgcgcggttgatgatccctgcaatgcaaacgagagaacactgtaagaacaagataagatgcaatctaaatattgcgaataggtgattaagcacaaaggaatagttgcgattaaagtggcagatctaatcgacccggcaaatcaacacaccaactattgggggctctaaatcaatagtcgccgactaatcgagcgaggactagagacaaggtgaatgacacttggcaaaattcaactaaacaaaacccaaaagtttttgaggatgtacaaaactatttatagaggaaaataaagctagggttaagtgctaattcgtggaggtggagggagacacttccgagatgggcctagtctattacaaggcccaagtcccaagttcggtttcagcaatagcannctgtcttgttttggcgattcccgttgactcgagatgaatttggacatgagaccggatgcgtttgaaagatagcgagataagctttccacgaagtccaagatcacccaaatcggagttggcatgaaggcgctaggtccgtttgaagtcagtgttgtctccggaggccgaactggacttggacttggaattatcattggaacatgtgaagttatgagcatatccgacgaagtgatgtcctcatcaacttcttttacgagtacggagggagtactccagttagcttcagatcaataatttcaactgatcactaagggtccctttgaataaaaaaaattatggaggaatttcatcgaattgaaattctatagtaatttttttaatgtagccctttcattcaaaggattagagttttccaaatcctataaaattcttaagaaatggctcactgcataaaagccttgaagaaaatttagcacgaggttcaacctattggaaaaattccttagagtctatctctctcatccaattcatgtgttttcattgcggtccaatcaaaggcttattcttgtatttttcttgtgttttacaacccactgttttacacttacattcctactagaatcatgcgttttttctactcttttcctttttcagtcctataataaggggctctaaacgtctagcaacaaccaaaatccatccttatgttaacctcactagattttggcaaagcacttctccaaattgttttttccaaattcgtttgtccctcaaatagttatcgtaaatcatttttatatcctaccatctcgatattcagcatgatagatatacttttttttcccgatgcatatccatgtcaaaaagttttttttaccctactgaatttttgcaaatgacttgtccaacccccccccccccccaaaaaaaagaagaagaaataaccacaccggccattactactccctccgtcccacgatataaaggattttgagtttttgcttataacgtttgaccactcgtcttattcaattttttttttgcaaatataaaaaacgaaaagttgtgcttaaagtactgtagataataaagtaagtcacaaataaaataaataataatttcaaaaaaaaattgaataagacgattggtcaaacattgcaagcaaaaactcaaatcccttatattatgggacggagggagtataatataagggattttaggtagatgtgatacattctagtacaatgaatctggataaacggttaatttgtccaaattcattgtcataggatgtgtcacatccacctaaaatatcttatattatgggacggacataatactattgatcgataataacaagtcataacttcgctgtagccccttgtgtgaaccatgcgtgcctgaagggcaccatcgaggtcagactcgcgtcgcacagtcgcatcgcacgcacccgcaccggcaccggccgaccgaccggtcgctgttgccttgcctcccaacggcgccaacgaaccaagtcgcggtcgtactgtgcgtgtagtggagacagtacagcggcggtggtgacaccagccacgctgacgtcacgcgggtgacgtcaccgagagaagagatcttttgggccttttctctctttctctctcttcgaatccgtctccgtcgccgcctgcggatgctgcggagcgtcgctggaaagaaacaaagagaggaggtgatcgagggtagtacccgacgttgtcgctgacgtcagctggtttcgtcagaagaagaacagagtacagaaaaaaaaatttgaaagggacgaccacccatgcatcggtgtgcctccaccgattccaccctgttgcagcgggtggtagtcttttttatttttgcttcttctttattttactgtgtgcagccttttcactttctcttctttttatctttccctcactttcctttggacaggtttatcgagctactctcttcgtacgaatatgtagaagtagcaagttttagttctttgacagagatattataagaagaaaagtaaaaagacttggttgtgttattgggatgcatggttaagatataggtctgaataagttgaagttgggatactacgaatagtttagtggtaaaagtcatatttttttgtcaagtaccacttgttgttaagtttgaaataaattttaagttttaaaagttgttattttcagacgaaggtgtactaatttagctaagaaatcttttcctcaactatttagacaaaactttgaaattgccggtaacttatttgtttgtacaagttttgtttttgaaccacatagtaaaaacacatgtgctcatatacatatgtgcaacctaccacttttaagaaacggggtcaacatgctcctctatcatatcttgatagtatcgtgccgtaataagaatttaactgtgacatcagattgtttgtttctaaacttttgccagaaatgtttaaattaaaaatatattatggcatatcgatctctggttgaatttgtttttggaggaccaggttatttaagtcatggttaatttatgatacatgtttgaaagccactcccaaaatcaattgtaggacaaccctaaacgccgttcttatagtgttgactcagcgtttcttttgagacctaacaaaacccgtttattcaatgatccaagtcaaacagaaaattgtactatatatatacattttcaacgatgaacaatgccactgtataccacatagaaattttttgtcaaaaaagaaaaaaaagtctacacacacatcagtatcagagaatctcattatttgaaccagctagcgcaactggaggagtacgcacgtagtttctaacgcattttccaacagatgccgtgaataaacccaagttaaaaacatatgctaattactccatccattttatattatatatcattttgagttaatcaaatttctttaaatttggtcaagcttataaaaaatattttaatacttacaatataaaaataaacatattatcaaaatgtattcattgttagatttaatggaactaatttagtattttagatgttcttaattttgacaaatttaatcaaacttaacaaaatttagctaataaaaatcaaaacaatttatagtatgaaaacgggaaggaggaactaaagctttgtttgtttgtttctctctccattattctaacgaatttgttgggggtttttttttaggattggaccagagaagcagagaccgtttggtcgtccaacgcatgaagcaatatggaattttgcagtaaaaaaaaaacaaaatacaaagaccagctcatcgcccccgatgggtcaaggcgtttgcacgtttttaaaactatagttccccctctcacgagatcatgcgcgccggcttccccacaggacacgtcaccctccctcctgcccctaccctcgctggtatttataccacccgtcgcctccaagccacgacgccaccgccattccacctctcgcttcgcttcttctcctctctctctctctatcttcacctcgcatcgttggagatatggagggagttgacgtgaaggcgccgcggccaggctgcggcggcgacgacggcggcgcggcggcggcgtcgttgtcggcgcggcgggaggaggaggaggagggggcggtggtgggcggggaggacgagcaggtggagaggttctacgcgctgctggccaacatccgggcgttgaggggcatgtacagccggtacaacggggaggagggcgccgccggcggcgatggcgacggggcgagcgggaggaagcgggcgaggcgcgcggagccgccgtggaggccggcgttcaggatggaggacttcgagttcgaggaggccgccgccggcgccggcgacgacgacgcggcgtgctccggcaggacaacgaagaagcagagatcaggcggcggcggtcacggcgccgccgtggagaagcggcggacggagaaggaggctgccgccgccgccgccgaggacgacgacgacgagcaggagggaggcgaggtcgtcgaagggaaggaggaacaccgaccgggccgccgcgtcgaggcccacgggcccactgaccagtgaacattagctagctagctgatctcgttggaattggtccttcggaaacagaaggcattttcgttggacttttctgattgatgtcctagtttgaaatgttcacatgtatgatagcactagtagtatcacgcaatccatgtgccagtcttgatttgcaaattgcaatgtacttatcaaaattggtgatcatggactatcccagctgtgcatgggtaaaccattagtatttgagatcaggttttttaatttcgaaattggtttttttgccggggaaccgaagtttcggaaatttcgaaattttttggtcgaaattatttaaaattttgacttattttcaatgaatttgaataaaatttgactaaattcacaaaaaattgcaagaaaaactaaaaatttcgggcaagatatgagcttgcccgagggaaacgaaatttcaatccctgtttgagatagactaacacacatcactccaattagtttaaacttgaactgcggtaatatatgcatttcaaaaaggagatttaaggaagaatgtcagtattttaagcagttaagcacctctgaagatttggtaatgcgaataggtgttcgatcttccggtagtttctattttgcaacgtgagccatatcttgagattagcaaagtaactatagatatttagttgtcgacggacgacctaccactaaaacaatattttgctataaatgcgatgatctatgctaagtgtatgatttaaactcagatgatgaacagcttcaccacaagacaaagaacctaaccagctgagaaaataattaggtataaatgtgatgatcaacgttaagtatgtaacctaaactcggatgaacagtttcactacaagaaacccaaccaagttacactcagtttacaaggttaggtggtgtttgtatctcctaaaaatgaagattaagtgtttcacgtaaaatgagatggtaataacgtgtgattaattgagttttaattattacaaacttgaaaaatggattaatctgatattttagagcaacctttatatagaaagttttcgtatgaaatacaccgtttagcagtttgaaaagcataccatgagaatctaaaatttcatccaacaattgttggacattcgaacgcagccactagtatagttttcatgtcactttaacgtaaacggaaaacatacttcacaagacaggaatttcgtaaaagaaaaggttgaagagatcaaactaaggccctttttagatcccatataaaaattttacaccatatcacatcgaacgtttaacacttgtatgaagtattaaatatagactaaaaaataactaattgcacagattgcgactaatttgcgagacgaatcttttaagcttaattgctccgtgatttgacaatgttgtgctatagtaaacatttgctaataacggattaattaggcttaataaattcgtctcgcggtttactgatggattctgtaattagtttttttattagtacctaaacaccccgtgcgacaccctatataatatccgatgtgcaacgccaaaactttacacccctgatttaaacaccccttaattaaagtgtatggaaatcttgcaaaactctcatattacaaagcactggcagagaaaacctttttactcccggttgggaaccccctttagtctcgggtttccaaccgggaatagcaatctaggactaaagatggttgaaataaccgggactaaagatgaatctttagaccaaccgggaccaaccgggactaaagatagagtatctttagtcccggttgttgttaccaaccggaactaaagaggatagctaggtttttttccttttttattttctcccgaatctaggtagtatgcatatccttttttattttctcctgaatatgggtggtatgcatatcccaaatcaaagtaagatcccaagtccacattacaaatctgaaagttctaaaaaaattacatcacaaatcaaatatatcacaaatcctaaaaaaaattacacacaagtcaaattacatcacaagtttctacaaaattcatcacaaatacatcacaagttcatatcacacacaaatcaaattcatcacatgatcatgcaataaatcacaaattcttaaaaaaaaacaaacagaggagccggccggccggccaccgccacgcggccccaccgcgccgcccgcccgctgccgcgccgcctcccctccgcaccggccggccccgcggcgctgcctgacgccgcgccgccgccgcggtcctccgcgccgctgcccaccgccgcgccggcctctcctccgcgtcggccggccaccaccgcccgtccctctgcgccgccgcgccggctgccgcccggcccgctctcgctccgatccaagtggcactaaggaagaagaaagggtaaggatagggagttagaggggaaaaaagagatagagaaagagtttgttgtgtggacgggaaaagaggataagtaatagggattatataatacgtgttgatttttaattccggttagtaacaccaactaggaataaagttagatctaccaaccgggactaaagatcctagccgcctgacacggtctgacatagagacaaccgggactaaagatctttactcccggttggggtaaccccaactgggaataaagatcatctagtcctgttacgcttataaaccgggactaaaaatcgtttttagtcccggtttttaaaggaatcgggactattgtggatttgagttgaccgaccaaagatggtttctctaccagtgaagaaatccaagtttctaaccctagtttgtttagttcgcccaccatgatgtgataattttgaccaccgaaacccctaagcagaaagaacaggacatttccacgtacagttcattcagatcagcatttccatgtagttgagcgtgcggcgtgggttccacgtacagtcttctcaaatttctaattttctcttctctcaaccacaccgagcgtacaatatgcacgaacagacaaactgaaaccagaggtaaagacaatactggagtaatatatagaaagctaattcctcaatagtgttacaaagtttcttaacgaaccgtgacccgctaatttactagtacaattatttaagtgaaactgtgagagtacaaataactttaaccgtaggctgctaattaaagaaaatagtagcatacacaccatgcagcggaagtatcgatggtgtaggggacagggcctgagacatcttgggcttgagcttcaaaactccatgtaattttctttagaaattgtatgagaattttcaaaaatatataatgcctaactaaaattgtcaaattcagtcttagacttgcaaaaaaaaaaacatccaccactgatggtatagtgtagtagttattgatgcacaactcacccactgggggttttaaatcctaatgccttcaataggattttaaagaatccacgtacttaaaaaagtatttgaatatgatatgtagtggtgtgtatatgcatctttagtattcaatgtaatcgaataaaaaacatacataggatttcaactaacggttccatcctaaatgtagaggttggagatattttcatataaaagaatacaaataaaacagtaaagatcacatgaggtaaaagagtaaaaaaaaagattaattcataagtacagtggtaaaagaataattggtcaatggtgtgtggtttatatgaaacactataaccataatatccgagattatatgtttaagtgttatagataaggcatatataatatatatttttgtgttaaactcggtgggacccaccatataccaagttttatactgaatcaatcctaatatacgaaaagtattccagataaagaaagaggaaaaagagtctactcgatactaccaggactatttggatcgtataatacttgcctacttagttttacttagaaaaaggcacacccgaagatataaatacaagtcccactagaagaagtgggaggccaagacagaacacaagccaatacagatctaaacaaatacaaaacaacttcaaacctcaccaagttcatagtactcgagaaataagattacactagttgtcaaccacatgtgagagctccatgcggctaggccaacagtgactagattaggtcatcccaaatattatactcgcgtgatgttgatagataaaggcaacaccggcttcaaccaagaagagcagggctattacttgttagttaaggtcatgaccatgtataaaaatccttgtctttcatctcttttacttcaatcttggtgacaccaactacccccatactctataaataccataggtggatatagtactctctcgtcaatgtgtcatgtgtcaaaatttatggagtatgttttatgtaatcaatattacttagggttatactagaaaaatgcatgtgtgttgcaacagataagatgtttttaaatcagcatacgttatactcctttcttagttttgggccgaaagccaatccctttcttctttttcagccctagcccagtctgctacctccctccgctcggcctgcctctctttggtccaacctacagctggagccgtaggtctaggtcgcacgtcttcaacctccagaagatggtgtcgtgctcgtacaataccataattgattctccccatcaaatccgtccgaatctttgtcgatcttctaaaattggtttagggtttttatccactcgatcttctctttcctttttttccaaaattggagtgagcaaaacttgggataaaaatggccaagttagcttgctggcctgccatcatcgacgacggttaaatggagattaaatccggccaattaaagccgaatttaaggggcaaatcatggggaaatgatgagggatgagtgtgaaatcgatttttgcaatcaattggaggagaaaacgcatgaagagatatatcgatgtggtggtggagctagagataggtatagcgaagggaaaagacggtgacgaaaagaaaaccgaaaagccagaagcccttaccgcgtgcgagaaaaaaaccgcaacgaaaaaacggtggcggaaaaaaaccgtatgagaaaaaaaaatgaaaaataataaaaccgcgacggaagaaaacaacgaaaatacgaacggagcataaaactgaaaggcttacagataagatccggataataataataatagaactggaaggcttacaagttttttatcaggtatatagattaaaactgaaagatagaattaaaaccgattcaaacacatatgacgtatcaaaattctagcagaaatattttaagtttttataatagtgtagagatgaaatttactatagacaaataagatcagtaacttgttatataggttcccctgattaaaaatgtcgataggcttgaaatcgttagacatcctgctatagatcgaattgacattatattccatgagaaactctcattccaagaaataaaagatatgttcgtccccatattcttcgatcaaaaggttcggaattctagaggagaaatcatattcttggcttggatcgatatggaagtgcatactgtatgcttcggacggtttcttctgttggctgtcaaatccagaatcaaacatcaacacatccggcggcagtatcatctccttttatggcgtgctacgaaatgatgcccacacacttgcacacagtaatatactccctccctcccattagagcagagcaggtacaataaaagactataagacatctataaatacagttcgagaagataaaagaggagagagcagcgggctatagatttatagctagctgcagcacggattttaagatatatgtgtgtatgataggtgtgaccaaatattaattgtgcagtatatgtttataagtaactattgtatgaattgactattaagttgactatagatgatttgaagccaactgttggctatactattaaacttgctcttataagtgcagccataaattttcgtatctaacgtttgatcgcccgtcttatcatctaataaaatactattcttattttatcatataataacaataaagatattaatcataaaaatatttcaaataggacagatggtcaaagttcgacattgaaactcacaactgcgtttattatgggacggagggaatagctcatgagtaataatggagtagctcgttcaatagaaacatttcacgccaaacaaacaaaccgacaaatttcgcaggcaggcggtacaacatcgtgcgacacgcgcgcgcgtgctctcccctgaggcccttcacagtgcagtgagctggccagttgcttcacagctccacggaggatggttgatggcgtggaggagagagggtgtgggccagagttccttcacatggttgctcggttccttggtgagcaacgagttcctcgtcataaaagcctgcaaaaatgcctgaaaaaggactgagcacgcacaaaaccatcgggagagagagagagggggaaagaaaaacgacctgcaaagcgattccgtggtggggccggcctgaaaaaaaatgagggtgggttacgcacgtgtgcactatggagagggaagcttcaaccacttttacatttgggttgctcgcccaggctcaccgcattgttactgccctgaaaaaaaagggcccgatcgatcgatcgaaccaccactccgtataattccatgtgctttgatcacctgctttgttgtggagcacacgggcacgagcacccgcgcgcgcctggcctggctggaccgaccgaccgagctgaccagatcgaccagctaagccaccacttttgcctttcctttaacccgtgcgcgctgacgtcacggcacggtcgtcagcggccccccgttcccgtcacacacacgtccccgttggccgttggcgcctctcttttttgtcgtgtgcgcctgcgtcatccgctgacgtcacccatgacccaaaccacagtcgacgtggaatggaatactgttcgtcctttggtttaccccgatttgtccccaccgaccagcgacttggcgtccccattttggggatggatgggcgagggcagtttcgtcacttttgcagcgatgattaaagaggaagaccgggggcagggcaaatgcctcttttcatcagggtcatagtttgtttttttagtggtttggtgactgggttgtggggcccgagacaaaaggacaacagtatcgccatttgcagctgggctattttcccttttttttatttttatttttgaaaaaaaaagagggtgacgtctataacgtgcgcacactgctattgacgggtacatacattacctactactaaagaagcacactcttatcaacgggtgcgtacattgtctactattgaaataatagttagaagtaaataagaacactcgtatcaaaaataggatttgaatctctatgggttagtttcaccacaaagaatctagctaaccagataagctacgctcaccttactggttagatttttttttcaagagaatatgtcgatattttttatagtaataagcagtagtgttggcagtcgtacatgctccattatttttggaggactacaacgcatcagacggtcaaaagaaagaggaatattcctatagagtgagccaccaaatcatatcgatgttgatttgatggaggaatatttttctgggtaagatgtgataattacgtttgcatgtggtttggttagaaaaagaaactatttttcaaatttctattaatgattgtaagtggatcttcgcatgaaactagattttaagaaccgctactttcttatattagttgtttgacttttttaatcaaaattctttagatttgaccaagtttatagaaaaatatcaacatctacaccaccaattagttttattaaacttaacattaaatatatttagacaatatgcttgttttgtattgaaaatgttagtatattttctaacaaatttggtcaaccttaagtaagtttgattaagaaaaaagtcaaatgatttataatatgaaacagagggagtacataattctagttgcttatc

SEQ ID NO: 65885 - DNA, 1319 bp, Oryza sativa
tataaatgtgggaaatgctagaatgacttacattgtgaaacagaggaagtacttatgttcctactaaaacaattttagaatcaattaatacagttctgttcagtttcttttctttttgattaagtgaagacgctgatatacacactctattacgcgcgcactcacatttttttaaggattatatggaagatgtacgcgtgcacaatttgcgctctgaattttgagttactccacttttgtttcttctaataaaattttagaagcaacagaaaccattcaatttagcatcaccccgttaaaatcctatgaaaaatatgcgcacataatatcttaatattagaaccttaatagaatcatacaccctgatcctagcacacataaaaacttatactaacgtgcaattcttttgcccgttcagaaaaacaccgtacacgaaaaaacacaagtgcttctcaacaaaccgtccaaattaatcctacatgaatggaaatatatatggaattgttcattcggcctcagatttttgacattgctctacttttgactctctaccatggccgttcaaagttcaaacctttgtatatctcttgctcctgatttgacttatttgagcacggtaataatgcttctccgtttatacgcatctgattccgatcgaattaagacgtgtctaacttcgatcgatcagatgctggcaacctggcaacgaaggcggcgcttttggatttacgtattctagagaggacgcctaattaacgtttaattatttaatcgtaaatggtccggtctaatccaacgatcgagatgtgtgctgtgtatagtgtgtcgctgcttcacaaattcaattttaacttcgctttcgttttcgcaagctgttgctataaatttactcaccatggctgcgccattctccgcagcagccagcctagctagccctagcctactcccatggaaaccaaggcggaggccgccggcggcggcggcgagaagaaggcggcgtccgtggcgccgcgcgacgccggcgacgccccgtcgtcaccgcgagcggcggtgggaggagagcagcagagctcagcggcggcggcgtcgagtggcgatggtgtggcggcggcggcgaatgtggatcggagcggcggtgtcgccgccgccggcgaggcggaggaggacgaggacgacgagcagcgggccgtggagaggttctacgcgctggtcgccaacgtgcgggccatgaggggcatgtacaggagcagcggcgacggcgccagcgcggacagcgccaccggcggtaatgccggcggcggcggggagaggaagcgggc

SEQ ID NO: 65886 - DNA, 4095 bp, Oryza sativa
aggcattagggctcattcgtttcaaggaattgtaaagaaaaagtacataagtatgcaatacttaaatggacatcaaactgtcattcgttttaaaggaatccaccgaaagagaattttcaattctatccctccaattttagggggaagacaaaggaaagaacaatccactcttaactcattgttttcatgttctttggattgtttgttgcacaactatagacaagttttttatgtttttcaatccaaagtttccacatgtattcccatactattctttttttttctattcatacattttaaaaatcctacaaaccaaacgagccccgactggaaatgaactatcgaactatcttctagtttatcttttttgttaaaaaaggaagaaaaaaatttagtataagactcaaaaaccttgataaatcgagttgaacttgagagttaaaaggtgatcatcctacggagttgaatttgagagttgaaacgatatctgttctaaattattttcacaaactttttacaaacaccgatgtgttacattatggttgaatcttgacttttataacttctagtttactcaatcggacatttgagaattttgttagtaagaagtttgtaagaaaattttagtacatgtagcattacttcatggagtaggagggtagctgagggtaaaatggagaaaatttgaatgggatgtgattgatgtgaaaagtactactacctcatgtatgacactgttaacttttttttataatatttgaccatttatcttatttaaaaaattagcataaatatgttaaactataagttaagattatattttatttgatgataaaacaagtcacaattaaataaataaaatttatactataagacgaatgctcaagctttatacgaagagtcactggcgtcatatatttggaaattgagggagtagtatggttgagttgcatttactttaggataaaaattaaatctagaattagatccctcgttatactgctacccccatagtatgatcccctcaggcagcaaatgaacctcccagtttagagccccattggataccctaataagctaaagcaaaagctaaattttaaatttcaaacttaattttgaagttgattttaaaataatttcaatgtggcatttttatattggattttgagtcgctaagaacatatatataaaaattttacctataaattaatttttcttccttaaaaaaccgttttggcttataagacttgaagaacaataattcagtattagacttgaagccctcaataattcgagttgaattgagagtttaaggtgatcgtactatgggatagcagtaaggcccttcacagtgggcgttacttcatatacgtggagcattacttcgtcctacgtggtaaaaaaaagttggtgggacccatagcttcactagcttcttcggttccaagtgaaggatcgagaacctcacttaaaaagttgagcgcggggcccaccgatgagagggatttgggtcacatgagcctggagagattgggagtgacctacttttatgtgggacccactaggatgaaagttttcttggttttgggtcacgcactgtggagagcgtgtccttcctgccaattttttttgtttcgttcacttttacggctgaagacacgctatacgtgccttgcactgctactgccctgctaacatctcaaagtgagcagccgacctacagagaaagtacggaaccagcagcaggcatcaggtagttggactgtgtcggcaaaactacacacatcgaaaaggattttgcacccacgtgcacacagaaacaagaatatgtactcatatggcattttgaattggtttttttgcaacgctttactaaactttttgtttatacaaattattatttttatttggtggccggccagatggagatgcgccactgttacatggattgaaattcgtagtacctttattccaaaataagtacacattcacgaattaggataaacttaaagtgaccgaaaaaaataaatacacatttatacatgaattctatgttttaatttatacatgattctatgaattctggcttctttagccaggatccatgaaaggagcaagaagggaactttacaacccctctcctcccttaagaaaattttaaaatatctaattaaatgattgagattttagaaaaaaaaacaaacttaccactattggccctagctctactccctccgtaaaaaaaaaccaatctaaaaggagatacttcctagtacaacaaatttggatcatattctcttataggttggtttttttaggacggaggggagtactgcgtaaatttggtacctttgccaccatcttgatgacttaagccttgcaaaaccattatcgttatacgcaagcaagcggcaaatttaacgattcttcaggggaaaaagggtccaaaacctcgttctttctttctacccgcggcttctctgagctggaccaattgattcactacaactcacaacggcacagcttgtacttgcacagatcgagagatattttgctggagggaatcgtatgccaagcgtatgtaaaatggccggtatcaatggctataagcacatctcattcatgggaatcagattaccttttagtttcttcgacaaggatgcgtatctttttttctttgcgggaatagagagctttattgattacgtaacaggattacaatcatgctgcagacattgcataacacaattcggtacattattacgccaaccgtgctttgccccgaacggatagcaatctgagcaagttcatgtgcgaccctattacactctctattacagtgcatcaaacgcacttccttaattaaccctataactgatcttgctactcgcagcagaaatgaccatcttgatctctcttcagtagtggaggacaacctcgcaatcgctgtggcacagtcacattcaagcataactggcatgggaatccattcagcagctagcttcagcccttcatagcacgcaagcagctctgcttcctccgctgacacacatcgcctgagaaacttccaagaagacaacagaacttcgcccctcgaattcctgattacaactccagtgccccattaccattttcaggattgaaagctccatcgacattgattttagcccagccattcacaggcataagccagcaaacacgttgctttggaaaggcccgagttggacctgactccttcccctgttcagggcgacacaaagccttcccttttctgttagctcttggttgccctcgtctgatcgtcggcacggtttataagatgtagcagccagtcaggtcctgactgagagaactcttgttcccctggtagccaccaattctgccgcatctctgccctcagcgcagctgctttcgtgcatgcaaccgtagcatgaaacgcatcttccacttctgccccacatatctcacagtttggcttttgtacaatctgtcgtcgatgtttattatgttgtgtggctagacaatctcttgatactctccaggcaaaaatccttattttctgtggcacttgcacattccaaatgttcttccacaacttcctatcaccatcgccatttgagcattgtgcaacctcttcgtcagctctgatttgggcctgtagggctaatttgtaagcagaacgaacagtgaacatacccaccttatcatagtgccaagcaatgaagtcctcttcagggctatgtggcaattggattctcaaaatttcctcagcatccaggggatagaagattcgatgaactagctcttcattccaaatttgttgatgtggaaccataagatccgagacccatttgattctcgatctaacagcctttcccaaaacccttagggtatgctctctcggtatctagttatccctccagattctgactttgcttcctgatccaatccgccaaattagaccttgtttcagcagctctaacccgtggaccatccccttccaagtttctgaagagtcaatagggaaagcagtatcacacaagtccccattggggtaatattttgcctttaaaatttgagcacacaaactgttgg

SEQ ID NO: 65887 - DNA, 21386 bp, Oryza sativa
tcacagagccctgctggaagcttaaacacactcatcacgtaggtcggaatagcctgtaggactgatttaattaaaacttccttccctcccatagagaggtatttctcattccaatccgttaatcttttctcaaatctctccttcaaagattggtatcttcctgccttcagtctacccatcggagtaggcagaccaagatatttatcttcaaaggaagtgtgctgaacatgcaaaagtgatctgatgtcagactgcagagcatccccacaatgctttccaaacatcaaagaacatttggccgggctcaggagttggcttgtgctttgctcatacaaagtaagagcactcttaaccacattagtctgttccatatttgatttaaagaacaacaggctatcatctgcaaacaagagatgggaaattccaggggctctcctgcagactttcagaggttgtaaccgtcctgatctttcagcttcactcagcgccattgataaaccgtctgccacaaagaggaacaaatagggcgacaggggatcaccctgtcggaggcctctggtcagtttgaaggattcaagcatggatccgttgaagcgaacagcatagctaacagaggtaacacaggtcatcaatagctgaacccattgagaacaaaaaccaaccttaagaagagctccctccgggtatctccaatccaccctatcatacgcctttgtaaggtccaacttataagcacagaattgagactcaactgatttacaccgattgatggcatggaagcactcaaaagctatgatagcattgtcagtgatcatccggccgggaatgaaggcgctttgcgctagcgcgataacatcctaaagtaacggccgcatcctattcaccaaacacttagcaatcaccttgtaaatcacattacaaaggcttattggtctgtaatctttcaaatcctttggctctttctttttcagaattaacacaatggcagtgtcatttacaccttgtggcattcttctctgttcaaagaacagcttaacagccgcaataatgtcccgtttcaacacatcccaattcttctgaaagaactttgtggcatatgtgagaagggatggaagacaacatggaggggaacgacgatggtggtttcttgggcatggaggcaagcggctgtggtctcaagggtggaggaggacagcgatgggccgcctccccggaagctggagccgaggtggactctgtaccttccctggtggaggtggaagtcgatcggtgcgggccacccggacgtcgaggtggacggcggtggtggctcctctgccctagccgtgcagggaggagaggaaagccggcgatggtgcaccttcgcctgcaaatggttgtggagaacgtcaaagaacaaccgaacccaagaggatgaggtgaaccagattggacgccgtccggaacagcgtccacctttggacgctcttcaaaagaaagtgtgtccaagtctggacgctattgggaacagcgtccttcctatttttacaaatttaatctgagatttactatttatttaatttaaggatcattaattactgtaaataaaaaattcggcgaaatataagtcactggtgagaatcccctttggccataggaagtggttcgaatgggattctcccctctgaccataggggatggctcgaatagagactttcctcattggctacaggaaatagctcaaaaggaagatcctggtggacatcgtcttgggcagctccatttcaatttaataccaaggatgtttagactgaatatgggatgattttaccccatgctacaacaaaatgcatgtctgacattggtttcgtagaaatatttgatttaacaagtaaagttggggatttttctggtgtgttgcttccagcccgcatacacaatatttcatttaatctaaattcacaaaccgtagaccggatactattaagttatataaagcctaacaatctcagatactattaagttccttgccgttttgatgcataacaatccttcggtattttcttgcttcagaaaatcagttctcctgtttcttttgcattttcataacgattcttcctaatgactgtattatttgcagaagaaattttagcactaccaatgccatgaaggcaagaggctcaggaatcagaacaaggccatggtgagatgatcactgctgccaatcaaccatcaaaggctctgcccgtcatagagacaaagatatgaccacttgtgccatgccttgaaaatggatattttttttgttataacaagtttatgcttaataatcatttaatcattttaaccggagtagttttcaatttatacttggattattatttttttgcccgttgcatagtatctttactacttaaaaaataagagatgtttccttcgtccgtcaaaacaaaataaatagcgaaaaaataaaaagaaaagtccgactccctctcagaaaaaatagtctgactctagatccgattcccccttaaaacggaaaataaaacaaaccacggtttgagtcccccaggcaccactcctcttggtttcaatctataacatgataccccattcatcttcgtgaaaaaaattaatatgccggattgaagatctgtttgcaaaaacggaacctaccggtcgagagcattccatttttatatgattttattttttggggtttatacatttacatttgagtccctataatcttgcaataagatacttgaggttgtttttgttaagaaaaaataataaaagggagagaataaaagcagaaaggtgcataaaaagaaaaacaaaaaccgcaagaaaaaaaaagaaaaacaacaacaataaaagtttgtttcccctaggtggcgaaaaaaaaccgtagatccgattcctctaaaaggcaaaaaaagtggtgaaaaaaaagctagatctgattcctttaaaaacagaaaaaaaaactctgtttcctataaaggcggaaaaaaatctgaaaaaacatctaaaaactttgttcgattccctaagaaagtggcgaaaaaaatagttcgtaaaaaataaaaagttggtttgtacaaaataaaaaatgcgtgcgagaaaagaaaatgaaaagggcgaaacaaattacaatttctaatcagtatatatgtcttctctatctctaatctaatctaactatttaaaaagagaaaatacacgagaaaaaacggttcaaaaaaatgcgtgagaaaaaagcgaaaaaaaacatgctaaaaaggttttccatcttccaaaaaaaaacgtgggagaaaaattatttccattgtaggtaaatttttttttaaaaaaaacatgccaggaaaaaactgtaagaaaaaatgcaccatttctaaaaaatgatttaaaaaaccgcgcaaggaaaaacaccgtctattaaaaaaataaatcgctctgaaaaagctgtaagaaaaaacactaaattaatggacgcttgagtcggatagaatccatcgattttttgccatctactacacggcttttatttcgtcatatattctcttgtattggaaaaaagaaaaaaaagaacatttgaaaaaaaacaagcaaaaaatgcatgagaaaataattgtcagaaaaaacaggcaaaaaacacacgagaaaaaaaaaagcaaaaaagggagaaaaatatggtttttgtcgtcagttaaaaaaaaacatgctgggaaaaaatgttagaaacaaatgcgccatttctgaaaaatggtttgagaaaattgcacaagaaaaaaacaccgtttataagaaaacaagctgctgattaaaatacaaacattgtcattgacataattatgcatgaaaaacgtatattatcattagaatttattcacctgttgcagcgcacgggtatttttgctagtaaaacaaaaaaagaaatcagggcgtaggagatgatcaaatactcgatcggtagtgcatatgcatgcggaataagtccactatgactcccttaaaagtgacctgaatctaatccatgaccctaaaccgtaaaaccggatatctcaacccccgaactatcaaaaccggtgcaatttgactcccttgatggttttggagggtggttttggtgacgtggtggtgttgacctagtctgtggagttgacgtggcgcttaagtgtcatttgaattaaaaacaaatatgtgggacccgtttgtcattcacacataaaaaatatggggcccactgacatgtgggacatgttcttcttcctccccgcttcctcccctctctctctttctttctctttctttcccctttggccggccgggccgccgagggagcatgagctagagcggcggcgggtgggcgccagagcggggaaagctgaagtggtggtggcggtgggagtggcgacggatggcgctcgccctgcaggccgactgcttcaccagcgacctgagccagctcatcatcgctgacgtgatgtccgggtcagtgccgctcgacgcaagcacgagtatctccgggagggtggccatcttgggtgtgttcaagccagacaaaattaattgctcccgtatgcctactcatcctattcttcagtggatggtgaacgacctgctaataatctctggttagttgctaaatgaatcaattttatttctggattttgtgatgcttgtggccttagcagcaccggttgaaggagacgcaatgggggatgagttggtggtgatgatggggctggcgcgggaattgacggccacgcagcgagctcgagcaatgacttgacgacgtcgtcgttgcaatgttgaatggcatagctcgatggcggccctcaccctaactagcttgacacttgagaggctcgatgtcgcatacgccagatgcccggatcttgttgttgcaatcggcggagaggccagagcgccggatcttgttatcacagacggcgggaggcggcggagggagcagggagctcgttccccggtgagggcgccgtgccggtggaggtgaggactggggttagggcgtttaggtgccgtgccgttgaccgctgtccccccgctcgatctcgtcgacgtcggcgtcagcgttgccgtcctctcccgcctccttgccggccatcgagctgcctgttgccgctctggaacccgccgttagctctagcccgccgccaccaccgcttcagcttccgctggccgccaccactctagccctcgcccgtgagaaaattgggattatactatcgcaaaagtgtggttttgctgaaatgctatcgcttcaaactgattcactaaaatgctatcctaaactgagaggtgttcaccaaaatactatttttgctcttttgggtgaatagaaatgtttttcttaattttaactttttcccggaccaaaatacccttaatgcggggcccacctgtcatactctctaacgtcttttgttcttgttcccctctttctctctctcgaggatgacgtcgggagcggggtggccggcggccagcggcggcgtggcgagggcgtggtagagcggggcctgcagaggagcggctcggccagccgcctcagccggagttcatgccatggaccgccgccccccagccacagccgccgccgccgccggtgagccgcgtgtttgcgcggcgcctcccccgctgtgggtggccttcttcgcgccgccgccgcatcgtcgccgccgaggagcaggaggcgaaagtggacccggatgcgacggaggcggcagagccactggtcgacgggcggggcggcgctaaccgagggacggtggacgcgaatggtggcggcggcgcgactggattggaggaggagcaggagagggagcagcgggggccgccggtgccggacccggacccgatgctaggcgcggagtgaggggcggcagtggcagcggacgcgaatggaggcggcggcgcgagtggactggggcaggagggaggggaggagtaggtaggagagtggcgggggccggcgctggcgccggagccggacccaatgtggaggcgcgacggtgtcgccggtgccgatgtcgctccgcactcctcagttagcgccgattccatctggtaaacctatctgagaccaggtattttggtcagaacaaaaatgaaaatagagcaaaatcatttctagcaaccaaaaagacccaaaatagcattttagtgaacaccccttagtttaggatagcattttaaagaatcactttgaagggatagtattccagcgaaaccatccttttgcgatagtaaaatcacaattttctccctgcccgctgccgctccagccgtgctccccgcggccggccgaaggggagaaaaagagaaagaaagaagaagggaataagaggggaggaagaagaaagagagagagaggggatgacatgtggggccacatgtcagtgggccccataattttttatgtgtgtgaatgacaaacgggtcccatgtatatgtttttaattcaaatgccacctaaacgccacgtcaaccccatagactagttcaacactgccacatcagcgccacgtcaccaaaaccgctctccaaaaccaccaagggagtcaaattgcaccggtttcaatagtttgggggtcgagatatccggttttgcggtttagggttatggattagattcgggtcacttttaagggagtcaaagtggacttattcctatgcgtgcgaattctactcgcgatatatttctcccgattaggcccagcccatcaggaaccaaaccagccagtcgggccacggcctctttttacgcgaccacgaagcgggcccggtccgtgagagcctacacttgtgctgggccgcgagccagcccagatgagcccaagtactccgccacatccaaatctgcaccgttaacgccgcatcccacggctgtaagctcccctccgggagataaaacaccctccccccgatccagccaccatcgccattctctagggtttattccacgcctcccgtcgccgccgccgccgccgtcgttgtcctcgcccgcgcgcgaggagaacgctaaactccggtcaagatggtgagatccgaacgccctttactctctcttcttcgcgtcgttcagttattttctttttgtttttttttccagttcgttcggtgccttgtatggtcagtccagttcttgatttaaaccaggatatgtgatcgtctagttggcgtagaattacgtgcattgtaccggtggaatcttgttgcctgtgttagatcacgcggtgagttgatttgttcggttggttagttcttactagatcggtctcttctttaggttcatgtctttttgatctacctgtaattctttgtagagcgagttctttgtcaaatatgttattttggatcagagatcattttgggtaagtgctctgtgggtgacaacctggtcaagttgttagtaaatggctcaacacccgttctattagacatccttttggtaattaggagttactttctgtaaaactgtgattcccaatcataaaacatcctttgatagttatgagccattccatctcaacattaaatgtttgatgaacgcatagaatcccaaggaatgatggcatagattgtaagtgcttatttggtgaatcttgtttttactgtattgcccccttttcatttctctcatttggattggttaaacgctatcaatatgtatttatcttgttaaaagaatctccttttctgcttaataggcgaggggtttgaagaagcatctgaagaggctcaatgcccccagccattggatgcttgacaagcttggtggagcatttgtaagtacattgtatagccgcaagttatatcacgcagttcaaatgcattctgtataatgctaatgtagtgtttggcaaatgggaaagggaaatgatttcccacccatctttaaatcctaaccattcattctccctcttccatttaatcctaacccttcattcatttcccaatcccaatcccaccccccatttcccattatccaaacacatcctaagtgtttgctcgaattttttctgatgtttatttcctgggcaggcacccaagccttcttctggtccccacaaagctcgggagtgcttgcctttgatccttatcctcaggaacaggttgaagtatgctctgacctaccgtgaggttatttccatcttgatgcagcggcatgttatggttgatggaaaggtcaggactgacaagacttatccggctggattcatgggtgcgtgccctgatttgctgcatcattgtacgagaagtcaatgtctaattaattccatggaatcccttattagtttcttgtatcatgcagacgttgtgtcaattgcaaagactggggagaatttccgccttctgtatgacaccaagggtcgcttccgtctccacagcatcaaggatgaggacgctaaggtttatattaaattatccatcactatatggttcataatagtaggaacttttgctttgtattcttctgtgcaatacaaaaacaaacaactaaaaatatccttatcaagtgaaatcctacgccttgcctaatatcaagcaaacttcttgatctttaaattctactagtcatgtttgcctcctatggctggtttcatcctccatcggtactgttgacccacaaatgtgtacgccagtgggcccgttccaccagatgtagcttcatatcatgttgttctgtttagttctttatgtttgtgtgatgtaggaattgaagacagatcctattaatatcctactaatatgtgttccttttataggattcttatctttatagatttactttgaggttctctttcttgtgccaatgtggtttgcttggtttgtgctttttttgcttgacaaaattctattgagtcctacacttttgctttaaaatatttactgaaatacttctgttaataatgcagttcaagctctgcaaggtccggtctgtacagtttggacagaagggtattcctttcctgaacaccaacgacgggcgcacgatccgctacccagacccactcatcaaggccaacgacaccatcaagattgacttggagaccaacaagatcgtggacttcatcaagtttgatgttggaaacatcgtgatggtgaccggtgggaggaacacggggcgcgtcggggtgatcaagagcagggagaagcacaagggcagctttgagaccatccatgtcgaggatgccctcggccaccagttcgcgactcgcatgggcaacgtcttcaccatcggcaaggagaggaagccgtgggtatctctccccaagggcaagggcatcaagctcagcatcattgaggaggcgaggaagcgcaatgccgaggctgccgctgaggcttgatttctgaaaatctccatgaatgaaactgttgatttgagcagtctatttatatagattatttagctcttaagatcatatgtccattggagaccgtcaattggcgcttcattgttcgatacttgtcgagctgttttgaaactatgaattcatcatctgttaccttcagcataatagatccagaatccttttttagcttgtgtaatctttcccaaatgagaagctaccttgcatactgaaatgaattccacatgatgtttggatttgcaagttcgtatttttgggccctcttttatgggttgtgatggtcaacgttaccctgatacggctacaaagcgacgtatctgtatctgatacggcaacggatacgttccggtacggacggatacggatacgttccgatacgtattcggtatgtatcccatatatttgtgatttcaaaaaaacaaaataaattgagatacgccagcgatacggccgcgacgtgcctccgtctacgctcgcatcagggatgcgccgccccatacgctcccatcctgatggctgtctctcgtgcgtgcccggcaatgccaccggagacgccggctgcagccgcgcgcttggttgccgtgcgcgggccacaacgtcctctccgcgagacggaagagctgccgcggctgggcggcggcgcacctccttcgccgccaacctcggaggccacgaccgttgccgggcatagcggaggccggtggcaggctggccgctggcagcatcaaagcagggagctttttctttgtttgcttgactgcctggccgggtaaatccatgctctttgaacgtttcttgcttgaatctgttgtgcctttcatgtttttcttaggacaaagtaccgtttttgttagatacaagtgctagtgcatccagcaattctagtggttactggttagtgcggctgctaatgttgatgcaaagtcatcaagagttatatgattgaactattaatacgtggtttttgggatcttaatcgtttgttaatttgaattgcttatagaaaagaaaattgcaaaatattgatatggaatcggctactattagtattatatcgctatttctttataaaagctccttattttttttttgtatttttaatatatattaatgtaatttccttaattttttgtgtgttttcaatatatatatagacgtatccccgtatccttggtttttggaaaatgtcgtatctccttatcgacgtatcgcgtatccgtattcctgtatctgggtaacgtaggtgatggttgaacagcaaactgtgcatccaagtgaattccacatgatgtgcatccaagtgaattccacatgatgttttggatttgcaagttccacatgatgttttggatttgcaagttcgtatttggccctcttttatggattgagatggttgaacagcaaaatctatgcatccaagtgctggctcgagctttgggatcttggtttgggcaaagtttgaagaacaggatgcgctgaaaatttcataaactcctttatccagtgcatattcagagttatggattctatgtattcagtgcacattcagaatttgcacgagctgcgtgtaaaaagaaaaaaaattccgttgccgggactcgaacccgggtctctcgggtgagagccgagtatcctaaccagctagactacaacggatgttgtgctgtagttgatccctgggaatatatattaatgttttttgatcacataaacagtattttcgacgcgtattgtcgtagatacagcgtacaaataaatgaatgtattggttgggtcgcgttggatacgtacaggacacagcagcctaggctagtaggcttgattgacatgttaccgagaaaggcctatacggcgataatgtccatggatgaccgaccactcatctgcatgcgccgctgcctagctgcaccttcccttattattagccgaagcacctgccatggcctccctgttgctagtatatactacctcaatctcttctctactacttaaaaaataagaaataagagatgctttcatcgtccgtcaaaaaagccagacaaaaaaacaaaatttgtccgatccaaaaaaaaaaccgggcgaaaaaaacgtgcggaaaaaaaaaagaaaagaaaaaccaaatctgccctatccagaaaaaagaggcgaaaaaaactggcaaaaaaaaccaaaattgtctgatctaaaaaaaccggcgaaagaaaacgtctagaaaaaaagaggcgaaagaaaaccaaaattgtcttgatccaaaaaaaccgggcgaaagaaaacgtgcaaaaaaaagaaaagaaaaaccaaatctgcaaatctgtccgagccggaaaaaaggggcaaaaaaagaccgggcgaaaaaaaaaacaaaattgtccgatccaaaaaaaaccgggcgaaagaaaacgtgcgaaaaaaggaaaagaaaaaccaaatctgacgcggtaaaagaaaattcgggggaaaaaacgaatctgtctgattccccaaaaataattgtctgatctctactattataaaaactagcattgtggcccgcgcagattgcgcggctagcatcattatattttctctcatataatagcatatatgttttctcattatattattcaaatatattaaaatgacaatataattttaaattttgcaataactctacaaaactactaatgtgtaatgttcatattatattttatatacgtgttagttattaattatttttaatattaaattttagttattcgtaaattatatatattcctatatggattctagaatcgtcttttaatatttctttttttagttccgaattttctgtaaattgtatttctatatagactctatgctcttcttccaatattatttatttttatttcttaattttcatattatattttatatacgtgttagttattaattatttttaatattaaattttagttatttgtaaattatatatattcctatatggactctagacttgtgtcagggttatggataccacattcctaatagtagttgactaaatctcggcaggacccaccgcataccatgtcctatatggaaacaacctgcggatataggaggagttccggataaggaaagacaaccagagttctacattgaaacgacaaggactactcggattgtatccatattggtttccttagttctacttggacaagggaacacctatgggtataaatacaaggctccctaggaggagaggggacacaatacacacccgccatggaagagacccacaatcaacatacatggaacatagatcaagacagaagatcaacatacaagccaacatacgccaagacaagacgtcgggtatcgacttcagggataagcacggctagtcccttacgttgtctccggatactgtcaggagagacgaaagcgctatctttgatctcgccgggcacgaactcgaggaggaagactaccctgttgtcgactatgagtcagaattacagaccgctatgtcgacaacagttagataggctaccccaaatattgtactggtgtgattatgatgaataagagcaataccggcttcggccaacaggatgtagggttattacctgacaattcaggggcccgaacctgtataaaaatcctcgtccccgtctcttttacctcagtcttatgtatatcctagtaccaacgattcccataccatgcaaatactggaatcgcgacatcaaacgtcgacaacttgtcttttaatacttcttttttttaataccaaattttctgtaaattgtatttctatgtagactccatgctcttctttcaatattatttatttttatttcttatatttcatattatattttatatacgtgttagttattaattatttttaaaatcaaattttagttatttgtaaattatatatattcctatatggactctagacttgtcttttaatatttctttttttaattccaaattttctataaattgtatttctatatagactctatgcttttcttccaatattatttatttttatttcttaatttttattatttctaattgtatttctatgtggactctaaactcatctttcaatattctttattttttaatttttgaatttcagttactttgacggagcttgggctcctcaccgggagaccgcgcaggcccctctttgccggttcggccgggggcgctatgtgaggttcttcgccctcgatctaaggaacgtcagcgagaagaatcgcacaagacacgggcgacatagacaggttcgggccgctgagaagcgtaataccctactcctgtgttctggtggatctgagtgtgaaggaatacagagagctggagagcgagagagagttcaggctttcgcctctattcgccagcctccctcctctcctaggcctgggcctcctttttatctagttaggggtcaccacatgggcctcaagctgcctaaaaaaagaaacattccttttacaatgagggctaatctacagccggaagtgacctctgacaagcacagcacacgccttctgctccgctcgtcagctctcccggtggacgcccctttcaaccttcattcaatggccagcgactttcttgccatgcttgcgctgaagcctggcatggatctgaccgggactgacataccaactccaggagtcagcacgccggctccggctagggacgagagccaggaagctctcatcattccgacgggacggggcgaggcgtgtgacaggccgcctgttgccacctaacccgcaatctgaccggtctgtgaccggtcacataccgcgactggtcacggaccggataagcatgcgctgcgccgtattgaatacggcgcggcgcgctcgtctaacccgctataaatgcggttaggtgagcgccgctgtgctcacctaacccacacacgtggcgccaacaccacagggggtcggggcgccccagccctcggggccgaaacgggagcggcccgacccctcggggagacagagggaggggtggccacgtcaccctcgggcccgacccccccgagggggtcgggccacgtgggtgatcgcggctacccaagcctctagtcacgatacccccgcccctatgtcaccgacagtagcccccggcgttacgccagggcgaccgcccccctcgagggaggcgctcgggcgtgacgccactccttaggcccggtgacaggtggggccggtccccgcaggcgggcagaaacccaacggtcgcaaatcgcgcgcatcgggacgagccggtttgtttcgcctggggacatgatgatggcgttttttgcggttggcgagcgcagttaatgcgcgcacgatctgccccatctcaaacgtcacggctgcacatctgccgcgtgcgccgcaaacgggcgagtggggttagtggtggcgtgggtgcgagaaacgagggggcgaggtagtgggcgcgggaaacgaggagccgggcatagcgttggcaagggtacaaagacgccaaggaagggatttgtttccttcctctcgccactcttccccttgccttcgccacttgcgctctgactctttgtttcctgcgccctacccttgccgtactcgctcgctctcaagctcctcctccgccggcgtcatggcacggggctccgcaccgctcgacggtagcgtgctgccgccttcccgcatcgtgagcgagaggcaggccgggctgccgcgccgattcatgccggaatctgccaccggccgggaggtggtcgcgctgggcgagggacacccggcgccacactacccagggcggtccgtcttcttcctctctttcgcaatggcggggctggtcccgccattctctatttttttcatggatattctggagttttatgatctccagatggcgcacctcacccccaacgcgataatgacgttggccatcttcgcgcacctgtgcgagatgtttatcggggtgcgcccatctctccggctgttccggtggttcttcaccgtacagccggtgtcgccgccgacggtagtcggtggctgctacttccagccgcgggggcaggtgttgaaccgctacattccttgcgtcctccgcaaaaagtgggacgactggaagagcgattggttctacacccccctcgccgacgaagcgcgcctccgacttcagagccagcctccggcgcaggcctccagctggcgggcggcggtagatctgggagacggctacgacgccgttcttgaccgcctggcgggtctgcgatcccaggggctcacgggggccatggtgttcggcgactaccttcgtcgccggatcgcgccgctccagcggcgcgcccggggcgcctgggagtacaccgggcccgaggactacatgaggacccaccaggggcgcaaatgggactgggaccctgaggacttcaggatggtggtccaacgggtgctgaatctcagctccgtggaggcatccctcatcccccaaggggtcctccccctctgctgcgatccagagcgcgccaacatcctgaccatcatgcaggaggtcggggcgtcgggggagcgggtcccccgtggccacgatggcgcgggagggagccgcaggggggaacaatctaccccgggagggggtcgtgcttctgggccccgcgacgggggcccggggggcagccgccctgccgacgcccgggggaagaggaagcaggagggtacccctcccccatctcctccccgagggggcggggcggtgcgtgccagcagcaggcgcccggagggtgccgtgccgacgccgcagcccgagggggagcgaaagaagaaacggccccgcaagatgggggggaccgagccatgccgggggaacctcatctcacccctgaggtggtcgtttagccgacctccccgcaggttcgtccccgcgctcgccgcggccgtattcattctcccatctcccaaggcgagttttcactcacccgtttctttttgtcttcttgtttttcttctgcctcagcgagatcccgtcacgccccccccgccattccaagtccggccggtctgaggccgaggagacggtgaccgcggaggcccagaggcgggaagctgaccggcgagaagccgtggaccgcctccgggaagccgaggaggctgcccaggaggccgtccgggttcgccaggctgaggaggccgctcgggaggaggccagactccgccgggccggggagtccgtccgggaggcagaggcggcgcgcgcatgccaggcggcctgccaagcccccgacccgactccgcccgaggcgacgacgacttccgaggccacccacgatgaggccgcgggcgcgccgctcgggcccgacccctcgggcgacgcttgggacgagccagcttcgggggacgcccccaagtccggcacgtcgatcggcgggccgagccgcgcggcacccacatcgaggcgactctcccctctgccttccgctgccccactgagcacggagcccctcctgcaggtcttggccaccgcgaacagcacggtgctggacgggttaactgcccagatggaggccctgcaggcggagcgggcgcagctcgacgcggcgtgggcgcgcgtcgaggaggggcggcgctcggtggaggccatggtggaggcgggccgcaaggcacaccgccggcacgcctcacagctcgaggcccgtcgtagggacctggcggagatcgccagggaggtggaggaggagcgggagactgccctcatcaccaccgccgtgctcgacgaggcgcgggacgacctccgcctaccatacgggagccgggcggcggagctagaggagaagctcgacaccgcccggggagtccttgacgccgccgcttcccgggaacggcgggcggcggagaacgaggcggcgtcccggcagcgcgatgaggcccttgagactagcgccacggcgctggaggagcgcgcccgcgccctggacgcgaaggagagagacttggcggaccgtgaggccgccgttgccacccgggaggcaacactggcggcgcacgaggccacctgcgccgaagaggagtccgcactccgcctccgtgaggacgcggtcaccgagcgggggtgagctctcgaggaggccgaggccgcggcgcagcgggtggcggacagcctgttcctccgcgaggcagcgcgggaggagcaggcgcgccgcaatctggaaggcgtccgcgccgagagggccacactggatcagcgggccgctgagctcgaggcgtgggcgaaggagctggacgcgagagcgcacagcggcggggcggccacgggccacggcgacctagccgcccgcctcgcagccgccgaacacaccatcgccgagctgcagggcgcgctggactcgtccgccggggaggtcgaggccctccgcttggcgagcgaggtagggcccggcatgcttcgggacaccgtctcccgtctagaccgcgccgggcggcaggtgggcctctggggcgggcggtacgcgaagtacgccgccaaccaggggggcctcgcccagcgcctctcagagatggccggggtcctcaagcggctccccgaggagctcgaggagacgatcaagtcatcctcgagggacctcgcccggggggcagtggagctcgtactagcaagctaccaggccagggaccctaacttctccccgtgggcagcgctggaagagttccctcccgaaaccgaggacggcgcgcgcgcaggtccgggacgccgccgaccacatcgtctacagcttcgagggtacggcccctcggctcgcgttcgccctcgactccgacgaggagggcggtgacgacggtgcggacgacagcgacgacgaggccggcgacccgggcgcatcggagtgatcccccaggcccccgccaatcttaataacttttccttctttttccgaggccttcgggcccccttcttgtatagactgatttaatctgtaatcaaataaagaggaaatttctacgtcagttatgtttgttgtgtgtatgagacgaggatggtctgtgccgcggtccttctgtgtcttggcttgaacgagggctcgtgcctaggtcccagcctcaagcggcgcgggtcggggctagtgcctggggagatccgcgtgtcgagactggccaggccgggagcgtggtgatcgagggttatggatgaccctattgtgggcctttgccgatttccccccggagttcaccacgccccggggcacggctcggttctgggccccgtttggcgattttagccggcccgggccactgagggcagggttgagcacgagcgtgctaattcaagccaagattcttcaaaaggaaacgatggcacagacacagtcctcaggaaatcgaaagtgcttttattgaaatacggaagggagaaaggattagtatatgcatgtggtagcccccggccaaccctgcacgcccggggggggtgcggggttggcccgagcccgagacatgacacccgacccccactaggggtagaagcgacgaaggtgttcgatgttccacgggttaggcagctctgtgccgtcgcccgtggccagccgaacggagcccggccgggggacgccgatcactcgatacggaccctcccacattggtgagagcttgctcagtccagcacgcgtttggacgtggcgtaggacgaggtcgtcgacgcagagtgatcgggcccggacgtggcgctgatgatagcgccgcaggctctgctggtagcgcgcggctcggagggccgcgcgccgcctttgctcttccaaatagtcgaggtcgtctcggcgaagctgatcttgatcagcctcgcaatacatggtgacccgaggggacctcagggtgagctcagatgggaggaccgcctccgcgccgtagacgaggaagaaaggcgtttccccggttgctcggcttggcgtggttcggttcgccctgagcaccgctggcagctcctcgatccacgagtcgccgtgcttcttgaggatgttgaaggtcttggttttgaggcccttgaggatttccgcgttggcgcgctccacttggccattgcttctggggtgggcgggggaggcgaagcagagcttgatgcccatgtcttcgcagtagtcaccgaagagctcactagtgaactgggtgccgttatccgtaatgatacggttaggcaccccaaaccgagcagtgatgcccctgatgaacttaagcgcggagtgcttatcgatcttgatgaccggataagcctcgggccacttagtgaacttgttgacagcgacatacagatactcgaacccgcccggggcccgcctgaacggacccaggatatcgagcccccagacagcaaacggccacgaaagaggtatggtctgcagggcctgggccggctggtgggtttgcctggcgtggaactggcacgccctgcaccgccggaccaggtcgaccgcatcgttgagagccgtcggccaatagaaaccctgacgaaaggccttgccaaccaaggtgcgtgaggcggagtgggctccgcactcgccttcatggacatcggcgagaagctcgacgccttgttcccgaggaatgcacttcaggaggactccgttagccgcgcgccgatagagggtcccttccaccagcacgtagcgcttggagatgcgccggacgcgttcactcccttcgcggtcctcgggtagagtcttatctgcgaggtacgcctggatctcagtgatccaagcaatcaatctaggggaactgggagcgctcccctcgggtcccgaggcctggactccgacgggcctcgagggccgttcaggcgcgtccgtctcccctagggggtcgggtcgcgccgacggctgggcaagcctttcttcaaaggcgcccggtggggtctgggctcgcgaggaagcgagccttgagagttcgtcggcgaccgcgttatcccgtctgggcacgtgccgaagctctatcccgtcgaaatggcgctccatacgccgcacctggcgtacgtaagcgtccatctgcgggtcagagcactggtactccttacagacctggttaacgaccaactgggagtcgcctaacaccaggaggcggcggatccccagtccagctgccactctgagtcccgcaaggagtccctcgtactccgccatattgttggtcgcccgaaagtcgaggcggaccaggtatctgaggacgtctccgctcggcgaggtcaacgtgacccccgcaccggcgccctgaaaagacagggagccgtcgaactgcatcacccagtaggcggtgtgaggcagctgcgaggggcccgagctggcctcgagggcggagacgggctcgggagctggggtccactccgccacaaagtcggcgagggcctggctcttgatcgcgtggcgtggttcaaagcgcaaatcaaattcagagagttcgattgcccatcccgccaccctggagcgcgcaggagcgcgcccgcagcctggagcgcgccctggggcgtgccgccattgccgtagacgaggcggcgacgcgccccgtctcgccgtcctcccccgtcgcccgcgggcggcgaagtcacggatcctccgacctccccgagcgcctccccacgcccaagatttcggcgagagggggacggtggggtgcgagcccgacggcgcgggttctgctccccgtcgtcaccgctagcgctcggagagaggctgtgggccactgcccgttcggccattgggctgagcggaagaagcttggcgcacacgaaagaggacgagggctcagaaagacacgcgcgccccctacctggcgcgccagatgacggagcttggggctcctcaccgggagaccgcgcaggcccccctttgccggttcggccgggggcgctatgtgaggttcttcgccctcgatctaaggaacgtcagcgagaagaatcgcacaagacacgtgcgacgtagacaggttcgggccgctgagaagcgtaataccctactcctgtgttctggtggatctgagtgtgaaggaatacagagagctg

SEQ ID NO: 65888 - DNA, 10381 bp, Oryza sativa
ttcaaccttcattcaatggccagggactttcttccaatgcttgcagctgaagcctggcatggatctgaccgggactgacaaaccaactccaggagtcagcacgccggctccggctagggacaagagccaggaagctctcatcattccgacaggacggggcgaggcgtgtgacaggccgcctgttgccacctaacccacgatctgaccggtctgtgaccggtcacataccgcgactggtcacggaccggataagcatgcgctgcgccgcattgaatacggcgcggcgcgctcgtctaacccgctataaatgcggttaggtgagggccgctgtgttcacctaacccacacacgtggcgcccacaccacaggggatcggggcgccccagccctcggggccgaaacgggagcggcccgacccctcggggagacagagggaggggtggccacgtgggtgatcgcggttacccaagcctcttgtcacgatacccccggccctatgtcaccgacatacttctaaattgtatttctatatttgtatttctatattgaccttaaatttttcttcccatgtttttcttaatttcgaattttagttatttgaaaattatatttttatacggactctaaactcttcttttaattttattatgtttattccaaattttagttagttttaaattcctatatggactctatactctacttctaatattccttattttttaattccgaatttctttttttttcttaattgtatttctatacggactctatactctacttctaatattccttatttttaattctgaatttcagttatttcctaattgtatttctatatggactctatactctacttctaatattccttattttcaattccgaatttcagttatttcctaattatatttctatacagactctagtctactattctaatattccttattttttaattccgaatttcaactatttctaaattgtatttctatatagactctagtcttctcttctagtattccttattttttaattccgaatttcagctatttctaaattatatttctatatggactctgttttttcttttttctaattaatgtgagaatatctaggccatgagagcgatcgtggagactcctttttctattcctttaataatataatagattaaagatgcttccgccgtccgtcatccgtgtttgaatcagttataaaaactaaagatatttccacggtttgtcatccatgtttgagtcagttttgcaaaaaaaaaaaagctaaaaaaacaaccgagaaaaaaagtccgactcccctacgaaagcggtgaaaaaaaagaaaaagaataaacgtagatccaattccaaaactggaaaactaaacaacgaaaagtcgggaaaaaaagcgcggcctctactaccagtccaaataaaaaacaacctagaaaaaaagagtccgattaaaaaaagaaaaggaaaaccgtagatacgattgcccttaaaaacagggaaaaagaaaagagaaaagtcggaaaaagagcgcggcaaaaaggaccgattttaatttgttttagtagtatgtatatactattctctatctctaatctaatctaatcttactatgtacaaaaataagttttcatcgtacatttaaaaagaaaaatacgtgacaaaatgaaagcggttaaaaaaatatgtgagaaaaaaatgtcaattaaaagcgcaaaagaaaatgtgttggaaaaaaaggtttccttcatccgtaaaaacaaaaaaaagaacgagaacaaaaaagggtttccttcatccttaaaaaagcaaaaaaaaacatgcaaggaaaaaactatcagaaaaacacgccatttcttaaaaaatggtttgaaaaaatcgcgcaagaaaaaaaataccatttataaaaatacaatccgctctaagaaaacggttagaaaaaaaagataaattgatgaacgcttgggtcggataggatccatcgggttttttccatctcctctacgatcgtcatttattctcatgtattggagaccctgcgtatctctgtaggcaattatcaaactatttttgttaagtatagctactattcttgataacatattatatggaaataatattaaaaaataaacatatttttaattgttatttagagaagagtgctcaatgactctattttgtgtagacttggtcatgcgagacagggtaggatttaattggtcctattattggttgcaggaatgagattgaaagagtattttagattatatgtatgttgccacatgaataatccaattattttagataaagcaaacatcggtaaagttgccatcgtcgaggttgggctattatattgaagatgttccaattttctgattgtcttagctacaaacgatctatacaaacattgccattgacatggttatgcatgaaaaatgtatattatcattagaaatttttcacctgttgcaacgcacgggtatttttgctagtctaaaaaaacgaacctagaacttgatgtgccacatcatactataacgaatctggataaatatatgttcaaattcatagtactagaaaatgtcacatctagtactggggtgtagtactggggtgtatttagttcacgcaaaattagaagtctagttgaaattggaacgatgtgacgaaaaagttgaagtttgtgtgtgtaggaaagttttgatgtgatggaaaagttggaagtttaaaaataaaagtttggacctaaacaaggactaggttggtttttttaataggacggagggagtactctgtaggtttcaaaataagtttatttttcgccaattcaacacataccaatataaaactatacgaaccaaaatattcttactttatcaaatcgtattgcaataatcttttaatttatttacttcctgatatatttatctccaaattttataaacttcgatgtaatgattacttaaaacaaatttattttataacaaacgagagagagaaaaaaattaaacttagggcccctttgaatcaaaagatttatgtgcgaatttcataggattcaaatcctataggaaatttttctatttagccctttgattcaaaggattgaagatgtccaaatcctataaaattcctatgaaatgacacattgcatgtggattttagagaaaatgtagcaagaacttcaacctcttggaaaatttcctttgagtctatcgctctcctccgatttctacatttttcccgcgctccaatcaaatgacccgttcatgtgttttgcaattctctgttttgcacttcaattcttattagaattctgtattttttttctatttctctattttttcgaccctatgattcaaatggccccttattatgatacgaagggagtactaccagcttccttacatttgacatgaccattcttgccctgcttggagtgcagcacaactgcacaaggcaaatactactggggctctattggagtatagacttctactcctacttgagttaaatctaccacattattcttttctctgtggttctgatcacagatcaaatttaacattgttcgctactactaatgtatcagaatcctgttgagctcatggattcagtacgatttcaagtctgggtattaatttgattgtagataaaattcatcacaagaatacaagataatgcaggactctggaagggtggatcgttgagggaaaaaaaaggctgagaataaagtatgagggcgttcacagcgcaagtacgtggtgtttagccccacatcaagaaaccgaatattcgatgtcatatcgctaatatgtggagccaaaacaagacactcgttcttcgccttgctcgagggcttgcgagttgcaacacagggaggaacgcgcgcagccgcgttgtgaagggcggagccttacgcagcatggctttgcacatgcgtcggcgagtgaccccctccccccggctcaccgacgtggaacctgtattttagacccgtatctctagcctatgtggcactgtgaggctcctcaaactaatgtgactgtactgtgaacatcgtctagttaaatatatacaaacatatatatttttttcagaaacttttgggtattcacgtgatacccaagaaccctctggatctgcccaagcagcttgccaaggagctgatttgattgattttgccaacgtaatcttcatcgctacctaggaaaaaccgacttcttcgctggaaagaagcagcagctttgctcaacaaatggcaccaaactcaagaaaagtttcattctgaagacaatttttgaccgacgaaaatgcagcaagcaaagcataattaagcatcctctagtcatcagtcaaacgtatgctaccatgctgtcaggaaacttcggagttttgtaagtaaaccaacaactttggatcataacaggaagatggagtatgaaagagtactaaacagatgaagcatatcctcttcagtgatacttttcttgtgtctgaaacaacttggaattagacgaatggcccacaaattcccttttttttacttgatttgctagtcttactcgatcataataaatatagcaacatcaactacaaccggtcaatcgaggtttttgggcactgatcataataaacataatgtcaatcgagtaacatttagtttaaaataaaatactgctaacatttactagtacctggacaaggtatgcagaaagcaagcctgaaatctgaaatctgtactcctactggcctaccttatttaccacactgcttcccaagttctctgttcatgagggccctactatttattctccaggatctgggcccaccagccaggatagcatcaaaacaccctgtccatgatccaaattcatgcttctttgtactagcaaaacaccaatgtcgccttcatgtcctagacagggtttcaaaaaccgccgggggcccggttaccgccacccggcggtacggcggttaccggcggtaaccgcggtaaccgcgcaaaaccgcgacaaatttacaaatcgaaatttgaattcaaaaattcgggcaaaccgcgcggtttgacgcggtaaccacgcggtttggcgcggttaccgcgcgatgtgtaatgggttgcacagtaacgggccggcccatttttttttctttttccaattttcaaatttattctccgttttgctctcaaatttgaataaatattactcttttttgagaaatttcttcaccataaaacactataaatcaagcactaccttcactattttttttgatttttttctttttttttaaatttttgaatttggacgaattttattaaaccgtaccgcgcggtacgggtaaccgtacccccgcggtacgggcggtaaccgcggtaaccgcgcggttaccggcggtttttcacaccctggtcctagacaactgagacacaacttatcttccttggctgttcatgttcttgcagtttgcttcgtcagatacagtcatacagaacttaaatctttttttcttcacaagctgtgagtgttgtctttagctgtggatgcaagctttgtctgaaccttgtgtcctccttggtcattcatccattcattcatggtcatgcactatattccaagcttcaagctggtcttgtcagtggcctgcaacattaaatgcactttgccatgttagcttcagcatatccctgctgggagagaaaggtgaatccaccattgctgcctgcaccttcttgttgcttgctgcttgcattggccatgttcattcagtgagaaaatcagaaagagaaaaataagggacagttgaaagttgaaacccagttagttcattcatggcttcttttgttctcttctccgaatggaaacaaacggcaaaagggtttaccaacttgtgtgttcataatcaaggttaataatggaagttgcatagcattttggtggcaattagcatcacaagggatctgaatgcacttgtctgaaggaaaactgtatactacaggaatggatgcaggtttcttgcaagacctgcactgcattcagttgagttagatttgactataacagtacaacctcttgaatggatctggtaattagcacataattgataattgcatcgagttcgacagtttcaattggttaacttgaccagaactataattgcatatcattccatctctttcggagtttcggtctttcctagccaaatgattattgtcctccagtcttctctgaaatgatctcatatgcagtatttttttctgctgaacttcactcaaatctcatatgaagtataggctgtgtttagatccaaagtttagatccaaactttactccttttccatcacatcaacctttcatacaaacacaacttttcaatcacatcatatctaattttaaccaaaatccaaactttgcgctgaactaaatacagccaaagcataactgtattacccaaatctacataaagtgataaaagatcatgaatcgaaaaataattcaagaacctgttgttctagttgcaaatagtcatcaaaagctcaggcatgtcaccttacaaaatgttactacaacaagacctgccttttgctcaacatctcaagtgagagaatcatctgacaacaactaatacaacagctacctttgaaattaatttctacattagtagcaatacgacttaaacctgcttataatactagataagtttagcaagtctaaacatgtaatctgaattaattttttcgagcttggtttcacatgacgctgcaagagttggcgttgtcgtcgctgaaaaggtcgccgtaggagttcctcgccggcgaggccgcgctcctctgcggcgtcctctggccgccgccaccgccgccgccgccgccgccgtagtagtagtagctgtagtagccgccgtagcggtaaggcgacggctgagactgcgagtagtacggcgagtacgcgtacgagtgctcctgcggcggcgccggcggcaatggaggtggaggcctcgcggcggatgcaggacgcgcggcggcgtagtacgccgcgctcgagctcggccgcgccacgttgtagctcatgacgtgcaccggctgctgctgcaatggcgccgccgggaagtggtggctcgtgtggttgccctgcgttgatgccgccgccgccgccgccgtggccatggtggcttcacctgccttctcctctttttgctgctgcgccggctgctgcttccttctcctcttgggctcactgggctgctgcgccttgaccgttttgacgccgccgccgccgccgccgccgtcgccggcgctctcactgacattggcgtcggtgatctccgtgccaccgtcttcagccggcgccacggcggcggcgccctcgccggcgaccttcttgggttcttcatgcgtcacctttgggtcgcttggctccgcggcgtcgccggacgccggcttctccggctcagccggctcgccggacatgcccggctcggcagcttggttcttggtttcttcttggcactgaccaccattgggttgctgctgctgctgctcctccggccattgctcggcgtgcttcccggccctcctcagcttccttacgagagtgtcggcgctgaccttgccggtgacggtgaccgtcgccttgttgctccggccatcgacgtcgcatctgtacacgccttcggaatcaacagagcacattattctgtcagttttagtcacgtttttctctgcttttttgaagtgaaaagagaagggaaaaaaaatctgtttccacagatgcttcgccgatgaaactactaactgcagcatcaaaaaatggggagctaaaaatgcatcaaaatgcaggtgatttgatttgatttgatacaaacgcacacaccttcaactctctggagcaccttcttcaccttcttcttgcatccctcgcagtggatggacactctgagagccaaaacctgcagcatgaatcaaatcataatcaatcatttaaaatatctctgattgagatgaaaaataaatgttctctctcattctcaacctcccagtggatgtgaatgcatgcagaaggaagacaaagtagtgagattgtgagtgagaatgtgtcgatgttggtagtctggtaattggtaccttgcattgcagagattctgaagccatggaggaagggaaggtatagcggtggaagaagggaaagtggccaatgagtgtgtactgcactgtcaacggcgcatggacgagggaggagaggttttatagcggcacggagtacctacctgtagttcagaacgccataaagaatcaccactgtttcatgtaaaattcgtggtacaaatttgtaagaaacttctttttttttattttacatattacgtgaaagacacgtacacaacaaaaaacaatgctgttttaaatggactctttgccgataaccgattatgtaacactagtttatatagcggttaactttataactcttttgaaacacattcatatgaaaatataggaatgtgccgcgtgtgtaaaatagaaacacgaaaaggtataaaaaacatttgactgattttttaatggttggtagggaaaaaataggaatactgagtattaagttaatagtagatctcaatgccttgatccatacaacttgaggccaaatatacttttagagaatgctgttgatcgggcgctcgggggagcgcagcaaaaatcgtcccccccccccacccgacgcgcgtggacgcccctaggaccccaccacccacactgccacgtgtccccaccacatactctattgtaataaatcacccacatattttagaaaaacctctattaggagatttcgtttaattttttgtttcgcctagtgtactcacaatgtttcactatgtatagatctaatgttgcaatgaactgaaatattttttttcaacaaatcactcacatattttggaaaccctctattaagggaattcgttttattttttgttccacaaaaaatgtttcatctagtgtactcacaatgtttcattatgtatagattaatgttgcagtgaactgaaatatttttttgctatttgctgaaacattgtttttatataaggtgaaacaacgtccgatttaaacgattaaaacattttcgatctacttagtgaaacaattccgatatacttagtagaacattgtgcaatattttaaaataattcaataataagctaaaaaaatcgtcggaatatatccttgtgtggtcttgtcttgaagatttaattgtaacgaatttaatggtgcaatcggatcataatttggataaataatttaagagaaaaattaatttaaagcggttttgtatgtatgcgtggcgctgatgtcatgctaatattagcgtccgatttttgccaatccggatcgggcgaccgatccgtagtctcctcctatatttatgtcatgacaacctattcctatattttttttagttcccacgtgtttttaaatcatgtgttctaaaagaaccctaaagaatttggcaatttccaaccttagtattccaaacaaccctcataggaaaataaatcctccatatttctcataataataatatttgcctccacccaacacgagctgggaaaaacatgagcgtggagtgggtttaacgggtctggatcccctggagttgagtataactctaccgggtggagttggccaaatctgtgacatccattgtttcctacagctgagatcattcctcatcaatttcacctaataaattaactccttaaattaatggttatgactttcgaggaaactttttttcatgcattttctctataaatagcgatttgattaaattctcaccaaaaaaaaaataatagaccagtgttttgttattgcccaaacaatagatataatcgatcaactctaaagcttcaagcagtctataccaacatgtatagtgctttcacatacagtgaaccatatcaatattaatgtgtgtgattttttatataatagatgaagcattaaattttttgctaattatacagtaaaaatgatctcatgacaagttgttgatgcaagtttatttgttgcatggtcagttactggtttttaagtacaaattaatgtggcttaatctcaacccttgaagtataccgaatggcacatgtttaaccaactacaaattaatgtggcttaatctcaacccttgaagtataccgaatggcacatgtttaaccaactccaccctgtagagttatatctaactctagggaatctggactcgggtttaacatttcctttatttttcctccggaatcacagggaaaggaaaattttatagcttttcttgtgttcattcctacgagaccagacagtcagacaatgccaa

SEQ ID NO: 65889 - DNA, 13515 bp, Oryza sativa
atgtaagtcattctaactttttccacattcatattgatgttaatgaatctagatagagatatatgtctaggttcattaacatcgatgttaatgaatctagatagagatatatgtctaggttcattaacatcgatatgaatgtgagaaatgtaagaatgacttacattgtgaaatggagggagtagttcactaatccgttcgacaataagaccagcagtaggataagaaatccagacctccaaacgaaaattgctatacatatacgacctaactgttcgacttatatattactaaatttgatcaacggttgtaaatgactacagtgtatatggatatgctattctttcattaatctatggttacatgtttcgttgtatatgagttgtacaactagatcctatgtaattaccaaaataaacgaacaatgaaaatgaaaaaggttggaacttgttgctgattgctcataggatcatccataactaagtcagtctgattctttatactcttttttcaggccttgaggggagtcagagaccaacagcagcttctcatttcaagaatgcctacagataatgctgccattatctgttgagagtgggaggtgaactgaaacattgagtagcgatttggcgcatcaaaggaaagaataaatctaaacaagtgcttatcggattcattctcagaagctggttttttcttcggatttgatataaatgtgttgccatatttttcatgaaaaaaaatactccatcctttccaaattgatcatcatataatggaatccaaaatttctcaaattgattatcatataaccacatgaacacggatttcattaaaatacaattaatgccgcataagagaatatgtgcatgctagggtgtaattgacatgatgttttaattgatgcatgtattgcaggagaatgtgtgcatggtgtcttgattgatgtgatttaaattatccttagtcttgatgcataaacatatattccctccgtctctaaatatttgacgccgttgacttttttaaacatgtttgattgtttatcttattcaaaaacttttgtgaaatatgtaaaactatatgtatacataaaagtatatttaacaatgaatacaatgataggaaaagaattaataattacttaaattttttgaataaaacgaacggtcaaacatgtttaaaaagtcaacggtgttaaatatttagggacggagggagtatgattatcattttgggatggagggagtagtcagtatgtatttatattgtactaagtccctaaattatatatgtaattattaattatagtgtatctagaatataagttcctaaattatatgtgtaagttccaaaattacgtatgtaactctctaaattacatatatgtaattaattacacttgatttataatataattatatttgacatatttttacaaaaacctgtggccgtagatagttttctttgaaggagggtacacaagcatatggcacacacataccaaacctaacagatgcagttactgatatgatccatccacaccttctgcaagttcacgatttcaaggatgcatctcccatgtatcctgggatcacgcatactttgcagggccatgtatattcctgtagcaaaaaacaaaataatccaaccaaattacaggtttaatttcgagagcatatataaacatgggatcactcacgctaaattaatttttgtgctgtgcacgtacacgattgcattgctactgccatggctcacatgatgacgtcatcacccactgcctgcgttgtccttgctcttgcctttgtcctcctcgcagtgacgccgacgctctgctacgtcactgacggcgcgacgcggcggcgaggcgcgagcacgagccggcgccatggcgaagctcggacttacatcgtgctcgtcgagccaccggatgccgacggcgatgacgacgaggccgcgcaccgccggtggcacgagtcattcttgcctggcggtggcggtggcggtggcggcgaggagcgggcgtcgccgacgcgcatccgccactcgtacacgggggtggtgtctggcttcgccgcgacgctgacgcgcggcgaggtcgccgccgtgtcgaggaggcgcgggttcgtgcgcgcgttcccggagcggaggttgccgctcctgacgacgcgctcgccggggttcctcgggctgacgccggagcggggcgtgtggaaggcggccgggtacggcgagggcgtggtcgtcggcctgctcgacaccggcatcgacgcggcgcacccgtcgttccgcggcgagggcatgccgccgccgccggccaggtggaagggcgcgtgcacgcctcccgcgcggtgcaacaacaagctcgtcggcgcggcgtcgttcgtctacggcaacgagaccggcgacgaggtggggcacgggacgcacacggcggccacggcggccgggcgcttcgtcgacggcgtctcggcgttcggcctcgccgcgggcaccgcctccgggatggcccccggtgcgcacctcgccatgtacaaggtctgcaacgaccaggggtgcttcgagtccgacgtgctcgccgggatggacgcggcggtgaaggacggcgtcgacgtgctgtccatctccctcggtggcccgtccttgccgttcgacaaggacccgatcgccatcggcgcgttcggggcgatgtccaagggcatcgccgtcgtgtgcgccggcggcaacagcgggccgacgcacttcacgctgtccaacgaggcgccgtggatgctcaccgtggcggccgggtcggtggaccggagcttccgcgccacagtgcggctcggcgacggcgaggcgttcgacggcgagtcgctcagccaggacaagcgcttcagctccaaggagtacccactgtactactcccagggcaccaactactgcgacttcttcgacgtcaacgtcaccggcgcggtggtcgtgtgcgacaccgagacgccgctgcctccgacgagctcaatcaacgcggtcaaggaggccggcggcgccggcgtggtgttcatcaacgaggcggacttcgggtacaccatcgtcgtcgagaagtactacggcctccccatgtcgcaggtgaccgccggcgacggcgccaagatcatgggatacgccgcggtggggtcgccggccgcgtcccacaacgcgacgatcgtgttcaacagcacggtggtcggcgtcaagccggctccggtggtcgccgccttctcgtcgcgcgggccgagcgcggcgagccccggcgtgccgaagccggacatcatggcgccggggctgaacatcctctccgcgtggccgtcgcaggtgcccgtcggcgagggcggcggcgagtcctacgacttcaacgtcgtctccggcacgtccatggcgacgccgcacgtcaccggcgtcgtggcgctcatcaagaagctccacccggactggtcgccggcgatgatcaagtcggcgatcatgacgacgtccagcgccgtggacaacgacggccacgccatcatggacgaggagcaccggaaggcgaggctctactccgtcggcgccggccacgtcgacccggcgaaggccatcgacccgggcctggtctacgacctcgccgccggcgactacgccgcctacatctgcgcgctcctcggcgaggcgtcgctgcgggtcatcaccggggacgccgccgcgacgtgcgcggcggcgggctccgtcgcggaggcgcagctgaactacccggcgatactggtgccgctgcgcggcccgggggtggaggtgacggtgaaccggacggtgacgaacgtcgggccggcgagggcgaggtacgcggcgcacgtggacgcgccggggtcggggacgacgacgacgacgacggtgaaggtggagccggcggagctggtgttcgaggaggcgatggagaggaagacgttcgcggtgacggtcacggcgagcggcggcggcggcgcgggcggcggcgggcatgtggtggcggaggggagcctccggtgggtgtcgcgacgtcacgtggtgcggagcccgatcgtggcggacagtagcgtcggcggccccagccgcaggtcggcacaagatgcttaattagttgccgccttcggtttgatcaacactacatttatatactatcgtcaattaacccatgtcatcgatatttatacatttcaagaggtaaagtttacagcaaattgtctcgaagtttacggtcgacggtagttcgtttacagtgatatggtgccttgaatttttttttttcacaagacggtttgaagttccattgatagagcatgaaaatccttgaagaccgtaaccaggaaaaacgaaaaaattataccacctcccacacaccgatagcgctaacacacaagtctagaagaaggctagcactggaccagccgatgctgagcatgaccgaccaccgctaggccaacaacagaacacagtcgagatcgtccaaaactcgacccttaaatccaacacacagcctaactctatccatgtattcaggatttagggagagagggtgagagagaagttagaacacctcgaccccctaggccctccgacgtggttaacttgtagaaattaggacgctgccacaggaggatgagaatctagagtgtgcttgcatcaattgtttgggtggtttcggcaaggggatgcctggacgacctctccaaggagagaagcgacggaaaaccgccgtcgccatccgtcaaggtctcaatagagccgagactgggttttctcccggcaaccacccttgagggggtgagacggcacaacaacgccctcaggagggaggaatgacactcgagcgccattgttgtcggtccgaccaaggttgggctgggttttcacccgccatccaccacctgccaatctactacaaatgcaccaatgctccatctccatctaatcctccgccaccaatgttgcaccggcaccccccgccggcccgtcgtcacgtgttgccacctcaccgggctccaactccagtgacatcacctcccgctgcggcctcgatgctgctggccgcaactcctccgccgtgccagatgccggccgagtctcccagcctcaccggccatccacagccaccggcgcccgcgcatgccgccacctccgccactcacccaacacctcgaggaccatgggcagatgaaacacaacgaagaactttattgatttttgctatacaggacatgagctattggaagggaagatggtcatcacgggctcacagacaaatcaggagagaaaggaagagagaaaggaagagagagaaccagatgaatggggaataaaatattagtatttacattagctgatgttagaggctgtttattgtactactatgagcaggtacaatagcaggctataagccagctacaaacatattttaaggagataaatgaggagagagaagagaagcgggctacagatttgtagccagctgtagcacagactttaagacacagtgtgtgtatgacaggtgggatcaagtattaatagtgtagtatgtaactattgtatgaatgagctattagattggctatagataaattggagctagtagttgactatactattgaacttgctctacatgttaactactctgttgcctgttggcggtaaatgaggggtccatgcataggattgcaagtgggatgggttgtgggccgtcccgccccaccccacaccagccgcaaactgcatgtgcgggcaaacggcagcccgccccgcacggcttggcgggattgctcagcccgacgggcaccgctggacagcccacaatgtgcacatctctgtttaattaggttcatcaatcacacaagcacataactactccatatcccaaatttagcacatgaaaactgtattattttcatgtgaaagtattctttttcaatgacataacaagtatagtactgaataagaacaccattcttttccttcaacatcatgactaaagttagagtgatgatgatgcattttctcttcatgataaaccaactgtcccaattgacaaagtgacaaacaactgcttccagctccatgagctcttccggtctttttctatattaccttcaacacattaaatttaataaagttggagtggagaaactactaatcgaaaattagaaatgaattcatcaaccgactgatcacaacgttattccatattgtagaatggagtaaatatgtactaagtttcatcaattaagaatgcatccaaaatatgaattaaaggacataattgacaataacaagcagttatcgaggatagtgagatatataacctgctgctggttgttgtgctggtactgcatgttactagaggtgtataggcattttcacctgtataggaagaaacaatggagttaataaaaaagagtacatgctggactgttggatgttaataaaaaagaaacaatgatgttagtggtgtagtatacaactatacaaaaatatagaatagccaagttaattcaaacgaatctcaatttaaatacctgaatgttgcacattttggtcatcactctcagcaagatcacgtgcaaagaaatcacccaaaccttctgccctcatccaatcttgaaggcaaatcaatgcctctacagtactgcttgaaagtctacttctatagtcactaatgatcctttctccagttgaaaatgctgcctctgatgccactgatgttgctggaatagccaaaacatcacgtgccattcgtgaaatcacagggtactttgttttgtttaccatccaccagttcaagatatcaaaatcatacccatcttggaaatcaccttcctgaggcatatcagcaagatatcgaataagctcactctttactttgctcctgcttttgtcatgtagaaactgtctccaatcagcgaattgattacttgcatcaacattctgctcaacacttgtttcgggctgagaattgatgttgtttgagcccccatacttggcagaatattcatcaaacaatttctgcatattactcttgatttccttaaggtaaggagttacagcagctccaaatgcagacttcaaacgaaactcaatgaatttgtacttataccttggatcaaaaataatcgggaaacatatttgcaagtattgagcgtcccagtacttcttaaatttttctttcatttccttgacaatagatgcaatggtgacatcttcatttgtagcctccttgtccaaaaccatctttatcttccaaagttcatgaaaatagcaagttgaagttgggtacaacgtaccagatactgcaacagtagcttcatagaaaactttcaacaaagcacaaagcttctcagccattgtccattgataatcgaagggttgatgcaaataatttatgtcatgccgatccaaggcttcaaaggccattctgtgtcatgcatgtggttcgactttttgtgctcctagatggttgaagggaggcggcgctgcgggcgttgcaggaggaatgtgcgagcgtgctgctagctggccatggcggtcaatttgttggactaatcagcatagcacacaccaaatccgagaagaggaggagcagcactgcgtaaaaaaaatactccatctgcgaagaagagctagcacctaacgcagataggagcatctcgcaagcgatcgagacttcgagagcatggagccacagctgccgaccgtgatatcgatggagtgggatagcaccaccgagccggccaaatcgtcgccgccgtcacagaggtacggctacctggagaggatccgtaacttgtccgtcgtctcggccgaggccggccggtggtggtggccatgctcgtcgtcgtcgacggcgagatccagctactacagcagcagcatgtcaagcagcgtgtccggtactggctctcagaatcaacggtacgtctcttactcttcgccgaggatggtaagactcgacgtccatggtcctcgagacattgcgaggcagatggtgcacgatgcatgggttcatggtgaacttgatcagagacttcgaccgggagcccgaccatgcgctggagaggtggttctccgagctcgacgtcggttgggtactccggtcggcggcggagaaggagctagccgccaagctcggcttggatgatcttgtgcagcggtggacgcgaggatatgccgtgatggtcgaagcactcgtagctacgcagcaaaatatgaaatttcaggatcataccaatatggagctagaagacgacctccgacctctccaagtcactcggttcgtggaggcgaccgtatccaagatgcttgcctttgctgatgccctcgccgctgataacacttggcggccaattgacaagctctcgcggtcgcggctcatgtgcctgtgcacctcgatcaacgagtgcggcatacgaatcttgtcagaaataatagtatttgagtttgattgcatattcagcaaaatgaatggtgctttctcagccatatacaggatggccaaggatgctgaagccatcacttgaaagaccaagaacgactatagagggggggggggtgaatatagcaattcaaaacttgtccccaaaaatactcatcaagccggatttctcaaaattcttactagaactgtggctattagagaagccggatctagaaaagaagagagatggaattcccgaaactagaagtgaggtgaggagaagatagcaaaacttgtcatcgcaaaattcaaatcgcaagcgaaatttaaattgcggaatttaaaaggcgaagacaaaacgaaatgcttcaaatcatttcattcatcagtgttgcaaaataacagctcaactaggagcaaacatacaccttcagaggaacattaacacaaacttaaaaatcactcggacaaacacactccaaactaatcctaatacaaaagcctctcgggcaaacacactccaaactcacaccgaaactctctcaccgagcatctcaaaaggattacaaaaggagcaacctccacccttgcatccacctctctatttatagcctaagaccccctaaaacattgtcacaaatgcccttagggcgaaatcctaactcacatgcaatctgggccatacgttgttccttacatcctaaggaagtagcctggatggaagccacgtcgcttgccacaccaggatcctcttttcacaaagaatccgcaccaaattcctcccatgtgcgtgcccgcgtgctcctcaacgtgagccccgtgatccgtgagaaggctcctccgagccaatcagcatgcaccgatcgggagatcgatccgcgtcgtctccgtcttgccgaatcaaaacttgccacgttgctcagtagtgctgtgcacgtcccgtctccttttcctcagcgcgcgcgcacgctcgcgcccagtccggagccgccacgtgtctcgccgagccgctccgcgcgtgctcgcgaaaaccgcgtgggtcccacgcccgtgcgcgccgaattgcttgccgccgcgtgtccactgtgcgcgcatgcctcgtgcaatctcccgcgcttgcccgcgcatggtgccgatgccgtgggccgtcgtcttgtcttgggcctgctcggcctggcctccctgccagctgatccatccatcatcttgagccacgaggaagggctagattggcttggcctccctgccaaccaatcacaacacacatgcacccatgggctagcaagctcctcatgcacacatgcatgtcttgagcccgtgcatggcattcggccatgtgcacgcatgcataaccgaagcaccactccccatgcttgcatatgcacatgccagtgcatgtatgcaagctcctcttctattctccattttcttcgcgaacccggcacttgcacttgaccttgcgaactccgttgcgaagacctcctcacacggtgtccgtccaccgtgtgcaaccttgtgtccaatcttgtcacccagcatccttgatcgctctggacctcaacttctccctgagtctagtcccgatccgccgttgaccaagatcgaccccgatcacctgcacacacatgaaccaaacaaccgttgtcttggcacatatgtcgcaacctgaccaatgttagtccacacacatacttcttgcacttccggtacttgtcaatttcccatcactaaagaactataaccacacatggtttcacaatctccccgttgatgagaacaatgacaatctcaagcaacattttgaaaatttaattttgattcacaaagcaaaccattttgcaaaagtcgaactttggtcattttgaaatcgcgaaaaatcaagaccaagtgacaagaagaaaagggatgcaaatgcaaatgcaaaaatgctcccccttgtgccaaaactccccctttcaccaagatctaaagcaagttttaattttcaataagtgcaaatttctctccctctttgtcaatgatgccatcaagatcaaaagagacaaaaatgagatgaaacttgcaaattttagtgttttgagagctttgagagttatctaaaggcatcaaaaggtagacatggatcacacagatataaacatgtgctcaagcctagctaagcatgtgcataagaagtatgaaacatgtcatggatatcaagatagtatcggcagcaagcaaaaagctttcaagtgaattagtaatttagtgtgcaaagctatttctagaagaagcttaaaaggaagcaaaccagctcataatcaagcaagatttacataaccaaagcaatgaacccatgctaatgtgctaatgcccagttcataaagagtatcaacatgataacaaaacatagaacatgagcttttaaacttttctcataacttttatttttatgtttttttaatttctttaaagacaatagcacaatcacgacggtccacctgatcttatcagtcagcaagtcatggttgtgccaaacactgccgtctgacctcaatcaagttttccagctagagttcccattacaggctgtctcagtgctatcttcggtactactcatgcgtaaacgcactcagtagcccgaacaaaaacagagataaagcttgtaaaacatgattgatacaaagtatgaacacataagcatgagcattcatgagcatgtactgacagttattgcaaaaagaatgtaaacatggcatgagtatgagatggatactttaacttaaacaaacttctagagcaaccattgcacattgattaagttcaaatgaatagtcaatttaagcaggtttcaacaagcttgaacagcataacatgatcacacaagctacttaagaaaatgaaagctagacaagagatcaaactagcataagagtgatacatgcatagcatagtgatgaccaagagataacaagcaaagctcaattgaagagtgtataatacaatgcataaagtaaacatgatgcaatatgttacaaatgcatgcaaaagaaaaacaattccccctcaaatcaagccataggggtggatcacccctaactcactccgcaagaactcaaaacgagagcgatcaagtggttttgtaaaaatgtctgccaattgtttttcagattcaacaaactctagcacaatggtacctttctcaacattgtctcggagaaagtggtaccgtatctcaatgtgctggtcctggagtgttgaactggattttttgcaatattgattgcacttgtattatcacaaagcagaggaacaccagagaaagacagaccataatctttcagagttaaaatcatccaaagaacttgactacatgcactagcagcagctacgtactcagcctcagctgttgattgagcaacagaagactgcttacgagaggaccaagaaatcaaagaagtgccaagaaaatgacaagtgccagaagtactttttcgatcaatcttacacccagcaaaatcagcatatgaaaaagctcgaactgaaagggcagaagagcaggagtaccaaataccgtactcaagtgtagacttgatgtagcggaagatgcgcggaagatgcgcttgactgcttggcgatgtgatgctcttggagaagcctgaaacctcgcgcataggcacacggagaagtggatgtctggccttgacgcggtcaggtagaggagggagccgatcatgcttctgtactcgcgttggtcaacttcttcaccgtcctcatcaggaccaagcgatgaagtagttgccatgggagtggcgattggcttgcagtcggccatgtcgaacttcttcaggagctctttggagtacttggtctgaggtacaaagattccttccttagtttgcttgatttgaagtccaaggaagaaagtcagctctcccatcatgctcatttcgaattccctactcatcacatcagaaaactgggcaacaagtgcacgagaagagccaccaaatatgatgtcatcaacatatatctggacaagaagaaaatcaatgccactatgaagagtaaagagagttttatcaatggcccccatttcaaaaccattttgaagcaaaaaggttttcaatctttcataccaggctctgggagcttgttttaaaccataaagagctttatcaagtttgaacacatgatttggaaatttggattttcaaaaccaggaggttgtttgacatagacctcttcctcaataactccattcagaaaagcacttttcacatccatttgaaaaagcttgaaaccttttgaagcagcaaaagccaaaagaattcgaatagcttctaatctagcaactggtgcaaaggttttttcaaaatccaagccctcaacttgggtgaaaccctgtgcaaccagtctggctttgtttcgaccaattgaaccatcttcacctattttgtttttgaaaacccattttgttccaatcacattaaaacccaagggtggttctaccaaagaccaacaaactttgtttctttcaaaattttctaactcttcatgcatggcattaacccaattctcatcagataaagcatggcaaacatttttgggctcaaaataggcaacaaatgctaaattgacaagttcataagaccgatttctagttaccctttcacccaggcctccgatcatcaagtctggcggatgtcggttctggatgtatcggggagctgtcggtcctgatgtgccaccatcaatctcctcagctgctgaagatgatgtagttggtgcatctcctgaaggcgatgtagtcgaaggagaaccggtttcttgcactggtggtgaactgtctagaggtggaggaatggaatcatcgtcatcttcatctgaatcatcttctacaaagatagtctcatctgaaacacctgaaatttccggtctagctcttgggctagcctcttcaaaagtgacttcacaagtctccacaattttgttagttgaaagaacatacactcgataagcccgagaatgagtagcatagccaagaaaaatgccatccacagatcgagattcaaacttgtccaaatttccaggtttaagaa

SEQ ID NO: 65890 - DNA, 751 bp, Oryza sativa
tagtggatcccccttttttgcttaccccaccaattgagctgagctcggcgatgaagtccttccttccatttattagggttttaaccgccacctcatagcctcctaaggacccgcggcagaccacgccaaaggcaccacgcccaatcacattcaaaaacttgttagtcgcaacattcaaatctcggtatatgaactgcctagggtcccccaatttccttaagatctaagtcgtcattgctccttcttgtccacataaaacatgagacaataatctacacaacaaccaccactagagctaggactccaacaataaataatgcttcatagcctgcaagaatatctcttgtaagacaagtatgtaccatccaatgcattatcgtactctgtgtacgagggctagacccattctataatagcatgctataaataagctataagcatactcccttcgtcccaaaaaacctaacctagttaggatctgaactgaaaatctgtccaaattcattgtactagattatgtcccatcccaatcctagattaggttttttgggacggagggagtatgcatgcacatcaaaggacacacattataggtaaaaaatatcatgtatagagaagatccttaaagtagtacttcctccgttttacaatgtaggtcattttagtatttctcatatttatattgatattaatgaatctacatatataatatgaatgtagaaaaggctagaatgacttacatcgtgaaacg

SEQ ID NO: 65891 - DNA, 4310 bp, Oryza sativa
  unsure (1)..(4310): unsure at all n locations
tttcaagtgaggttagacgtggcaggagctgatcccttgcacagcaaggtggctctcctttcaccagcgtgggacgccctattagcttatcacatccctcaatgcccaatgtcttcaaggatactaagcacaggaactcttcctctggccagtagatgagcacaccacagaaccagatttccaaacacacaagttgtctaaggcatttccaaaacatgattattggttgtgatgggctcgtggggaagaaaaagttgcagtgctttaagtccagttctgagagagatgattcgtgaatctgatcaagctgcactcttccttctttgtcatccacgtccagtattagcttggatttttttagataatggaagcttttattaaactcagtcaattacatcaaggtgatacaattatcctgagaacacttccggcctctgcataactaagatgcacaccgccgaacaaacaaaacgacactcgaaaggaaaaaagaatgacatggagtattgaggaccatcaatctaacgactaaattgccactcatgaacaactccttggccatctcctccaaaagcacagagttttaaggaccaccaattctaagactagatcaccacccatatccctgggtaaaaaactccttgaccaccttctccaaatgttgacatgccgcaactaccatatcccgcgaatcaggcttctgtaggatagcccatatacgaagccaatggataagagaatatataacctgcaaatgtgaagatatgacttttttatcaaaaaccacattattcctgtatagccaaagcgaccaacaagtagcagctgctcctaacagaacatggtgnanntttcaangnattattatgnaantntgccatcaagncgcagctncncccccaannannaccantngagtggnngccgnncnnttaanncnaacnannatggagngggttgggntggnaggnnaagtccagatgctgcttggatgatggaccaaacagaaagggcaaaacggcattcgaagaaaagatgtctaattgtctcgtcattgcaacaaaaacaacaattcttattgccttgccatttcctttttatcaaattgtccttcgttaacaccactccacggcttggataatgaggacatgtaactggcttggataatgaggacatgtaactggattgaagtaaaaacaaggacagttcggccttgttttcatttagactgaaaatcttgagctttggtgcttcgggtagactcctcagttttggacagttcctgatgtcagccttttcaagcagaggaaatgttgattcgttttccactagtctctctaagccctctaaatcatataacttgattttctttaatgctggaaatggtgtgaaagccatttcacagcatagtgtttgcagttttggacatttctctatttcaaccttctcaagcagaggaaacactggttcattttcttgtcttcctcctgttgctacccatctctctaaagcttccaaatcgtgcaacttaatcttctttaatgaaggaaatgttacggatgccatgtcagggattagtgttagaaactttggacagctcttgataacaacgttctgaagaagatgaaatgtttgttcttttccttgtctaacttccttgcaacatagggtttgcaatttatcaagtctgatcaaacagagaacttgaagagacttaaattgaatgaattgaggaaattcttcgcacattgtacaaccctctaatttgagctccaccaagttttgcagtatacttagatctgtcatccatgctggaaaaatgagtgcttttataggaaattacgttgagcatcagcagcccatgatgtggtttaagagcatcaagaaccttcccattgcaatttggttcttcaacacagcattcactattccacacaagagataggcgtgcaagtttctctttgtttctaagattggctgcttttgcatcttcttgagatacattttctaagccacgtaactctagttcaccacagaggtttaagctgtgcagttctctaagggtgctgcaaccagagctagcaccaaccacaaaatatgttagtgtccggatggaagttaattgcccaagctctggaggcatgcacttcaatcttaagcatccatttgtatagaggtgacgtagacttgtcatatacttcatatcctttgggagtctaacaagattatagcaatcaggaaggtttgatgtctgtagattgtacattgtgcttatgtctgcaggaagttcatggatattactgttgtctgagagatttagatatcttagatgttgtaggtgtcttggcctgattggtaattcttcccttcttgggagctctaatgctcttagctgtagagaattgtacttaaataaatgtgatgttgagacattaccataataccctcgaaacaataaagttcggagagctggagcttcatttcccataaagtcatctggaagagcaatgctggtgtatggtatgagaacgtgatataaaggatgttctcgcatcagatttttcaaattagacgaaccaattatactgagactatgtctttaccccataactagaattgacgaacatgtgcatgctataagcatcattgtactctctgcacgcttgcttctgctcaccggacgctcgactctcctatacaccatctcctccttccccgctgcacgaaactttgtattgcactatctgtgtaaaagaatgtaccttctcaaactatgtgtcctgtgacaaatgattcctcgggcctacctgtcttgccacgatggctcttgcctgcctgccagtggtactgaagctcatgtgtccataccatacattggcatccaatgttctcccacattcaatgctcatagatctctttggggaatatagcacacgaaagcaaagcactgcttcatgtgtgatggcagatcatcatagctcagccgaagtataggaaaaattttatcctccccttcattgcaaatgttgcttttagttaatacatcattccattcttgcatagtagtcctggtacttaacatagaaccaaaggcttttgcacctaaaggcgagccatgacatctgtgcacaatcttacaaagaattccaaaatgttcatcattgtttggcagagttaatgctctcctcaggattatttccttcatgtaaatttctcctagattttcaagattatgcacttcaacttcacccgtgaccataattctagcaacttctgcatctcgagttgttgttagtactgcactacccataccacccttcttaaggcaggtctttagctttccccacttatcataatcccgttcccatacgtcatccaacacaatgagatacttctttccacctacttctttctgcaggtcctgcaaagccttttcacgatctctctctgtgctcatacatatgttgtttgcaatagtgacaacatcaaacacatccgacacacaacaccacctgcggagcgggaaatgcttctcaatttcagggtcattgtaaatgagttgcgcaaaggtagtcttgcccagcccacccattccaacaataggaaggacagtgaggtccgtgttattagctttatcaagcaatatcctgataatcttcttcttctcctcatctctagatctgataacaatatccttgtcaaaatcaaccatgatggaatcagttttcctccactgcttgggtgtttcctgctggtgtacgagtccgaaggagttcatctccgagacaagttccttgattttctccacgatctttcgcagtttcttgcccatcctatatcggaagacaataggattacgagaagggaagaggcttacagagtccatgccaagcatagtgtggttgcggtgccctttcttcttggcctcacgccagagcgactcgtacttgaactcgtcgaagacgtcaattgcctcgtaggacaccttcttgagtgatttgagccaagcgcaaactagaccggatcgatgatttttcttctcctccgcatcttggatgacatcgaggatggctggaagcaagcgctccagagtctcacgctggtcctccatgccatccatcaccttgtacatgtctacaagaaagctggaagccttctccagcaccttggagagcagtggcccaaccaaatattcagccatcgttgctctctcaactctcaggagcaggagcacacggcaagaacccaaggcaagggcaacggcggctgttgctgatatgtagttctattggagagtgattaatggggta

SEQ ID NO: 65892 - DNA, 880 bp, Oryza sativa
tttttttgacaaactaagtgctttactctggagttatttccatcaaataagcttctccgagcttttcaagattatgcactggaacttctccaataaccataattctagcaacttctgcatttcgagttgttgttagtactacactacccatgccacccttcttaaagcaggtctttagctttccccacttatcagaatctcgattccatacatgatccaacacaatgagatacttctttccacctacttctttctgcaagtcctgcaaagccttctcacgatctctctctgtgctcatacatatgctgtttgcaatggtgacaacatcaaacacatctgacacacaacaccacctacgaagcgggaaatacttctcaatttcagggtcattgtaaatgagttgtgcaaatgtagtctttcctagcccacccattccgacaataggaagaactatgaggtccttgcctcttgcttcatcaagcaacatcttgataatcttcttctgctcctcatctctagatcggctaataatacccttctcagtatcaaccatgatggaatcagtttgcctccactgctttggtgtttcctgctgctgttttatgagtccagagtagtccatctctgatatacaatcttttgcaatttcttacccatcctataacgaaacacaattgggttacgatgagggaagaggcttacaatgcctttgccaagggtagcgtcgtgccccttcttcttggcttcacgtcggagcgcctcatacttgaactcgtcaaagacatcgattgcctcgtaggacaccttcttgagttcatcgagccaagcgcttagttcgggtttcttacttctcttctcctccgtatcttggatgacgcta

SEQ ID NO: 65893 - DNA, 733 bp, Oryza sativa
ggatcccccgtgtatattccctcaagaagctactaatatttggctgtgagaagctttgttccgtctcaggacagctggatgcactcaagcgcttaattattgatcactgtaataaactggagtcattggattgtttgggagatcttccgtcactacgaatcctccgtcttgagggatgcagacgcttgcaatcagtagcagggtgccatggtcgttacccacttcttcaagatattacgattaaatactgcccagctataaatgtgaagcctctgtatgaacgcctcgggcagcggattgatagtcttgagatcagagagttatcagatgttcattcaagaaatcctgaagaaggtccctttcgatcaaccttcccttgatagtagtactaccttgctgtactttttgcctgttgagaaactcaaattttaatcactactacacctactctgttattgttttaaagctttccagtcttagttctacatatatggcatgcatgcatgtggttttgatactagtttcttccttttgcccatatatatgaaaatgcacgacttattataatcttcactttcggattgtagtcacctgttctcataaccttgaaagttgaaacttccatttgcaggttaccctctagtctattaattcttttagtaagtgctcacctgatttacatgtttgaagtttgtttatatagaggaattctctctctcttattatcacagat

SEQ ID NO: 65894 - DNA, 1359 bp, Oryza sativa
cagttccgatgatctcttagaacgttggttccctatcccttgtttcctccgattgtttcgcatgagcactaatcactttctcccacaacttccaaagtggattaaaccgagtctcaccaaaatggcatacctgaacatcaatttacgtgagataaaggaggaagatatggaaacacttggagacctgccagccttactctgtctagaaatatggctagaacctaacccaaaaaaacagcttacagtccaaagcacaggattcccatgtctcaaggagtttctccttgtttgcggcgatcacgatggtggagcgtacctaacatttgggaaaggggctatgccaaagctggagaagcttgagattccatttcacgtattaatggcaaaatcccatggtttctattttggcatcaacaatctcctgcgtctgaaagaagttttttgaaaattcaccgggggggagagcttccccacctgaatatattacttcgaaccatcttatatagaagagatacatgagagtttccaagcacaggagcccttgaggataacatgagagaaagcactgagagatatagagaagagaatacaaaagattaagagacagaaggagaagctttgacattttccacctacaagatcaccaggccaagatcaaaatcacttacgctaggccctatctcaaccacatccgcttcacacgcaaattttgaaacaccataagacaatagagccagggggccatttctgccacaagcatgtcaactcgagttccggcgatcaaaaggctgtgattgtccaggaccacccgcattagccataaaaaaacacgacttcatcatgttgctgcttgcatcaatgcctgccggcgccctttagggaaaggaagccccaaaggagggagggccactgaagattacggtcatgggccatccgcatcaagacgtcttcaatatggatttaacaaagtgctagcaagttcaacagcctccaacgcccttcgggggaaagaagcccctaaggggggagggctgctaaacaatgtggccaagacaaccaggtaaaagggtatagcggagcaaggaggtagacagaagagataatgaagaggtggagatgtcacaggtaggaggaacatcaacagcactggcagagagatgcaaagatctgaggccatcacagccaatggagaagcacaatcaagaagagatagacccaaactatcaaacaaggagcaggttaatattgaggggattcaggtaagggagtcggcaccaacaaactcctagataacagatcaggccaaattggtcgtggcaggcttaactccaaccatggggcacgacagaaaaggcacaa

SEQ ID NO: 65895 - DNA, 1316 bp, Oryza sativa
agtggatggaataggggagaaggatgggaaagcagggggactggttgcagggtttctccaaaaatgatgccttcaagaaggtgacgacgtcggaaaggacgccaccatcacataaacaggagactggaaagggttttcacccagcaaggaggaacaagggtgttacgacgacacctctagggaggggcatgatgtccgaggatgttcatcgccgtcagtccggcgatgagtcggacagagcttttcacccaacaccctaaaaccatcctcactaccagctagcacacaccgcgcaacccaacagccatgcgcggtggaactggtcccaggtcgtcggccgctaactagcccggcaggtcccaccgccgccaacctgcacaaccgacagcaccccacaaaccgcaagtcccactcccgacagatctagacgaaacccttgaacgggaaaaatggccacaacagccttccctaattccaccaccagcacaatcagggaaggggggcatcagcggcttgaaaacccagattcggaatgagaacattgaagaacaacaaatgaggagggaggctaggagaaagacgggagggtgggaaggaggtagaggagggtgggggcgccgccagcggcaaaggggggcggtgccgccgtcggcgaggtggtcggtggtggggtctcgggggtttggggctatcgcctcccgggccgcccgagcgagcgacacgggagtcctaggtccaggtaccgcttgcgtctgaaagaagtgaacgtaataatctaccgttaggggactgtacgttctgataccgagtctgcggtggctgcaatcaagagagaagcaagtgcaaatcccaaccatcctagacttgccatcttcggagcagatgcagaagaggtccaagaggataatagcgaagagagtgattataactggggttcagaggatgacgatgctactgacacctgatattgttgccagccatgatctttctggcaacccatgaaagaggtaaatagaattctctctaagtagcaagctagttgtggttgttacttttactatcttattttgtttcactcgatctgtaagaaatttggcactccatttctttcaggtttgcttcaattgcatgtcgtcaagtttgaaactggagtccacgttaagtccgtgcaaagtgggaagcataaattatatgtgtgcttcacattattgttgttgtcgacattttgtcttatcaaaacatgatcctgcatgttgtactttctaaataatgtagcaacttcgggctgcttggattgttataattttatttgaatt

SEQ ID NO: 65896 - DNA, 1048 bp, Oryza sativa
gcactttaccctcgagatgtcgcggctgctgttcgcaccagtggccgcctctttgccctttggcgacccaccgggcttgcctcggtgattctgcgtgccgggcgcgccgcggccttattgccgctgttgccggagccctcctgctcccgctgcttcacacgtgcctgccattgttcctccgtgaggtacaattttccgccatcgcttccctcctcatcatcgctgtaagaatccactgttgacagccgcccaactagctcctccagcgccatggtcttcacatcgagcagctgctcgagagagatagccaccggcttatacttcttgggaacaacgcgcagcagcttcttgttgacgtgttcatcttccatgactccacccatgtcgcgaatgtccgcgacgacggcagtgagccgcatcgcaaactcctccggcgtctccctctccttgaatcgcatcgactcaaattgacgacggaagcccttctccttcgcctcacgcacacggtcaacgccgacccgcatggtcttgatggcgtcccacgccgccttcgccgtgtcatgctttgccagcccgcgcaacatctcacgcggcaccgcctgaaggattgccgagagagccgcccgatcttcacgaaactccgcgtagccgggatcgatcgccgtccacagcccctgcgcctgcaggttgacgcgcatcaggagcgcccaatccgggtagtttgtcctcgagaggactgggaggcgagcggtgtgcgatgcgtctctcccctgagacacgagcggaagtaatgcgccgtctgctccattccccccgccgctgccgcttgcgccgccgcggccgttgccgctccccccgccgccaccgccaccacgacggccaggcggtgtgtatgacatcgccggatcgttccagtactgctctgataccaattgttagctagaacactctgaacacacgcgagattgtggctatcctagcttgtctgagtagttcagaacgatccccagtatctgacgaaaatacgacaacatagaaaaacagagca

SEQ ID NO: 65897 - DNA, 1081 bp, Oryza sativa
aacttttattattttatgtaatcatggttctttaagcaaaaaatttctggaagtgctgctgtccaagttattgcttctacgtgtattgattatatccggagttagaattgacgaactcccagattcaattggaaatttgaagcacttgaggtatcttgacctcacctggaacaaaaccataaaataccttcccaattccctatgcaagctcataaaccttcagacacttgatctttatcgaagtgaccaactaatcgagttgccgagagatgtaaacaagttaatcagcctcaggtacctgagtttgacatcgaagcaaaagcagttgccagaagcaggacttcgtggctgggcttcactaacatccctgcagcttcactcatgtagtgaactaacatcactgtcagaagggattggctcgttgactgccctacagatgctgtggatcagtgattgcccaaagcttccttctctcccagccagcatgacacacctctccagtctgcgagagctgttcatcgacaattgcccggagctggatttgatgcatccagaggaggccatggatgggctatggagtcttcgatcattgcagatcattggacttccaaagctagagcgtcttcctgacactctttgttctgcctcgggttctcttcggtatttattgattgagcaatgccccaatctaagggagcttccaagcttcatgcaagatctcactaaccatcagaggcaggggggtattcattaaggatttcccgagcataattatataaagggatgacaattagttgattactatctccccataaaatcttcatggaggtatagagcttatgctaaaagaaaagccccacaggaagtgaaataggtaagttgcattgttctctcagaaatttaaatctttataatttaatacgaattgcagtgtttgctagattttaggtttgggtgttaagcttccacacttgtatgattactttgtctaatataattcagttcagtttgggagatggatttttcatttttattttttttgcattataggtatgtatggaagtatagcaaccagtgaagc

SEQ ID NO: 65898 - DNA, 1308 bp, Oryza sativa
ccaaaaaaaaaagctaagaatgagaatgctaagagaatcctttattctgcaaacatgcagaagaatttcattttttaaagcaacaaaccacctattaagatctggctgaacattgttaaaaaacatggctatttcgctgcttccaaatgcgccaacaagcaaaacatataaagtccaagaaacctttcctccttagccaaaacctgcatttggcaaattttcaaattagtattccacctgattcccagacgctcccaacacatcttactgaaaggacaaatgaagaataagtgaagcaaggtttctcttggtcctccacaaacaccacaacacaaaacaacatcttcaggggcacaatgcctcctgtccaacacatctctagtgttgagtctatcccacagaagtaactacacgaaaaccttattctttttgatgcactttgatttacagatccaaatgaaaagccttggaatcgaaattcccaaaaagttagatggataaaacttctgagtagagtacacttgagaattccaaatgaaagaccaagaatctcctctttgagttttgaaagataaactactcattgcaactgaaggaactgcccataagcctgcgcttctagaggaagattgaaacaatcttctagatggaagccagaaaaatttcttacagattcccatctcactgtggtttgggaaaagagagcttagaacttaagttttctgtcttccccattccagatatcatcccaaaacaatattgtagtaccagactggattgagcatttagagatagctctgtatatattaaccaattgaataatatccctccaccaaaaagatcctttattaaagatcatgtgaggcacttttgttctgctgtaagaagtccatataagtctaacccaaggaaagtcttgcacagtgtaaaatttatgcagatgctttaaagaagcattagcagttaatctcctttacactctatccaccattggtgccatgtcaaccgctcttagtttgtagtatacccattggcaaacctaagtaagtaaaaggcatggtgcccacctttacatcccagcaacagagcaaattttctaatttatccttaggaacattcaaggggtaaatactggccttatgataatggatttccaaaccagtgtcttgagtgaaagtgtgtaaaagatccttaaggaaaaaaaaaatctctctaggatgcgtttatgaaaatgagggtatcatcagcatattgaaccactggaaagtccccctcatcttgcacatttataggtttagataacagtcc

SEQ ID NO: 65899 - DNA, 804 bp, Oryza sativa
aagaggggctccacattatctgcaattagtgagtatggctggttagttaagtatggtggaacttaaccacctaggtttaagatgtagtcttgacatgggtctcatatttatggctaattatttttgtagtaggcgacgttcccatcaatagcgaggtgcttgtggtgacttcactaatttgaagatatatcattggctcagtctctcgaatatgttttctatggataagtgcacacgcgtgtatatgaactcttgtgtttgtactatgtttctcttaaaaaagcggcatgcattacccttccaaaatgattatctaaaaaatcaattagcaaatttctgtcggcaaagcacgcagtatcaagatgtctcgactaagtgctcaaaaatcaactgacatcacccaaatacccgatgttagtgaatatattgtccaagagccaagagctttgatatatcgctttgttgtagaagctagtagcaacagatcagaatacgaacaacatcaccaaggagtagtataaaatgggaaaaagtacgaattacacccccgaactatcgcggtcgtctgaattacccacttgaaccacaaaaccgaacatttttcacccccgactatacaaaccggacgaattaccccctcgacccaatccacgttggttttggtctacgtggcgtgcacgtggcagtccagtcagcgttttttaattaaaaaattgtgggacccgcatgtcatacactttttactctgtctattctctctctcttttctctctcgcgcaccgcgcacggcgaggacgagcgcgg

SEQ ID NO: 65900 - DNA, 3588 bp, Oryza sativa
cgtggattgggtcgaggggggtaattcgtccagtttgcatacttgggggtgtcagggttatggataccacatacctaatagtagttgactaaatctcggcaggacccaccacataccatgtcttatacggaaacaaccttcagatataggaggagttccgcataaggaaggatgaatagagttctacatggaaacgacaaggactacttggattgtatccatatttatttccctagttctacttggacaaggggacacctatgggtataaatataaggcctcctagaaggagaggggacacggaacaatagatcaagatacaagatcaacatacaagccaacatgcgccaagacaagacgccggatatcgacttcagagataagcatgactagtcccctacggtgtctacggatactgtcaggagagatatagcactgtctttgatctcgccggatgtggattcgaggaggaagggtaccctgttgtcgattacgagtcagcacttcggactgccaagtcgataacagttagataggctaccccaaatattgtattggtgtgattatggtgaataagagcaacgactggtttcgaccaactggagtaggattattacctgacaattcagggacccgaacctgtataaaaatcctcgtctccatcttttttactacaatctcgcaaatatcctagtaccaatgatccccatactatgcaaatatcagaatcgcgacatcaaacatcgacagtggcgcgcgcagttgggagattttggtgcttcagggtttcgatgaaatgggtttatgagatggattctccaacaacaagctactcgacaacttcagctatgaggagatctaacccgatcggagtatgtcgtccaacaagatcggaaccattgtcgtcaaatatttaatccggcgagatagaccaagcttgaagacattgccgtcgcggaagacgttagttcactaatgtcgaccgtgggattttggtccatgtcggctacttcggaaactaacatcgaccgccaaaaagttcgacgaattaccgccgggtatcgacacatcagtgatcggtctgacgattagcgtgttcggagaattgacgaggtgtacgtatcctcatcggtttctgatatactccctccctccctaaatatttgacaccgttaatttttttaaacatatttgactgttcattttatttaaaacttttgtgatatgtgtaaaactatatgtatacataaaagtatatttaacaataaattaaatgatagaaaaagaattaacaattacttaaattttttaaataagacgaacggtcaaacatttttaaaaaagtcaacagcgtcaaacattttagtatggaggtagtattatattggcctacagcagaccagagtcaactacacgtcgttacccgccaatcaagcaactagccgactgcatctacacatgtattaagcatgcatgcggtgggacccatgtacagtaatgcatggtgtgtaccgaaggctattttagccataggtatgcttgtatacataggtaagccgtccacacgtgctaatcacggaggacaattcagattggctaaaaggtatttagtagattaattttttaaattaatatatactattttcgtagatatatctggcatatatctacacaggtacgcgatatttcataaaaaaattatcgtacttacttttctgatctatataatattgtcagatccatgatttattatgtttaactagagcatgttttttatataatatctattgtgcgagtgtttccgacgttaaaccaactatggtctaatgctacgggcttgctctattttcttatgataaatcatgcttgtttacggtttacataatccctgatatttaatctgcccgttatatcctgataatactagaagatccacgcagttttctgagtacatactcgatattatctactatatatcttgccttctagaaaatatttttcaggaatgactaagcactcgagtaggttgtgatcaagcacatgcattattgagaacgttctcgacaaatgcaaagttgtcacacccaacctaccaacgatgaccgacgacctatctcatagcactgaccatggctgggctgttcgagacaaggttgttaacggataatttctcgcgaacgttgtcagcttgatcacccaacatgattgcgaacggatatccggatatgctataagttggatatgtgagtcatgctggccacatgagatgcacatgtaacaaaccaactttagcgcccctatagacgatcgagaggcccctactcctggttctcgaaccagtatgacgaagcgatctctcgcgccttaacttccaacggtcgaggtacgacaacggcaatagcgtagcggtgcttgcaccacgacatcaaatggttgaggtacgactacggcaatagcgtagcggtcctcgcaccacgacttcagatggacgaggtacgactacgactggtctttgaccagcagcgtagcggtcctcgcacctcgacttcaatcggtaaggagataaggttgctcctggttctcgaagtagtaggccgtagctatctctcgtacctcgacctcaatcggtcgggagataaggctgctcctggttctcgaaccaataggccatagctatctctcgtacctcgacttcaatcggtcgagagataaggctactcctggttttcgaaccagtaggctgtagcgatctctcacacctttacttcaagtggtcgagttataactacccctggtttccaaccagaggcatagcgatcctcccactaccgttacttcaggtggtcgagttagggctacaactagttttcggccagaggtgtagcgattctcccactacctctacttcaataaagttgatatcaggtacacaatatcgccaagtgttttacccatagatcccttaccacgacgacacctagagttgaaaccaatcctacggtccctttacaccgccctagcaaggcctccaaggaacctatgggaacttcggctggggacgcccagagcggataaggccttgtcaggaaatgcatagacgaacgaccatgtaagatctggtcatgtaagagttctcaccgtgcgtattaaccaagccgtgtaatcggaaattgggtttccaacttcacggctgggggctagggtaagcgatttttcaaccaaggtaggtcaagggtccaagagccttatcctccgagaacgattctccgacgataaggctgggggctagggagagtgtatgactcaacaaactgactgatcgaagtcggtaaaagagaagacgctcatatacaaaaacattggtctgtaaatttaattcattttcagttttccatacatattataacatgtcaccttttaagcattcactcgggggctatttctatctaatattcttttctaagtattgatttcatgaaaattctattcgacattgttcttctcattctcttctctggaaaagtctatctgacctcccctcaacaactcccctcaacccagctcctcattctgttctctgcaaaaagt

SEQ ID NO: 65901 - DNA, 1685 bp, Oryza sativa
cgcaagccgcggcaaggaccctagccaaccggggccggcttgcctgcgtcgtccgtcattacgaacaaaacgccggtgcgccgtcccattctcgccggccgtttcccgtggcgattaggtgggcacggtcgcccagcggcccgtgcggcggcggcgttgagcggcaacagccacttggagccccgcgacacccaatcctcggccgcaaaaataattctacctccatccctaaatatacgatgttggtgataaaaaaaaatcaaaggatgtgatgatttcttaagcataagcacctagtatttgttttgggagcagaaaggagcagggaagcgggaaccagcctagctagctagtatttctaacaactgaaactatcaggatatggattttcatccctgaggggatatctccccttgttgtttgcatgtcatctaaatagttgtaaaaaaaatttaaaaaaaattgacaacatagattagtatgaaatatatcagttcacaaagatgcaacaccaaatttcacttccgcaagttacaacaaaatgaacaaattaaaatgaaaatagttgtgtacattcgcatatatatttgttatttttgttgaaacttgtagaagttgaattttaacttgcatgtttgtggagtcatatatttcatattaatatatggcatatttgaattttaacttgcatgtttgccaaatttttttaaaaaaatttgatgactatatttaggtggcatgcatgaaacgaaggaatatcccctcgagggatgacatcactttcccaatctatcactctattaacactattgtattaatatagtaagcaagagcagtatacggaaaaacccacctattttcggcttctggcataatatatatagcaccctgggcaggcgttgtcggatttgctacagtacacaaacccatgaatgccttcttttggcatcaatcgctttgtcttccgtttcaaaaatcagtttgtcttctgtataaaataaattatcgtctcagtaggctaagttcctatcaagaacaaattatatatctaaccgaaaattatggaagggaaactgcatatctagcacgaaaaattggaacatctttttattccggccttccgagaggccgcattattatcagcagcatgaacacctacaagcaaaactcgctcgctgcaagaactcaaggaggtgaactcatcctcctggttctcaacaactacagattgctcactgctacctacccctacaacaatgctacccacagcttggccggaaatctgatcggcggctgccgctacatcgaattcttccgccgctacgacatcgggtgatgcaccgagaacatcgatccatccttgatcggagtcccagtccggcaccgatgacggcgagcacgccattgctctcacccacttggctggacactctgaagatacgttatctgctgctgttgctgtttctaatttatttgctatgctaatggagacgctgctgaggacatcgatccagccttggttgccggagtcccagtccggcaccgacgacggcgagcacgccattgatgtcaccctctgctctattgctgctgtttgtttgctacattaatggagacgctgccgaggacttcgatccagctgcagccatggtcgtcggagtcccagtccggcaatgtctggcagg

SEQ ID NO: 65902 - DNA, 726 bp, Oryza sativa
gccagctgatcaaactgtctcccagcatatacagtacacctgtggtgctcttcctatcatccaaatccccagccatatcactgtcactgaacccaatcaatctgagttcacccttttcccttctcccaaaccagcagccaacatcaagagtacctgcaatgtatctcagaatatgcttcactgctgcccaatgttcagaagttggtttctccataaatctgctcacatacccgacagagtaagcaagatctggccttgtgttcaccaaatacctgagacttcccacagtgcttctatacatggttgaatcaactccttcccctccactctccctcttcagtttcaacctagcttccatgggaacttgagtagaattgcagccttccattcctgtcttttctaggatttttgctgcataagcagtttgtgacagaaacactccatcatccttttggacaacctccattcccagatagtaactcagcagacctaagtcactcatgcgaaatttcttcttcatctcctccttgaaaaaatcaatttcacttgcttgagccccactgataatcagatcatccacatacactcccactatcaaccttgagcttcctgttcctctcacatacactgcactctcagtttcagacttgatgaaattcagagaaatcaaagtgttgtgcagttttgcattccatgctcggggagcctgctttagcccatacaaag

SEQ ID NO: 65903 - DNA, 3407 bp, Oryza sativa
attataatgtatctgtgttatgtcgtatttggattttgtactatttgttcgtataggtgaaaggaatcattatgttataaatatgagcgcaatattgacgaatattaatagaactcttactacgacaagggtgataaagggagtttaaggccctctctttttttcccgattccatattttggaattttgtttgcatgctttctaagtttctaaatagtgccttctttaaattaacaacattctaactttttagaagtcaattcattcatttataccctcaaaaaaaatatcacataaattatataattcatcaatttcaaaaaaactatcacataaattatataattcatcaatttcagctatcctaaaccttaagtactacatattttttttcatgcgagtcatggtgataaattattaaagtcgtaagatgaatatgtaagagttactctgaacaattgtaaataggtgtcaaaattaattgctattaattagacatctaatggcttgcaagccacaaaattaatttcactctacatgtatataatcatggacgaagctggaacaaatattaccatatgtcccatacatatatattgcacagttaatattctaattacatgtgttaagtcatttaaaatttcttaaaatgctctcaagctgcgacgtggtgctctaataaattagggaaaatattagaaattctaagaaaaaaacaaagtatctatttcttgattttcacttaaatcggtaggtccaatattacaaaccgttagattaaattgatcttagaacaaactaaatagtacgaggtcccatctctcctcccgcggcataggtacgcacctacgtgcatgggtacgtacgcttcccctccctttttcattttttctccttcttcctttttttcccatgcatatgcttccctctctttattactatatcatgcgccttcatgagacgatttaatcaaaagaattttgagtatcttgcactcgtatttttcatttgcggtcgtactacacggtatgcgtatagatggattatatgataattaactagcaatagttttttatttactcgagaaaaaagaaacatgattcaaaaatcgtaagtacttaatccatctcctacttaagtttgtgaatggttttttaagatacgttaagaaaaatagaacccttaaattattataaaataacattatccaaactttagtttgcccttaatctatgagacaaaatttctgaacaaacaataatcttaccttttaataatataagtgcccgcgcatacgcgcgagccaccttcctagttgcaaaaaaagttgcatgatagattctgttccaaacttctcctgtcacaattctatgctgatgtgaattggatgctgtggatttgtgactggaaggagcaataacaatttgaaatttttatctgagctgaaattatgctacattgtcccttgcagccctgtaaaagatgaaaggttaggggacatcggaacagttctgaagaagaataatgtttctcttgatgttgttgaatttggtgaatctgaaaactagaagctcttgttgctgcagttggtggcaacagccacatagttcacatcccacctggggaagatctttgtgtcgtcctttcgaagtgaacatctattatgttatctgctggttcttacccaaattcctagtgctagaatatgctatcactaatcagtaataaccctattcctttcaaaggtcaccaataattactggagatgaaggagggggtgctgcgttactatccttattgagatcacctctgctgtcaaaaaaggattatgaggtagattacaagaaggaggcggaatctacctcagatacacctactgacaatgagaaggcaaaggtatgctactgcgttactatccttattgagatcactggctttctttgtgcacaagtttaactactatcagatcatgaactctgtgactgcagaattccatcagggatatatttgtatttgtggtattgtctatctgtttattgcttcggagcacccatccctcaaaatatcccaaatcactgttcacccttgtaagttagtgcctatagctacacactatgaacttcactaacttaactgcccttgggagtggtagtcctgtcctgtctagtattctccaggacaaaaaaaaaaaaaaacaacaacaacaactccagcaacaatctatttccatgtcaatttttagtaaatagtaactgaattatatgaatatgaataaacaggaactgcatttagacttgtaatcttggatctgtttagaattttatattaacattttcttatctgggaacttaattttcttttgaggctggccttgaatgtgttgctaggaacctgagccacttcctcatttgttttcttcaccttctaacgatgcaagttgtcttgaaaaaagatcggaatgatcatgatactaaccatcattatttgattgcttttgtgctattttagtggcactgtggcaggacaacgttaacagtgtaattggtgagataactataaatattattatcaatgatttttaagctttgaaatctataacatatggttatcaccatctttgtaatatgcaaaatgtagtaacactaagtcaggattacttttatggcttccttgccttttattttttagataatggaagctttattaagactcagttaaatacatcaagatgatacattccaactgagtccacccggggcctctgcatagaatgcacacagccaaaacactggatctaagaagacttccccatcacaaaacacaaaaactagtggctatcaatccatagactagatcgccacccatgctcctgggtaaaaaattcttgtaccacctagtccaactgttgcaataccaccgcaatagtatcccgaagtcccggtttgtggaggatggcccaggtgcgtagccaccgggtgactaaagtagtaacctgcaaaggagaagacaacactttgttataaaaaattaccccgtttctgcttagccatatggaccaacaaagagacgttgcacacatcaaaagcagatttctcatgtctttaggaacacaagtaacccaatgcccaaacaagtgagtaatattttgaggaggttgtatgttcgaagccatatgaacaacataccataccaagcgagaaacactacattgaaagaacaaatgttgaatggtctcttccttgtgacaaaagcaacattttttactacctttccagtttcgcttggctaggttatccttggttagtattactccccgacgtaagtccataggaaaatcctaactttgagcggtatttttaccttctaaatacgtctattgatatttgggatcttttgtgtgttgtggg

SEQ ID NO: 65904 - DNA, 4565 bp, Oryza sativa
taggttagttattggcttatactacgtattttctgattttacaatatcgttttcctcttcagccttgctctcttggtgctatatacgttggaatacgcgtaggctacgatagcataatcaaaatttttctactgcgtaaacctggtgtttacacccaaatttggcacctatgaacgaaataggggaaaattggcaaagtttggaaagtgacgggtttacttactcgagaaggcaggtttcgtgtttcctttggtttctatcccgagttggatgtggagaagggcctgtagagggcaagaccaacccctatttaagggacaaggccggttcattgtaaaaccctccgaatacaatatacttgaatcgttcttttactatgttttctattttaccctagtttagtccatctttgtcggtttgcgccgtaaaccgtccaccgccgctgcgagagtgcgacacccctttgtaggtttgtcctgaaaaccttctgttttgcccacgagacgggtagttatcctcatatcgacttaaatcggcctagaggctgattttgatctctaaatcggctccgctagctggtttatcttttctttttgtaaagcccatcttgatttggccctttggctagatcgaggtggttagcgactccatatcaccgcaaggcgtttaggtgttgcgatcgtgcttgtcgacttgtcaaaaaagttgccaacaccaggaaccatacaagtattagaccatagatcgttatcactcgacgtgcgaccctataggttcatgtacactcggctgtaacctgaaaactccttttcggtccacgtgtcaacaacggcccctagcagaacgtattgaccaccgggcatacataaagattatatcgcctaaacctctagtgcatacttgtatgaactcctttgcctcacgatatcgattaagctcaaggctagatatgtgccatcctctattagctcaatcattcactcgaacctatgatagattatataacttgtgatagactcatcaatcacctttggcatggccatgcacttccataatctatgacatcgaggggcccagagatatctctccataggaggggcaaatcccatcttgattattcatatcccattacatgtttcatagcataccccaaaactacttttatagctacccaattacggagtagcgtttagcagtccctaagtaagctactacaaatgttgggaaccatgataatctcgggtctaagaattcaacaccaacactaaatgagatcactgatgacacaacacatatggctcttgcagtgtctcatgttgggtctatccaacaacatgttccccaacatgtgtccacattatcaatttggtatctctataccataatgcatgagacatgatcatcaattaatacatgtgctgatcatttaaacattttttgttccacatattatatttgatcagggatcctttagaaatagtaacatacaacataaagagtctcatgaaagaatcacatattcattaaccaataatgagttatctatttcaaggaacaatgttggataaatatgaaaacatagtatgtgataacaatcatctctatgattgcttctagggcatatcaccaacaatatattgagcaagaagtgaggagatttactaccatcttctttctctcctctctcttctcttcttgcactcagctctcgtcctctcctgtgctatatatctgcctcctttcgttccgattctacttcagcaagatttcagtcttgagtgcttcagtagattattctgttcacattgcctgagtgacgtatgtgggctctgctgcccagagcacgtgcccacccaccatgccgacgggaatgccgtcgttattgaggtgagtggatcaagagcgcttcttgtcttcaatttactctttcttgcttctgaattgaccttttttgctttcttagaaggtacatatggtggaaggttcctctgctctaagccaccacacggtcaggagtaatggacttggctataactggataaaaatacggagagtagactatcaagataatacgtgggtcatgatcggacaaggccgaccaagaagcactcgctctagcatgagagggtaatgcaagggatgtcatggtcttatttctctgaggaatgaatattgtagccctgcatgcaaggtaataccaacacagatgatttctatcgcagtattcttgttattgagttgaacactaacgaattgcagttcagtttttgccggaaaaaataatttgcattgtctatcgcattattcttgtgattgagtcccaaatttcagtttcattggttgaagttattgttgagtctacagaggagtcataaattaaatttccattgtatgacactgacagattgttgtttgctttaagtaatggttgtataaacctgccgtagcaggaacataatgcaaagccttgtgagcattgacttccatggttcacataccagagcaatagattctgtaccatttgtttgagagcattttcatctgaaaggtgtctagaccactcaatgcatcatcctgttgctgagcaaccgaacgtttatgtccttcacgttattcgacgtgatggatggcttctgataccatatcaacaactaccttcagacatgataattgggattagggtaagtacccttctaatgctatttgtgcttgaaattgagataacttctactattgtatgtatgactaaaattgatatttgctaattatagaaggtacaactcgaggatggaagttttggtgtaccactaaggccacgtctacccccaattcaagatggagaatacatatgtagcagattggattgtgaagagggggtccaatttgctgctgacatatgtagcattttgtgcaagcatcatgtcccagattaggacgtcaaatcactgatgatgaaggacaacattaacattctcgggacttatcacaagctgtttatctgattacaacaagatatataatttctctctttactctttaccgtcaggaattagcattgtgtgcaaatacatactcaacttttgaaattctgaatccaaatacatacatttcaatactattaaacatttcaatactattaaaagcacatccttgaacagatccagtgcaatctcaggccaactctcgtgagggtatgtttgagaaaacttattgtaatagatgcaagaatgttggtcacctaaatagagattgtgttgcttttgtgttttgattaactgccaacacataatactgaggactgcatctttgataaacaacctagacccataggaaaacttgtgggatatggagctcctgggttatattgcatcatgattcagaataccaaacctatctctttaatggaacactctcaatcatttctgatggagagatgtccgatcctatggcttatatcaatcatttctggtggggagctagacatggaagatttcccaataggttgagatttgaggagctctctaattttgatcatttcactgtaaaatggactaatgtgtatgagagaatggatttcccaataggttgagatttgagtagctctctaattatcatttcactgtgaaagggagaatggacacaacaatgctgtgcatttagtttgggttaatgtgggtggaatccctaacgagatgaaaaattaccaagctctttttaaaatagattcaaatttggggctggtaatggaagtaggtttaaatttggggccagtaatgaaagtagatatgaagctagcaataccattagagtcaaagtaggaatgatggagttgggtgtgctagctttgaagttggtgcttacaaccctaaaaggttttttttgtattaatctgttgtgactgtgaatggagtgttagagataagtaatggttaaaagagatgaatgtttatgaggaggggaacatacataaaggagacttgcgaagcataagaacagaatatagagaggaaggataagacagccaggtcagatgagggagagataaggagagaaagagcaagacagcacagatcaagtaagagatatgtgagcatggaatgtcaagagagtactgcagagatatgatatgatgtacagggaaggagagagttacattagcgagatactgttgttccagagagctgcatgaagctaagataagaagcatgtgcagagagtagtgatgagaggatagcttgcaagcagcaacggtagttgtgactatagaggattggtagaagaagtcatataatcatgtagggtagtcagtgcaggagagactttgagatagagcaggaagtatgacatgaaaaggattccatatgcaagataaaatggaaacacatggtagatgcatgatgggtaaggaattcagatcacaggacatggtgagaaaaaggttctggacatgcaggagacacacaaggagtataaatattgaggttagtgtgcaaatgaggaagacagagaaaaggtagattttggggagagtgaggtgtttcttgatttacaagattctgaatata

SEQ ID NO: 65905 - DNA, 1576 bp, Oryza sativa
aaggtccttctaaagttgttagagaaatgggaagaatatgaaaaaaaagaggttgaaatgtttgttctagaatattagaggaatgggtgctatagaaaaggaatattagagaaatggtgctatagaatagaaaaggttggaatgttacaaaatctgattagagaaaataatgtgattttgttggtataatggaaacagtgaaacaagactttttccctacaatgctgaggggattagtggtcatgaatctttgtgctggaactggatgccagcttctggcaaatctggaggtattcagttcgcattaatactaaaacatttgatatcttggaagttactaaaaaaaatttgtttcaaagtaaagctgatgaatattactaccaagtttaaatgggatttgatggtaatttatggagcagcctagaaagaggaaaagagtagtttctaaactcatttggcaaatcttttacaacaaccaaaaaatggaagtaaagaaagtgaaaaaaaacaaagctagtggctataacaaatggagtttcattttcaatgcgattattgaacaagctagtctaagagaactttgtttgggaggaaggcaatttacttggagtaatagccaggacagcccaaccctagaaaaattggacagagtttttataagcaatgaatgggaggttcaattcccactcactgctgttagatctttgccaaggggcttgtctgatcataaccctctgatagttaccactggagaaaacacagtcagtcaatccatttttcattttgaacagagctcattccttagggaagacttaaataaagtagtggaggaggtctggaacaagaattattctgggaccagtatagaaaaatggcaattgaggcttaaagcccttaggaaaaaactaaataggtggaacaaaaactgggaaagcttatataagggagaaaagaaggacattctagaaagaattgatgccattgacattagagtagaaagcatgggtatgagtggttctgatagagaggagagaaaggaacttgaaaatagactcaaatttgttattagggaagagaaactgaagtggattcaaagaagtaaaggaagtattacaaggggattgtaatactatgttcttctatgctaaggcaaatgggaggaagaggaagagtcagattcatagtttggtgcatgaaggagaggtgattgaaggataagataagtttgttgcttcatattagaaatttttacaaagatctctttggacattcaaaggaaaacatgttttcaattgatatggcaaatgtatctaaggtggcaaaggaagatatgaagatgttaaccattcctatcactttagagaactcaaaacaatgatttttgaactaaaaaagaacaaagccccaggtcccgatgaataacaggagaattttacatgcatttttgggacttggtcaaacatgacatgattgacttgataaatgattttatcaagggtttaataaatattgatagattgaactttggagtgattacattgattcccaaaacaaaagatgcctctcaaatacaaaa

SEQ ID NO: 65906 - DNA, 18958 bp, Oryza sativa
tatcttgcaatatgcagatgacacaattttccttattgatgataatctggagcatgcaaaaaatttgaagtacatcttgtgtctgtttgagcaacttgctggacttaagataaagtgaggtttttttttttttttgctttgggaagctaaggaaaaacaacatgtatatagcaatattttcacctgcaatgtggttgatttacctctgaaatatttggatattcccattgaccaaaaaagaatactaaacaaggactggaaggtggctgagaacaaaatggagcataaattgggttgctggccaggtaagctgcaatctattggaggaaggctggtgctgcttaattcaagtttaagtagtgttcctatgtacatgctctctttttatgaactgccaaaaggggtgaaagatagaatggattacttcagaaaaagatttctatggcaagaagatcaaggtattagaaagtaccatctagttaattggcccctagtttgttcacccagagactaaggaggtcttggggtgattgatttgtaagcaatgaacaaagctttgctgggaaagtggatctggaaattagagaatgaagagggttggtggcaagagatcattattgagaaatattacaaaaacaaaccactatctggtctgaaactcaaacctggtaattcacatttttggcaatggattatagaggtgaaagatgttttcttcagtctgtgaataaaaaagtgggaaatagagaaaatattcttcttttttttttgggaagatagctggataggtggtagacctttgccttgcaattccctgagattcataacatagccttgacaaaaaaaaaaaagatcaccattgctgacttgaacaaaaaaggtattggttctataaactcacaagggatctgtatggagccaaactgagatattggagaaaaattatacacaactgggaagagttgaatttgaaagaaaattgtagagacaaactctgatggaccttgtccaaagatgggaaattcactgtgaaatctttctgtaatgcacttaaaattaagcaagtgaattaccctcataaaaaaatctggaagttcaaaagtacctttgaaaatcaaagtgtttctttggctctttaccaataataaaatcttgacaaaatgacaatcttttcaagaggggctggaggaaaggtgataataaatgtcagttttgtgataaggaagaaacaattcaacactttttctttgcttgtcccacggctagattgatttggaagattatttcttgtgctctaaatttgaaacctgttttgaacaggcatgaactgtttggttcctagattaagaatgctgacaaattcataaaaaatctcattgtggttgggattgctgttgtgatatggtctaaatggaaatgtagaaataaagcttgctttgagaaaaaacttccaaatgatcccactgatttaattcacatggcctataattggatggatgcatggtcaattttgcagaagcaggaagcaacaaagaggctggtggtgcgagcagacgacgatcggtggcctgcggcggcggatcggcggatgaccacggcagcgtggcttgaagaaattgaagacagaaagtgatttgggaaaaggatgagcacagctaccttgcctgcttaaatagttgggcagcgggagattgacggtagcagtggtgcttgctcggttttaagatttgtgcgacaacgtcggcaccatctgatcgagttccttcgagcgacttcaagcgcgtgtgtcgtgcgcgtggcggcacgcggagcagagcaggcaggtgcgaggcggcacgcggctagcgcgggccaagcgcatgcgggcagcgggcgcaagcaaggcgcagggaggtgcgaggcgaaacgcgcgtaacgcgagcggtggctggagcgagcgaaacgagcagcgtgtcagttggaggctcggccagcaacggcaatgggctgctagctgggtggttgtgcgggagatgggttagaacagcccaatacagaggagcaatggaaagtaaattgggaatatgggctagattgcaaagaattcggcctgaggagaatcatagtgatctatttaaatttttgaagagattttttaatcgaattcttgtaaaatatttccgaataggaatctttgggattggggatcttagaatatttgcatgatgacttcgggctaacttaaaaataaacacgagaacttaaaaataaacacgagctcttcggatggttttgggaatttttttttgtgatatcttggatttggtttggagggaaaactaaacgaagttacgagggagttggaaaattaaaaggaaacaaaaggaatgtaaggattgggaggcttcaattcgaaagaacaaagaacaacgactttaaagattttcgtaaaaaaattaccctgaaaaatatagtatgttacaggggcagtagatagagaactacctcaacctaagcactttgaatcgcaataaagagaggctcccagcaaaaagaggtgcccaactcacatgacaagctcacactccctggctggatgtcatatatttcagaaagacattgtataatatactcatcaatgatttactaatattattaaattttcatattttttaacgcgaatttgttccttagcacaatgtaggataaaaatgaaattttctcatggtattcttccactcttccatctccttgttatctcatttttctttattattgatgatgatactgatagctttagccaataaacactgccagttggtttgtgtgcccatgctttgtattatattatttgtaatttttacaggagttagtagtaattaccgtgacatattaattacactgtatgcttccaagttgattaattagattttagaatttgagagatattttttcttaaatatcatctagaatgctcttaactaatatatatataattggtaagtaacatttgttgtaaatctgatgatcatagtgcgctataaatattgttcaactgatttatgactttcactatgtataagtatatattatgttatattatatagtttaaaattagttatctctaaaagttaatttcctattcaactgggtggtgggacatatatttcaaggagtgctggctcgaaaaactccacacaaaagttgattaaaatttacgttgacaattgccaccttcgaccgtgttgtactgccgatacctaaaaaaacagcaaacataatttagtcacgctctcatgtcacacaacggaattcagcagacatcaaccaaatcatggaagaaattaagtagggaattaggcactttgatccaaactttgcgaggaagtaggtatattaacgcagttatcgcattagtaatcaaactcatgattcgaccataaaacgtgattattccagtgttccatgctcatccatatacactatatcactagagggattaaaacacagccaattatcttccaatattagaaggatttcctgtcactagaggggtgttggattttctgtcactataggggattaaaacacttactgctaatttaatcatgtgatgattaagtagatatatttgataattacaattttattttgttatgggagaccaggcctctcccttctcccctccctatgccactaatccaaacctgccactgatccaaaccaaatacaaataaaaccatgtgagacagtaaatcttggtaacgcactatacaaaacccagtgctgcaacgacacaagttttcctcgtatgaggaaattccacacaagaatcataacaaaaaaaatcgtctaagtccatctaaaaatgaggactcagagttcaatcaataaatcgcacacaagaaccatctaagtccatcaaataaggctcaaacacggacaatgatctattcggcatatccctccggaacatcttgcatcatttttggtactctgaacgtggttacagtcatactcatcccgttggtgcgtaagggcgggaaaactctccatcatgactagatgtgaacaagcaaaaataaataaataaataaaatataaatccaataaagatagcgcatggagcaatgttaatccaaaagatggcgcatagagaggaaaaaatagaggatagtttgatcaatccttcgaccaaaaccgtatttgtgtcagggtgatgggcaacggcgtggtttgggcagcaatatacacaaacctaaaaaaagcttgcggtatgcaaggcatggcaaaatcctctgctaagaaatagtctagtaatggttgagatcatccatgattggagaggacaaagagcaacacgagagcaatagaaagagaggggtgggcgcctgggcgggagggatagggcaaggcatgaaatttggggtctttctgttaaaagggatgacatataagatgtgagtcttataggaggtcaaagggtgggcgcctgggcgagagggatagggcaaggcaagaaattacactaatgctaataaaaaagagtataactctctactaggtggagtctttatgttaaaagggatgacatgtaagttgtgagtcttataggagggcccaaatgtaatgcgtcttcttctcgatgaagacaaagtccgtctgcacgctcgccaagtgtttgacgcgggtgttgacggttcttaaatcatgatatctgaccgtcaatgcttgcatataatggaataaaatatggtatccaacttagtggtagggattattactaatcgtatccactagtattggtgaaatatgttgctgatggttgttatcaatcagttttgaccgtcaatattaccaaaatagaggagaactagtgatacttgcaatgcataaatatgttagaataataatattacactagtattatgtataccaaccttttgcagagaatgacactaaagtggaggagaatcgacatcaacatagacgataaatcaatcggacggtgtcgagaattaaacttatgcatgaatgggcaaagaactcagaattgacacgatgaattgggccaaaattcacaagtctacgaagtgaagcaacggaggaggccacctgccgattttgggctaggttgggctggccttggatgtggggttggcagtgacgctccagatcttctcttgatgacggttgcggggcacttcagacattttgcagcggttacaaccgtcatacctgcctataaaaagacttcgccttctcacttcactcacacacctcaagcaatatctctctcatttctctcaagttcagtttactagtatctagctggtggaataggaatagagtaggaatcaggagtccggaagcctttgtaaaatcaaaggtgtttttgattattattctatgatgaacaattgggcattggagattattggttttgatatttggaatttattcacgaagtggttttggagatgattggatttcatagatgaatctgcaggattttatcattttgtgcggaccggtcagaccgggctctggtagccggtcagaccggcggtgatcgagcggtcggaccggtcagcccacggtctgaccggccgacactgtgtcggtttcggtttcgtgttgtttatttggatatccgagtttattccatgattatgacttctagatggatactatacgtatgtaatactattgtttgctgctaatgagtcaagtggttttggagatgattggatttcatagatgaatctgcaggattttatcattttgtgcggaccggtcagaccgggctctggtagccggtcagaccggcggtgatcgagcggtcggaccggtcagcccacggtctgaccggccgacactgtgtcggtttcggtttcgtgttgtttatttggatatccgagtttattccatgattatgacttctagatggatactatacgtatgtaatactattgtttgctgctaatgagtcaagttggagatagcttggtcttggaatatggtttctttgtttgttccatgtgtaggtgactcgatgtctcgggagagtatttgcggtgatggaccgggagtcggcttggggataagacgacgtccgtggtggtcagagatcatgcgggatacttaggctagagttgatgcacgtggttgatggagtttccatatggcatacgatagagttattgtgtgcgtgtgggatgcggagtcgaatttggaaggagtccaaatttggtacgtttggttatgtaaagtttctttcttgtactagagggtttcctaaggtgtttaggactcctagtatgagtttggttcgtggctttaggctacctacctcacgtataaatagagagggagcgtgaggattcccggcatcgcttttgagagcaatatagttaagttttgagttagggtttcgagtttagtcgaaatttttgtaaggagtgttgttggtgcactttgtaaacacagagagaatcaataaagtcgtcatccactttaagagttcttcgatttgtgtttcaccgggtttcggcggtctaaccggcggcgcaccggcggtcagaccggaggcatctcggtggtccgactggcgggcacacggcggtcagaccggcggcgacaggaatcggcggcaggatttctcggcggttcgaccgatcgatctacatcggtcagactgacgttcatcaggcggtcagaccggcgcaactacttcggtcagaccgcgatccatcgatttcgagggtaacttttatttccgctaaaagttttcggtttttgggtataccaaccattcaacccccatctggttggcttagttcttgtgattcgatcctacagccttcggaatagttcgggtatggctctagtagcttttctcttctcttttgtaagctttgtacttttattagaatactcttctaaatacatttatggtattgaaatactttccaagtatataagtacctactttacattatgttcttgttatactgaatatacagctagcttatctgggagatgcattggtgcgggtataatgtttgcatatgcaattactctatgtcatgacgatgatattagagtagtatctggtagtttagacgtggtgtctagcttacgggatattattatttggggttatatattgcggatgagaggtgggccgctgatggtgacagctcagtacgggtattcctccgtgccggtatataatcctaagttaattccctggggagggtatttcttcgtatttagtcccgtttgtatggtcatgacgggctgtcgtaaggaactcggcagtcaggggtgacttcccgaagtaccaggagggcatcggatagagggtcttagctagtatatcggttaactagaatgtatgtatactatgtatattagaagtataggaatagattatatttctcttttccatccacttagcttagataatatattatgataatgagtagttgatgcttgtgtgtcattctacccttggattatcttaacccctgcttagaatgtgattatcacaagtaatatataaattattagtcaagttctctctacatgatcttcccacgggataaaataaatacgatatccttggaatactctcgggtgaaatgctacaatggtatatctgtgcgcttacggatgaactctagagttgcggctttggtatatagccgcctatcgccgctcgggggagggggacgggggcgccgctcgccggtcgttgctccgtgtcgccgcagtcgctcgggggaaggaggtggtgggcgccgccgccgcctccgctcgaggagattgggggcgggggagagggggagaatgaatcctagggttagggttagggtttaggtgtatttatttaggttaggattaatctagaccgtccattcgatcggacggctccagctgctcccgcgtcatgccgccggcatattgggccaccgaatggaggacacaaaatggacttcaacggagaaaggaaacaggccaggcacattgaatagacaaaagggagaaaatataaacttttctatattcggcccaaacctagaatgaaggattttaattctttttccaattaaataattgttaaatgatgtttgtattattaaacattagcaattaagctttgataattccaataaaatttcaaagagcgtaactaatcgtggagaatttagtaaaattaaatttaacaatgtcattttatttctcacactggctttacttgtaaattgatttaattatacacttacctacttaaaaataccaaatattttagcaaatttgtattttaattaattacataatgtaaatttttcttaaatttttcttaattttctagtctgtacactttccgttgcaacccacggacactttttgctagtaatatatttttccggtcgtcgcatcttttcacccgcgtgatttttcgtcacatctttttcacccacgtgatttttcgtccgtcacttcttcgtccgtcattcatcaccgcgtcgttcatcaccgcgcctgcaatgccggtgtccgattcagaaatttcgaagaatcggactctaattcacccaaacaaaatcagtagacggattcatgggagaaaccaggaatcaaattctaatccaccctaataaaatcagcatagggatccatgaggaactccaatccacccaataaaatttgtccgtcacaacacccccaaatcccatcccaatcggaattcaatcaacccccgaaaaaatcccaattggaattcaatcgcacaaataaaattggaatagcggtgcatccacgaatcatgtgcagcaagcaagcccaccaagcccaccagttgcagatcgatgctaaccacttctagatcgaagaagtggcgtggggaaggaggtcttctatctgcccgccaacgtcacgcccttccttcccgagcgccgccgagccgcccgacgccgcccccatcctccttctggctcctggacgccacgcgtgcgtcgagctcgcaccacgccatcgccgaagccgaaccaagctgcgccgccggcccaaagccaccgcggtcctatcgttgccgcgcccgccgagcacagccgctctcgtcgcatccccaaccgtgccggagctccctccctctaccctggcgcaccccggtgccctgccctccggcgccctcctgcctacgccatttggatcgctgccggcgctctcctgcctgcaagcagccgagagagaagaaaaaagcgagagaaggaagggaaagtgtgagagagaagataagaagaggaaaaggaaagagagaaaaacggtgggactgggacctaccaggggacccactgctctaaccccatctccgtgggacccaccattctaccgctcagctcgaaaaataatttccaaagtccacatagcctccctcttccttcatttggccaagcccagtagatcaatcaatctctacaaaagtttataatatgtctcacgtccaagctctaggccaaagcccatcagcagcccctcccctccaccaaagtccaaattgaatccttctacatccaaattaactaaatcgaccgtacaaatcaaattaactaaaacttgtataggagattagatcaagtagcaactcgtggcatgctattttatcaatatatattgcccatgatcaacgtcttgttgtaggaaccagagcacttgttaggttggcgcgtcatacccatgggcatcggcttctggcagtaatattgtgcaccactttaattcagccacggcacatgcctcacacaaccatgttcccatttcgttgatcaactcaatgatctccttacactctcagcgcgcacacacaccacgccgaccaccatcttggagtcacctctccaaacgcatcatcacggcattgcacacacctcatctccagctttgtggtcatgtccgagcaccgtaaattaattattgttgtgctgatcagctccgtatgtgtggctcgtggccgtagtacacactgatatggttatgatcccggtcgagttcttataacatcaaacttcaagcctcattcaccaaagtcttcgtccgttgcagccagacgcggctgctacctaccatgctacggtcatcgttcggccgtcaattggtctaagggtgcttgctgatttgctagtcgatcgtgctactgagccaccccatagatctacctatatcttcagagtccatgttgactcgcgtcgtgtaaaggtggaaatcaaaccggctttgtctttttttatctccctttcttcagaataataatttattatgagctactatatttctctctatcatttgatactttttctagcgagcaaaagtacagaagcagtgcgaaaataacttcggttaagaacaaatatttttagttttaatacaccgtgcgaagcacgggcattttgatagtaagaattaaaagattagtatttttacttccgtcaccctttgattttcgtccgtagcagcatcatctgcacgatgcgactgccaaggactccgcttccttagttgctttccctcctatcgcgcgtgcgcacgcttgacgcgcctctgtgcgactggatttgaatacgagtgcaaatacaatatggaacaaacaacacgcgcttcctaagcaggccgggttgctgacactaagtttttgattgttggggttaggggaagggtgctgccggcgaggatttgatccgatgggcttaaaggagagttgacatcggccgatggggaggaggtgtgggcataagacggtgatggggacgccgctcggcgcggtgctgtgtaagatagccggtgtggtggtgctggtgcatggattgagcgatgtcctgccaatcgaggacaggagttgccacttgtcaggcgagagatgggggagcttgccctagcaggagaacgaaaatagagagagagaaaaaagaggcgagaggaagaagacgatgtggaagtcgtttgatcaacatccaacggctgagatcgtcgaccgataataatgaaaagagaaaagaatcctccgcagcgtcgcagctgaagaccggattcgctgcgtcgggctcattcggtgccgtgacccgtgatagtcgacgtgttgtgctggtatggatacacactcacaaattgtcacaatttcggactcgacatgccggcctatatatataccctaacatgcacgtacgtcatccattaacgatcgaagcgcatccttttagcaggcacaactacaattggggaaaccctccaggctctagctagtcatgccgccgctgcgacgagcccgcgcacgtcgcgacgccacgccgtacaccggcgggtggctgtcgcgccggcgttgccaccagagaggccgaaacgacggcgcgcttctgaccactctgccagaccgcgtgttctccgacgccaccgacgtcgcgcgcttcgcgtcgacgtgtccccgctagctggggcaggttcgtggccacgcacgtacgccgctacaatctcccgcgcactgccgcggccagctcggttccccactcggttcctcccaagcctcgcccttggctgcttccaccaggagaacgacgtcggccgctgcgcgtgggggcggaagtggctcgcggcttcgagctcgcggcagccgcgcttctttccggcggcatccgcctcgcggttcctaggcccgttctagctcccggacggcgaggccttgctgctcgactacgcccagccagtggcgtcccgcaaggccgcaacggccgcgtcattggagctccggcgcgacgcgcgcccgcgccagcaacggcctcacgctcgtcgtctccaaccccatgaccggcggcgactgtccaggctactacagtactacgcgtgtgcgcaatactcaccggtgacgacctcgacacgccgccatcgcgctccttcttccgcctgctcatcatctacaaccgccccggcttcacggctatgcggtgctactcgtctgacgacagtagctggggcccggaacgaaggaaaccatactgcgcccggctaggccatgccttggcggcggcgtggcctactggcccttccactgggaggcgttcgtcggcgcgcgctatcggactcagccatggacgtgtgttcggtgccttacacgtatggggcaatgttcaaaatagccggctaaggcttttagcggctagtatctagggaggctaagaaaggctatagcgggctatagcccagctaaccctatttagcggttttgtaattgccagacagaaatcagtcaacaattatgcatatgaacatggaatcaagaaaaaatcacggactgaaacaaattaagtgttctttcatgccttcattacagtctagacaacacagattgctggcttgatcttctacctcccctttgggccactggcgaaggcccaaggcctgctctgattttggcccaggagctaaactacaaagtgagtggcgctaaatgatctgcagtttagcggatttagccggttaattgccgctatgagcggaaaaaatcgtttagcgcaaaaggctaactatcctagctccaaccctgcccaaacgctatagcccgctatagcggtggctatagccggctattttgaacattggtatgggggatactggccggttctccgcatacttgggggtgttggcggacaggacggagttgcgctacatcaacgtggggacttctcgccgagtgtcccagcttgtattctgctcgttgaagacacaattagacgacactgatgcatggagagtacagacacgacgtacgtgcactgtgtacgtccgagtaccagacctcaggccggcgaggacgaccccgatcgagctccggtggttcggtgagaagagcggtacggtggtgtacaccgttggggaggccaatggcggtcttcgcggtgaacatggcggatgggacagtccagaagctagcagacggtggcggctacaacacatgcaggaatatttaaggttactagaaaaaatacccgtgcgttgcaacgggtacaacagtacacgagttacaattccgaataggactccagcaccaagctggagacggactccgtctcggactcgccttgcactcgcactcgcagggtagccgggtagggccgcaggggtgaggttttattatatttatttatttgtaagaactcatgcatttaagaactcacgaggtggatcctgtttgagagagtttggtttgttattttaggatggatggcgccgaacgcgtcacaacagcctccgcatccgcctctggctcctccctcgcctataaattgagcaagcgcgccagctaactccccacaccacactcgttctccaccatgcatagccgaagctcaaacccctctgggtagccgggaacggccgcaccaccaccacggtctgcgccgaacagagcaccgccccccaacccacgccaatcaaatctccaccacggtgatttcccttccatctccttgcgccagaatgaccctaggagacccttcaacccatttcatcaactaattatagggccccctctctagagcgccgtcatgtcaccaccgtcaccgacctctgccgccatgggagctcgtcgtcacgccgcctcagaccgcctcaactctaaccgagcactgcacagggtaagtctcctagtagtccttccttaggccatcccctatcccttaatcgaatctccatagaccgtggcacaccgcccgcccgtcatctagaaccgctggcaccaccggccatggcgctcgccgactccagccttccccggccttaggccgagccatcccctccaccgctcatcgccggcgagccattcccgagccgttgtgcctctctgcctatcgagctgcctgtaggttgaagaagaaggacctagtcctgttattagggtaaaaggggttctttctgcaaagcgccagacactgacagttaggcctaggacttatatgtaatttatgaaaactttagtgcttggctgaaagtttagaggagtgcccctcactgagagatggaccccacagttttaaaatgaatacaaccgtgtgaaatgatgttaaataatcattgagtgtaaatcggctgtaacaaaaaatcttaatatagaactaataataattacgtcacatatttataattttcacatctttatagtattcacatgctagtaccacatataacaaaattaatgaatggaacagcacattattggccacatattgatactactttggaaagtttgtctatagtttcatctgattctcattcctaatgcttatagacaattgctaatcatatgtgtaaaaattaaaagaaatggtaactaatccttttggaaaggaatggatctgcatttgcatgcagagaagcaatggttaaagttgtttacaaaattctacacaatggttctcattacatagcaaaagaaatactccctccttcccaaattgatcatcatatatgtttatgcaccaagaccaatgataatttaaatcacatcaatcaagataccatgcacacattctcccacaatacatgcatcgattaacaccatgccaattacaccttagcatgcacacattcttccatgttgtattaatggtattctgatgaaatccgtgtccatgcggttatatgatgatcaatttgagaaatcttgaatttcatagtgtgatgatcaatttgggaaggagggagtaacggaatggttaccatggaagacagggttgttgtggaagaagttagtgcttgacacttgcctcaacacagtcatttccttacagtgctagctctgcattgccaggaactaacacatacaacaacccaacaagtcagaggcttcatatatttgtatccttttctcttcatgccaatatacatatctcaaaagtttgagtccctggacaaataagacaactttgagcttaaggtgtaaaagtcatagtaatgttcatgcaaagcattttagtatgtcaacctctttagttcttcaaattttgaaaatacaatatgcaactaataccattgtcaaacaatatgtgctttctaatatagttaaatgaaaaaagagaaacatttcagttcattctgagaccaagtaaagaaatatgcaatcccattgttgacccatctagagtaggttttaagtcataatgaaaaatcatgtattgtttaggaaaaaaaactagttatttgttgcatacccatgaggctctgttgttccgtctaattcatctcttcatgaaaatgatcggttgacttgctctcatttcacccaagagccaccggtgtctgcccagccattctgtcaggggtgcaacaaccataagttgatgaccgaacgtggaaatattatcatgtaaaataattaaccaaattgataaaaacaaaaaaaaagtattttggttagtattttcaggaaaaccaatcaaattatatatacctataggcttgcatgctatttataaggctatgttcaagtcatctaactattgggttgctctctagcttatcttgatctagctatgcacttctgtccgaacatgaagaagaaattcactttgacgtgtttaacttggttgtagtggaaccacaatgaaatttttgggtcacctagtgggagttgcatgttgctctggaactgaatttggcaagggcactactttgatcagatatatgaacctgaaacttgtctctactttggtcagatatattatgaacatctgaatatcgaggctggaaacctcttatattggtatattttcattccaaattactattgctcactttggaacagcagtgaaccaatagcagttatgcacagggagcacccgatcagaccctgctcctactgtgctggccaaacaattgtaaacaagcttgcagtcaaggttttttttttatagaatttggagcttgcaaacaaaaggtgcagacagtattaagaaatatagattatcatcaaatgtgcaacatttgataacaaaaacaaaaattcttttggtacattctctaattgacagtaaatagattagtgtaaggattgaaatacccctgggcaaaagattatagttagttgttataaagattgaagagtacaatttcatctgtggattgcaaataaattatgaaaattcctcagtggattttcttgaaaaatcatcatttgatactgttagacaatcaaattaaagggtctgtttgcacaaacgtatgctgaaatcacatccagattgtttcagaggcatttaataaaaacatctactgggcatgcatttttaatctaacattctaatagtaatatcatcatggcctttctggaacaacttagaacttacagtgaaaatggaaagtgattgaaattaactgtgcattatgcctctctatgaatgaacaatattctgccccgtatgcctcctctgaacaggaatggatctatttaaaaaaataaggaacagcaaattaaataacaaagcaaagcagaccaagcctccaaagtctaaatcaacaaattgaggatggagtaatcagccactccttgcacacaggatcccaaatcatagctgagaaaacagcagtggcgctgcagccgcggtacctcgtgtcggtgtgggaccgaagcgaagcctcgaaggccaaaaggggaggagagggtgggatgtggcgctgggggtaagggcacgacattggtcagttgagatcggggagtggcgtcggcagcgtgatctgggcaggcgtggatgcgggcgctggcggtggcggagaggagcagattagcgatgagcgtcgacggcaggtgatgcggggtggagaaacgccggggacggggatgtggggcgggggactccacaacggtggaggtggatatgacgacaacgctcgatccaatgatgggcgcgcggcaaaggggattcagcgacggtggaggacgcggtatcggtggcggcgatctaggaggaggtgcgggacgggagggaggtgtggtgccgcggcgtattgcggaggccgaggggactcgcgacgaggaggatgagccgtggcgaagggggagcggcgcggcgatgtggggcggcgctagcgtgtttttttttcccgctgattgcggattgcgagcaatccgtaggaatcgcgcgtgggtggtgcagagggatgcggaggagtagtgtgccgctctgaagcgtgtcgatgtacattatgttggatcgcatgtcgggaaaatatgtgcttcaccatcaccactacgaattttttaaataaaagtagagtagagatatacagaacagaaatgcgtcttctcttccctataggaaaacgtacttcaagcagtgccctttagtttcttttataaacaaattattaaatctgagaaaagattttctgttaattatttatgcactataaaatgctgaaaatttggaaaatcatagaaaattcattttagctccgattgaggtgaaccagattttgttagtttccaactctctttttaatactgcacactcaaacttagaatcactgttgtaaaaaaattcactaatttaaattcgaatagtacgtaccgtattttaatatcttagaaacgtgataacttgcacattcaacatcggatttaggcgaatctttctcctaaatttatattaaaccatcatctatacactgaacatgttcatgcaccgtgcatgatattttatcttggagttttattggattttcatttgaatataggtttaaatttaaatagaggacagatcgattgttgccgttgatgggagtgtgcaggatcaagaaatattcgagtaactcttgagcaagcaagtactattagatcaattcctccttcgatcatgttgaatcatatattttcgcaaatgctttattatgtttaaaattgcatgcggtgtttgcaaaaatgtgggactttggtagaacaactcctaattgttgcattatccaccttgattattgatcaccctattgttgatggacctaggatgggttgtggtcctatccaagcaccaatatgggtatattcgagctactactatagctattgcttagccatgcttagaaaatttgctatggttataaatgacatgatattaactctttcaaatgggttattttaaaatgttgtacagagcggttgcctctgttattatgtgaaaattggaaactgaaaatgatgatttcaaacttgggcggcaagtggtgtgcatatggtgatagttctacgctgatagggggagtgttcgcccgagtcaattaaggaccgaactatgtgtcaccaactaagcttaccgtgcaaccacatctgtcggttatggggcaaccttggcttactaagttgtttactgtttagcattgcattggaaggccgttgtagtagggactagtctgagcgatagctcataggagctacccatgtgaccctctatgggaacgatcgtgttctccatatggcatgggcatctaagcatatccaatataatggatagtgccttgttgagggaatagatgtgttacaacattagtattaggatggggcccacctttcctagcggcattggttcatggccaatgtggagaaacactctccatgctcatgcaaggctagactttacgcaatgtaacggcttcgttgtgacctctagaccgtgctcaatgtgtagagtgtgggttaccgacgggtaccgaaacaactagagtgtagccttttggcttctatcacatcatgtgggtaaagttgtacaaactctgcagagtttaaaactaatcgattagccggtgctcacggtcatgagcgacttggtgaaatgatacaagtatagtgttggtgatttgttaaatgaattgcgatatgggtatggtgaataatggtgatgattttgcctggtgtgggctgataatataatgattacttgct

SEQ ID NO: 65907 - DNA, 1829 bp, Oryza sativa
caggaacccttgatcattctagcactaggaaggatgtgattttgcctagctgatattgactgcatcattctgggggagaaggagcctacctgcatgtgcgtctaatgagatcggcacttctgtattggatgagaaggcatgcatggacaaatccacccgaacgaagtcaccagccactaccattgtgctcaccaccggtcgatggtgtcagccattgggcaagcagatcagctactactaagcttctgcctggccagatctgccactcctgatgaccgccatctccccacatgtgaagaggatgaacagtggaatcaccagcgtagtaatcaccagaaggtagcattggcaactactgaccttgtcaatctgccatggctagagatcggagcagattaatcgaccgcctccggaacttgccaccatcagatccattattagcaagtccagattccataggaacgactccggcgacctcagtcaaaacaggacattgcacgaagatacgggaaaaagccaagaatgggtggaacccaacactatactggctaaactactactagtaggaaggggcttgacccctctttcagccatcactggcagtgagctgccggaaccgagtaagagggatcgagagaaggggatttttctgtttgtcgcctttcttattgtttccagagagctccccaacctccctatcttgggagagcgccagaagagcacattgtgatgaggacatcactcctttggatatacacaacaatcatccatcggtcattcaagaaccaatcacaagagctcgcacgcaacaattgaatttagatgtgagctcgttcctatgtttatctttatatgattttgagaacagattgctacctaatgattatattatgattaggaataatggagaggacaaggagacacttagagagggacttagaggtgtggaggatcagcaaggaggtccaagtcaatatggaggcccaaaccaagtcaacttcaagtacgtttcgtagtctaggaccagtctgcactaaaatgggtgcctaggtcgcatacgtgctcggattggggctttctttatatggatggaaagctaagaagataacatttccaatggtttggtcccatatccaaattctttccgagtcattgggaatcgaccaaacaagttgacatctagaatctgtttcggtgttgcgtcgccgtattttggtctttgggctatgtatcgtgttggagcccattagggttgcgtcaaggggtatttgcatgaccctaaactctatatattagtagctgctgccacctttagggtttgggttttgcttagattaatctgtcaagaatagtttcgctgatccttcagtttgtaagaccccaacttgtgagcttaatcattcatatacattttgaatgtattctttcttgttcttgtttgtgttcttcgattcacaaatagggattagccttctcggtgaggtcaaccgggtttcgacacgtacggttgataaccagagtagacgtggtgctgcggttgcggggctcaagagcatgttcgttcagaagccagatcaatttgtgctgtgactccataaaatcgactgtttatcaaaacctttcagaagatcaggaacccttgtccgcatcacattggttactaggaaagtatagtggaaactatatcttacatgaaaacttgaacaagatattttataaatgttcgcaaaaaattaaaaaaaatcacacatgctatatgtaaataaacaaccatacgaataacactattattgtttttgtctttttctcctatgttttggtcttttgag

SEQ ID NO: 65908 - DNA, 919 bp, Oryza sativa
taccaagtcccaggattacaagagtatcaatcaaaacagtggtgtgcgcatcgacgcctacgatgatggtggcaacaagcagacttaatacggtttcatagagtcaatatgggagttagattacggagccctcaaagtccctctattccaatgcaagtgggtcaaaattccaagggggttgaagattgacaagcatggaacgatcatcgttgacctcaatgatgttggctacgaagatgaaccattcgtgctcgcaaaatccgttaagcagatattctatgtcaaggacccatcactcatgaagccacatcatgttgtactcgaagacaagcaaagtattgtcggaatggagatatcatcgacgaagatgactacgatcaacccgatgagccaccgacacccacaactgatgtcgagactgaaaacgaggcaagcgctaaagagaatgaccaaggcttgtatgtatgatccgatcatgcgaaagggatagtagttagggtgtgaattaatttctaacttcattgtatggatttgtatggcaacttcattgtacggatttgtatggcaactgtttgatttaaatcaacaaaatttggaaatatattatgtgcactctaatatttaatttctattttggtcctttatactcttttttggaacatattaagtaataggcctattttctagtgaaacataatttatgaaagaaattataatttataattaatacatataaagttacatttatataacatgcttatctctactattataaaaattagaacctattatagtcaaaggttccggatttagtgttagaaccaacacctatctcctttacttaaataccctcacttatccctttactctctcacccttatccattcactctctccttctcaccctcggcggtggcagt

SEQ ID NO: 65909 - DNA, 2439 bp, Oryza sativa
tcaccaggaaacaccagggttagggcaacagtctaaaccacgccaaagcacaactcaactaggctcatgtcatcgttgctacacgtcgcgccccgtcaacaccgcagctccgacttcacgaccactagactcattgagacaagggcgagccagactgacaaaccgtgcagatcgaaaagcttaaaaccccacactagagcgtaacgcataagacgaagtcttacatgagtcatcattgccgagctcgcaaacacgtagcagcttcgacttcccaagaggacaacagcaaacccctcccgaaaccaagcaaggatacaggtcattgttgccaagcgtgtcgaatgcctcaaacgcagcagctccgaattcccgatggccctccttaggtgtcaaagcggagcaaaactagaaattacctcggatttcctcaacgatgcattcaagaaggatgtgacgctagctacgtcaccatcgccagcccaagagtggactaatagattttcatgcagagaatccaaacaaggcaaaacgggaaagcgcaataagaagaagctcgcatattaattctattgttttcttgcaaaattttctctggatcatcaacaattttagcctctcatactgcaagacatatcgatgaggcgcagttcagtttgtatattgtagtgtttctgtgtgcttctcttcatctatgaaaaacagcagcagatctcctgcctgcttcatgccgcgtcacttgaaaaagcatggagaatttgtaaaattttgccaaactatatcaatcagtaatgaacgagtttgtgtcattgtgtgtgtgccaaacgtggttgatttactcattcactcatatggtcccacatatcatttccaccagcgtcaattaaagcaaattggcaacgaatataaagggtcgaattatcaaatttctcaaacaaagcaatggtgccctgttcaaataaaaagttttgaattgaaatggatttcatttccatttctgctagaattagaatcgcctataattagaatcagaaacctaaactgtttacatttttatgtcaatcaaaatttgcaaaactgtaccagagtgtaatcagaatcactggttagaggccggcagacattttttttatactggaaaccaggaagaaacatacatccagcattagtttaattagttagatctatcaataataaatggcctttttatgcagtcccgctaaattggcaacctctaaaaggagacaaaaacaaatttatccccacataggatgtatctttaggatttgcccctgcttgtgttaccgacatgtgggccagggtccattttcagtttcatatgatgattttgcatgtacatccttctattatgacgttattataactgccttacacgaacacgacacgagcatatttcacgttcaaaattagatttgataaaacatttcaaactttatcatgtaaaagagtttgaaacaaacccaaggctctccatctccgacgagggactaccgtctcctccggcgagtcgttgaacggcagacgaaatgggacaaacaaatccttagatagatcattatccaaaaaagcgggtagccatggattcacccacgagtcgagaatcgatggcgttccagtgttgctgatcatggacacgatgttcaccggaatgcctcgccacgtagcttctccgaccctcaccgtcaacctcacctttgaaagtgctcggcgcctagagggcagactatttttttagcctcgtacgttgtctcggacaatttgttttcctccggaagaatgttcttaacgagttttaataaatcaccaaatgacttgtcactaacaccattttttgtcttccattgctagaattccagagtggtatccaacttttgtgcccctatccacaacctggtccaacgatgttcagtggtcctctaacatacgctccaatttatgggcctccttttcactttcgtagtcctccttggcgtcctgcaacatttaaccaagatcatccacagcgtcgttatcgtcaacatccccatccacatcgcccgttctatttccttcaaatccagcgtactaaactcagtcgggaatgttctcgtcttacacgtcatcttcttccatttaaacccctagctctccgtgcgatgtccaacaattatagctaggcatgaaccccgactcaaacaagtggaaatgaataatcctaagtgcataatactccttctggttcttgcacttattgcatggacgacaaatataacccttatgcttgttagcatcggccactctcaaaaaataatgcacgtcatcaataaactctttcgactgctagtccgcgtacatccattgccgatccatctacatgaaatgcaaaaaaaccgtaaaaatattcaacgaaagtgaaacccactaaacagtcatacaataatg

SEQ ID NO: 65910 - DNA, 1198 bp, Oryza sativa
ttggatctatgacatgagtatggacaggcccgcaaaactagtcggtgagagctgtgaagacgtgtggcagcatttcgcttgtttcaagacccaacttctgcaacacaagggtggaaggcatagaaatttactttcgtacttcaatagaatagtctaatttattacgtaagtccctgaaacatgtcatacctcagcattacggggaagaaggtgcccagactctacaaaacatagcatgtaccacatgacgtacatcccgcagaggttggtaagcgctggttgtctataaatatattgattttcaaagatccggaatgatgttgcatcgatcgcacatctcccatacgttcttttggacctacggtacttcacatatgccctatttagtgcattcataatagtttggtaattgtctgtccctttcctcaagctatcatatacacaaatcttactgtcgtcgatattgattacgaagaggatccaatgatggctgcacataggacaatgtatcaataatatgatacgcgtggagagcaaatggaactagaaatcgatgatagtgacttactgagataggtaaggcaggagaatatggtcataaccattttgcttaacgagggcattgaagagatagtcgtcaatttctttttctttggacaactgattgttgaagttcacaaccgctggatctagaaatgcaatcttacggtcaagacttctacattgataagagcagcgcctgcaaaaggagaaaatagttgaaaactacttagagtacgtccaaggtgccagattaaggagaagatatcaaaggactcacaatgaccacatttggaggaggctgatatcgagttcctttttatggtacaagttgaagagctccttaaattatacataacatatattggggtcatggtgaaaatcaatgtcggtgtagtaggcaccgatcatttcatgaccctttgcggcctcctccaaataccattgatgcagccaatgcgcttgagttcctaaccattcaatttctgagtcgagcaccatgggtcatccatgttggaactgagtaccacctcagccttgtcaaggttatcaatatctctaggcttttcaaatcgactgacttacagaaagcagcctcatcagacgctttcttgtcaaggaacaactccctagatcgagactgcatttgggctgcagg

SEQ ID NO: 65911 - DNA, 1216 bp, Oryza sativa
cgtcgccgccgtcgaaggtggagaacaatgccaagggacgccggccatggctatgcggcgctgggacatggcggcgacaagaagccgcggcatggcgccggcgcggttcactcgccgtcttcccggttccgatggaagcaccggtgatcgccggcgatcgacgtgctttggtttcgctgttgcagagcctttttggcttagttgtttatggatttcttttcgtttgctttgtaaatgtgctgagaatgagatcatcgtctgaaactgaaaatggttaagcctaatcacaaatgtgaatgccttgttgctactttggatctttgatccactggtgttagaacttagaactctcctgaccaagtattaagtatgaggttagtaattaaattagagaccttatccttatttccttagtaatctttttcaatagtgggtatctggtctttgcttcaattgaaactacacgcataataatttacagcttataaaactgctaatatgaaaaagcaaagaaccacacacactccacccaccgtgtacaatgacttctagattcatgtagctagtgatttctttgtagcagtaaactatgctaagtggaatccaattaagatttttcttctgttacaaatgctgacacttacgaatgctcatttaacacacagtcaaagggaaaaaattcagcaacaaatctctagactcattaaaaaatccacggaaagcttacccagtactatgtatttatgggcacaatgatttaaagtctatgagtgaaattatatactcacgactctttattttaaaccaagcacccacgacgtactccataatcacactagctaactatacattttcaattttatattttcaccatatcgaaacaaaagtataaactcaattaatggtaaaactagcttctttcgatgttagcatagatttacagtttctggatcaaacaaaaccaatggctctaactaaaaaggtatattcaccacaaaagttgcttaatatatgttcttgacaaaatgaatgttagattactgtttcttcttcctagctaaccggtggtgttccttgtcatgctgactatggctgagaacattggccatatatcatatcaaaggcataaaacagtcagatatgtccaaccatgcatggaaaggcttatatcggcaaacgatatgattatgctgcaaggcgcaatatggttcctttt

SEQ ID NO: 65912 - DNA, 728 bp, Oryza sativa
agtcagctatggcgagcaaacgacggtgagctgaaaggctaggtacgtggcggtgaggcggacggcgtgttccggcggcgcatgacgtgttcatgggagaaatactactgccggtgatgacagagtggatgagagttccatggatacgtaggtatccatttgtgccgcctccgccgccggagtcgccggaggaggaggagacggtcgtacctcgtcggaggaggaggcggagagcaatgccaagggacgccggccatggccgtgcggcgccgggacatggcggcgacaagaagcagtggcgtggcgccggcgcggttcattcgccgtcttccgggttccgatggaaacaccggtgaccgcccgccggcgatgaactttgcttaatttcgccgttacagattttacttagtttatttattttctgtggatgtttttctttgtttgctatggacattttctgagtgtttttgagattatcatctgaaactaaaaatggttagtactaaccacaaatatgtacgaacaatcgagaagtagatatgaggttaaatacttaataattaattagaaatttaatcgtgaaaaattagagatctaataaactgaacatgtctttaaccaaccagaaggcccgtgaaagaacataggagtattgtttaagctagtgccgataagacttctctaatttatcaaatttgtagaaagacatcgcaacattctaaagcata

SEQ ID NO: 65913 - DNA, 717 bp, Oryza sativa
cattttcatgaattattttggagcaatgtattcaaaccaaaaagaggaacgcctgaccaaaactatctgaagattaccttataagtccacgaatgagggctatgacaaacttggcacaaaccaagtgcaagcatgcattgaggggccaggcaactcttcgatttgaccatcctccatgctgaaccggtagatgaaagacctgctggctctgtccatcttgaagaagtaaacacaattcccctcaagccccgcgaaatccgcggcgcggagcgagaatccctggtagagaccaacgaacagcattctgtctccaatgctcctcatctgaacccaccgcgatttctcccccgcaatctctagccggtgaacctccaatgcacggcaatcctccagcaattctcctgcttgttctgtgttcttgcgcctgaagtaccgaatcacgcacaggagatcatcgccggacgggacgaaggatgagcacttgaaggcatccctgtgcagggtcaccggcggtggtggcggcggcgcagcgtcaccgagcacggcaagcgtggcggcgtcgaagatggtgaggtggccgcggtcgttgcagacgaacaccttcccggcgtggtacatgttctcggcgacgaggtccaccaccggcaccgtcgtccacccgccgccgccgccggcggggtggtggaagaagatcctcctggtgtcgtagagcaccac

SEQ ID NO: 65914 - DNA, 6767 bp, Oryza sativa
tggtagatgatttcctttgctgatttttttctccggcttatatggatagtatcgattcccctgtcctatcctcttgaatctctccgattccacatgtaccaggtactacacaccatgcagctggtaccatactggtaccaggtaccagcctgtgatgtgctactccggttgcagaggagtgacgccggtgacgaggtatcacgcacgcctatggtacgtggtatcaggcaggggcggatctaagagggattaataggagggtctgaacaaactatacaaaattataggccctcttctaatgaatatatgacagaaaaatttagtgaggtcttcatgagggatctcatggttacaacacgggtagtgggggctagagaccccacagaccccaccatgggctagagaccccacagaccccatggtggatccaccactgctgatccttgatggtgttgtcgacgtggccaactccgcacaaagctccttcgtggcgccgacgcaatggtggggtggggagagaacgtagtgctggtctcgtgaaggagatgaggcggcccccaccactagcctctcctcgggccccctctcctcataggctgtggagtccttgcggcgacgcagctgacaaggtcctgaacttgagggtaacgtacgagcctggggagaagatctggccaccctggaggagccaatcctagtggagaagtccctgagctgcctcgccttgcccgctgcatccaccgctccccgcggcacctccatcagcatcgccgccgccttcacttactgcttgttggggaaaagatagagaaggaagaagggggcttatatgtggacctcacctgtatttttgccatcaatgtagtggaccaagtcaatgtgtcacgtcaacaaaaactactatcaaaaccgctgagggagtcaaatttcactagctttaataatgagggcagctacacaacgggatcccgttgctacggcatactttaagtgacttatccctttcctttcttctgtataggtgagatttcacgtagtgaacgtgtgctcccttctggtacctggtaccagtggtggatccaccatggggtctgtggggtttcgagcccctactacccctgttgtaacgatgaggccatttccaacccaaaacattagacatagtttccataaactccacatcatcaagaaactagtagtagacaccactcttccaatgcaaacaccactattctatactaaaatttaatggtacttatctcacatgatgtcttggatgttgtgtagaaaccatgtctcatgcaagacatgatttccttctctttcctcatttattcacttgccacgttatttttcatcctatgtagcacgtatttaatactatggacaacatcttagtcattgggttgggaatggcctaagatccctcatgaaggccccactaaaattttctgtcatatactaccttcatcttgaaatatttgatgccattgacttttttaaaaatgtttgaccgttcatcttattcaaaaaaatttaagtaattgttaattctttttctatcatttgatttattattaaatatacttttatgtatacatatagttttacacatatcacaaaagtttctgaataaaacgaacggtcaaacatgtttaaaaaagtcaacggtgttaaacatttagagaaggaggaagtattcattagaagagggactataattttatatagtttattctgatcctcctattaatccctcctggatccgcccctgtaatgagctactaccgccgacgccgacgatggaggagtgcgagctcatgttgctcgtccaggtcaccacattcgcgtgctgcagcttcgtcatcgggttccggttcagccgcgcggtggcggatgacccgaagtggcgcaatccatggctgtcatcggcaacctcgcccacagcgcggatggattcgccgctgagctcgtgtggggccgcgacgcgatcgcgaacccttgccaccgctgtcgtcagcagcctccccgacccaccgatgccatcgacatctccgccgactacatcaaccacttcaagagccagtacacacatggcggccgtcgccaggtgctcggcgtttgaggtgttgatcaccaagacaccaaggcgtggcagagccggagacgcgcggcggggttcgaggcagacaccaccaccatcaagaagaagacaggaagaggaagaaagaaacgagggagagagagagaatgacatgtgggccacacaggatgacttagcaagataggccggatcaagcgccacattagtaaaactgttgagagagttaaattataaagttttactaatagttagggatcaagatatctgatattacagtttagggttataaagttagattggagctatattgagagagtaaaattggacttatttccgcttagccctctgcttttccgcatgcatgggatggcctggataagttggcccaaatcaacagtgccacctagctcactttgtttctgggccatctcgaattcttttctctttttttttctactgaaatttcgaatcattttccttattaactaaatttataatacatcaaagttaaaaaaagaaacgtttgtctcttgattaaaaaaaagagaattttgttgatagtacagcagtaagcaataaagtgcatctgaataattagtatctcaaatttcatcactgtatttgggtcaaaagaaattcatcactataataacttacgataaagttgttgaattttttattctctaagtctacattgggaaacacgagcaataaacttacgtatttaaatataaatattgcactgaaatgagaaaaaaaaatcttgattgtctgttgtatatataagtaacttgtgttctcgaaaaaaagggggaaaatatacaaaactgaactcggttgcagcataaaactgatattgtttgaactggggcaacacattacattccaaactgttagcacacagagtatccaaatactttacaatcaaaaacttgacagcaaactccaaacttttttcaggttatctgtacagagaactaaccaaccacaacacaagctagcggttaactgaaccttggcaagagaaatctcttcacgctaacaacattaccttctcaatcttcatcgaggtagctaggcaaatttacagtgaggttccatgaggtataagcagtaacagcaacccaaaaaaatccagggcaaaggatggttcttagtactgacggctgacaaccacactgaatatggatacagctaaaatctcaagcaaaaactactagaatctggtaagtgcaggcatcatctacataatacacaaataggtggtaggttttgttggcaaaaatatacacctgcagtgcttgccacgacaagcaaaacaagctcaaaagtcggttagtattcgctcttgctcttcgaaaataaccgactgaaacctcggctctgtttctctgtgaactggttagtaaatgaggaagaggaagaagaccttgatctgtgctttggacgcttggagttgtttggagaagcgaagtaagtgtttccatcaagattggaggggcttttgtgtgttctatatccatttagcggagatacgtttcctgttcccggtgcacttgagaatgtgtgatctgtatcaaattgacctgacagcttcttaaaatgcaagccttgggttgttctagcttgatcttcagaaaacacccccacaggttgttggtttaacacagaacccagtggttctgctggaggggggcgaagagtctgcagctgacggccaagaagcaatattgtctcctggcattctgcaagcttctctgctgctgctgcgatctctttgtcctgccattattttaaccaagaatatattatggaatacacaacatgaccagaaaaaaaataatgtttaaaagaaagaatttgaaggacactgaagcgtttattgtccaggaagtatttattcggagagcacaagggaataaatgtgtaattcatgtgtttggcactatatgagctgatatagtataagagattatcacagatttctaagaaccaattctacgaaactatagatttgggtgcaatgttttgtgcataactatagatttagagcccatgcaacaagcaattggtcttggcactatttggcaccttctaagttttcaccaatttgttgaaatgttggcttgtgcatagcaggctgctgacacagacacacgcatgtcataagtattgggcacatagatcagctaaaaagggtctaatgttgcctctcatcactcaacaccatagacacacatggacacttttctataggctgttggatgcactgggacgcatgatttgaggctgtcagtggccaggtctattagaaccaattgcaactttaacaaggaatattaaagttcagagaaatgagcgttaatagttatgcctgtacatttatgaaatttattccatatttaatttttggggaatacgcaaaagactcgcgtatctttgtattgagaaggaagtttcagcagtacaaggtccccctaactgcaagcagccagctcgctacataggtgaatttctcgtggtatcaatgctcgaccagcttattctatatttaatgaaagaagctggagtaaacaaactacataggtttataatcagttacgaacatgaagtttaggcttagtaatttttacctgctttattttaacacctgcatcctcatctacagatgaagtattcttctcattctcataccttcatgacataaacaaagtcaacgaagaatctgttaaacatgcaacaaactaaaggaaacaagatgataaaatagtctatctaagtcctttcaacaaagaaaaactaaggaaataccaaaatggaaagacaggtatttcacctttcaatcttctccttaagatctctgtacttcgccaaatcgtcctgatggttttgtctttcatcagcaagttcagttctcaaagtatttatttgtctatgcataacttctatttcactttctaatttcaacttgtgtaactcaagtgatttgtatgattcagccatacacttcagctgtgtctcagtcaagctattcgatttctcgcatgcagataactttgacgtaagctcttccatgtttttctccatcagactaaactcaagctttctacattcgatagtttcattgcactttgctaattccatctccaatttcctcttctccgatttcagttgttcatattcctccattgagcacatctgcactgtggttttgacaacaaatgcatccctagaaccctcaaagtcaggatcagaagacgaatgaggcgcaagtgaacaaatatcagcaaggctatctttaattggctcatgatgcactttgttttccaataaggtcactttatcaacatagtccagattattgctctcggtttcagtgatgctgtctctcggcaatgtgagtttaatagcagaatttcctgccaaaatttccgctaatgcaatcaccatttcggcaagagcattttcgtttagcacaactttgtcagctatagtggagaacttttctattttctcaaggattgtgttttggtgggaacttttaccttggacctcagatagttgtcttttaaatggctggaaaaaatcaagaatttccaaaatagcatgtcttagaccatgatccacatccctcaggttcttggattgctttgtcaaagatccattatcagcaagtccattcatgttatcaggctgattcttttttgcactcactgattctgcttcttccttgatatctcttaggatatttctgataccctctaggaccttgccaacattgttctgtggtgaatgagaacctaagagagaagaaattcttgagtgcaattttgaaagtggggagttctcaggcagatgctcactgctggatggtgtatctgggaactgcgaggatggccatgaatctctatcactttcccgtttagtgatggtagtgagagttgtgtgaactttagtggccttcttcttgtcaataaagcttccacattcttttccttcaggagataaacacgccaacctctccatctctagaaagtcatccatgagtaccatctgattggaattttctgtcaaactgcccttacctccattatctttcttgatgtgtgagagctcagatatcaaagcattggcccaagattcggcacaacttgttgcatcatcaactccgtcttcggacatggaagtcagacttggtgggttacttccattcaggctcagtgcaccatcatggtgaacatcaaggtttgaatttgttggattcttatactgcctagcactcaccatatgaacatccatgctgcggagcttgcctgctgtcttagcacatgtgtttcttgacacctgcaactcattattacgctttgacagcgcctcttttaacatctttgtttcatcctccatcgataacaagcgtgcagtcagaaattcattctctttctgcatgtgctgcaagttttcaagagaattatcaggggatggtgacaaaggatgatggaaattagaactccttgaaggggagcgtcgcaatctgttatcagcatggtctctgccccagctatccacttccagcttcatttgagctaatgcagctggcccgggtaactttttccgaacaagaccacgtaacctttggcactccgcttccagttttgatattttc

SEQ ID NO: 65915 - DNA, 2106 bp, Oryza sativa
  unsure (1)..(2106): unsure at all n locations
tatttttattatgggagtcttactactagattactagttatggttactacagattttattgcatcaaataaaatgttatgttgcacacctccagtagttactaaggtatataatagaaatgaccaagttcaagatcctggggagaaatcatgatacagtacaatttactcaatagtctatccaacaaaaaaaaaagtaaagaatagcagcaatcagcttcaaacctgatacagcctcttctgccactttgacatgctggcttatnanccttagngngcctttaatcgccgttctgtggggggttaggtaaaaactaatctgattgtgctgcagatagtttttcattcaacacattcaccttatcacatagaatcttcacttgctcttctgattcagtaagatttgtgtatctttctggtgaaatctgcacaaattttggtacttgttcatcctgaaaaacaggaaaatagtttaagaaaaggataatcaatcaagatgagtatttaaccaccatgttgatcaaacaaacagcattagtttttgacatattaaatgaatggatgtaattgatggcatttagcactaacgataaaatcagtgtaccttaagtctaacgagtaaatgcactgcctgctacttaaagggtaacagcaggcttgaccaaaaagcaattttatgttagttcacaatctaaggtacatgacacattaccataacaaagggggtacatgacacagacttaaatttgagtacatcagttgggtatcagtatcacataaagttaaaaatcaaattgaaaaagagcatctcttagtaaagtttgtgactagttccctctattttcctatggacaggcaggtgatgatttggtactaatgcaggacaaagctgtgtaaccatagcatattaatatgcagagatactgaaatagaaaacaagtcaatatactggatagcaaataaaaacaagcataattatttgggttgatgcgcaatatattcatttcggaaaaataaaagcatgaaaagtatcaagtagatatataacaaagaagcacaattttcccaacaaagccacacacaccatgtgtagtaggatgcttatcaatttcacaaagtacagagtataagggagcacagtataattctttggaagaaaaagggcagattaaagaagagccatcagttgtatatatgtgtttacaaaaggattcttgttaaaaaaagtgagtacagttggcgaataaatgaaccctttcatagtagccactgatgaccagattaaataaaagaataaaaacaaaatatgttgtttagatttacgaagatcattgacttaaaaaaaaggaagacaagaaagaagctatttttttctcatgagtgatgcatagactgaatgaatcagcatatcaactgatcaagattgcaaggaaggaaagccaaagaatggacacaaacctgctctgcttgaccggaactcttcaacacatctccagctgatgatttatcagaagacttctttttccaaggccagcttcttcgatccatcccccgctatctctctgatcaagtatgttcaataccttcagctagccaaactaaagaaaatgaagatctatcacatgatggcggcaagataacgatgcaggattcagaaggctacaaaagtaagtaaaactaacctatccagtaaccagcaaccaactgtacagaaaacagaaacgaaggaataaacaaccaatgcaactgacatataagtccaaacaagttggcaagcaccaaacaagctactataattttaggcgactcggattctacggaagacaccgcagcaggaaatcaatttgcatatacaagtccttcagtcaagacctggtttattgctgggcacgcatggcatccaattcactaccatcaagacaaggacatgcagataatcgactcaacaacttctgcctcgtccacaagcatactaccttcagacataggacagatgaccttgcaggaggaagcacacgcccccaaagcagatgtaattaaacaagtggttaatactttactcaaattgcacccacaatcatatagtacgcctatacatgacaacaat

SEQ ID NO: 65916 - DNA, 2019 bp, Oryza sativa
tatcaattgtacaaccacacacacactttcatcagatcatggcaagaacaggctgcatcccacagggaaggacaccatgggtgcagacgcagccaatggaagagaccacagccacagttgccgggggccatggcatggatgagtaaatgtagaacatgcccccatgtgttcctccttgctccggccactttctcctgtacttgcaccctccattactggtgattgctctgctggggaggcaatgcatcaattgccaccggcagcagcagcagcaggaaagcgtaggattggagtaaaacccgcatgtacggccgtcaatggcagggattaatggccatttctggttaattcatttgtcgatttggggagattaacgggatttggcgttgcacttgtatctaacaatcggaagattttcagtaaaatggagggatttcatcaaggtttttgcggagccaacagcacgaaattctgatgagactgaatcaatttcgcaggagagaaaaaaaagaatcggccaagaaactgacacaagaaatcgcataggtgaatcaagaaaagaacctcgaattcaacttcaagaatcaagattgctgcaacccgcaggccgcagctaaacctccccaagaaaccgcgcagcaagaagagcaaagaaaaccccccaagaaaccatcaaaccatcagcgaagaacacggagagcgatgcttaccgcttagcaagcgagcttgaagaagcttcgaaccacccactccgggcgtgcgcggcggcggcggaatgcgggatccgatcggtgtcggtggcgcctcctcccgctttgcttcgcgcgcactcctgctctactctgctctgctcccaatctggggaggaggacgagacgacgcacgcacacgcacgcacgcgcgacggatcgatcaagactggattggattggattccttcactctcctccaccacctttactcctcctctcgctttaccctttttgtccacctgtctcccaccctttcttctccctcttctctctaatctaatctcatctcatctccctaatgccaatcaatcgatcaatcttggtgtgcaaattggcaatgcaatgcaccttcccccaccctccccatctgtctcctcctcaagcttcttgtgccttctctatgagtgataaaatagctcaacagcagtggatggatcaatggaggaggagtggggctcagcggctcaaggaaggtgagagagaaaagcaaggggaaaggtggagagggaaagagagagagagagagaatgcaaggaaaagtggagtgaattgttgttgaagctcaattgctcatgatgatggtgtgtgtggccacatggtcactgactctcactggctttggcactgctgctgctgctgctgatggttggtgattattgctgggttaattgcttgtgggttttacctttggaattttgctgtggtattaggtggtaatgctggttgtgatctcactgtcccattgacattgtctgcgtgtagcagttaagtgtaaacaatatacgtttccattgatacaggaaaaaaaatacaattctacaatctttgaagactatagtcagaaaaaagaacaaggcaaccacactatacgtctacgtctgattctactgctaaaaacaataagcttgttcaataaaaggggaaggaagcctccacatggaagaagtcgtgaatacatgactgcatgtttgcgtccatcataagtacataactttagattttgatgactgcaattagacacactcgggtgcaataacacttgaaatttagaaagtttaaggcttagttcttgttggattacttacttaaattatttaaataaattatctactactctacgctttgaaaaatacattttctcgaaaaaaaaaaattcttccaatataggaccagttgttttatattatttcttaattttatttattaaatattaaattattccccataataaagtagataattcaacgtaacaattcacttaattaat

SEQ ID NO: 65917 - DNA, 10558 bp, Oryza sativa
aactcggcatcatgactacagaagtattggcaactaggtaaatgcatatagtttaaccagttatataaaaatttcgtaaaatttaataatatagacgatgataatataaaacactttacaaaacatgcaattctaaatgcgatctacacatgaagaaaaaaataacaatttttatctgcgttgtacgggcactattcactatctaattttattattttgtttctctagttatagatcaaatatagtcttgcatgtttgtatataaacttatatcatcacaattagtattacttttttttatatttttataactatttgagtcacatgtatatgatgggtaccaagacacatatagcgaagaaaatcctggttcatcatgactaacaaagttattcctagtgtaaactatttccttggaaggtttgaacaaccatgctatggagtagtacccagattcttttctactcggatttggccactatatcataacaaggaaaaaaaggtagtgagtatgcactcaaagtccacagtaggtccacaactgttaacacgaaaaattccaccacatgctgccatcacaaatcggctactcatgcaagaaacccatgcaatacactgtgaccagaaaagcattatgttagattaagggatgtcaggacagctagaaaatgccaaaaatataaatatagttatattccaattgtgtgtaagtgtgatactgccaaaaaagtaaatatagttatattccagttgtgtgtaagtgtgatacagccgtcagccatgggaggaatttaatcatccatgtagggtgccaaacgactatgacacttcttccctcacgcgtcagcaggtaattactgtgaaatgttgctttactagtagttttagtaagtacggagtactagatttcttaaaatttgtttggtttcatcattaattaattgacaaagtttggggatcgtttaattaagcactaggattgtcgttatcattatggacgaggaagaatcgaacaaccggcagaaaccaaaaatgtgcagctagatgttactcactttaattatattactgaggagcaagctaattaagctagccaacgaattaaggcagctgtacagcatatgtgcacattgcgcttatgccaatttaattcacttcttgtcatctaaacttatacacacaacttaaacttgcaaactaaactgacatagtgtgaatgatggggaatggattctactaatcctcgagcagatattccatgggtatttttttctccaaactcaatataaatatttacaaaaaatttaaaacaattgacaatatagaatataagtggcatctattattttttaaaaaaaacaagtttgagaaaagaaaagataaatttggatatgatgaatttatttttttcactccatatgtgtgagttaattgtcgatttaggattttgtgaagtggtatatgtagtatatgtcatcaaaaaaaatttaaaagaaagatgttttatacttctttaaaagtctctagtagtggtggtggacatgctctcatgtctagatccgttgtcctaaataataacacatttaatcatagattagtgtattatgggccgaggagagtacatatatatttttgctaattttcataaatattaggatggtttctaacaaacgaagcggccaggacatcccctggtcgaatgaaagcgtacatgcatttatgttttcccatgtaattggaaaatacagctgtacggtagtagtattactccctcaatcccaaaataagcgcagccataagtttctgtatccaactgtaatcatccgtcttatttaaattcattttttaaaaaactaaaaaaatataagtcacgcataaaatactattcatgttttataatataataacaataaaaaaactaattataaaaaatggatacggaaacttatggtcgcgcttattttgggacagagagattatttctcaaaataactaatcggaattccccacggagctaactccgtcctaaaatataaacatttgtagcatagtgacaagtcaaatatttttaactttaactattaattgcaaagaaataaaaaagatcaatcatgtaaaattgatgttactagatttatcattaaacaaaatatcataatatataattatttttatttaaaatatcttacttttataaatattattggttggttaggatctaaaaataccaaggaaattgccaatcaccaagcagtcaccatctaccatacattgcaacgtgcatcctgaagctttttctctcaagcttgttgctgctgtgctgtccaccctgcttgcaccggccatggcccatatggtggccagccaggggcgtaatcatgactgctaccacgaagaggggtcaccggcattcagatacgcaggacttgttcactttattattgtttcattcaaccaaacgaaaattttatgttactaagttttaataagctaataaattaaacagatgtccatatcaaaaaattgatagtagttcccaaacttttctctcacaaagccactactccctccgtttcaggttataagatgttttaagtttggtcaaaatcaaattgttttaagtatgataaagtttatagaaaaaaatagtaatatttttatccaagataaatttactaaaaatatatttaattattaatttaataaaactaatttgttaatgtaaatattactatatttgtttataaacttagtcaaacttgaagcagtttggttaaaacattttataacctaaaacggaggtagattttgaaaaggcacagactaaacacatacaacactatcaaaatttaggtaacgtcaaaacttataaaaaaatttggtattgtctaaatttgataaggttgtctctttttcattaagatatggattttatcttagtttccgttagcacgctttttaaactgctaaacagtatatttcgtgcgaaaactttctaatatacaagttgctttaaaatatctgataaaccacttttaaatttataacaattaaaacttaattaatcatatcttaatgatttttattttgttttctaccacctaacctcatactatttcatcaacggtagaaacgaaccccagctcagagcataactaaagatttgcccttgattggcccgaagcgtcttgcacgcctcgcatcgcatatacgcgacgcgcccacacacagctgcatatgctgcacaaagcttttgcagatgcatgtgttggcctcagctttccagggtacggtcgctggctcaccaaggcaatatgcagatctcagctctcacatctagctaactaacttgtgtactacccgtaactgtgtctgtgtgttggtacaatcgtgcatcgcgtgacacgtgatcggatccatatatcggtcgacagttcgacacctacctaatttattgttagcatcggagggggttatacagggacctgtaccgtttaattttgtctctccaccacttgcaaatatacagatacggataagattagagaagagttagtagtagtacaccacctaagctcgttaactcatcctgtgctggtcgcattcttttgccaacatagagttggtggtgggactgtttttaacttcctgcgagagacaatccatactgtggtagatgtgatttctatttgttttcgagccgttttcatccttatctaaaacggtgtttagattcgtgatgagaactgtagggaaattcctcccgtaccaatatagttttcgtaagaaaataatatcgttttttattgttttcatttctagccatatataaatttttttttcttaacttctttcagcacagtattaggaggagaccgtggatcgaacgagagaatgcaagttccactatcttggaggtgaggaggacctgttggtgtgtggctcctcgaagccaatgctgtggcaccgagacttacaacggtgagtagagaggagcagggagtggtgtgcgtttggtcagcgtctatagcaagattcggggcgaggctcaatggtgtaagagcttcaatgtgatgacgcggagccgataataggttatgctcgagccatgtaggtgttgcccaaatagagtaaagctggaaatagaagctgaggcgccgacaaactcctacaacataacagtttgggggaggagaggagaaaggagcatcacgacataagtcaaggagcctccgtctctggttgagggatgcaaactagacttggtccgcttgtgttgacatggcatcccaatcacaaaatagaagtgaggcccatgtgtaagtgactggggacaaaataaaataaaaattatagggcctacttgtcaggctctttctccacttaatatcttttttcccaaatcctcccctctatatttttcccaaatcctccacactcagtgcagctcatgtctagcaccggtggcctcgtcctagcatcgctgcagctgtgggagagggagcggttcgtcatgatggcagatgacgtggtcggtggacacaaacgaacgacgatggtgatgacacgtagaaggagagcgggcgcgagcgcgcaaggcgtggagtaggataaggaagaagggggcaggttccatggtgaccaccacttggcaacaccctggtgagcagaccctaacagccataatcatactgtcgagaagaaaaccctaaagccgcccaacttcctcaagctcgtatttcaccgtggcgttgtgggggtcccttcagtaggccagtggtgacggcgaggaggtaggacaaatcatgctcttgccgacttaggtcgtcaactggcttgaggccgtcgtagattttgtcgtgggcaagggagcaaatccaacaaggtgggcgattggccgcaacatcttcatcatctcctcctccttccacttatattttcctgtcgttatgccatagttgccgaacaggctgtcctcgtcgtggctgatagatacaccaaccaggagacatcacgacacgtcatcgctgttccgccacctctgcagcgtccccatgtgcgacgatgggcccaccacactgtgtcgaatcaagcacgtatcagatgtgtcacgatagccacggtgcatgcggaggaggcatatgacaatgtttgccaccgtcgccctaccgctgctagctgccgcccgtcccacttctccaagaaaagattaggaggggagaagggacctaacaagtgggccccgccagtttttaaatttttcactagtcacttatatgtggaacccactgatattttgtgatggggctaccacaccaacaccggtagacaagtcaacatgcctcgttcatgaaaaccactctcgaaatcgaggaggaagttaaattacaccgattttaatagttgaaggatcaatatatctggtactactgttgagggatgcgtatcaaattgaacctatatttgagggactcaaagtgaacttattcccccaaacaagtatgctgactgccaagtgaaagcccaacagaatcactggtgtttgcgggcagcgtcgagctcggcctagcccacaagcatgcatgccacactagcttagctgtctcatgccaccactaaacatgagatgcatgcttgccgctaggcgctgactggtgacgcctgttgataaccgtagatacgcttgcagcctctggctctccgtacacgtatatatatgctcagatgcatgcaccgatgcgtgccaacgtacgttgcagatggcctccctgactgcacacgcgtacacgcacgtacgcaaggaccagcggatccgaccgccaattctcgcgtggcatgcatgacaagcagctagcaccaccacatcgtatgacacgtagatcacgatgatcgcctcgaaatcccctcctgtactctactacactacgactacccattttcatcgatccatcgcggccggcagccatgtctccgatgaggccgcgctcctccagcgcgagctcgacgtcgccggtggcggggaagaaggagaagacggcgacgaagccagctggtggtggtgctcgcgatccgcccaagggaaggtcgtcgtcgttcgcgtgcagggtgtgcggcaagaggttcccgtcgcagcaagccatggccggccacgaggatcactgccgccgccacgaggatcacgtccgcgaggcagctgctgccaccgccgccgcagtcgtcgttgtcgccaccgccaccgcttccggtggttgctctaaccgtgcaacttgcggtgctcttctggcgtcttacacctgtgcgactcagcttcttgccgctgccgccgtcgcagattggtcacaggtggccgccgggatccctctttccaaagagcagcttgttgtcgccgtcgccatcgtcctcgccgacgacgggtgagccggcgagtgccacggttgatgtgacgctccggctgggctccggtggcaagcgcgggaacgagaagcctctggtcgagtcactgatggtgccggcggcaagcctacacggtcaccgaggagagcagggtcgcgaaggcacgagggcgagggggatggacggctgtgatcatggtaggaagaaggggaaagcccagatggacggattggatctagagctgcatcttcaccgctagtttagtaaagggtttattaccgggagcagattacaaaattagggatttgttagacagctgcctgctgttttttttttttttgcgcttttgtcagctggatttgtggccatgggatttttcttcaagatttgtgcacaagccagcccaaggcgtgtcctcccttcagccacaaacgagcccaagctacagttcaaaaacataaatcctcatcttccaatttctcctgcatgaatgggaggaaagcaagagaagctgtcggtgagagagagatcgagagaggatgcggcgaagcaagaagcagcgacctcgatgttgtcggcgtcttctccgccggttggagctcctggttgtgggcttgtggcgcagccagggccaggcagcagaggtgtttctgttggatctcgccgctgaagagttgaatcttggaccatcaatgaacaacgaggccacatcgatccccaaggtgagtattccccatggagatttatgcgttgaaatttatcacatctgttcatgtgggggctgccggattaatgaaaaatccattaagcaaatatgtttgtgactcactaaattacacaatgatgaacattaacatgtgtgtttattgaactaccgaaaaacgatacgtgccccggaaggaactacgagcttccatcttctgtacacatcggagggaccatttggctggatcctacgaaccgtgcaaaccctccctgccattcactggtggtagttgtatgcggaatagaagggatcactctgtactacctgcaataatctctataggtaaacattgaattcaaaaatagcaccagttgatccatgccagcaaaaaaaaaggaccatatgatggggaaaaataatcaagcttggtttttctggagcttttcaactcctgcctcacatgtacgagagagcaaagaaaaaaaatgcatagggaatagaacttgcaatagaactacagaaataaaaggctttccaagcaatccatggtcccacacagcgcatgactgtagaaaggtttgcaaagttcagaaaataaatggtaaaatgaccacctaattttggtatattctgaaaattagtccataaaaatagtgtgtattgtacttttaagtccctagattaaattagcatggggtggaacaattaattctataagttatgccacttgtacgtaaaaaaactgtgcatgaaaaagagctaaattttaggacgattttcataataatgtgtaaagcttttggtttaatttagagaaaggttaccataactataatgatttaaaataattcgtgcacctaatataattaatatgttttcatatacatagcttgtaacaggttgattagagtcgtgtgaatgctatactatatacaatagtactagagaagttaacaagtcatccatacaaaaatattttgtgaaacagtttctaccggtaccgatgtaaacccttgatgccactgtgatcctccttttgttgttggtataggcctaaccaactgcatgctaacaagttaacaagtagtatgctcgaaaactatttgtatcataataggctttacctgcattgtccggtcagtttatcgtagacggtgccacaggccttgccgacgacctaggacgtgtggaagctgagggtcttgcctatgtcgaaggcctagaagaggtagaagaggtagacggttgttccagtagggggtccgcaaacctgtgtcctgtgggacggtggacttctgatgcacgcctgcacgatgccccccgcataatacgtttgcatttctgtcgcattcggtccagagcagacatcatctcctcaagggacccagctatattgtcacgcagcttctcccacagtgaggttgtgtcagaatatagttcctccgcaatatcgccctacgaaaataaatgttacaatgattacaggttgcggtaagattattgtttcattaaaaatttagtggataatatgttaccgtcaggtgggtaactggcgctgactgcatagggtacagcgtgtccacgtcggctatttcaggaatatatggatcctctattgtcacaaggcatacgcgtgtttatgcgatgtaccaccgcatgtacaacgcgtacatacgacggtcgtacggtctggattcgttaatatatcgaatgttgccctcgaacattgttcgacccaaggggtcatcttaccaacgatatttcgccacacgctagcatctcccttcctcttttctaacaaaaaaactcatcattaggtgttgagttaagtagtataattcggacacacggtaattaatgggaatccaattgaatttaacttataagtgtatttttttggagggggggactgtttcaccaagcaggagaggcacttcttggtaaaggctgaattgcctcattacacgctgtagattgtacgcctcaacggctatatcgtagacaagcatctttttcatcagccagtaagacgagtcacgcaagtagagtatactgaggtcggcaggggcacgacgttgtgtctcctcttccgtgtatggacaccactgaacgtatcctccttaagtagatcgaacgcctcagtgaagtactcgtacacgcttcgagcctgaacgttcgtccactgtggttgcatgttattaaataaatagtaagattatagctgtacgaactaaatgcaaatgtacaaaaaaaaatttctacgtaccggtccctagcaccaacgcatgccataagtaggcctatcatctgtagtgttaccaaataagctagaatatgccacagttccaggcacgtatggtcgtcccaatgggaagcgttcttaagaccatagcatgaacaacaacggacaaccagtaaacataggttgcttaaagcttgtctttgtgcatgcttcacatagatctcggtaagttgtagccaaaactgctgatccccaactccactagggaaaactttctatgttgccctgcacaataaatcttgctatggaaatcattctcgcatccactatgtatccgtgtccacttgtgaacataacccatccaaaaagccatagaaggtaagcctccaaatgcaattccacatggtaattttctacgtcctctctcgtgaaagaaacctacaaaggtacacagaaaatttcaataacaaaacataatatcatcaatggaagttttttgtatgaattagtttttcctcgaactggatgagccagtgtaacgtagggccgcgcgcttcatctttatagaaaagtcctttcatgtctctatcatcctctggaacaatgtaagcatatcttccaataatatcatccctccattccacaggtgggtcggggaggacaattgtctgtcctgcaagtggtagccctataagcatggatacatctcgcagtgtaattgccatctctccacacgggaggtggaaagtgtgagtctccggcctccatctgtcgaccaatgcagttagaagtcccttgtgtataatctatcggcgtgtgtctctagatgacacatcttcatcttcctcgtcagtgtcttcccttttatttgctttccgtcggcgtgcactttgttgtcttgctaccatgtaatcgtaatgccctctagcctgcaacatcctaacaaaaagaagaatgcctgcaacaagacatccttgcataacgagttgttgcgtcagacaaaatttacaataattgcagcaaaaaaattaacaaaaattcatgtaagtgtgtaaaaaaattagttaccttggtaaccaacgttcgtcgactccccacattgggaaagtccgcgttatgaagaccgacataccacttggacgactggaagacattagccatgcatggtgccatgcatcgatgtctctactgagtaacgggtaggattctggaagaca

SEQ ID NO: 65918 - DNA, 3195 bp, Oryza sativa
tatgtccaagtggtacatcgcacaaacacatgtatgtcttgtgacaatagaggatccagatattcctgaaatagccaacgtggacacgctgtaccctatgcagtcagcgccagttacccacctgacggtaacatattatccactaaatttttaatgaaacaataatcttaccgcaacctgtaatcattgtaacatttattttcgtagggcgatattgtggaggaactatattctgacacaacctcactgtgggagaagctgcgtgacaatatagctgggtccctcgaggagatgatgtctgctctagaccgaatgcgacagaaatgcaaacgtattatgcgggggcatagtacaggcatgcatcagaagtccaccgtcccacaggacacaggtttgcggaccccctaccggaacaaccgtctacctcttctaggccttccacatcggcaagaccctcagcttccacacgtcctggacgtcggcaaggcctgtggcaccgtctacgataaaccgatcggacaatgcaggtaaagcctattatgatacaaatagttttcgagcatactacttgttaacttgttagcacgcaagtggttaggcctatacaacaataacaggaggatcacagtggcatcaagggttcacatcggtaccgggtagaaactgtttcacaaaatatttttgcatggatgacttgttaacttctcatctagtacaactgtatatagtctagcattcacactactttaatcaacatgttacaagctatgtatatgaaaatatatgaattatattagatgcacgaattgtttttaatcattatacttatggtaacctttctctaaattaaaccaaaagctctacgcattattatgaaaatcgtcctaaaatttagctcatttcatgcacagtttttttaagtacaagtggcctaacttatagaattaattgttccgcctaatgctaatttaatctatggacttaaaagtacaatacacactatttttatggactaattttcagaatatactgaaattaggtggtcgttttaccatttattttctgaactttgcaaacctttctacagccatgcgctgtgtgggacaatggattgcttggaaagccttttatttctatagttctattgcaagttctattccctatgcattttttttctttgctctctcatatatgtgaggcaggagttgaaaagctctagaaaaaccaagcttaattatttgttgtccattagatggtcctatttttttttccgacatggatcaactggtgctatttttaaattcaatgttcacctatagagattattgcaggtagtatagcagtgatcccttctattctgcgtgtaagtacctccagtgaatggcagggagggtttgtgtggttcgcaggatccagccaaatggtccctctgatgtgtacagaagatggaagcttacagttctttccagggcacgtagcgttttccggtagttcaataaacacgcatgttaatgttcatcattttgtaatttagttagtcacaaacatatttgcttaattttgcaggtgtaccttaagttaacatgctcatgtttccaacgggtatgaacgatcagtggtatggagcttccacatacaacactggttcgtacataatgtgtttcatttttgacgatccttatattgcgatattaaattagcgctgcacctgcaggggatctaccaaatgtccataactgaaaatgtacaaccacaaggaccaagctttttggacatgttaggccaaggagattggttgttcagtcaatcacctatcatgcaaccacaaacaacatgtacaaattacaatatactttaaaatattttagctccagtatgttagtgggctacaactttggattccatgttttgtaggaatgtacactgccgaccaaatgataggatatgccgacagcacacagtcctacagagaaccatgtagctacggtgggggtcgtcaacagcactacacgagataggaccgtcgcatattgatgaaccacctccaataactcagctgacccaagactacgggcatgttgatttcagcggtgttaaggtggcacataggtctgtccgcgagtgacattcacctgaaagattatctttgtcaagacgcagacctccagctagtgctagaagaaagggaaagaaaaaggacactagcacatcacgaaattttgatgatgaggctaatgagtggaacgattttatattttgctctttcgaactaatatgtaatgttgtgtgttcaaactttctaatgtgtcagctacatttctaaagaaataaattcgaaatatttacccgctttcccttcacgaacacttacagatatttacctttacacaacacttcagtgggtttgagcgctttgcaaattcacagcattatcttttggtaagcccccaatatgcgccataaatcatcgcgtactcagttcataccacaagatagggcctgtgaattcgcaaagcgcactaacttattgaagcttacaccaatgatagactctacgaatatgaattatatgctatacttgagtctgtttctttcatttcgtaactttcattttataggcactcaacgagtaggctctgtaaccagacgacaacaaacttttggcggacatcccctgaaaaatgctaggactagagaagagaatcactctctcctttatttctggctgagaatgccaaatggagcaagaggacaaaagaactttcggtggacaaaacaactttcgatgcggtcccgcagaatggaggtgcggagtagtagtgcgatcccgcgcgctaggaatgtggcatcgatgccccacgggaccggctcggtgctaccgtttggggctgcgttctgtgtgaccggtcgggccggtggccggtcccgcgtgcaacaccaactcgcacagccgtgacgcgggaccggctcggttccgcacccccggtctgcgcgaccgtgccggtcctgcactcccaggctacggtaccgcgttcccgcgccgtgccctgtgttactatcttactcccgcatttccagcgcgtggaggaggtatatgtttgctaaactttaccacccaggtatataaatgcaaattattaaaaaaagtatatttttaaatttaattcaagttaggatcagctgtaccacagctct

SEQ ID NO: 65919 - DNA, 3655 bp, Oryza sativa
tggtgattcaattggaatgtctgtggatagtaaaaactgaacaaaacaatccccattaccctcatatgctaacctgatggagaaatttgtcagttagtaacagttaatcaaggttatgttagttttgtcaaccgagtaactaattcttttctacaagaaagtaccacatctgagctgaccattgctaatgctctgaacaaaagacacagaaggctaaagacgatagtcggaagaggacactgcggactggctttgcgggatcgattggagcagcctatcagaatgagggaagaactaaagaagtaaagaggctgacaagcttagtacagtaggttaatttctgtaatgtttgcagatcttctacaaacaaggtatgcttgttgtgtgtatatagattgatccccattgatgttgcttgtctgaataaaaggatgatgtgattaggagacaaggaggcacaggtgtgacgctatcaggtagttgggctaccattttaacgattgtgtgttgatgggcttgttttgttgacgaacaaatcggcaagcctcagaatttgaataaactcgcacaaaagcgtgacgtgcgcgcgggggaggtgcccgtggcagggcagtcaacagatgacgctacttgtttcatcatgtggagaggaaaccgactaaaatagtataggacccgcgcagattgtgcggctagcatcgttatatttttctcatataatagcatatataatttaacattttaaaatggcaatataattttaaacttttgtctcaaatgaccgtggtggcgtggtggtggagttgtggctgcatgactccacctagcagaattcaaatctggtgcctataaatattatgcatatttaagcttttgaaccaaactttagtgtgattagtaaaaaaatgactcaactaactatgatattttgctaatatagtaatttctctgtctataaagcaaacgtgctaggatatgtaagtcatggtatttctttttgtcttctttcctccatcttcatcctattagtatcatcctcttattatttttagtggcatttttcatcaactagataagacatattgtattagtgatagtttatattgtatcaaatattcctcacagtttcgaggaaatttgttgtcacgttagtacagattcgaggatataatcttatctgttagtatattgttttaatgtagattgggaataaagttatttttttgaaaaaaagtatgaattgccccataaactattctagtcgacccaattacccctgaacctaaaaaccagacgtcactcactctaaactttcaataccggatgaattacccccctcaatctaatccaaagcggttttgtcccacgtgaagtacgcgtggcgatctaatcaatattttctttttaaaaaatggtgagacccacgtgtaatacctcctctacccctctttttctctctcctcgcgccggcgcgcacagcggcgcacggcagcgcgcgaaagcgggcggtcgacgcacaagacacggaggcggtgggcccctcggctgccaccgccgctgccgaggcagaggtggagaaggccaggacagagtgggtggccaggagtgcgcggtggtggagggagtcggaggaggtggagatggaggaggaggggatgggggcgggagggagagaggaggagcggagggcggcgcgcggggaggtgtaggggatggggccgcgcgccgctcgacttgcgcccatgccgatgacgcggcgctcaccccatatccctcgcctccttttcctccacgagctcgaatccgagagtttcgattcggcagcgacgacgttggagtgggtggtgcttgaggcgatcatggtgctgcttctgacgctgccagtgctggacaggctcccggtgcgggatgatctccgtggtgcggagcgcgctgaagacgatgatgttgatggtgctcttctgcctcttcctgctgatggacatctactggaagtacgaggtgcggcccacctacaatgacgagcaccactgcaccccgtccgagcacctccgccaccagaaatccatcatgaagccgcagcgcagcgcgctcctcatcgccactgcgctggtcctctactggatccttcttccctgtcaccttcctcgtcgtcaggcttgaccagctctagcagcgtgtcaacaagctcaagaagcaggatgactaactctagctgatcctgctaccccctgattcagcgtgtcgattggcccgaccgtgacccgcccaccgccgacttgcacccgcgccagacgacgcaaggagagagaaagaggggggaattggggaagaggaggtatgttatgtgggtcacatcattttttaaaaaaaagaaaatgctgactggattgccacgcgtacgccacgtaggataaaaccactctaaattgcataggggggtaattcgtccggtgttgaaaatttaaggtgagctatgtctggtttcaagttcagggaggtaataattaggtcgaccgtaattgttcagggggtaattcgtacttttttcttatattttatttgatcacctcgtaggactaatgtggggcttgaaaaagcgccccccccccccgcgcgtggccaggccggcccgcacgggcgccgcctccacgaccaccccggcgccggccccaccttttcattgctgccgccacacagagccagccgacgctcagccgagcacggacgcgagctgcgccttgaaggaagaggaaggcggggtggccatgggcgccggcgaggagctcaaggaaggaggagggaaggtcggcgatgaggccggcgtcatcttcttcatcttctgccagccgtcgatttcatttagggagagaagagaaggggaaggaggccggcaacagcccctctctgtcggcaaccattgccgagacagaaagaagataaaagagttggcactatcatctaggacccgccgccgccatgtcgcccgccacctcctcctctcccgcctctccccggcgcctcctcccttgccaccggccggctttgcctagagaacgtgacaagagtgagagagaggaggaagggagagagaaggatgatgtggcatccatacatgtgggtcccacgtgggtcccacgctgactcagccgccacgtaggacaaaaccggggtcaaaaccacagaatgacctattgtgattggttttgattagttaagagacgccggatatctggttttgcggttgggggacgattttgtaactcgatgacaagttgagggaccttcggtctactttttccaagaagagtttgccaagtcctaaagaccaccttttatgattttatctaaggaaaaagtatacttggactccctcaactatcgcccgagtatgattcatgtcctccaaccacaaaaccggtgcaaacaatgtccctaagtggttttggaggtggttttagctgacgtggcgcctacgtggcagtcttgaccgagtatttgtcctacgtggtgcttatgtggcattagaataaaaacaaaaataaaaaatatgtgcgacacatgtcattcacaaaaaagagtattgtgggactcacatgtcattctccctctccttcccttcttcctccccctctctctcccttatctccctccc

SEQ ID NO: 65920 - DNA, 10954 bp, Oryza sativa
agagagagataagggagagcgagagggaggatgacatgtgggtcccacaatacttttttgtgtgaatgacatacgggtcccacatttttttttaacttaggtgattccctgcgctttgctgcggaaattactaagtaacttttatattttgtaataatctagctaaaaataaaaattctattagttattaaaaacaaataaaactgatttgtgaaactatgttaatagagaaataaatttagtagactctgtatgaaatataatattccgcactttgattatatggatgaatatttgttaagtattataaaaataatggatatatatatgttaaaaatattgtgaaaaataatgtgaaggaagatgattggatattgatttgtagaattcaatgaattatagatgatgttgcatgcttgcatgttacactatgataagttttgtatgtattattgctagtggatgatgaggtggcatgttgagctttagaattagtaggttataactctatagtaaagataagatttttgtttttattttaataccacgtaagcgccacgtaggacaaagaatcggtcaagaccgccatgtcagccgaaaccacctccaaaaccatctaggaatattgtttgcacatattttaataattgaaggagttgatatatctaattttatggctggagaacatgaatgctactcggacgacagttgagggagttttatctgacgggccctcgtagtccgagcccacacgaccatctaagtgaacagggcccagagagagagagagagagagcccaaagtcaagtgaagtccagcccacggcggtgctcgcgcccgcggcttcccgacgccacccaccgctgccgctgttagtaataagtctagctgctcagagtagttagtttccctctgtttttacgttgagtcttgcacatgatctgttcatcctgtttgtgtgcatagtgggcttgacgcacgctgcgttcgtgcggagtccgtggtgtcgtgcatggtgtgctccagttcgtgggatggcgcgaagtggcaaggagtgtggcacgcacaattaggaggccactatggccacgtttaactttcttgtaatttgctatttaaggttaagctctaatccagaaaagctgccagttaatgcagcgccaaaatactctgtgttgctctgtttctgttttgccagacaagctacagtttttcgttttgccgctaacaattggtatcagagccttcggtgatcgccggggttcctgatgtcgctaccaacgccacgcgtctcccactcaccaccgcgtcgtcgctggcgctcgccgtctccgcgccgtggccgtcatggcagccgcggccaaggtcgtggtggaacgcagtcgtccgcgaggcgaccacgagcagcgtcttctacccgacactcacccacacaaattaccaagactgggcgctggtaatgtgggtgaacatgcaggcccaaggtctgtggggcgcggtggagccggagggcgatgatctcgtcgactatcggcaggaccggcaggcgctcgccgcgatacttcgcgccgtgcccgccgagatgctcgccacgctcgctgtcaagggaggacggcgcaggaggcgtggaagcgatcaagactcgccgtatcggtgtgcagcgcgtgcgtgagggtgaatgcacagcagctgcgccgagaattcggtgatatcctcttcaaggacggtgaaaccgtcgacgacttctcgatgcggatcggcggcctcgccaacaaccttcgcaccttaggtgataatatcactgaagctgaggtcgttcagaaattgttgcaggttgtcccagaacatctccagcaaatagccatctcgattgagaccttgctcgacgtcaatgaggtgtctctcgaggaggttactgggcgtctgcgctccgtcgagcaacgcaagcagcgcaagactgcggcggcatcgagtcaggtcgacgccaatggccgtctcctcttcaccgaggaagaatggctggcgaaattccgcaaggcggcctctctgcaagacgccgctcactcctccggcggcaacggcgaccaccggggtcgagggcgtgggaagaaggacggtggagccccgaaggaggcccagcccaagccagccaacccgggaggccgtaacccgggaaattgcaagaattgcggcaagaggggacattgggccaaagactgtcgcagcaagcccaaggcccagcaagcttacgtagcccaggaggaggacgaagagcctgctctgctcctagccaaggtgcagctggatccgccgcgtcctcgcgtcgctgcaccgacaaacgtcgtctcgccaccgagcgcgccgagggcgccttcgccgatgggcgaactcgccgtagtcgaggcaagggtcttcgcgcagctagacgacggtggcgaacatgatccggcaatgtggatcctggatactggcgcaaccaaccatatgaccgggtcccgctccgctttcgccgagctcgacacggtggtcaccggcactgtcaggtttggcgacggctcggtggttcgcatcgagggccgcggcaccgtcctgttctcctgcaggttcggggaacaccgcggcatcgccggggtctactacatcccgcggctcatggcgaacatcgtcagccttggacagctggatcgttccggcagcaaggtactgattcatcacggcgtcctgcgcgtgtgggatcctcgagggcacctactcgtccgtgtccgacgctccgacgactgcctctacaccatcaatctgtacatcgaccgtccggtctgcctcgcggcaaggagcgccgagccggcgtggcggtggcacgccaggtacggccacctcaactttcctgctctccgcaagctcgcgcaacaggaaatggttcgtgggctgccgctgctgcaacaagtcactcaagtctgcgatggctgtttgctcgggaagcagcggcgagcggcgttcccgacgtagtccaagtaccgcgctgacgaacacctggagctcgtccacggcgatctctgtgggccgatcgaacctgcaacgccggctggtaattggtattttttgttgcttgtcgatgacatgagccgctatatgtggctaaccttgatcaggagcaaggatgaggccgcgaacgccatcaagcactttcaggcccgtgcagaggtggagtccgggcgcaaactccgtgcactgcgcacggatcgtggcggcgaattcacctcaatcgaatttggggaatactgcgccaatctcggagttggtcggcagttgacggcgccctactccccgcagcagaacggagtagtggagcatcgaaaccaaaccatcgtcgccactgcccgcagcatgttgaaggcgaagggtgttcctgggcggttctggggagaggccatgtccacagcggtctttctcttgaatcgttcgccgacgaaaagcttggacaaccaaacgccctatgaagcatggtatggccaacggcccgctatgcatttccggcgcactttcgggtgcagggggcacgtcaagatcaccaagcccgggctgaagaaactcgatgaccggagtgcgccaatggtgctcctcggctacgtgcaaggctcgaaggcctaccggctctatgatccagtcagcgagcgcgtccatgtgtcagggacgtggtgtttgatgaagacgccgcctgggactggggaccagtgacgcccgatggtgctccccagctcgagccgttcaccgtcgaataggtggtgacgaccaccatcgggacggcacctgcttcgttgccgactccgccctcgccaccatcgccggctccgtcggcccccacgacgccggcacctccgtcgcctccgttgccggaggcggttgagtttgtcatgccgcctacccaggattccatcctggacgccgacgcagatgacgacgtcgtgcctcgctaccgcctggtggataacctgctggggaatgcctcaccgcctggacacgctccgcgggtgctggaatagctcgagctccatgttgtgagcgccgacgaacctgcttcactggctgaggcggatccaaactggcgtggcgccatgcaagacgagcttaacgcgatcgtcgacaacgacacttggtcgctcactgacctaccccatggccaccgtgcaattgggctaaaatgggtctacaagctgaaacgtgacgaacagggggcgatcgtgcgctacaaggcgcgcctcgtcgctaaggggtacgtccaatgacagggggtggacttcgacgaggtcttcgcacctgtcgcccggctggaatcggtgcgcctccttctcgccgtcgccgcgcaccaagggtggcaagtccaccacatggacgtcaagtcggcattcctcaacggcgagctgctcgaggaagtttatgtctcgcagccgctgggtttcgtcgacgacaaccacaagaacaaggtgtatcgcctgcacaaagctctttacggcttgcgccaggcgcctcgcgcgtggaatgccaaacttgatagctccttgctgtcactcggctttcaccgcagcagctccgagcatggtgtgtacacacgcaccaggggaggaagacgactgacggtgggcgtctacgtcgatgacctcatcatcaccggcgatcacgacgacgagatccgcagcttcaagggagagatgatgaagctcttcaagatgagtgatttggggcactcagatactacctcggcatcgaggttacccaggacagtgatgggatcacgctggggcaagccgcatatgccggcaagattcttgagaaggcaggactcaaggactgcaatccctgtcagactcccatggaggtacgtttgaaattgagaaagggttcagattttccacttgtggatgctacattgtatcgcagcttggttgggagtctgcgctatctcgtcaacacgcgacccgacctggcattctctgttgggtatgtcagtcgcttcatggagtcacccagggaagatcatctcgcagccgttcggcgcatactgcgctatgtggcaggcactcgctgctggggaattcgatttggcccaggtgcacggtgcgctttgccaatgttggttggttactctgacagtgatctggctggcgatccagatgagcgaaagagcacgtccggccagattttcttcgtcaatggcgggcctatcacttggcagtcctccaagcagaaggtggtggcattgtcctcctgtgaggccgagtacatcgccgcagccgccgcaacatgtcaaggagtatggctcgcgcggctgttagcggaggtgctgggcgacgagatcgccgcaccgctgctgaaggtggacaaccagtccacaatatcattgataaaaaatccagtgcatcatgaccggagtaagcatatcgatgtcaaatatcattatatccgggagtgtgcagaaaagaaactgatcgaaatgatgttcgtgggaactgcggagcagctcggtgatatattcaccaaatctctgggcagaaccaggtttcaggagcttcgtttaaagatcggtgtctgttctcttgacaagagcggtcagacttaagggggtgatttgttagtaataagtctagctgctcagagtagttagtttccctccgtttttacgttgagtcttgtacatgatctgttcatcctgtttgtgttcatagtgggcttgacgcacgctgcgttcgtgcggagtccgtggtgtcgtgcgtggtgtgctccagttcgtgggatggcgcgaagtggcaaggagtgtggcacgcacaattaggaggccactatggccacgtttaactttcttgtaacttgctatttaatgttaagctctaatccagaaaagctgcctttctgttttgctagacaagctacatttcgttttgccgctaacagccgcccactccaccactagtccactgcctcgactgtaccgccgcccccacgtggccggcgccggcgccaccgaccgaccgcccgtgacgccacgccatccaatccgcccgaatccgccccgcaagattccgccgccgaattcccccgccataaatagccgcaagtgtgactgtgtgtgagcactgcagcagcagcagccgccatcacagtctcagctcactcgctcttctccagaggaggcggcggtctctcctccccccctcgccgtctgccggagatgaagtgggccgccgccgccgccgccactgcctcggccgcggccaccgccgtcgcgtccgccgccaccgccgccgccaccgagcgctgcgtcaccccatgctccaatcccacggcacgctccatcccgagacctttgttccttgtggctgggtgtggattgctcacgctcgcgcgtgtttgtttgttacttctgcaggggtcgccggcgtcgagggggaatgggcggaggagcgcggcggaggaccggttcgcgccgcggttcgacgggctgcgcttcatcgagaccctcgtcaccgctcaccgttgaaccgccatggcagagcaggattcatggcttagttaggtagctagattagcattcgcgaagagcagaatggatttcagttagcctcaggatgggtgaaagatgaacgaattagttactactaccatcattaattgactgtgctgttcttcctgcttaatctgagtttgaattttgtgcaaattttggcaaacgttttttttcttgggcaggtatattgatttggctcgcgtcgcatttcgagtattcgatgcctagtagaagtactgctgcctactccctccggtcaaaaaaaaaaaaaaaaaaaaaaaagacaaacctccggtcaaaaaaaagacaaacctggttttcgtgtccaacgtttgaccatttattttatttaaaaaaattataaaaaaaaataaaaagacaagtcacgcataaaatattaatcatgttttatcatctaacaaaatgaaaatatgaattataaaaaaatttcatataagacggacagtcaaaattggacacggaaacccagggttttgcctttttttttacggagagatacggaaactcagggtttgtttttttcggagtaattacttaaagttgactttccgctaaatgtcaggcttcaagtacacatgacatggtcgcctcgcctgctagtaaagtgaatactactcccgtccgttcattataaaactaaaaagatgctcactttattaaattaactatttcttattttatcagcttctaatacatttattatttttattttcactaactttaatttactagtatttggaataaacagaagaagaaaaaattaaacaacttagtactatttggcaagagagcgagtaatactaatggtaacagtgtgaaaaataaagtaacccaaggtgaaaatggatgtggggcatctcgcgccgaccacgcaaagagagccaaatcttcacaagtgagtgtgaacgcagacagattctctgccccgtgatccactgtattcctatgcctctttctctgtccacgtttgcgctgttcccaccactggaactctgcaaattgccttgcctactttccccgcggttcttctccacacgaatttggaattcagggcgagtttggcacagctccagctccatccctcctagaactggagctcagctaaacagttttagctctatcaaaactgggaatgaagctgggtaaaactctctcacaaaatgaactagagttgtggagctgggtttaggcagctgcacaactccactctatacccaactcctggagttaaatttaggagttggagctgtaccaaaacagcctctcagtttgtttttgggtggttcttcgaatttaggattgaaaaaaccatagaaactaaaagaacaacatataattttaacagaaatacgactataaaatagagaaatagaaaacataaaaaattacagaaataatatttgagtatatcacataaaaaatgaaggaatcaaataaaagggatagactttaaagaaaatttttcaaaaggtaccagctcttactgatttttctctaaaatttttatatgattgtctactgtaaaggaatttgaaaagaaaaggataatagttgtttgctcaagtcaaagcgagcacacctattttcctcgcccgtaatagttgttttcgacaagtctttcatcgacaattagaaattaacagcagtacagtgatgattatttaatagtgtcatgttacttaatctaatttattttcctaccaaataaagttgacattaacttagtattgattagttggttatctagtatacatgcctatactaatattttttccatgaatttagagaaaccgttaggttcagtttttatgtttaatggttttccccggatatttttctagttatacatgaataacatctggttgaatcttatccctaatctctggatatcctaaattggatatagaaccggcggatgcatatgcatgtctaatcagttcgaccatacataagctagcgatgacaatgtacacagtatccaattatccatcacaacgcatcacaaaggtgcaaggcgatcgatcgaggtgcaccatatattttggataattcatcccaacacgcacttttgaatggacatatagcatctctcatgcagcctcatcttgtttttcctctcctttaattaatctagtactccatcttttgcacataaaaaatgtgtacaggaatgcattttggagggaggtatattctcgacgcacacgcactgcccctatctccgaaaagcacgtccaaccaaaccagaaagccgacgagggagggacagcatgacggaacaacagcgacggccccggttgatcgatgcatgatccttacatatttatattcaacaacttttaggctctgtttatttcgctagacgaaaagttttggcgtgtcacatcggatatacagacacacatttaaagtattaaacatagaaaaaactaattacacatattgcgtgtaaattacgagacgaatttattaagcctaattaatctgtcattagcaaatgtttactgtagcaccacattatcaaatcatagaacgcttaggcttaaaagattcgtctcgcaatttacatataatctgtgtaattagttttgtttggtgaaaagattttgtttgtaaactaaatagggccttaatttcatttctttatgattattaggtcgttcatttatctagccatgatgcatgtgtggtccactcatcaagcttgaaaaaaaatatataacaaaagcgaaagaagctaaaactgaaactgtatataaaaataactcccatggaactggcaatttggatgaggccggttgtcacaatccgtggcgacgcaagcgcttgcgtgaggcgccgggtgaatggatcaatcgaatggaacggcactaacattaacataacggggaagtatgcgtatgatgcaaatatggagcatatctactatcggttgggcgccttcctcggctggggactgctttctccccacgcgatgctcccagccatgcgtacattccacggcgacgacgacgttacttcccctcgctttccccgtcttcttttttctccgaagatgatgttcagctagcgggtctcactgaactgtggcccatgaaacatgctaaattgccaattgccgacatcctcccttggtctttgaggttaggcgggtctgctgtgctatagacatattaattacgctccccttctcgaaatataaggaattttagatgaatgggacattatctgtctagattcgtattattaggaaatgtaatcaccgacggatctgatggatggtctggtggtccccggaccacctaaaaaattgccgacccaaggcccatgtaggtaggtacggcaaaaaaaaaatcccataaaatatattgccgtatcatgtgggttgctaactggcgcgcgcacgtcagcaacggaggtctcgcgcgccctagctggtaccttctgtttcttttttttttcccttttgtgattttcacttttttggtgtttttttttattttttttaatcttcagcacatgtatttttagatctttgggttgaaagtttttagatttgaagttgaaagttttcagatctggtttcgaaagttttcaaatctcgagctgaaaattttcaaatccgagttgaaagttttcaaaatttgtgttacaaatttaaatttcgagtttgtcgagggaagacccccgatcgcggggagtcgcgtgacccccctttcgtgagttcggccgaggtcagagactcatctctccgaagtcgcgtgttcgtccctccgattcccggttagaaagcacacaagtcgattacccaggttcaggccgctctggagtgtaacaccctactcctgcgtttgggattatcaatgaacttttttacaaggttccccttgcctccttctcttcctctctctctagcccccctcttttggtgggcaaggtcctccttttatagcttaaggggataccacatgcgccgtttctacccttcccctccatcggagggaggggagggggcccttctccctactgccaccgggtttcaacccgtgccttttgctggaagctaagcatcggtcggtccttgagtggggcccagcgccgtctcccgcctgacacggggggcagccctgtcattccctcataaatgaatgaggacttgcggtagccctgcatcgaccgacgcccggatgtgacggggcgtacctaccgccactccgcggagacagaggcgacgtgggggcacgaccacccgttcaatcgaccatgaccggcaatagactggtcacagaccggtcgcatccgactgacaggagtcggtcgggcacgccgcacgtctgccctcgccgcattgaatgcagcaagggacggttgggg

SEQ ID NO: 65921 - DNA, 2033 bp, Oryza sativa
agccaaggaagcaaggcagggcagatgattaggccttattcgtttcgaaggattcctaaaggaaatctcaattcctatgcaataagcactatccatgcattcggtttgtaggattcaaagaaaaattttccatagaaacgctatgccaatcctccaaaaatcctccaaaatatactaattccacagaaatgacaacatccactccatccttttttgtttagctaagtataggaaaaatttctgtgttccaatcctttgttttgcacgtgcattcctaaattatttttacgtttttcatattcctatgattttaaaatcctgtgaaccgaatagacccttattgattagccgattagattttctcttctattcaattcatctcagctgggatgcgtcacgaacgaacgcagacggcgagcggaggcggggggcagtcagtggcgtcggaaaggtaggacggcgagtgaaggcagtggcgcgtcgcagatggaggcggtctccgctttctcttccttaccgcacacattcaacttcttcctcgagcacttcatccatttctgccatttgccgctcccgactttggcatcattggatccaacctaatatgatcgatcacttgatcagaaataggtatgggtttatcgaaaaccacagagaagttggtcacggacgttagtttctttccattcacaaatcactgatcgaagtagctccagtccatccctgtctctccaacaaaaaaaaaaaagtctaattcgatccaaaaacagtgatggttccattataccctacttggtcctcagaccaaatacatgtttaaagcccacaaattttcaatgtttcaatgtatcgtgcaaacaaacgacggtgtttgagaaagattaagggaaagataaactaaaaaattattaaggcatgattaattggattttaactaatataaatttaaaaatatatttatttaatattttaagacaagttttatatagttttcttttaaaaaaaccacatcatttatttgaaaagtataataacacaaaccgaggttatatcctagtctgaaaaaacttgcaacatcatcttttcgcttttgcttatactaatcagccaaaatttaaattttcacccttaaatttaaagttaattttgggatttttcaatcatagtttattttcggtctttgctttaagatcactaaaaacacgtatataaaagttttattcataaattatttttttatttacaaatataccgtttcgcattttcctccagtatgtcaaacgatggggctgttagggtatcccaatagaagccacacctatcagtggcctcacatgggtcatacaagctgagaccacacatgagaaacatatctcccaatagaagacactccaaatgcccctacaaaaaatctgaggcaagtgtccgaagacacactagcccacaatgtcccacaacgtgtgttctctagcccatggagcccatgtgcattttactatcctacccctacgttttattttagcccggcctctttttctccgtcacccgtcgcctatctctctatctctttcgccaccgcttgcctctctctccagccgctcaccgctgtctctctccctcctcacaacgagaggggcgagcggtgcacgaggtggctggcagcgcggggtggctgacagtgctggttgctggttcccttcttcctccgccagtcaccgcctctctctctctctccacggttggtcgggaggctggatctagtgggttgctgcgttgtcgctaggttgtcgctgttgcaccgcctccagctcgtccactacctcaccacctccggccaagggtagaagggaaagatacatatgcggagcagagaccatgaaagacttagccacgacatcgtccaacatggagcctagctccgtggcttgatgaaaaggggccgagtagcacagtgaggtgtgtgtctcatagagaagtcgtgcccctcttacgagagatggatccggtcctaaaagaaacgttcgcattggaca

SEQ ID NO: 65922 - DNA, 2259 bp, Oryza sativa
aggggaaaaagttcgcgccgcggttcgacggcctccgattcatcgaaacgctcgtcacggcgcaccgctgaactggggctgagattccttccttccttcctcccgtgattcggcggaggaagaggaggaggagacgccagatgcgcgcgtgatccttcggcgatttagatgcagcgccaagaagttttgttaggacaattgagaaattgaggctttgaaatctttcctcttctttctgtttgcttttctttctaatttcttcttattttcccccctttctattgttactgctattgctgttgacaattatggtgatccttgttaagctgaggcgataattgtgatgatttatgtaaattgcgagccatgattgattcttcatccaatttcttaggactgttcatgatatgatgttgatatccgcctcctctatcttagcatcccaagggatgtgggtgtctctgctgtaccttgcttacccatgtctgtccttattctcagcttgtttcttttcccttctttttcttctttgatatggtttctttttttttaattattttcttgatgtgatctctttccctccatgttggtggattgaattgctgcatgtgtgtgtggcaacaaattggtgctttgtcatcactcatcaagagttgtgatgctattggcacctgtgattgtgatgttattgtggcaaggggccatgtgatgtggctgcttgctctccatgctttccatttctactcctgcttttcttgattggatttgtatgtgatcaagatttcgaatggatgggatcaacctgagcaggatgtccgaattgaaccgtttatcagcaagctggtgacattgatgggcagaatggatgcaggaggcattgctggaaaggaagtacagtactggagatgattagggctgcgttttatgtgcaaatgaatgggacaggatcacggaagggactctggagcatgttcctcccaacttcctttttccaaaccctttctttcgttgtttattgtaccagcatgacacatgtagtggaaggcaagaaaattggacaaattttgtagtgtccaaactttttttttcatatttgtagtgtccaaactttttttttttcatatttgtagtgtccaaacttttttttttcatagttattgattataacagcctggtacatgtggaagcacaaaaactggacagttctttacactgtacaaacaaattggctggcctgaaaaggaatatccaaggatgaagttgccctgcccgggtttaccttaccgccgataaccgcgtggttaccgggcttaccgcggggtacggtaatataaatatcacggtaaccttcttaaattcaaataaatttaaaaaaaattgaatttttgataaattttgcacggttttatacgatttttcacggttaccgcgcggtaaccgtacttaccgctgggacgcggtaaccctggccccggcggtttgggaaaccctagccatgcccgcatgtgcacatgatttaatttatttttggctggagaattgattgtatttttttctattgtaaattacaaaccagtatgacggaatcgattttataacacatgcctctcgtgctgtatgagttttttcttttaaaaaaaaagaacagcaaagagaacctattcaggtattttcaaaatctactattcataactgcgggaaaagacaagcaaatatttatcttattaatagtattttcaccgtcggtaatagaaaaacggcaaaatttgctacaggacactcaaaaaatatgtaattagttgtcggacaccgcaaagacgtgaatttgctctagtacactccaaaagtgtggtaatttgctgcaggacactaggcgcattaaaatataatatccacccaattgatgagagagaaaccaaataaaatgacagttttactctcatcttcttatctcttcttcctgtctttttccgtcgctcctctcacgtgtgcaaatttcttagattaacgtacagtgagggaaattacacctaagtacagaattgatgatgctgctgatttcttggctaattaacagattatggtgttgattaactaattactccttgctagttttactaggcctccaaaaatttttagacggagtagtcgaagacgatggagaaccttctcgaattaaatttgaaaatatactgttcattcgattttttctcacaaatattcgggatgcaaaatattttacagaaatataccgtcggt

SEQ ID NO: 65923 - DNA, 3123 bp, Oryza sativa
catgaatctgccttcaagtgtatataaattttatgggtgtgattattcccttcatttcatattattttttttcactcaaccacctttagctattaattatttttgtttcattgattcactagttgcatacgtaatagttcgttttcttaaaaaaaaataggagatacttcctccgttttatatcataagtcattttgactttctaagataaacttattgaaagtttgaccaaatttatagaaaaatatagcaacacttatagaactaattagtttcattacatctaaggttgaacatatattttttttgtgttgtgttgaaaatattggtatatttttctataaacttggtgaaatcaataaaaaaattgacttagaaaaaaatcaaaacgacttaaaatatgaaagagaggtaatacattttgttttcttaatgtataggggtggggtttgattcatcttccgcacgctcgccaagcccaagagatgatttcagcctaacacgctaataaaaaggagttttcacatgagtccccctttactctttgtttacatttagatctgtatattaatttgtcgttttatgtaccctgacatagtttcctggacaaaggtttatacacaatagactgaaaatgtgggctaaatttctgagcatgacaaactctatatgctaaatttctgaacatgacaaactctatatgcctataatagcatgtttagacctacctgtgacttatttcttgtgtttgacttcagaattttgttcctaggacataggttatggaccttgggcaagcaagtagaagagtagctgcagcaatcttgatttcagatatacagtatatcataactggccatcattcaacataaaatattcagctcaaacaggaataggcactatctgtgctgacatagcatataaaaacattcagaacctattcatattgatgccattttaaaccataccatctttttgataaaatctaacatgtggatgcattaggtttgttaccaaacattggttatgcactaatgcttatgaaacttggcaacatcatagtaagttaccaaaatctgggcaggtcaaatgttgccaaaatttggtaatgtatatgtgggcactaaactaaacagataaacaacagcctaccatgttggtaacataccaaatttggaaatgtttattttggcatcaatctgaacaggctatcaaatttcagccattgtttgacatcaatagattcgaccttgaggcttgaggtcctagaccacacatatgctacaagaagagtgtcacagcaaagatagtgccacaagattaataatgattaaatctggagtgtcagctcttgattaattctgatagggaataaggcaatgtgtagttgtgtactatacaataaataaactaaactatagtttagagatgtcgccgaatttcaccatagcaaatcacttcattttaacattaaagcaggattcgaaattttgaaaccaccccccccccccacaacatgaaatgatttcaactaaaacttttggattttgtgaatttgatgaaaagaaatgttcaaattcaagaattcaaattatttcggaaattatggtcatatcggtgatcccgataaaaatagcgaaaacaaatatttgaatcctgaattaaagtatagggtttcctaaaaagtttaagtgaacagagacctcataacttttaattcaaaatcataaaatgacagcgggaaaaactcaataagcaactatctaacacaagttaacactgtgccagaagttaggttcctctgcccattatcaagtatccacaattctacacatttgtgaagagaatgaaggctattatcagtctgattagcagtacccacacttcacattctaatcacacagctaatcagctagctattctaatttatgatgcaaacttgcaaattatcagccaacatttcattcgattaacatatcacaagaaaattgcatgtcttaaagcagcattttcatgaattattttggagcaatgcattcaaaccgaaaagaggaacgcctgacccaaactatctgaagattaccttataagtctatacgaacgagggctatcatagcccggctatgacaaacttggcacaaaccaagtgcaagcatgcatcgaggggccaggcaactcttcgatttggccatcctccatcctgaaccggtagatgaaagacctgctggctctgtccatcttgaagaagtaaacacaattcccctcaagccccgcgaaatccgcggcgcggagcgagaatccctggtagagaccaacgaacagcattctgtctctaatgctcctcatctgaacccaccgcgatttctcccccgcaatctctagccggtgaacctccaatgcacagcaatcctccagcaattctcctgcttgttcactgttcttgctcctgaagtaccgaatcacgcacaggagatcatcgccggacgggaataggcactatctgtgctgacatagcatataaaaacattcaggacccattcagattgatgccattttaatccataccatctttttgataaaatctaacatgtggatgcattaggtttgctaccagacattggttatgcactaatgtttatgaaatttggcaacatcatagtaagttaccaaaatctggacaggccaaatgttgccaaaatttggtaatgtatatctgggcactaaactaaacacataaaaaatagcctaccatgttggtaacttaccaaaatttggaaagttttattttggcatcaataggttggaccttgaggtcctagaccacacatatgctacaagaagagtgtcacagcaaagatagtgccacaagattaataatgattaaatatggagtgtcagctcttgattaattctgatagggaatatggcaatatgtattgtacaataaataaactaaactatagtttagagatgttgccaaatttcaccatggcaaatcacttcattttaacattaaagcaggattcgaaattgtgaaccccccaacacgaaatgatttcaactaaaacttttggaattttttgtgaatttgataaaaagaaatgttcatatttgaccaaattt

SEQ ID NO: 65924 - DNA, 2889 bp, Oryza sativa
cggaggagagggagtagaaggagagggaggggccggggccggcggtggggttgatgggggcggggcgggcaaggagccatgggaggaagggaggaggggaggccgctgcggcggcggtggcggcgcgccacgcgcggcagacggcgcggaagcggaggaagtcgagtgggtcgtggaggcggccggagaagaggcggaggaggtcgccggggaggcctgaccagtccattcgcggcggcggaggctacggcggcagcgcgtcttgaatgtttcagattggggagacggcgaaatggctcctattttttgtttctttttttccattttgctacgaatctgtcgcgtgatttgttttgatgataggatgtgtttagttcacactaaaattaaaaatatgttaaaattaaaacgatgtgacgaaaaagttaaaagtttatttatgtagaaaaattttgatgtgataaaaaagttagatgtttgaagaaaaaattttggaactaaactcggctatacttgtctcatcaattaacgagccagagggaccattaaagctgagatgcttgtattttggaaaggaggaattgacagcttagcatggccattttatgctttaacccattggctgtgtttagttcagcgtaaagtttggatttcaattgaaattagagatgatgtaactgaaaagttatgtgtgtatgacaggttgatgtgatgaaaaaggactgaagtttggatccaaattttagatctaaacacagccattgttttgtttgttatacagagaaaccctcttggtataaagctaaccagttgaacaaacacatacaaatgacaaaagctgggaccataatgttgaagcaacattgttcatatatattgaaaaccaacagtaacgaaaatcctgctccgtaagattcacaaggatccagcatatacatatcgcaagccacaatattaggggaagtgtcatatttacaggtgtcaaaagatgaatacaattgaccaaaaaaaagcttatactcgaacaggataatggacagacgacttattgactggatgcagcagccactgattggaatttgatagtcagaaattacaagatgaatcaggtcctaagataagacgatcatgagttggtacaaatggctaacacaacagacaagacccacgactatcaactctttcacagaaaagtggaacaaagatatatgatcacagacgctcatctcttaatgagaaaaccaagcaggattctcagaatagcaataaccagcacaaaaactagtgagaaaccaccgttctgactccccatttgcctccttagaagatcctgttcaattccaatagaagataaatgaaactacgtgagtgttgcagttcagattcagatttcattgatgcacaaagccataatagacaaacaagatgatatttgtagataacgaaatacatctgtacttgtagaaattagtgggttgcaaataaacttgacaaaaaagttaaaaaaaaataaataaagcgcatgtaaactgcttattctatctatctaactcaaagctaaaaattgtattagtgtttttttccggtggactggtcactgctggccacagtaaaagaacagggaatgagtaaatcatgtggtgattatttattggagatgcaaatttagcgacaaagctgttactcaaaccaaactagtttttttttttttggggggggggggggtaagttaatctagttcttactgccaaagttaaaaaatataatgggtcattaaatgtttgcataatcaagctaaccagttcttcttgaagcttcatgttctgttgaatggcagaactcttctcctccttcaactttgaaatcaaggccaatggctgcacatagctgtgaaagagatcagcttattgtgctttggcatcattgtcaagcaacataggaagtcggaatcctctataataagacctctcagttcctcagtttgtaacaaaagtaaaatgctaacaaagtgaatatatgctagaagatgaagcatccctcagattaagttaccatttgcatctaaatatgttgagatgaaaagccatgatttatgcaaggagaacattaatcaaaatatcattagagcaagaatattggcaagcaaaaaaaaaatgttatagtagtgtgtgaaattaggattcagtgataacatggcattgtcaaatttaacaggagaacaatgcaacatatatatcaagcaaagtccgtagttttccccagggaaaaaacaaagagcatagcataaaacagcacacacatagttctgttggatcagagttctaaaacaagtgtcatgcagaggactaggaaataagaagagcacagcaacactgtaaaatataattaaacaacttctgaagcaatgctcttggataaaatcagacatagtagtatctctaaattatgacacctatcagaagaaaacatagatgtttcccatctgaagatgcatacctcagaggttactgtttcttattctctagatccttttgttgcctgcaaagaaaagttcacaatttgtttcagatgataaggaaatgaatctctctgaaacgagaaatttaactatttgccactttaggtttgccaattatccaaatgcccttattaggtttgtccttaattttttttgcccttttaaggtggtggcatcttaactatttgccacttttgcccatgtggcatgccaacatggcaacacagtgtaaaaatcgacgtgggacacacttgtgagccgcacagctatccccttcctctcgctctccggcctacccgtcggctgccagcgttgctcctctcggcgacggcggtgcaccggcttgcagttgcggaggaggagggggagcc

SEQ ID NO: 65925 - DNA, 7506 bp, Oryza sativa
cctgcaccccatgccacagttgcaaatagttaagatgccaccacattataggggcaaaaaaaaattaaggacaaacctaagaaagaagggtatttggataattggtaaacgtaaaaatggcaaatagttaaattccccctgaacccccaccaaattgaagcccccaaaagtacaacgcacaaagcctccatgggaaggaaatgcaaagatagtgccaccgcacaaacacatcccgcaggtggcggcggatctagggcttggggtgctggtgctcggcgtcttcggctaggagcaaggagacgctggatgagatgaagagggtagaggcggtggccgtcggcgggggttaggctggtggcctgtggcggaggaggcagcgcggggtgtagaaggagagggaggggcgggtggtgtgctggaactggaagggatcggaggaggggaggccgcagctgcctgcatgtggcggtggctgaaacccatcggtggagaggagtggagtggagtggcggcggcgcggtcagaggctactggccaaggaagaagaagggctgatattataggatacaggtgggacccacgtgccagtggaagtaaagggcacgagcccacctgtcatcctctctgactctgcttgacttccatggcgcggtgcgaccgcgagcgacttcttcccggcttgctgccggtgatggccgagtagaatcgtagaaagtgagggaaggggacgaggatgtctgagcgcaagtactcacctagactccatgggcgtcgtcgaggaagaccgtctgctgcagtgcagggaagatgagaagatcgattcaatcacctgccaccaccggtgcggcaatattccttcttcaggagatgctgcaccaatataatggccgttggactgcctatacatttgtcgataaatttttccctaaaaatttgatagatgtaattattgtacaatcataatgtaattacgctgtaacttatatataattacactgtaacttgcatgtaactacattgtaacttatatataagtttcacataattttgaattattagatttattacaagatttgttttggtgaggaagaaaacaaatcatagcacacacatatatgaaagaatttgttcccacgacctccattttaccgaaataacatgttacggagagatttttgaaagttatatataagttacactatagttacagtgtaattacatgcaagttacagtgtaattacactacgattgtactgtaattacatctgtcaaatttttgagggaaaatttgtcgacaaatatatagcaaaatcgaatgggcgtaaactgtcacctcctcctggcaatcgatgtgcctgcatccgtgtccgtcgtgggtggttagcgccctgcaggaggacggaaaaaaaagtggtgtggcatatggactaggtcttgagaccgagaggacacacaagaatttcagcaagtctacgttatgtgattatgtcaagttgtcaaaacggtaaattcaacctggaaacaaccactaaaccacaattcatctacataaatgcataaataaaagggtaggcactgaaaaatacttgaaagaataatgtttcagacttttagcaatacatatataatcgatagatatgataaatatatatagaatatgcaaaagaaagagtaaagatggattaaaagactacctttaacatggattaacttaaaaaaaaacaagttgaattttttagatggcctttactcaaaagagctacaaccaattattacatagtagcaatcaaaaacagagtgtaaatctagagaataacaaagaatccagcctaacgtaaggagatcacaattattgaagtctatttgtaaatctccaaccataattgataaaaagttgcataaccgtagtctctaactttcgacgtgcaactttcagaaactcttcatcttcatcacacttttgtagttgtgcccgaaaccggagtcaatatgttgccctgaaaataacctgcatataggaaaatgatggtgatttttcaaaaaccatatcgttcctacttagccatattgcccaacaaatggcagaagctccaacaagtatcagtttactctttttcttatcaattcccaaaagccacccattaaaaatagaggtaagttcatccgaggtcccttaacttgttaaggaatccgactttcgtccctcaatcggaaaactagacacaacgggtccctcaactattaaaactggtgcagattagatcccttggcagttttgagagtggttttggctgacgtggcgcctacgtggctaatttgactcggtcttcatctgacgtggcattgacgtggcgcttacgtggcaattcgatcaggaaaaataataaaaccggtaggacccacatgtcagtttcacacacaaattaataaaaatggtggggcctacgtgggccccacatatcatgctcacccctcctcttcttcctcctccctccccatctctcctctcttcgtctctctcctctgctctctccaggcgacggagaggcagcggcggccggcggccggcggccggcgggagagaagggagcggcgcgcagcggcggaggcacggctccggcggttgtgggcagaagaggaatcggcggcgggaagtggctctggctgcggcggccgcggtcgctgcacatgctcgaccccttcgcggccgctgccgcgcccgccgctgccgaggctccgtccggggaggccgccatcgccgctgtcggagcggcggcggaggaggcaaccccgacgctgatcgacgcctcagcaagctcaacaaccaccttgataagatgctgaagtaagatttctcatgttatggcaaaaactgaaaattgattccacaacgcttgatgcattccttaaaaaaatgtttgaattttctgttgttgaaatcgatcatatttttaataactttttggttctggtatgttatgttccttttgaacagagacatggaggaatcatggctggggccatggaaatgccttctcttgggatacgaatgtacgatttaactgaccaacacattgaggcagctctgacaaacctgattgctggtctggaatcagaatacaaatttgaagtaaatccagtgctcatcaaggtcatccttggtggtgctatgtcagtggatgaagtgcaggactgtgtttctcaacttatatcgtgtaaaggctattttggccgaggagggtgttgtgggaaagacagacttagagccttctcttcttgctgtattgagtctgaagctctggagacagtcgaatgcttaataaaaagtacagtgaatgagctgagtgaaccagttgatagagatccaggcatttttgttctcgacgaacctgctgcggccacggccacgaccacgagtccacgacgacacttccgctcccgagatactgccacgtagcgagccctccgcctccagtccacgccggggtcgcgggcttgggcgacgagcagcaactggagcagctggcgagggtgctctcctcgctgtggtacaacgagatggcctccgcggcgccgctcctcgccaactcaacgttgctcgcggcgtggccagggtcgatcaccgtcttcgcggctcccgacgtcttcctccgctcctcttgcaccatgtgctcgcgccgccatgtcctactggagcacatcgcgactagataaatcatttgttgccacgaaaaaaatcgtggcatcaatactaaaattgtggaaatagatacatgttgccacaattgtaaaatcgttgctagccgtagtaataaacagcgtggtaataggttattgcaacgatttttattttgtggtaataaatttagatgttgccacggaatggatgtggcaaaaagtcatattgcaacacttcacatcgttgtaataaaaattattgccaccactccatatgtagcattagttttacgtaccaagttaaaagttcaaatattagtctatcatcctatctatttatctactctttttttttgattttgtgtcttggctaggattcgaacccaagacctgtccttcaggtgtgctctcctttaccaactcaactacacatcaattctgttcgaaaatgcatatagttctatttgagcctagctaactgagatttgaatcatagatttgatatctaaaagatttcaaatgaaaaagttatcacctataaaattgtagatctcgtcgagagctataatttccatataaaatttgtctcaatccgtgtccatatgaaaaaataaagttaaattatgagatggcaatttttttattgcaacaattttgttgatcatggcaacaaaaaatagtgaaaagtactgtgtactatataaattgccacaaaaataaaaattgtggcgatagaacatgtttttttgcaacagtacgatttttcgtggcaatatctcattttctattgcaacaaaagtactaaataaaacaacgattgtagatcgttgcaataaaaaataattatttgccacagaaaaattatcattgcaatactataatatattgctacgaattattttttgttgtaataatttggtggcaatagctcaattatcttgtagcgccctgggagggaggaggaagaacaggaagggtgagttctactgacatgtggggcccacgtgggtcccccatttttattatttatgtgtgagattgacatgtgggtcccacgggttttattatttttcgggatcgaattgccacgtaagcgccacgtcaatccacatcagatgaagaccgagtcaaattagccacgtaggagccacgtcagccaaaaccactctcaaaaacgccgagggatctaatctgcaccggttttgatagttgagggacccgttgtgtctggttttctgaattagggacgaaaatcggattcgttgacaagttaagggacctcagatgaacttatttcttaaaaatatgagatatgctaactggaagattaaaaaccaaaagagaactgaactgctatccatatgaacttcgcaaaatgacaattcacatagagatgttgaatagactcattcttcaaacaaaaagaatacctcaagctgccattccagttacgccttgccaaattatccttagttaacacaacccctttaagcaagtaccacatgaaaattttaatcttaagtggcaacttaagcttccaaatacacttatttctctcgatatagccattattaattaaagctaggtatatagacctcaccaagaacaagccattctgatgggaattccatatgaaactatcagacgaattattcaactggatatgtactatagaggcacacaactcatgccaacaaacaagattctgataaactaaagctctcctaaaagaaacattaagcggaacagatcccataacagtggcaatagagtatgttttccttcggacaatagtgtataacgacggatatttatccttgaaagccaagttgcctagccatttatcttcccaaaatctaatttgttccccattattaacaatccaagagcccatatttaagaaagtacttttgacattcataagaccaggcaaaaaataggaatccccttgtttcctatcaacttgggttatagacttattataaagatatttcctcttcaataagtcatgccaaaccccttcctcattaattaacttaaacaatcatttacttaaaaaacatttattttgtatctccagattatgaatcccaagaccccccggtccttgggttgacaaacaacatcccacctagtgagcctgtaatttttcttatgatcatccccttgtcaaaagaaccgcgatctgtaataatcaattttacgaagaacccctttcggcacctaaaaaaagatatcataaatatggctaaacttaaaagaacagaattaatcaacaccaatctaccaccaacagataaatgcttgcctttccaactactaagctttttctcaattctctcttcaataagtttccaatctttactagtaagcttcctaaagtgcatcggaattccaagatatttaaaaggaaaggcacctaacttacaaccaaagataccagaatattgctcataacattcctttgcctgaccaaaacaaaataattcactcttgtgaaaatttatttttaggctaggtaacttttcaaagacagattaaatcaatttcagattctttgcctgttgcaagtcatgctccaaaaagatgatagtatcatatgcgtattgcaagatagacaaaccatcgtcaacaagatggggaataatcccattcaatagtcccacctctttagccatcttgatcaatagagtaagcatgtcagctactatattaaaaagaataggagataaaggatccccttgcctaaaacctttgtaagtttgaaaacaattaccaatttgatcgttaacctttataccaacatcatcgccttgaataaaagatgctatccactcacaccatctaggagaaaagcctttcattctcaaagttttttgttgtacaaaaggccatttaactttgtcataagctttctcaaaatcaatcttaaaaattacaccgcttttatctttgcgatgtaattcatgtaaagtctcatgtaaaataagcaccccttccataatatttctcccaggaatgaacgctgtttgagtaggactaattaccttttgagcgatatccattgttctatttgtagcaattttggtaaaaatcttaaagctaacattaagtaagcatataggtctatactgttgaatcttcatagccttaacacacttaggcaaaagaatgatagtaccaaagttcagcgaatataagggaaaactcccagaatgaaagtccttaaacagttctaagaggtcgaatttaatgacattccagaaaacttggtaaaactcagcaggaaatccatctggacccggagctttgttgtgttccatttggaaaatagcatccttaacctcattttcagtaaaatccttagttaaggcttcattctccaattgtgaaacttgaggaatgtcagtaacataattctcatcaaactgaaggtcagactcatcaagagggccaaaaagacctttataataagtggtaatatgtgactttaaattggcatcaccacttatgcgactttaaaaacaagttgaatgaaacgtaaaacagtaaaagcatactgctcgacaactactagactacctggtgaaatagctcttcaaatctacaaacaaaattacacacatgtgaatcaatgacaaattgtgcattaacttttgcaaattgcaatgttttcacttgtcatttgtcaaatactcaacaaatgttatctttttaagatgccaaagcctttcctttcccctttctatccatttgtgctgaatcgggccagttgctttgctgccttgcccttgctgacttgttggtgtagctgccctgctcggctta

SEQ ID NO: 65926 - DNA, 1496 bp, Oryza sativa
tctctccgtgaccacgagcagcgcctgcacacggctgccattggttggttgtcccaaaccataggaaggcatgcaatatgctcggtattctggttgtaagccccatagacaaaccagagattcagggtcatgagacgagatcgaggagcttgtgttgttctgccagagccgttttctatgagttgtattgtgattttaggctaaagaatagctgttttgacccaactaatgatatatataggtaatatacctattaattcaaagattattagtcaaaaattttgggggtacagatgtacccccatgtcccatgctaggttcacccctggcgcagccgtgcatgccaggtggcaccgcgacactaggagcagacgagcaccgccatgccggcctgcagcctgcagatgctcgccgcctagcctagatgcattgcccacgtgttaacaaccaaatttggtaatatcggcatcggaaaagaagattagatcgaagtggagtcgaaggcggagatcgattcgagaacagagcaagaatcggctggagtccagatcggctacgaataggatcggctgggtctgagtcggactaggtaagccgatacagccaattccgacaatacgacttggtgtatgacatcgggttgaattgaggtacttcaagatgattgccgcacatggatagagtcctgagaaggcaattgtatctattaatttggatattttatgtaatttccatagagatatgtttgggcaaaagtctgccgcaaagacttatggtatcttagagtatgttagagataagagtcgtgtccgatatggacatagtttgtaattttcgggtataaatagaccccgaaccccgtgtaatcaattaacacacatgttcactacaatttcggcgcatcaccacccttttgctttagttttatttcgacgagttcttgctttcgggttgagctgcatcggtttcgatcttcaacaaaagataaaacttgttatgacggcttgcgttctcgggattagtgcttccatctttatgatattctaatcttgcttatgtaattcgtcgagttatcatatatcttacataatttctggcaatatcgttatctaacctacaatcggctaacatctatcggtaaagggcagtcgattaggttagatttcaacgttgatttaaattatataagatatctaccactctatgaaatttccagcggcttgattgtttagatgttgttcttcttttcatacttaatgctgcatcagttgagtttgatctattaagtcgtgcttagcatatcaatctctagcatgccttctggttgccaattagggtagtatcggagtttcagcctaccttatctgatttaactatatttgctctatatgcttcattgacatgttaaatccaccctttatgtcaagatattattgcatctaagtatactaagcttctgtttagcatattctgcttgttttaacatgggctgcagg

SEQ ID NO: 65927 - DNA, 2071 bp, Oryza sativa
ctggacgccgcgcatggccgctgcccggcttgaccctggagctgaaggccggagcagggggtactcgcaggcagcctaaggtatggcgagcgccagacctcgccataccgggtcctccgccactggccgtccacaagcttgacgcgcggtgaaattgagcaaatcaatccagaactagttttttttttttttttgtttctgcattgcatagaaaagttaccagtgaactgaaactggtcttaaaaatttacatctatgctatcacaagaacctattgggagttgttccccagagataagacattgacactccatccatcttccatcacaatctccaacaccacaaggttatctcgctctttaactggatgatgaagcctatggtccaaacacttctgtgagctgaagctgagcttgcatgtcaaacagaaccggtcttttaaatgttcttgattataactcgagtttacgagtttttgcactgtctgccagctccggccccgttgtacctccgcaacctatatgggagagaaatcaagaactcacaaaattaaatctggactcttttgtagcacgaattgaactcgattcaacgattccaatttccaagccaaagaaatgtccacaagaaaaggtaagaacagaaaataatcaattatcgaaactcacagaatgaaatcaggactctttctacaacaaattgaactcgattcaacgattccaatttccaagcaaaagaaatgcctgcaagaaaaggcaataacataaaataatcaatcatcgaactcacaaaatgaaatcaggactctttgcagaagaaattgaactcgattcaacgaatccaatttcagagcaaaggaaatgcccgcaagaaaaggcaataacagaaaatgatcaatcatcgaactcacaaaacagttagaaacaacagaaacaaacaatttattcccaccttggatttcgggctacaaaagttgtatcttgacgctattggtaatcgcagcggcatttctccctcagacccgaaagtgttttcctcagcctatctcttcctagcattatctaggtgtttgcttcgtgcttgaccctttgaatcttgtccaattacaacccatcctcctatttttggcatctcgatggctcagtacaggaaaaccattaacaatgaaaatagtcaaaaagaaggaaacatgtggagttagttcagatgcatgagacaggacatgtagatgattgaaagaaagattcttgccgcaacgcaactacctccactgtaacagcattggtgccagggtgaaggatggcggcgtgttccggacaacaggacaaacaaaccatggctgagtagcgggaacaaaacctctcatgacacgaaatcctcatgcaaaatctgttctatgaagggagaaagatccatttttgttgaagaggaggtgaagaaattaagaaagacgatcggggtggacgggaggaagaaggagaggcgaggaagaagaaaagagtctatcggcagagacgagaaaaaaactattataaaatgttaaactaactagttaaaacttataagtattattattactcagtaagttacccctttcaaattgatattctagcttcgctactgtaaagtttggatcaaagtattattactaatgtcatacttcttgatttcttctatgatttggatgtccgctgaattccgctgtatgacgtaaaagcatcactaaattctattagttgtttgtttaggtagcggtggtacaatgcgaccaaagctggcaattggtgcagaacttgtcaacataaattttaatcaattgagctgcctatatgaggaatttttcgtgcatcactgcttgagacatatgtcccactacccagtttagcaggaaattaactttaaccaaaccgcccagtttagcaggaaattaactttaaccaaagttagagaaaaatgcattgacatctattccaataaataaatactttctccgtttcatattataagactttctagcattgtccacattcatatatatgttaatgaatctagacatatatgtgtgcctaga

SEQ ID NO: 65928 - DNA, 2788 bp, Oryza sativa
attaactcaaaagtaaatctatctattatattattaaaggaatagaaaaaggagccctcacgttcgctctcatggcctagaaattctcacattaatcggagaaaaaaaaagacagagtccatatagaaatacaatttagaaatagctgaaattcggaattaaaaaaaaaggaatattagaagaggagactagagtccatatagaaatacaatttacaaataactgaaattcggaattaaaaaataaggaatattagatgaggagactagagtccatatagaaatacaattaggaaatagctgaaattcggaattaaaaataaggaatattataagtagaggatagagtccatatagaaatacaattaggaaatagctgaaattcggaattaaaaataaggaatattagaagtagagtatagagtccatatagaaatacaattaggaaatagcttaaatttggaattaaaaataaggattattagaagtagagtatagagtccatatagaaataaaattagtagaaaaaggagcattcacgttcgctctcatggcctagaaattctcacattaatcggagaaaaagaaaagacagagtccatatagaaatacaatttagaaataactgaaattcggaattaaaaaataaggaatattagaagaggagactagagtctatatagaaatacaattaggaaatagctgaaattcggaattaaaaataaggaatattagaagtagaggatagggtccatatagaaatacagttaggaaataactgaaattcggaattaaaaacaaggaatattagaagtagagtatggagtccatatagaaatacaattaggaaataactgaaattcagaattaaaaaaaggattattagaagtagagtatagagtccatataggaatttaaaactaactaaaatttgaaaaaatataatgaaattaaaagtagagtttagagtcccgtataaaaatacaatatatttataaataactaaaattcgaaattaagaaaaacatgggaagaagaatttaaagtcaatataagaatgcaatttagaagtaaatgaaattcgaaattaaaaattaaagaatattgaaatatgagtttagagtccacgtagaaatacaattagaaataataaaaattcagagagtaaaggtaaataatgttggaagaaagtatagagtctatatagaaatacaatttacagaaaattcgaaattaaaaaaaagaaatattgaaagacgagtctagagtccatataggaatatatataatttacaaataactaaaatttgatattaaaaataattaataactaacacgtatataaaatacaatatgaatattacacattagtagttttgtaaagttattgcaaaatttaaaattatgttgtcattttaatatatttgaataatataataaaaatcatatatgctattatatgagagaaaatataatgatactagccgcgcaatctgcgcgggccaccatgctaattagaaagtaaagatatattcactttcgtgggatcacgctactaactaaaataatctaaccaaccagagtattaattcccagtgacaaaaattgtgatgtcaacaggtattccatgaattgtccgttgtcaaattccaattacgacataccaacttaccaagggcatgcgcacatagaattgtgctaaacccaccgctgtccgctctcggcttttctcatcttaccgtaggccaattctcttccttatatataatttttacgcgatttgacatcagaggatggagcaatttggcatcaggcttccacggcgaggccaatctgcatcacctgcccgctcgatccctgaaaatcttcttccgtttctctctggagattgctgacagcgaggctgcggaagcaggcgaggggttcagggctggtgactggtgagatcgatctctcatctctccgtcttgctatctttctccctatctctaagtcgatcattcctgtaaattgtattgctggtaggcttttcttgttacctttgctgttaaagccatttaggatttttctattgcctgtgacctgtttgtggaaatgcctcaaaaagatatcacagctcacaggggcaggattctaggttcccaggtgaaaagcaacatggaagagggaggaggatgaatctgagtttttttagagtatttctttttttgtatttgtaattggagaatttagattatttaccacctaattctcttgtaattgaggcattcattttctaaatcatatttcttttggctaactgcactatgagcacctgcaaacaccaaaaggtatactattagagcatgattttcatacatatataacagaagtttcagtaaagctctactgtaatcagattctgctttattgaattgcaatttctggtttagtgatacaggattttaggtgactatgcaataaggaaattcgtgcccttgtgtgcgtttgggggctgatgtttacaaaataataatcactatgttgaggatgttaaatggaacttgtttgctctttatatttagcattgtcttgcactatgtctcttaagggttatattatacgagttacatcaccaaattggactagaagtagaacttcatatttggaagtggaattaccagtctaattcggatcataatataacagtcatcatcccctaacaaattttgaccactagcagctacatggcacaggtaacaggtaatttagttcatagtatatatttgccataaggcatgcagataggg

SEQ ID NO: 65929 - DNA, 800 bp, Oryza sativa
ccgctagtaaaaaggcttttggactgaccgattggacagtgggtggtcagtgttctgaagaaccagaaagagaatcatattcttttgtgtatcaacctgatataattggaagggatgatgctagagatgagattgttagtaagatactaagagcagcagaacatcatgatatttttgtgcttcctctgcttgggcttggaggcattgggaaaactgaactagcaaatatggtgtatcatgatcaacaaatcagggagaggttcagcaagatgatgtgggcctgtgtctctaataaatttaatctgaaaaatatactacaagatataatcgagtctgccagtggtgagagttgcaagcatctaaacttggaacatttacaaaataagctcaggggaattctgcagaatggaaattatttcctggtattggatgatctgtggactcgtgatgtaaatgaatggagagagctgaggaatttgttgtcaagtggtgcaaggggtagtgtgataattgttactacacgcgaaaatgttgttgcatctatggttggtacctcagacccgtacaaggtgggtgcactcccttttcatgagtgcatgcaaatttttaccagagttgcattcagacaaggtgaggaaaataaatatccgtggttgttgaaaattggagagtccattgtgaagaagtgtgctggagtaccactggcaataaaatcattgggttctctactatttaccatgcgtgatgaaactcaatggctacgtgttaaagaagaccacttgtgcaaaattgtacaaggt

SEQ ID NO: 65930 - DNA, 2523 bp, Oryza sativa
cacgccgaagcaccccggcgtcgccgtgccgacgtacatctacgagctctacgacgaggacacccgccccggctcgacgtcggagaagtactggggcctgttcgacatgaacggcatcccggcgtacaccctgcacctgacaggctccggcgtgctgctcgccaacgacacgacgaaccagacctactgcgtggcgcgggagggcgctgacgagaagatgctgcaggcggcgctcgactgggcttgcggcccgggcaaggtggactgctccgcgctgatgcaggggcagccgtgctacgacccggacaacgtcgaggcgcacgccacctacgccttcaacgcctactaccatggcatgggcatgggctccgggacgtgctacttcagcggtgtcgccgtgatcaccaccaccgatcccagtaagttcacaaaaccataagagattcctgctttccaaacatttggatttgagcttatttcgttctctctgttttcttcaggccacgggtcttgcgtttacgctggaaggtacgctctttttttcccctccccataacgtctttacattctcgcgatgtttgaaacagaattcaagtgcgtttcgctcaaatctgtcatttatttttggacgtgcagtggtgggaagaacgggacgtcgttgctgaacggcacatcgctggcgccgtcgtcgaactccacggcgggggactccggcgcgcaccgggcgatcggggacgtctcgtcgttcgtccgcgccgtcgtcgcggcgctgctgttgagcgtcgtcctcctgttgtaggcagtgagacgagagtggttagtttagtaggcaaggcagcagagtccgtaggaattcatggggggattctttttttggtgtcgagtgggattggcctcggtgttatgggtgggtggtgatcattgagaacgaacaagatgatgtgcctgtgttcatctgttgctctaagatgttgtctgggaacttggtattgggtggtacgttgcctggaaaaggaaattggtactaggttgtatttgcagaaggtgtcagtgtttgtgcgctgaccacaatcaaaatcttcttctgagccaactgcttcactcgtttcctttgttctgaatcgttgatcgattcatggatttttgcggctttccgcttccttcgatcgcgacgaacgcgcggacttgcattggttgggccgaaagggatagccacttacaagaggcccatatagtttgggccggaacggtgtaatgccacagctatgtgcggcccatagataccggcctccaccctaatcgtggtaatcgaggcctataaaacccagcgcctctgcgtctcctccatatcctcgcgcgccgccggatcccgcagccttggctccctccctgttccttcccttccatcaaagatccaatctgaatctgtttcttttctcgtttgcgcttcgaagaacagatctgttttctcgtcttctgattgcgtttcgatgtgatttgctctttttttcgaagcactcttctcgtttacaactcgatcgctgctgattcgaagcttgcgtttctgaagggctgccaaatcatactcgaggatctatggacatgcagcttctggtaatagattcccgcattttctcgtaggtccaacatatttttttttcaatgaaatctatatctatacctaataaaaaaatacgtaaggattccgatatttcttcgtccgtcatcccacgcgccactaaaatctgttttaatccgagtcgggtcggtcggttttcattgtattgcaaaaccgcagttgatatagtatatgtatcttccatgtaatcacataacacaagtggtaatttgcttgcttggttaatgtggaaaatcttcactccggcctctcctgtaataagtctactttcgctccctcgtgtaatgtgtctataggacctccttgcctaacgggtcgggccggcgcacgttgttttggcccttattttttcgcccaaaaatcattaaatgtttacataaaaaaattaatcactttgaaccatcattttaagatataaaattgctgtaaattttacatgtgcgttttaatttatttctaactaaatagaacccacgtgaagaacaaaaaaaaaagtaagtcttcgggtaaagtttttttttcatcgtccatcacacgcggaatcaccttcgtatatttcggcaataatttgtttttttataacgagggtttgtttagattgtagtcaaaataaaccttatcaaattttggcaggattttttatgtatttattagagtttgataaaaaaactaaatggatgcacatatttggtaactttactaaaatttgataagctttatttaagctacaatctgaacaggcctctgacatcagtttcctaatctgccaaagcgatataaaatttcaagatttggaagacatgtacaaatttgaaattttgtacacatgtatcatacaagtacacatgcaatattagcaatccatatttgtttgatattcaccc

SEQ ID NO: 65931 - DNA, 2356 bp, Oryza sativa
ctgattacgacaacagcaaattagaagttgttgacttgataagcatttacgtcatccgtcttaccaaacctgacttgctacaactaaaattatccagttacacgcacagggaccggacaggaagggtatgaacaccttcgtcgtcatttttttcaacggatgctactgctagttgaacgagttaagaagtggtcttttgcagtagatagtatagcagataaatagataaatatcattatcccagtatcaatcaagtgatcaacgaatcctgcgaccatttctgacgaaatgatttctggtaggatttctgactaaatgatttttgctaggatcagcgttgctcccagtcgtcaactggtgcaatgcgctgtgcgcatcaccgcagaaatatcccggtgagatacaaaagaaatcaacgacttgctcaaagtaaaaccaaagcgaatgacaggacaaacaaattgacagcgctcaccattgtcaagtgccaacgacgcgcagctgccaacaaaccttcattaactagggggtggccactccctctgctttcctacgtactccagcgacgagttctgttcaggccgccggttgctttcatccgaggacactagggccgagcagcagagtaactggagtactggacaatctatgcgatgacacttcagtagttcacagcatccaaaatctggcaaactgccctactaattatggtcccataaacctccaataccagcgaaattgcaataacgatcatggtccaagaactagcggctaccggtcggagatgggaccttagctagttattgcccgtaaagatataaatttatttaaaacatttaaaacttagatttaaatttagaaatttatgatataatcttttgattccattctgaaccgtgcgagcaattaaaaaaatgttcgattttgacccggacccatggtgcggtgcaatacaacatcgctcttgcagtttgattgctgctctcgttggttaattaacgtgggggcatatccatccatttctaagggataaagcctcgatgcgtaaccaagaaattactaactttcataaatgcgggctatgcatatgcctatatatcgggggtgctgcatcgctactgaacgggcttcacagcgacatgagaccaactagtgatagacctaaagctaaagcgatgataaagacggatggcttcctgctgaagcaggcagatcaaagaaaatttcagacctgattcacatcaacacgcgagagagaaaggatggaaatgagcatcaggtctttatatagagataaaagttcgtcttctttaaaatctgagaaatcttgttgactagcacttccgaaaaacttgaaacagacattattgtcacgctgaaacttactgccaccaaaaacttattgtcacactgattggatacaagtcgcggtttgtatatcgtctaaaatccaaataaactgtaaaaaagtagtccattggcacgtaaacatcgttgaagaagccaatgctgcatcatgccatgaccggctgacggctaatacataacttgtggattcatgatggccaaacaaagcttggcccttcaatcaatgccatgacagatacctatgagtactatataggaggccaacaaacaagttaatcactcttcgctaagtaagtaagaattgtggttgccactcggcactcgccaccatgctcctcgtcggcgtcctcctgctgctcttcttcaacctacatctccccacggccgccattgacaccctcacgctaggccagtctctgctgtggaaccagacgctggtctccaatggcggcaacttcgagctcggcctcttctcgccgggaaagtccaacaagcactaccttggcatctggtacaagaagatctccaagaagacggttgtttgggttgccaaccgtgagcgcccgattcttgagccgtcgagctgccacctcgagctgagcgtccacggcgatctgcggctgttctcgacggcgccgtcgaacaccttgctgtggtcgtcgaacgcgtccgcgtcttcctcgccgtcgcccccgcgcaccaccgtcgccacgctccaggacgacggcaacctcgtggtgaacagcaacgcgacgcggtcgcggtcgcgatcgccgtcgtcgactacgacgacgcacgtggcgtggcagagctttgatcacccgaccgacacatggctccccggagccaggctcggctacgacaggggccgcggcgtccacagcttcctcacgtcgtggacggactccgagaacccggcgcccggcgcgttctccatggtgatcgacgcgcgcgggctggccaagttcgacctcctcgccggcggcga

SEQ ID NO: 65932 - DNA, 2945 bp, Oryza sativa
cgtggaggcgccggccggagctgggaacgacaaggcgtgcgcgcacacctgcctggtcgactgctcctgcacggcctacgttcacgacggagcgaagtgcctcgtgtggaacggcgagctcgtcaacatgaaagcctacgcggctaatgagaatggccaaggcgatcctggcctcgccggagcggtgcttcacctccgtgtcgcccactcggaggttccggcgtcgtcgacggagcactcgtggaagaaatcgatggtaatccttggaagcgtcgttgcggcggtggtgctgctcttggcgagcctcgtcaccgtggtggcggtggcggcggtgttgcggatgcggcgtaggaggggcaaggtgacggcggtgcaggggtcgctgctgctgctcgactaccatgccgtgaagaccgcgacgagggacttctcggagaagctcgggagcgggagcttcggcacggtgttcaaaggcgcgctgccggacgggacgcccgtggccgtcaagaagctcacggtctccggcaaggcgagaagcaattcagaacggaggtggtgacgctcggcatgatccagcacgtcaacctcgtccgactccgtggcttctgctgcgagggaaacaagagggcgctcgtgtacgactacatggccaatggctcgctggactcgcacctgttcgtcatgagcggctccagctccggccccgactccaagcaggtgaccctgacttggagccaacggtacaacgtcgcggttggtgtggcacggggcttggcttacctgcacgagaagtgcagggagtgcatcatacactgcgacgtcaagccggagaacatcctcctcgatcaggagatggcggcgaggctcgcggacttcggcatggccaagctcgtcggccgcgacttcagcagcgtcctgaccaccatgcggggcacggtgggatacctcgcgccggagtggctagccggcacgccggtcaccgcaaaagccgacgtgtacagcttcgggctcctgctcttcgagctcgtctcgggccggcggaacagcaccgcgccgtcgtcgtcgtcggagggcggccctgggatttacttcccggttcatgccgtggtcaagctaaacgaaggcgacgtggccgggctggtcgacgagagggtggccaaggatgccgacccgaaggaggttgagagactctgcaaggtcgcgggctggtgcattcaagacgaggaaggcgaccggccgaccatggggctcgtcgtgcagcagctcgaaggcatcgccaacgtaatgttgccgccgatcccttctcggcttcatatcctggcgattgagaacgaatgggtcagaggtgttccagaggatgagcgctgctcaaagagcggtagtaaaccagaaacagaagcaatagaagaaatgtagaactgaaaagaatctgggagcaccctacagctgaagtgaagatgcagcgtcagatatgaaaatgtagttgtaatgtcagcatagttgatatttcccgtgtggatgtatagccagtactgtactgcaactgttctgtaaattccttaaattccggaaacaggatcagacaagtaccttctctcgttttgttcccatctaattctggtccatccttgctgacagctgcacctttattgaagaaatccattagtgctacccagaagtccttaactaattgttgaaaacaacttgttgacaaaattgcagatccactcctccacactcactataattctgttatgtacaatttttagatgggaaaattttctgataactacaaagggcataagaagcatatatctacacgggcaactagtaacaacctatacagattaagaactaaatacaaccccaaagaatgaacgaatatcactatgtaactacaagaaccaacatatcaagatgtacactttacaggtaaagatgaagatgatgatacagagtaaagagctttaagtaaagaaatgaacttcacaactgtttcttcagagaaccacttgagtttccatgtatgcactgtgtaaatttcatctggttgcttgctctgtgaatttgtaatgctaccgttactgcaaaatcttccttcatgtgcatggttgtccaaaactaatgtcaaacatctcttgtcacagtgatccacaacctgaatacatgaagagagaatattgaatgagtgatatcaactttcaatctgacagaacagctaagcttacttacaatgatatcacagcttattttggtaggacacaacttcactagctaaaggaataaagtcagatgcaatcatgattcatatacttgatcgattgatattaaattaaagatggctgttcgtgttcaacaataggcaagcagcgctttgtttggattgtggaataggaggggtaggatacggattgagttaagatacaggaataggggaaaaatggatggtcaagcaaggggctattgctctaagctctgtatgtatgctattcctttcagacatggcattacctaacatcttaaaatgcaaccaaaatctaaaatgggtacgtatgcttactgctccctgtttttctgtttttctgtttttcatttacatcacaaatatttacagccaaggaagaaacagagtactaagggtgagtgttagtgacctacttaacatcaaggtgggaaggaattatcttttggagctgttggagcaaatcatgacaaataactagcaagggaaatgtcaaaagtaaaccatggcttaccacttcttgaatatcgttgataaaacaacaagcatccagagaaaaatatggagtatccggatcatcagggagggaaccaaactgatgtatgttctcgatacacacaaataatgacccttcagtaacagcgagggatctaataacaaaggatccttctgcaaaatagaatggacactatttcagcaagtt

SEQ ID NO: 65933 - DNA, 1125 bp, Oryza sativa
ttacaatagaataacagtaagaactcacgtaaaacaaccatctaggtaaattccagttgcaacagtctaacaaagatattaggacaataagctttttagatgattcaatggtttgtagaaagcaaaccttgtccatcttgagccatatcaactagcacaacatgtagtttattttgagaacatcgcagcaaggctacctctctacacaaagagataaaacagtacacttaaaaaaaggagataaaacagttgtctggtgtacgacataaaatgacatggaacatgcagacagattttaaatagctaaagcttgatctgtatataacctcacatctatgcaaatttcggtttcagatcaagagaacctaaaagtgatagttactgaatatcgtatagaattaaatgctcaaggaaacaagtggaattgtaaaacggagccatttaacacatttaaggatatattattgataactgcacataacacattgaagacatggaagtaacttgaatcatggaaaatgttactggaaacagatgcatgtgaatttctaggtaaatatgcaagacgatgagccaaaagatttttttgttcatgaataatgcctgatttttctgttcacttttttttaagaagaaatactttggtcaccagacatcccctgctgttcatttttcagagtacagacaatttctttatgtagaaacttcgctgcgttaaattcatgatctcctaaagttcctcccacgactgtctgaaatgccattttgctgcttgactaaagaaatgaatattatgacgatcaaagacatggcctacaacccctggcatgtgttatgtcacagattgtttagatactttgcctaaatcctgccattattcacctggacagtacaactaagttcttcaattctcatttgcaagaatgtgaacatacaaaaacatattatacagagttatgagtttgaaacttttgaatatgacaacatgcactaatgcaaagatgaagaccagttttcactctaaacaacagttggaatcatattgattctggcaatttacaggacgcaataaatttttttgaagtggtgcgcagatgaagccccccatccccacccctcaaaaaa

SEQ ID NO: 65934 - DNA, 1575 bp, Oryza sativa
taccactaccaagcgaaccagcacaattaaagtctcccgaagtctgcaaaacctcttcctccatacaaagtcttcgatgcagaatgtcctccttgtattgtgggggtgactgcggactagaatttgtgaaggatagactcggttctaccagcttgttcatcaaatttgatgaaactccatttgtatgtaagtttccagtgccatcttccatctcacaaaaagaatcagcatgcgaaatggctacaaaatttagtggaggaagttgctgggaagaattcaagtgcaactttaaaggagcctggtatatattcccttcatgtgaggattctgtggtaacaccattagcactgtaacatgcaccatcagtgaaagataagtcagattccaaaatgtttgagctgctcccaccttctgacgtctgtaccaagtctgagatgtcctttgagttcttttgagctttctgcattttcttttgttcctcataccttccattgctactgttgaactctatgtaaaggttgtcaggttctgtattctccatgttttcatccatccactccttaaattcacgcagccaatcagttgatttctctttcttcaataattcagctgtattgatcaacgaagtaatttttatgtcattatcagcacctgcaacttcatccttcttagaactgtcactttcgtggggggtggtctgctggtccacaccttcatcacaaagacttctctcttcctccacaattaaggcaagtcgagaaatctttttctacagcaaatagaagggcaaacagactatcgtaaagagatatcagcaaattttgcagagtacaaatgcaggatgccctacttttgcagagttgtttcaatttagtagcgtttaatagatggtgttatatcttgcatttctcgaaacaagattaccataatatgtcaatgggaaatctctgttaaaactagtgaataccccgggtgttgtagcgggaaatttaaaaatactttaaagaaaacacaaggaaaataatttgtaaattatatacttgtaatgcctgaaaaacaatattttgagctcatagtaattgatttagaattgcaattgtacatgacacatggatttatcaagcatgagaggatccaatggctattacttttctaagtgacatggttcaatgcacattgagttttatatcaataactacaataagtgggttgtaaatgtacatgacacatgattgagatcaaaacatgcaagagatccataggctactattttctaaatgatgtggcccaatgcatgtcaagcttttggttccaactatataggatatatagatatgcccccccccccaaaaaaaactgaggctataagaaaccagcttctgcatgtgaaataaacaaatcgtaagcatgagaagagatcactatgcaatatttctattggtaatgagataaaccgctctaactaacagttcttgaatattttctgtcgcatacaatagatgaattttgtggcagatgttaacttaccatctttgaatttgatgtgtcttcatcctcatggtcatcttttgcagg

SEQ ID NO: 65935 - DNA, 4244 bp, Oryza sativa
taagatcaagggtttcaactgcaggtaacaactgcaatgactcatccatgagcaccagaccatttgaagcacatgatacatacaacagccgaccccatacgggtgagtccttgatatccatgatcctgctcgtgaagatatgcctaagagcatcctgaagtagtgcaaaactgaactgttacatggccatggacagtattgttgcattgtgtggaaatgaacaaaaaggaagcctaatcagaagaattgtttgaccaatgcaactaactgtgcaacttcttcctctattaacttttttgctgctactgagcttttgtttgtgtaccaataaaagatccaagcaatggcactgcccagtaaattgcagcctctaaagccacaaccaaatattgaggttctcaggctatatgctctaaacagtcaattatatgtctctactagtaattacacggtccatccacacacacaaacactttgtttgtttccaatcaacagtgttttagttgtttataatgggtaccctgtgataattacctagacaagatgacttattacagcattattaccttaaatgaccactgcggactccactgaaacctctaactcagataaatgacaaattgcctaagttttcctcagtaaatttgcaaaggagtatgtcaagaagcataaccctattttcagctgcatgaaagcatacacaagacaaacgtacaaagatattaaatggctacagtgccacacaacttctgcattcagagattaactaagcacgtcaggagggtaattgcagcgagcacaaaagggacagacgctacaattgcaatactgtggagtgcaccatgtgccacaaacccacaacacaagcctgaatgtgatcagaacttagtattgcaaagatgctcacaattctctagtccagagaaacagcatgtggattagattgctatcaaattcatattcaccagaggggtgcttgatgataacctaaagacctagcagcatcccgttaaatcccatgggttacaatggaaacattagtaaccatcaaatgcttgtggcgtcatgtcatatgtcatactagtatcttagaactcggaaaatgggcaaattcacccatagaaaagccagtaacatgctgagtaactatagtacaatacttgtaatatatgtgccagccaccaggatgggtcagatcctaggaacatagtattgattgtggctttgtggtctgtggggcataggtgggataacacttaaaaccagttcgttggatgtagaagaaccagactgcaaacaataagcacaattcacacttaatatagttcatagtttagtatgagatcaaaactagcgcctctgctcaccatgtgaattgccggaaacaacgaattaagtagctgcaggatcagaattactggggaacatgtcgtaatcgcaccgtggaattgtaacagatgagcttctcgagggtgtggcggaggtcgagcacgcccctgtcggcggaggaggtggagaggtcgcacccacgcagctcgagcacgcgcaggcgcgcgaacggcacgagtgatagcggcgccgggtcccgccccggcccgggggccacgaccttgagcgacgtgagcaggcgcaggatccggcggagctgctcgagcgcgcggtggtcgccgaggtcggcgacgtaggcgcggaggtagtcgacgggcgcgccggcgccgaccgcctccagctcccgcagcgcctcgaggcgggaggcgacgtagtggagccccacggggtggagtcgcagggtgacggagccgtcgagcagcgccccggcgttgcggcccacgaagcggaccagcaagtcgaggtagcggtcgccggtgaccggcggcgcgccccccgcacggccagccgccatcgccgccgtcgggatcgggctagggtttggggacccgccgcatcggcgaatgggggcggagcggacgccggggagggaagaggtggtggtggtggtggtggcgacggaggaggaaacggacacggccgcgctagtatgattggggacacgcgggctcgtgggggagggaacggaaggcgacggggtgcggccgtgcagccaggccgcgcggttgccagtgggtaactggcaagtttcggctggcacctcgcggatcgctgtgctgtgatctccttcggagaagctcccggtttgtggaggccaaaacggacggaatcgcgagagtttcccgtgtaaactttgggtcggttcgagccggacggactgccggagcgacgggttgtggcactggtctgtgctcccgtgcgctgtgtgcggcagtttccggcgctaaagctttgcgttgtgagatgtgccgccctcgctggcttggcgtgtccactccaggagaaggcctcttttggtgttacctacagaagcgtttgtcctggtcttagctgccgcgtgaggcgggggatcgctttccccggaccgcgccccgtcttctcgtgatcgcgtcaggtgatgcttcatcagttcagcgttgtttcaggctcctacgcgcgcatgttggttcaccagatcagagttgttctcgtccgagaattatattactttttttcttgtactttagatcagatatgatcagaattagatccgatgagctattgtttcttcggcggctggatgaccacctgcctgagtgttattgctgtattccttctcgtagaacatggtatgtttcctcgtaatttcactaggataacatatggcatattttggcagtgtgggcagtgctattatcagcgactctatcttgcaggatcacgattcaatccttactcgctctcgcgttgcccacatgtccccttccagaatttaatgagccacatgtcgaccgcatgcgccgtttagcatgccacgctagacgctacaatgaactaataatgaagtcaaatttgtttattccctgccttgccagattcaaatcaaggtgtggctgcatccacggtatcctaggagaaactagctgtattttttggcatgttcacacgaatgttagttctacaaacgaaaagcatgaataatagtatcgggctgatcctgtgtagcagtactgcagtagcactggggaggaaacgtatcctgaaggccttgtttgccaaggctgaaaattctcaggaccttagggatatgggctttggcgaagatggccgaagagtttgagcgtcatgttgtaacgggagaaagtctacaagacgtccttcacatacaagcctagtctaatttttttctcaaccccaaaacaaggtacagcattacagcacccatattaagaattaaaaccggttcaatttacctctttcagtgttttgtttcctgggtttatcccatgtgatatgttgatcggttaaccaatgttaacgtattgtccacataagcaccaatgcgagtgtaagtaaagaaaaaaagaaaaaagaaaagcaacgggcttacatgtcatgtcattccctcactctccctcctccccacccccaaactcgaggaaggcatgccgagggtgggtgcggagctccgagaggataagctcgtgttcatcatcggtgacatgggaacaacagggcttacggatcgcacgggtggagcttgagctcgccaacaactgtgcccaaatgaagaagctcatgctcatatgtcatcagcgacggtggcaccattgaaggtggcagtgccccacgatggagtttgagctctgcgacaatatcaacttcttgagaaggtcctaaccctacggtagcttacctttctgagggagagagaaaagggggagaagagcagaggagagagaggattttatttcgtgtgcatcccatttttttttatttttgataagagacctccctacggctacacctattttttttgagaaaagtatgaattacccctctgaactatcacggtcgaccgaattacaccccttaacacgaaaaccagatattgttcaccctgaactttcaataccggacgaattacccccctcgatctaattcagagcggttttgtcctatgtggcgtacccgtggcaacccagtcagcattttctatttttaaaaaatgtaggacccacatgtcgttcccttcttcctctctcttcactctctctctcgatcacggggcggtgcaggggaggatgtgggcggcggcgcgagcggcagcggcggacgcagctggcggcaagcggcggcagagggcggcggtgccc

SEQ ID NO: 65936 - DNA, 8938 bp, Oryza sativa
accatccccgttgccgtctcggctcctcgtccgccgccctcacccgtctccgccccacccggctgcggtcgttggtccctcacccgccgcctgcagccgcctccgcgcctgcctgctgctggcctcggctcctcgcccgccgcccgagcccgcctccgcacccatccccggcgccgacctcggctcatcgcgtgccgccagcagcccgcgcccgctaccgcctcgcctcctttgccctcgccgccgcctccgctggcggcaacggctgcaggtagaacctctccttcactggagggcagtggtaggaggccaagcttgatgggcttggcggccttggtgagcgctgcctgcgcgagggcgccgccggtgatcccagtggcgacgaggccgagcatggcgcagcggctggtctggacgttagcggcggtgtcggccgtgacaggcgtggcctctgatggaacgctgatggagaagagagagagagagagattgggagagagagagactgacaggtggggcccacctatatttttataaatgaattgttgactggactgccacgtaggatcaaaaccaccgtggattaagccagaggggttatttgtccggtttgcaaagttgggggtgaagaatgtccggttttgtgattaaggggggtattttggtcgaccgcgatagttccgcggggggagggggtaattcgtactttttcctttttttatgattaattataataccacgtaaacgtaacgttagatgaagattaggtcacgtgccacgcatgcacttgtaggatgaaatcatagtctcaaccccttgtgagaccaagacgggtcggttttaataattgatggagcttctatgtcatgttttgtggttgaaggacgataatcatactgagatgatagagagagccatctttttttttctattttgcaatttgttggactggaagtccatcttttatgcggtgcagccgtgcaggttctgccatctgccgttcagggagagagagagagccttagggtccatagagcgttaagttacaaacaaagttcgtagaagtaactaagtatatgtcagatcatggattcgacaaatcttggctatacgaactgaattaaacatggcaaagtgtccctcacaaaaaatgacagtgaaagtttatcaaacagatgcattatcaaccgaaattcgccccaaaaactgttcggtgccttactataaagaggtggtggtttgatacaagttgatgcgaaacataaaaactagataggtatcccgcgtattgctgcgggagaattacgtgataatatagagatatgagttctaaaattttctttcttacctattatacgatttattttcatgtgtttatatattttttgtacctttatcaattatcctaaggatggttgtatggtgtttcttttggagggaagagatggaatttacacccctgatgaatcatccaaaggctaaaaacaattgagatgatgtggcttcatgagagaagagagaattagcattaactacatttagtggagataaactttatagatatataggatgtgataagataacaaggtgtagcatggtaattctctcagcagccaattcacaaaacaaaaacaacagaaactctcacatcatattaaaaacaacacaaactcttcaatgcacaaatcctccgggctaaacgccgcgcaactgctaaaatggaagatcaaagcttcctaatcctatgacaacaattttctttcttgtgctagtcatattccctttgctgatacatacatggaacggaatgcaaagtagtatatagctgtgtaaagttgcaaatgaaatcccctggaatgccagtgctgcatctgcatgtatataaattaaccgggtgttcttcacgagcgcacaccgttggggaaggacgcgtccagccatccacccttcttggcgcgctcgacgtagcagcataactgcttgccggcgtccggcacgtcgagcgcgaggtcgtcgacgcagccggccacccgctcgaagcccttggtcatctggttcggcgtgatgaggccgcggccgtagcactcggcgaggaggccccacagccgctcgtccttgccacgcttctccatgatcgccaccagcgccttcttcaccacctcgtggtggaagaatggcatcccgagctccttgatgcactggcacgcctcccggatgtcgccgccgcagtcgtactcctgcagcagcctgccgatcttgtccttcacgtcgtccagctcccacccggccttgccggtggcgccgccgccccagcaacgcagtatccgctccgcagagagcttcgcgccgagcagggcacgggcgttccggagcgccaataagccggtggaggatccccctggcttgccgcggccggcctcctcctccattttctctaggttcgatggcgcgatcacctcgtcgaccactgacctggcgaagaacatggtcaggtcctcgacgatggcggggttgtccagcgcggcgtcctcggcggactcgatcaggaggtggaaccccgacacgacgtcctccggcggcattccgagcgaggacagcagcacggacgccatctccttctcgcggctcttccggtccatcgcggaggtgatcagcttcttgacgaagatggcgttgtaggaggaggaacacgcgtagttctcggcctccaggctgctcatcacctcgatgatgtcccctgtcaagaagtactcctttatgatcgacaatgtcttcgccttgaactgccgcaccgcagcgtcgtcctcgacgacggccttcttcggctcggggcccagcggcttcagcgacgacgcgcagagccatccctccgacgaggccttcaggatcatcgatttcaggaggcgcctcgcgtttggcacgtcgagcgtcagatcgtcgacggaatcgatgaggcggttgaaccctttggtgatctggctctcgttgatgatgccttcgtcggacgccgacttgaggagatccaggatgtgcccctcggcgccgccgccgcgctccatggcgagggtgagggcgcgcttgacgatgtcgtggtggaagaaagagatcttgaggcccctgatgcaccggcaagcctctccgatgtcgccggcggcgaggtactcctcgaggatgtcagcgatcttggccttggcctcctccaccgtgatgctcttgctcccgccccacctctgcaggatgatctcgccgtggtgcggcacggacaggtagcttttctccgccctgtgaagaacctcggcgcccttgcatccctccggcaggcacgtcagctgcttggccaggaacgccggcgggagtatgtcgtcgatgatggcgcgggcgacgaacacggcgaggatgtcgacggcgtcgggcgtgtcgacggacaggtcgtcgcaggactcggcgagcttgccgaaccccttgtacacctgcggccggtcgatgacgtcgccgtacagcgaggacagcagcacggccgccatctccttctccctgtcgtggcggtccatggccaccgagaccagcttcttgacgaagtagtagtggtagcacggcacgcgcagctccctcagctcgttcgccgtcgccgcgacgtcgtccgtggagaagtactcctccaagatcgtcgtggctttcctcttgaactgcatgaactcctccgacgacaccgtcgggcttcgcagcaggctcgcgtcctgatgacaaattaaccacctcgccatgatagttaaaagaaaaaaaacgcagaggcaaaatcaacgcaaatacggatctacctcggcggcggcgcattggatcgccggcttgtgcatcgcgggaggaacaagatcatcaggacgggactccatgggggacatgctgcaactcgttcaaactcaaaccatccgagttccgcaagctgcagatgccccctgctgcatgcagggggagacacctgtaacctcggttattcttgacgtggcgtccaccaaatgcatgcaggcgccacgatcctcaacttgttacatgtacagaaacgatcggtgatgagaagaacaccagaattattccgccccgagttgtcgagatcgagaggctgccgtgttcatctggtattatttgcctttggcagggacagctctagctcagggagcgattgagagagagctgtgaggagcgagggcagcagaggccatggcttttatgtgttcggttcgagcctcccgagcaagcaggaggaagaatggccacaccatgcaaatctctggaccgagtcactgggaagtgggcccgggcgttccaggtacaggatgcaggcgtggacacggtgcatgccgattaccgagatgggaatttaggcagttggatccgatgaaccgggtcgtggcccccgcgggaaacggccgagcggttgaatcggtctctgcatccgtgcatatcaaccagatttggagttgcctattagccgcatacggcggatgcgcgtgaattttcgtgatgccggtgtcatgctggattccaactcgatcatatcctaagttcgaaccgagttctaattgaaaccagtgtgccaccctatatacgaaatttttatactcacgctctgaatactagaaaactctctgcactcgttcaatcgatcaagcaattcgcttccatggctgttttcacacgatcgtaccccatggacgtcgacgacgagttagccgatgatctcgaccggatcagtgccctccccgacgacttgctgcacgtcatcctctccatcctgggcgacgcgaccatggtcacgaggacggccgtgctctcgcggcgatggcgacgcgtgtggacccatgcccagaagctctcctttgtcgacacggatccgaaaatacgagccaagccaggccagttcggtggtttcgtggactgggcactcgcccaacgcggcgatgctaacatacaatctctcagtatctccatgcccaccagcgacagcgccacgccagagcagatcaatgactggctccgctacgccatgcaacacaccatcaagacattcaaactttgttcgccttatcattcaagctatgagacggatgatgatcacccgctgccaattctcgagttgcccagcaatgcgaggacgacgtccatcgagctaagactgtcctcttttcggctccgactccctgtatatgcatatacacgatcgaacaagcgttcgccatctcaggaaccttggcctacgcatgcgcggacagtactcgtgcaatactgactacggtttatggctcctcaagaactgtcctaacatcgagcatttagacatatatcttcgacacatgttctccatgaatgggctcattgacctgatggacaagggcgcacctcgtcttcacaaagttaggagcatggtagtgaaaacatcttacttgtggccggaacatcgttttgtgacatgtgtacggccgttgctcctgatgtgtcctggcctaagatcgttttgcgtcaagattagtggtagggataaggtgagttgatttcctgaaatatatatctagtactatgttgttctctatataattagctactatatatatgcaatatcgcatcctcaaaatacaggcggcttacattaatgcttttctgttttctttatccacagataccactatttgaggacccaaatacattggcgagccaacccaacattaccatggatttcctacatgaggcaagtataattggcttcacaggaacagatcaagagatgcacctcgtgagtttcttgtttgggtgctcaacttcaatcacgtgcatgactattctgccagaatgtgatgacaacgacgatccaaaccgtagccaactactagaaattccatttactgggcacggttgttggcattttcaaagagataaatatacgtggaagcgaacgcaatatgaaggtgcacaagggaagagttgtgcatattgagatttaaccatccctgtccctccaaccgagagaactggtagacacgagggctcgtttgttttgcgatgatgcatcaaacatttgggggaaatccaaatgttgtccatgaagacctatgaactaccatatcataaagaaatagacgtctgaaatttatccacatcactatgattaaaacttttattcacaaatttaatgatgagtaaaagttttacaaagagtaaaagtttaactcatggagatatggataaatctcaaatgtttacggtagtttatatgtttgcactatatatgtggtttgcatcatgtatttgcttcatttgtatcatatgcatcaagcggccctcgtgttgtgtttctagtatagtttgttttcgacataaaaaatatgtaaatatactcttgtcttgggagttcagcggacctttgactttttttttcttagcaaacgaaatacacatagttcaattggttaggtctctattggttaggtttctagtgatgaaactcgtccactagagtctctgatatttatctgccgcattgttcgactagtataaatggccaaatgagccacccagcccggcccaatctgagatcaattaggctggcacgacctaacctacacgtcgggtcaggttgggtccgcccatgggctacaccaatgacccagacatgacccaaaacatttgggccgggccgtcctaaaggcacaaaaactcgtgaaaacccattgtgcttctccttgcaataagtctattgtttctccctcatctctttgggccgtgtcttatatgactagaataagtctatttgcatccctcttctctctgggctagaccttatatggctgaaataagtctattttgtctcccttatcaattttgactccgtgatcattggaccatgccaggctagcccactgttccaaggcagagacccggacacgatccaacttttgggccaggccagacactagtcgtgtcgtgccgtgtcgtgcctaagccaagcctagggctaggccgtcggtactcgggtcttatagctatctataccgactgcttttactacgccgtggcccgtggatgcgtgagggggtgagatgggatgcggagaccggacggctgtgtcctgttcaattccgatctgcatgcccgattggatgctctagttgggaactcatccgattccccagttgtctctctacagtataaactcgttaatcgatcgatcaaatcttgattacgtaaactgtgcaggaatttcgctctcatggcaactttcgcacgtgctgataccatggatgaccacgacgatccagccgatgatctcgaccggatcagcgccctccccgacgacttgctacacatcatcctctccaatctgaacaacgcgactacggtgacgaggacggccgtgctctcgcgacgatggcggcgcgtgtggaccaatgcccaggcgctctacttgccgatatgaatcccaaacgacgacgggccatcaagccaggccagttcggtagtttcgtggactgggcgttcgctgaacgcggcgacgctgacatacaatctctcactatccacatgtcctaccgcaagagcgccacgcaggatcagatcaacgactggctccgctacgccatgcgacgcgccgtcaaagctttcaggttttattacttttcgaacgcacgtgatggtcaggacctgcagctgctgccaatcgtcgagttgcccagccatgcgaggacggcgtccatcgttctatttctgggttcttcccgtctccggctccctgcgtccccggcggcatgttacgaagcgctgacagagctgaaccttcgctgggcgtcgttcgacgaggaagagggcgccagcgccggcggccgcaccctcggcgacttcttgtcgacatgctgccctcgcttgcgtaagctggagatgtcgagcctgaagctgttgtctcggctagttctgcgcaccgagtcactcgaagagcttcgcatttcctacgcaaacgatctacaatcgctggacgtgacggcgcccaacctgcgcgtcttcacccacacattctgctggtacggtttaactctcgatgacatcaacgcgcggtcggtgatcaaaatcgtggcaccgaggctggaggagatcgccatggacaaccaagtgttcatgaacactccggatttacatatacatggcttgaaaagcgttcgccgtctttgtgaccttaacctaacggtgcatggacaatactgcagcaaccgtggctacggtttatggctcctcaagaactgccctaatgtcaaacacgtagaccttcttcttaaatccagcgtgttcaccacggacgaggagcttgctgatctgacggacgagagcgcaccccggcttcacaaagttaggagcatggtcttgaaaacatctaagttgccgcaccaccattttacggcaagtgtacggtcgtttcttctgatgtgccctggcctaagatcactctgcatcaacattactgaaaggggacaggtgagttaattttccagaaaatatttagcaccgtactactattctctatgagatttgctaccgtccagcagagggaggcggtaccaaatcctagccgtccgttgggacagatcaaacggttgagattgctcggtaccgtgcggtaccattagctcttatagtggtaccgtttctttaagagaagtggaagggtagtatagacttttcgcatgtaagggcgagacgccggcctccagggtgcgtggtggggtgttgatggcggcaccagactgtgggttccagacccgatgtcgattgcggcggtaggtagcgaggtgcgctgcggggccagcatcgatggacggcgaggtctggggccagcgttgatggcggcgccggcgagctgcggggttcaagggttcaaggtggcgtgcagggctgcaggaat

SEQ ID NO: 65937 - DNA, 6520 bp, Oryza sativa
tgcgactctgcgagatccagtctgggcatcaatggccatggcgggcggctgcggtggcggtaggggcgctgccagccgcgacagcgaggtggccgtggagaggtcagactaggtgccacggcagcggcgggggtgttggcggccgaggcagcgaattggtcgtggagttgtcggattaagcatcacgccagcagcggcgagtcgtcggaccaggcggcggcactggcggcaaggaagaactgcaaagacgcgcatatgagggaggaaataatggacgcaagcatgcagcggggtccaagaatgagaatttttcttttttgacgaagaactcaggaacgagattaattgactcaatattgggagagatttttactcattcccaatcctacccctaaacattggatagccagatttgtttcagtacctagtggtactggtaccttgggtaccaagtgctggacagtagcaaatctcattctctatacgtagtactagctgtgcacaaaattctctctcttaaactgcctacgtgtttttacgtttttcctacttttctttatgaacagatatcactatttaaggaccgagatacattggcgaatcatccgaagttaacgttggaattgcttcaggaggtaactataactggcttcacaaggacggatgaagagatagacctcgtgagtttgctgtttgggagctcaagttcaatcatgagcgtcaccatacatgccactgaaaaggaggatacagagaaagtctcgttgaaaaatattatggcagaagatgatgacaacgacgatgatacaacaactcatcagcaactactggaaattccatttactgatcacggctgttggcgttttcaaggagatgtatatagctggaagcgatacacaacagaggacgcactgagtgactcagtgacaagtggtgcctgctgaaatttaaccaactctctgtctcagatagagagaattaaacatcagagctatagcccactgttaactctaatttatctatagtcaatctaatagcaaattcatacaataattgcttgctatactattcatatatggtcccacttatcatacacacaccacgtcttgaagtccgtgctgtagttggctacaaatatgtagcccgctgctcttctatcttatcttttatctcattaaaatatgtttatagttagctaatagtctgctattgtatctgctctcaaaggctagctagctattcggttgtgttgcgaagtcgaatccaacatttgtactatgctgttggggcaccattgcgttcgatttctagtatagatcgatattctttttggcttaaagattatgtacaaatcttctcatattctgatctttgaatcttgaaattttctgtagcaaaactgaataaaaaccttaaactggcgtggtggtgttgtgttgatcactcgctcggccgtgtgcgctttatccgtgctgcccaggaaaactcttttaatcaccggggtttatacatggcctgacaagcgttcgccatctccgcgaccaaactccattgattcatggacaatactgctgcaacactgaccacgtcttatggctaataaagaactgtcaagagcatctttcctaggtaccacgaggtattatgaggtacgaggtaccctgagataccaatctaatctaaccattggtttagcatggatatgatcggcctaacaaaaataaggtctcctctcttccatctgctcgtatcaggttgtccgtgccggctgtctgcgccgcgccgccgtcgcatcgagcccaccgccgcctgctgccgtcgcgcgaatatgaggttgctgtcgtgcatcgagcccgccgtcgcgtgaagatgcttgagcagtaggaattctgaaggaagatgaaggttgtccaatcgaagatgcttgagcagtaggaattctgcaagagatggaagtttcttccaatttatacaacttcccaattcccaaatctaagctaataagatttttcacataggcttttgcaatccagtatgggattttagcaccagcataacctgaaatctttaggttcttcatattagaatttggctcaaggttaccaagaatgattgaacaatcttctctgctgttggtgccatcatcctctgaccattctagagataatgagccgagatgtcgtttttccttcagcttcacattcttggcttcgcattcgaaggtgctttaactttgccagtttgcccataaaatcagatgtgtggaacaataccgttttaaacagacgcaaagatcgtgcccttggccatatctgacaccctcgaccacgggggcggccggatctggtaacgaggtgacaggagtggaggcgctagggaaggggaggaggagggctccataggatgaggaggagcggaggagacggcagccgacgacatcggcgtccatgctcgaacgcgaacggaggagatggaagccggcaaccggcggcatctgttcaccgtcggtgggagagagaaggggaaagcgacgtaccgtacgggagaggcgggggagatcgctgggttgggtgttattgcgaaattaccatcttaccggctaggctggtcctagctgatccagcagcgtcttcggtcgctgggcctggaaacatgggccggaccacaacgggtaaaggaggaggaaaaagtacatggaaggtccctcaacttgtcatcgagttataaaatcgtccccaaccataaaaacagatatatgacatctcttaactaatgaaaaccggtcacaataggtccttcggtggttttgaccccggtttattctaggtgacggctgaatcagcgtgtgatccatgtgagccctacatataaggatgccatatcggcccacactctctctttcccctcttctctcccttcctctcatttttcccctgggcgtcgctggatgccgccgccgctccgctccactctaccggccgctcgactcgcgatcgtacgtctggccgtttgccacgacaacggggtcgcgcattagatcgagagagattgggcaccggaagtccgacggcggtgccggggctcgatttcttgtatcagcgacagcacgctcgccttcagcgcctgctccgcctccggtgccggcgagcaccgccggcactggcgcgacgcgagggcgaggacgtcgagcacgtcgtcggcgaggcccaggcgcccagctcgacgaccggcaagaggtcgagcagcgtggccaggtcgtggttgagctcccgtagctccgcctccatctcgtctgactccagcagcagccgcatccggcttcgcaccgagcaatcggcgacgatcgccttgaaccaggagcacctcccgcaggcacagcgacgccaaccgcggcaactccccggcggcgccgcacagcctcgatatctatatcagctccccggcggcgccacacactcataatgcaaatgaaaacattcagttcagatctatatcagctttatctgtcatgaattctcagaagcagaactggcatggtaagctgaaagtttgtttcatcattgccaaaccgccaaatctaacaaagtaaatctaatgaacgaaaacacgaatattttagaggaaatatgataactgaatgtatccattacgctgacacagaccaatcacgagctcgaagcatcatgacctgcaacactgaatggcatggtggatctagcacagtcattggggattcattcttcaaaggattccagtccgacaagcccggggttagcactgtgcatgaacagaacagatataaacagagaagagtgagatttttctaaaacagggtacaagaaaagaaactagtctgcatcaagaaaaaattgtacgcaagcaacaatcgtattgcctactggagccatggcaacagaaatgatttcttgacgcgtcgatctatccccttcttgcaaagatggtgacaccacagagatattggttccccaaccttaacaggagcaagagaggacgattcaaaacacacaggaaaaaaaccatataccatcgatccatgaaaaaaaaaatcaaattgaacatgtagaaggcaacatgaaaacacagaccagaaagaaaagataaaccgcggcgccccgcaggtcatccaacgcggccgccagtagcttagaccgcctcgagatggacgcgaacgaggcgcgcaggaatggcgcgggtgtgtcgacggcggacaggtcgcgtgccaggcggtgcagcgaccggagcagctccctgtaggacggccgctcgcacgcctgccgccgccgcccgcccgctcgctgcagagctcgtccgctgcgcgctcgcggccgctgccgctctgctcgctagcccgccgctgccgctccgctcgctcgcccgccactgccgctctgctcagcccgccgcgcactcgctcgctgccgctcccctcccctccgtcggccgccgcgtgctcatccgcctcctcgggtcgtctccatcgacctcctacgtcatgtcccggcgcaggcggaggcagcgccgccatcaccgccgccgcgtcgcccgtcgccggccgccgacgccctcctctcccgccggcgtcctccccacccgctgaccagcttgcgcagagtggtgagagagagaaggaagggagagaagaggggtgctgacgtggacaccctgacatgcggggccatatgagttccacgctgactaaataaccacgtcggataaaaccagtgttaaaaccacctaaaatgtaaaataaacggttttgtaagctgagagatgttggttttgtgggttgagggatgattttataactctcgcggcgatggcggcgcgtctggattcatgcccagaaactctgcttcgacgacgatcggcaatcgagatggaggaggttagccaacttcggtggtttcgtggactgggcgttcgcacaacgcggcgatgccgacatacaatccgtcatcatcttcatgtcccgcctcgacagcgcgaggccggagcaggtcaacgagtggctccgctacgccgtgcggcgcgtcgtcaaaactttctggttcaatgcctgcgattcgacgccgatcggtgcgtggtgggcaccgccaccgcgtgaccatggccaccagctgccaaccgtcgagttgcccagctatgggaggacggcgtccatcaacctcaacctgtcgtcctaccccttccggctcaaactcccggcgtccccagcggcaaggtacgaagcgctgacagatctgagcctcagctcggcgtggttcggcgaggacgaggccgtcgccggccgccgcaccctcggcgacttcatctcgtcctgctgccctcgcctgcgtaagctggagatcatcgatccgatgcggttgccccagctggtgcttcgtgccgaggcgctcgaggagcttatcgttgcatccacgcgagatacgcagacgatggacgtgacggcgcccaacctgcgcatcttcgaactccactacttcaacagcatgacatcagtgacgagctatggggaaagcatcgacttggtggtcagaatcacggcaccgagactggaggaaatcgccataaacaactccaccctggagatcgaggacaacctggacctgcggatacatggcctggcaagcgttcgccgtctcaaaaacctcactctagcgatgcatgggcataactgctgcaacaccgactacggttgagacttcgatacgagatgctcgccactcatgaggtcgatgatctgacggacaatggagcacctcgactttacaaagctaggagcatggtcatcgacgcatgtggattggatcaatatttggtcacaagtgtgtggtcgttgctactgatgtgccctgatctaatatcacttcgcatctgtttgagagggtgggggtgagctcatttcacttctagtaatttatttaattagcacaatataacagctctatatatgcaaactgcacccctcaaacacaccggtaaggcgtcgatctgttctgacgttttctttacttgtatttactctccatctacagagatcgatcatccaaggaccaagatacacggacggacaatcgtaatatatcgttggaatttctggaagaggtaagattaactagcttcacaggaacagatgaggaaatggacctcgtgagattgttgttcggaagctcgagttcaatcaagagcatgactataagtacccctgaaaaggaggtagctgataactgttcgggagactttttgctagattctgacgacgactatccttattatcaccgactgctgaaaattgctccactaagtcacctcagtcgttggcattacaagagatttgaatatacttggacgcgatatgcaacagaggacgcacgagcggtggacgctgaagccaattctcccagtccaagaacagtgagggctgtgaatattggaaaaggaaagaaaaatcaaagctagctagggtcattcttctgattttgattgtttaagtttgaat

SEQ ID NO: 65938 - DNA, 2513 bp, Oryza sativa
tcttccaatgcgaagtactaggtactaggttttgtttggtggattggcccatgaaactctcctccctcgcatttcgccatttctcgcatcaacaatctgagggtcacgccgtcgccctgcccgcctcattatcctgtcttttcccaaaaccctcgcatccgtcggtctagcaaaccttagctagaatgaagctcgttgcttgttacccacaagaggagccaatagaagatgggtgccgaaaacactagttcacgaatgtgcgtgaactagacatctcgcgatcagttttccaaccatgtagtgacgagagctggggtagggttaggttttcggggatggggagggggaggggggaggtggtgctgggggagggtaaagtaggggatcggatttaaagggatcgcctgagaggtggtgcactggtggtgggttgtcacaccccaatctggcaccgccgtacaacggcaactgacaggagcgtatcgtaggaataacggcgcgaaccgcttcctacgaaaccgcaatctcagtactagtcccaggacatagtgctggtacccatggtgacaaatatgaatcattgcaaatccttaaaataaatagaggatttatttaccttaacttaggttgcagctcagaaaagcccgagaatgcaaccgacgacacggacgaggaaacaccaacaacagcagcagcagcggaaccaacggactaacacccatctccacaggcgacggctgggagccaggacgaaaccctaatcttcacttcacttcatcttctcttcagggcggaggaactatatatatttatttatatagagcaagggtgagtactttcgtactcagcaagtcacgggaatttaggtgtttaatgcaagcttggaagagaggcgaggttgttttacaattcctttgtttgaaatcatttttgaaatcactaagtgctttatttctttttaactttgggtcgaaaggagacttgcgtctcgattcgacttaagagatgcttttcaacaactcaaatggtaatgtaccgacctcccgggtcagatcattacttctcaactcccggagccatttcacttgattaaccggctcccatagcctttttcattttctcggactcccagagtctagttgcccagcagcacaacaatccgcttccactcgggaagcctagtctatgatgtccgcagacatcccgaatcacacatattcgtttctgaccactcaggtcatccatctgccacataggctgattctggttacgattcccacaccacaacaacttttcacaaagcacaggcaaacaaatctacgcaacgggaaccacctcacatccgcccatgaccgtgggcgcggctgttcgaccagttagttaacctctacagaggggtacattttacccacaagatacgaacttattccgaacacccgtcggtatcggaggttcgcaacaaagcctttcccaagccgacccatggatacctcatgccacatagaaggatcaaatcctcacataagtataggccattttagttttcacaaatcaaattccaaccacctcgatcggtaattcagcaagcttctcttccttgcttaccaggaacctggtttggctccaaccgaccctgttcccaactattggcatgcgaggtttccctgaaccgactagttacttagccagggtgtcccattccaccttgtggttgcactttgattatgctcgataagtttcccacaggaatcggtccttatatgcgaatacgggacagcgccacgtaggcacaacccccgcatcgcgagttttcacaattcattttattttcaaacacaccgacaccacatgtcgggttttcaaggcttctcaaactcatttcccaaattatcgacaatcgatggtgtctgtggagtagttggtatacgtgctcagagagcacggataccgaagtaccacaagggtggagcgacaaggaataagggtagtacaacctacaggaattagtgtgactaatgggtaggtccgtcggtttggcacgcaaaccgaggccaagcaagttaagtgtgtgattctaatgctgcaggttgcacacaaaataataatgattttccaattataggagcaattggtcaaagggtgacttgccttgctcaaggtgaagatgaagcttcacgattcttcgagaaaacccgtgatcgacgaaaatccggtaaccgcgactatacgtaaacaatcgaaaacctaaacaaaagaccaaaagaaacaccctatttagactaattaatagtgccattagatagatctcaattttacggaattattggaagtggaacggagtcaatcggagttacggatcgagagatatgaattttggaagtttaattggaatatctggaataggagaaatggtttatggattttatagaaataatattctcaataatattattggtagtcattgatatgtgggaccaaaggaaatgattcatggaataaagaattgatttatg

SEQ ID NO: 65939 - DNA, 8421 bp, Oryza sativa
cactaccgagtcgagacgggccctgtgatgggcgaccgacggcgcggggcgagctctccggactcgggccggggaaggggaaggagagggtgcccgtagtcccgcgtcacgtgtcgtcgcacacaccagcttcaccagcacgtgcgacggcggagggaggcgaggtcggcgagcggcagagatggtccggcggcaatggcgcggtggaggttgggcaaggaaacgaggaggaaagggaggggctcgagttgggttttataggcggtggtgatgtcggtttggggaggaaaccgacctaggcggtcaaggagaggagctggcggtcacgggcggtgtcgggcaaagtggaaaaaggagggggaaaagggagcgcggttccttcccgatttgagcgagcagagggaggaggaaaacgcgcgtgagggagagagaggcgctgcctccgcgtcttggacgcgagcgcacggaggtggggcgagcggcagggcggcatgggcggctgcgcggcgcaggcggccagggttgacgcggcggcgaccgggcggtcggccacgcgcgagcgcgcgcgtgcgaacgcgagggcgcggccggatttcgaacggcggcggcggcaaagcggccccggggagagagagagagagagagagagagagagagagagagagagaatcgagcgagagaggaaggagacggcgacgctctctcctgctcctgaacacgcgcgacacacgtgcgagagagagacggaccgagagggagagatggaccggaaagagaaaaacggcccagttgaccaagagggaggcaaaatagacttttaccgagagaactgatttggagggtttggagcttggggtttgaatttcaaatggggatttggttatttttggagtcggggcaaatatttggcaaggattcaaaggtagttagatagatcaatagataaatagacagttggatacgtagatcgataggtagagggatagatggatagataggttagataagtggatagatcgatcaatggatagggagggattcaaggtgagggttcaatattttcttggaatcggtaaagtttttggcgagggttcaggggaatagattggatgtttgagtttgattttgggaacttaaatttggaagaggaattctgaggaggcgatttttttgacggcgacgagagggatcaaggacggatttgaattaagatccacggcacgacttagactctcacacagagaatggaattttcgcatataggatttttgccgaattagtttttaacgcctcacaaaaagcggagcgttacatgggtggcgaacaagggtggacgagaggcgacagcgaagccatgggacggtgggccagtattggtaacgggggtaaagcgagggaaagaggatagtgaggaggccgggtggcggcaccgtaagtggaaagaaatagcagcgtgcgcaggaagaatcaaatcttcaacttgcaatacacatgtgcgcgagctatcacctcatttcattttcttatatatacaattttacataccggttatagtgttacgtgtagttcaaactagctgggtggcccgcgcaattgtgcggctagcacccaaacaaaattatatattttttatgattttactaaaaaaattattaaatagctatctcattgtcttaagagtttgaaagaccaaaccttatcatccccatgtttctaattatatagttttttaaaagtcacaccagatactaccccttatgtcatctccttctttatttgcttgctcgatctaccactatttctattcattctccttagaacctttaaacattggatcttataggttttagagtttattttcacgttgagtttcgtttttataatttctagatgtcccgtcaaacgttgccattatactcctctatgacccgtttactgtctcttctctttattgtcattgagattttagaaatcgaacataattatcgtttgggttcatttttactttctagaagtcccgctaaaccgtcattgactttgccattgtacttctctatggctcgcccgctgcctcccttctttattgtcattgagattttaaaatcgaatatgactatcattgtttttttttactttttagaagttccgaaccttcaaaaattgaaccttgtagtttttagagtttattgtcttgttgggtttcgtttttttataatttttagaagtcttgtcaaacgatgctactatgctcctctacggcccgtccgccgcctactctttattgtcattgggattctaaaaatcgaacataactatcgttggaattcattttttattttctagaagtcccgtcaaccatcggcagctctgcaactatactcctatacaccccgctcgctgcttctcctttttattgtcattgagattttaaaaatcgaatatgattatcaatggggtttattttttttactttctagaagtcccggcaatcgccttgatcgtttgctttacggcctccctatcgcccctccttttaatcgtcattaggattctatttggtgtttcattaacaattttttttatgtcgtatcaaccaccaccactactcctttatatgcctgttacttaatttatctcgtcatgtgttttagatggtcttttctatcaatagtctttatttttatcacaaattttagttatttataaattgtattcctaattggaaccttatttttcttttttctaatttcagatttttttaaaaaaaattaattaatatcgaattgtgttcttttaatatttttattttttattttcaatttcagttgtttcaaaattgtattcctacttgaaatctcttttactttatctaattttggatattattttatttttattccgaattttaattaatctcgtatcgggttcttatatgaaaacttttttcaatattccttatttttaattccgaatttcagctatttttaaattgtatttctacttggactctctttttttttctaattttggattttattttatttttatttcgaatattaattaatctcgtattgggttcttatatggaaacttccttcaatattgcttatttttaattctgaatttcagctatttttagattgtatttctacttggactcttcttttctttttttctttttctctgattaatgtgggaatttctagcccccacatcgaacgtggtgcctcctttcaaagctgttttaataatataatagatacaaatacaccataattacatttagaagtttttaactcagagcaattgtttaatttgatgtcaaaattaaccttaccaaaatttggtattgtcaaaagttggcgcatttttatagtaccaaatgttgatagcgttagaagcgtttagtttgtagccttatcaaaatttagtaatgctagtatgagagaacgtttatggaaataccaaattttagtaaggtgtcaataacaatagaatgttcggtttgttccttaattttaataatttgaccctttgagaaaacttatcaaaattttagtaaggtgtcaaaaaccaattttaaaaataggccggcaaacttgaacctttgcttagaggcttactggcacttgctccaagcaacgatgggccatccgtgccgagcccaacgagctggaccacaaagcccattgtcgtacggtcttttctccttttcggtaaggccggccgggctgcgacccatcgctaccagccacccgtgggcaccactggacagttggggtaaatgttcttattcttccctttttttctgaaccaaaggagcaaaaaaaatgtttcctgtaatcccgtgtactgcagcatggcacactccgtttgcatcgctgcatgcgggggcagaaacagccaagggcgattggatcttcacttgacgcgctgcatgatttgcgtcgtcgtttgcttcctggccattgcgatcaatgcctatctgtatctgaccatctgccattccgcgtagctttccgacttcagagcacccgctcttccatatatcgtggatactctcttcaacagagccatgatgttggtgcgtgcgagtggtacgtggaaaaacgggcgaaagaaacggagtatcagctgaggcggagtactacgtggatctcaaaatctccacatttcggtggcttcagaatccatatgatggtattaaaatattttcgatttgtttagatcgaattacaggtgcgagcgtcacgcgcgcctagcctttccactggccagcacgtgtgtaccattgcaaagcacgccaagacgcaagacgcaagacgcgtgccatgctggcggctggcttgctctatctcccatgccagtatcctgcaagagacgttgacatgtacgcagacacagtgcacactcaccctctcgagaaagcttgtaaaaatacaggcagtcgctctgcttgttcggatcgcgtattctggatttacggttgaaattgtgtgcgaagagtgctaaacgagtaatgggagccggggagaagtttctctgattcgcaccggcttgggaggatttggggactgtttggttggttgtccaacactacctaagccagccaaatatttgtggttaagttgttaaagctgtgatcaagaagccacaccttaacctttttaccatatattattatgtctatgatccaaatgtgggatcaagttcaaggaaagtttgatatgactaactcgtagttagaaccaaacactgcactaaactcagtaaaacatccttatcatacttgtggtaaattgaggcaaactttggtaagcaaccaaacaccctcttcatgctggattttccacaatttgaactttttgaaaaacttatttcgcaaatagacccttgaaaaaacttatcccgaaaatggtcattttggggcgtcaaagtagctggcgcagtcctcctaccaccgtggcggggcggcgctgaggtggcagggggagcgcgccaatgtagctggcgccccccttttttatttattatatatttttttcacacttaggagcacataagaaccaaccataaaaaaaataaactcaaatagacgaagtatgtgacctatagaatttttcaaagctctaccgaaaagcttctcgcctcgaaaacataatcttgcaagtggaatttggaggttttaatttcctcgaacccagcaaagcgggggagaatcggatgtaactttttttttaagatatccgtggatatattatttgcctgattccaagtccgtatgagaaagttacgactgtttcaagaaatgacacccgaatgtaacaaaaagaaacacgaaccctaactttttttattgtttataggatgtgaaaaatgtaaaaaagtctaagagtgttcgaaatttaatctactttctttggggactacaggaaaaaccaaaacaacgaaaagcagggagaacgcgggggagggggggtcttttcggtatagctttagaaaattttataagtcacatatttcatctatttgagtttaatttttgtatggttggttattgtgtgcttctaagtgtgaaaataataataataataagttgtacatatctctcctctacactagagagaggaaaaaatggggggagggaggggcgccaaccacattggcgcgctccccccacctcagcgctgccccgccacggtggcaggaggactggcgccgtcgtattctggcgtcttaaaaaggattatttttcggataagttttttcatgggtttatttatgaaataagattttttaaaaggactaaattgtgaaaaatccagctcttcatgcgtcgcacgcgccagatccgttagcagggcaatgtgagcattcaatccatcgtgcacacgccagtagtgcaaaaaataagcagtcctagtacaagagaagatcgcgtctagcactctccgatcacgatgtcacgcgaggtcacgttgctgtgtggcccgtggcatgttgcaaattgtcaaaactcaaaacctaaccaccaggagatagctagcactctctcgctggcttcagggatcacactctaatcacggtcattaatcccactcatttccatggtcataagatacgtgcagtactctgttgttgttgttcctaccaactgcagcactgaaagtagcttttcagacccttgcagcacacagttttacagccgcgccgattttgttcgttccgtttctaggagtagcatgactcagcgagcaatccgttgccttccacgtgttaacctatatttcggactctgtccagaactccagatgcgaaggcgaaggcggaggatttcggctagcttggtgatgctgccgttcgcgagcattttaaatacggtgtgggggcgttcctcctaatggcgaccctactacttattgcttgcctccccacccggcgcccccatctctctttgcgccaaaggtaatccatccatcgaatcctgcatcttttttgcttgtgccttgtgttgcaaagcagtcttggattccttctgttcgcattgccctgagagttctagttcgatccccaactaagagcgttttgttttcgtttttcttctgttcgttcgttctttcgatctgcagatcctacaaactcgccccccgaataaccatggcgtcgtcttcgtcgtcgtcgccgccgtcgtctgacccgtccttggagacggtagcgccgcacgcggctgttacgggggagcggaagctcaaccccaacctgcaggagcagcttcccaagccatgtaagcgattctatttctaccatgcagggatcgaaaaaaaaactgttctttctttctatctttctttttctttctcgatcgtctttgatgtctttggtcagtggtcactgaacactgataacctgataagagagtgagaggccggagttggctgcaaagcacgcggttgtgcgtgacggcagctcgacgtacatcagttgagacttgagagatcatatggtttaagtaccaacagaaagaatgtgtaattttaccatttaatttctctagatactacgtatttcgatgtactaaaatttttaagtattataaaatcttgatatctcaatgtactttgtcaagtaacgtaaaatttctgaaatttctcagaaagtatacatgagagcagtagcaccgctagtgctttactggtactgcatcatctgttacagtgcagaaaaattactaccgctccagtaactgatcctaaacctgatgtcgtaaccgtagccagctaactgctgctgtttttttttctttctgggttcgcgtgcgcgcagatctcgcgagggctctcgcggcggtggacccgagccacccgcaggggacccgtgggcgcgacgcccgcggcatgagcgtgctccagcagcacgccgcgttcttcgaccgcaacggcgacggcatcatctacccctgggagaccttccaaggtgagtgagtgagcgagcgagtgagtgatccgcccgtgtgtcttgctgtggatgaactctccacgtcgcgatcagtccatctctctctgctgctgctatatctgtgtcccgtttcggacaggcaaacagtttgccttctaaggttgtaattaagcttgacgcaacagaagagattaagagattttagggtcgcgtgttaagtcagaattatgcttccaaatcaacgattgcttgtgcagtgcagatgtagtatgagactttgagtatatggtatgttttgttttttgtttttcacagggctgagagcgataggttgcgggtatcccgtgtcgattgctggtgccatactcatcaacctcgtcctcagctatcctactcaaccggtaaagtttgccctctgtactccacgtgctccttattttcaatactttttaccaacatatatgccgtgccttttgctgtattgccaaactgtgtgatcatatctggactaatcttacgtcaaaaaaaaaatctggactaatcttctcgattatgatgtaaagaaattgtataatgttttttagggcgttctgaattttatatgttggtctgaatgttacaccaccttcttttgtaaatgtgaagaggtgtcactaggctagtgaaaattgaattgtagtgacttttgtaagtgggaagacatatctatcttcacttcaggctttggatttgatgtgtttttttatggaggggccaacatgtacagatgaacttatgtttactttctttcaaatgcaggggtggatgccttctcctctgttttccatccatataaagaacattcacaagggtaagcatgggagtgactctgaagcatatgatactgaagggaggtatgtaactttgtatacataattgttaagttcctctctttgcctagaaacgattacaatttctatctcgttt

SEQ ID NO: 65940 - DNA, 1898 bp, Oryza sativa
tgatcaccacctcatgatatagtcttgttctttctttttgtatgtgcatgttccaaatttaccctcatttatttttaaaatcaaggtgaagttacgcttgttgattcgtgttgcgcttatttaagcgtcatattaacgtatttgttccggaagtttaaacatataattctccccccaaaaaattgagctatatctgataaactgagaagggaccataaaaaataatttataggttaaatttaaaataactccaaaataattttaaaatttttagtgttattagaggtttaaaagccaatgttaaaaaataaactacaataaaataattataaaacaagctgtataactaaaatttaaatttaaattttggttgtagttaataaatcaataaggagactatagatgatgatgggaggcatgcacaattgtttcaaaatagtaaactccaaattatgtattgtaatgcacataagcactcctcccatcccaagtctcaactatatagattttgctaaattgagttcgaatttgatgcgtccaaaatgtgttatccggcaactcatatttgagatttcttttgctgtataatatttttttattaagaaggaaaatccatcgaaggacttgttcaatttgttgcccaaataaagtataccaaattttggtaatgctaaatgacacattttagcattattaaatttggtaaattttaagagagagcttctgaaaatacctaaattcgattatggagggcatgctgtgtgttgtcgttaaatgaacagttatttttttagtttttgttttggtgtatcggagctttccagaattctagtcacgtgacatctctatattaatgaaaaatggaggggcgtcgcccttttgattaaagaaattctaaaatttgatactcccagtcaaactatgttaaatttaattaagttttaaaaaatacggtaattttcaacccaaaatagcatttatgtgataaatattgataaatttgtctttaaacttagtaaatctaaataagtttgacttagaaaaaaaatcaaaacaacttgtaacgtgagacggagaaagtactaggtagtaatggctaaagtaagtttagtttattatctaattttgataatattaaaattcggtaaagtcgaaagtgataacaaaagttgccgatcatccgagccgttgcgagcttcaactgaacggtcaagcgtgttcggttcgtctggtttagctcccctcactggaacacctctccgtcgtgaaaaccaactgccggcggcgtggaagtcgccggcgagttcatggccgccgcgctcatcgtccccgcaaacccaaaccctactccaaaccccacctcctccctccgtcccccatcgcgtgccgcctccagtgtgctccgcttcccccgccgcgaccgcgctcgaacccatctcactgccgcgtttgggaggggatcacccgcggcggcggccgagcgcggcgggaaggactactacgctacgctgaacctccgccgcgacgccaccctgcaggaggtcaagacggcctaccgtaccctagcgcgcaaggtgctgcacctgcactccccccccttcactctccgatgtcatgtcccctcgaagtgttagattgtgtgatactgctagttttagtgtatgcgcagttcaatttatctggaattgaaccggtagcgtgatatagttgcgattgagttgggccacttgcattatctgcttgttccaacctgggtaattatcgtcttctgcatcccctgcacaatcctggttacagtatatgttaaaatgagtaaaatgactatgtaattcttggtaatgtggatcatggaaatcgcacggtatcattgccctttttagcattttcactgagatgat

SEQ ID NO: 65941 - DNA, 2873 bp, Oryza sativa
attcctgcagcccaaagtttaaggagataagtgccgcatacgaggtatttactgatatagactggttgattttcgacgcatcttccttgtataacgtgcggttgacctaagttctggttctgctttatgtacctttatctgcaatagttgaaattccatgaaaatagggaatatgctacatttgatgttttacaatgtttacaatgtaatttctcatagattctatcagatgaagaaaaaagatctctgtatgaccgctttggagaagcagggctcactggagattatggaggtggagatattggctccaatggggtagtcattctgttcaatacctaagttacatttttttgcttctgatctgtccaaatttaggaactgaaatttcttgtctacctgatatttttctagttaattatattatccaacctttgacaattggtgtctaaatttcatatcgtgtttaccaatttttcttgtttcccatttcaccctcagcaaatgggttcatctcattttcccaactcctgactaagcctgtgatttccattgagttctgagaaacctgcagataactagaaaacatgctgcattatattggtatgccaattgccaaatattagaatccagagagaaaatttaatctgataaagttatttaaatttgttcttcaacagattgatccatatgaactcttcaatgcattctttggtggccctgataagctttttagagacagcatgggtgctgggagattccattatggtacaaaagtcacagacaacaggggacttgatattcggtaaacaattttaacctgacactgaagcaaggaactgatacttggatgtttgtttactattttaatctctcttttgtatataacagatatgatcttctcctttcttttgaagaatcaataattggaggcaaacgagaagtcagcatttttcgttatgaaacctgtggcacttgccatggaactggtgctaaatctagcaatgacataacagaatgtactcaatgcagaggtcaaggcaggttaatgaaaacacagaggacaccttttggtatagtatctcaggtgaactatttattgtaccgtatgtattcattctcagtatttgttcaccactacaaataatctgataatatcttgtggtttctttcttcttccctggatctactacaaaccagttagtagattaagtaaaagaaaaatttgctgatgaatgatgttgtgcaattataattttcttcttctgctgagtaaatagagtataagacggcttgtggagttttcatattcattgggacaggggatgaagattcattatgcaggaagccattgtatatgaaatattactagctaaatactcatgttttgctatggataaatatgagttatacgcataaatatgaattaattgtgaggtttttagaacaactcatccatgtagatgtctttgcataataaacttgtaatttagagatgaaataacaggcttgttcggctgagatttatgctgcagcaacagcaccaccacacaagagaaagcatgaccgctgcagcggctgcgctgtacagctatgcggaacaaggccaacatagatacaatatgtaccaggactattttgtaatgtgaaagtacaccaagaagtagtaggtaaaaaaaggagtaggttgggtatcggattcactgccaacaccattgtcttctttcaggagagtaaagtatatatatattctaaatgttctcacccttgacgtgcaaaagttcagctgtagtatattcagtggaatttcaatgtcatcattagctgcatatacctcataaagtaatctgttcttcaatgtttactatttgctcagggtctcctactctttgtttcatgaaccacaacataaacacgctttaggtaatatctgtgttgatatattctgcagatatctacttgcttaaattgtgatggcaaagggaaggtaattactgaaaattgcactagctgctgtgggtcaggcaaaatccaagttgaacgcaatatcagggtagacatacctggaggtattcatgatggttctgccattcgaattaccagaggaggtagcgttgataatcaaaggcaagcactgggaaaataatacataaccatgtaattcatgcaatctttgttgaattttgtatgtttgatttaatcatacagcattcaaaactatcctacatttttctttttgtttattgtcggagtgctcagaataaaaatgagtaaaactgcatgtgtagaaggtacttccatcccagtcagttaattcatcatagaacactaaatctcttataaacattcctctcaggaacttatatatttatgatgtattaaaatatattatttgatgttatccatttcatcttattgtgcaggcgcgcaactggtgacctatacatatttgttcatgttaataaaaaagaaggcatccacagagaaggcctcgatctgttctcagatgtcacaatagattatactgatgcaattttaggaaccacagtgaaggtgagctgttaaatgtggctccgttcatattatgcattacatagcaatgacatatatttatgtaatgctagcaggtagcagcagaactctggctccagctttacctagaaagagtgtttcttatttcaggttgaaacaatagagggattcaaggatctttatattcctcctggcactcagcctggggagcggctgaaatttgctcaactgggagctccagacattaagaatcctaccattagaggagatcataattttgtgataaatgtgaagatcccgaagagtatcaggtttgagttgcgagtattgttgtactttgtgat

SEQ ID NO: 65942 - DNA, 726 bp, Oryza sativa
atggaaaggttcctacccgtataggactgggtcgttactatatcgtgcaggctccaatgtctccgagtcctacttggggaccgcctgacctgcgatataaaagggaccccccgggagacctaaggcatcgaatctcatagccgacacaacgaccacagcctacgaagccggagactacaggagccaagtcgccgagtgatctagtcgaatcaactcgactacgatctcgtcggtactaccgagttctacttttccctttgtaatatatggttctttccatataatcccatatcaactggattagggctattacctgctaagaggtctgaaccagtataatctttgtctcttgtttccttaatgtcgtattacgtagatcctcgtaccagcgtaccccaataccctctatatccggtctacgggtacccaccgtcgacacaaatattccttatgtcttcacggtgtatttctttagtgctatagatgttggttcatttttttctaggaatttggttaaagttaaaaaaagtttgatttagcataaaactaaaatgacttgtacaatatgaaacgagagtatccaacaaagaatgaaataaaacacaccatatgaccgcaaaatacccagtaaacaaaaaaagttcactgcttggctattagctgagatttcaaattctccctacttaattatctagttgatattcaggaaattcctttttttaagtg

SEQ ID NO: 65943 - DNA, 6835 bp, Oryza sativa
agtggacgccgtgagtagggatactccagggcacccattgctgatgctctaaagctcaactcccaaagaaaaacttgcttacaaatcatggcagtgacaccgtcggtactctgtccaagaccgttagaaaccgttaatgaaggatttattgtactactactccgtagtattctactactactgtatcgccagcgtttagatgaagattcaagtaatgtaggagtacactggaaagaatcgtactcgtgtagcttcatcggggaactggccgataaatgctcgcgaaggggataacatgccgtggtggaccggcgactagtggatatgcaagcaaattccgtgtttagttaaggtggtgtttggatacagtgacttaactttagtccctctatttagacactaatttagagtattaaatatagactacttataaaactaattacataaatgaaagctaattcacgtgacaaattttttaagcctaattaatccataattagagaatgtttactgtagcatcacataggctaatcatgtattaattaggctcaatagattcgtatcgcgaattagtccaagattatggataggttttattaatagtctacgtttaatatttataattaatttccaaacatccgatgtgatagggacttaaaagttttagtcccatctaaacagggtctaagtctcaacttctaacttttcatcacatctaaaatttttctacacacataaactcccaacttttttttccaaactatcaactttcctcaaacttttaacttttttttaggaactaaacacaatcttaagctggaattcactctgggtgaactgatgaatggacaggctcaggtactagtactggaggttaagaatatcgaattccgtggtgaaacaaagactttgctcatgattttcaaaaatcaaattatggactcctcctagtttcttttgtcctgatggtcccacatccagccttacttaacctttaaagacagaggcacctgctgccaagctgccttttgcacctgcaggagctttggatataaaaaaaaaggagcaaaaggagagaattctccaactaggctccagtaagtgccacctagtaatccatcattaaagcaatcaagcctcctcctctccctaatcccatttcacaccctcaataacaccacatccagctgcttaagctaacaaatcttccattataattcaagattcccatcacctgcccagtccatttctcctctactactagtaatactcttctctcttctcacagggagtgtgtgtgcctccatgacagtgctcgctctccctgagccgagagagtaaaggctctctccttcacacacctaccgcctactctcccactcttcttcccaccccactcgtgtgcgcgccactgccgccggcgatggcgccaatgccggcgccggccgtggctctggcggttctggtgctcctctccgccgttccggggtacttctccgacgacctcaacaccgacgcgcaggcgttgcaggcgctgcggtcggcggtggggaagtcggcgctgccgtcgtggaacagcagcacgccgacgtgcaattggcagggggtgacgtgcgagagcggccgcgtcaccgagctccgcctccccggcgccggcctcatgggcaccctcccgtcgaacgtgctcggcaacctctccgcgctccgcacgctctccctccgctacaacgcgctcacgggccccatccccgacgacctctcccgcctgcccgagctccgggccatctacttccagcacaacagcttctccggcgaggtcccggcgtcggtgttcaccctcaagaacctcgtgaggctggacctcgctgggaacaagttctccggcgagatctcgccggacttcaacaagctgaaccgcctcggcacgctgttcctcgacggcaacagcttcaccggcgagatccccaagctggacctgccgacattgagccagttcaacgtgtcgtacaacaagctcaacgggtccatccctaggtcgctccggaagatgcccaaggactcgttcttgggcactgggctgtgcggtggcccgctcggcctgtgccccggcgagaccgcgctcacgccggccggatctccggaggttcaacctgctggtggaggcgcggcagacgccggcggcgcaagcagcggcacgaagaagaagctctccggtggcgccatcgccggcattgccatcgggtgtgtgttcggcgtgctgctcttgctggccctgatcttcctcctctgccggaagaagtctagctcatccacgccagcgacagcggtggagaagggtcgtgacctccagatggctccgatggacatggaaccaaagggacagaacggctcagcagccggcaacggcgcccacgtcggagcagccgcggcagcgccagccgccgccacctccgccgccgtcgcggcggcggcagcagcagcgaagaccggcggcgcgacgggcgggtccaagaagctcatcttcttcggccccatggcggcggccccgccgttcgacctggaggacctgctccgcgcgtcggcggaggtgctgggcaagggcgcgttcgggacggcgtacaaggcggtgatggagagcggctccgccgtggccgtgaagcgcctcaaggacgtggaccttccggagccggagttccgggagcgcatcgccgccatcggcgccgtgcagcacgagcttgtcgtcccactccgcgcctactacttcagcaaggacgagaagctcctcgtctacgactacatgtccatgggcagcctctccgccctcctccacggtaaaaaaaattcccccatcctttttttacgcttctgtcggcgaaccgaatccacactatcaaaccatgcgtttttttgagcgatctcgccgttacaccctggcgatattcctccggtctccagtttccaccggtggccgcagtggcgcaccgcgagagtcgtcgcctcgttgggctctcgcgtaaggtgtcgcgtccctctcgtgtgtgcatctcgttttcgtggcgtctgtctcgtcggggtcgcggctcgcgactgtggctgctccgcctcggcaccaatcaatggtggtctcacctactccgatccagtagtgatcctccggtttttcttctcatggtgtggccgtgtgtcgccgagccaagctgagctggttcgacggggcgctgccaaaagccaagtgtacttcgtcctatgggtgagccgcgattagttagtttaccagcaaacaaacactgcttcagtgtttgccagaggggtgagcgtgagatctaatcttagtttaagcccacaacgtgacagccatgactggccccccggcacgtctcggcattcgaactcgcagttgaaacaggtatagcaacttgcggctgttcatttgaaatctctgaactggtgccagtaaagtaagcagagtgccagagtttagtgtaggagggagttgtggtagattggtggtaaatttgggggcaagtggcgcatgtgagccggtgccccgggttgcagtccgggtagggtggtttgatggaccatgtgacgtttggttggcgccactgttcctcgcgattccccttttgcgcgccaataatttagcctcctcctctcctctcctctcctctcctctatctcgcgtacagatttgaagaattattcattcccggacagcgtagacagatcatagatgtacacgcgcactgttgcacacacacttgagacgtgaagctgaagctaccgcgctgtggtcgcgtgcaccgtgcagtgaacattcttaattgtccgccgtcgtgaaaacggagtaaaattcatggggaattcgctgtggatgacgcggtttttttctggtgtatctcatgggggttgcagggaaccgtgcttccggcaggacgccgctggactgggagacgaggtcggcgatcgcgctggcggcggcgcgcggcgtggcgcacatccactcgacggggccgacggcgtcgcacggcaacatcaagtcgtccaacgtgctgctcaccaagaactacgaggcgcgggtgtcggaccacggcctccccacgctggtcggcccgtcattctcgccgacgagggtgtccggctaccgtgccccggaggtgaccgacattcgccgggtctcgcagaaggccgacgtgtacagcttcggcgtgctgctcctcgagctgctcaccggcaaggcgccgacgcacgccgtcgtcaacgaggagggactcgacctgccgcgctgggtgcagtccgtcgtccgggaggagtggaccgccgaggtgttcgaccaggagctcctcaggtaccagaacgtcgaggaggagatggtgcagctcctccagctcgccatcgactgctcggcgcagcaccccgacaggcggccgtccatgtccgaggtggccgcgaggatcgacgagatccgccgctccagcctcggcgaccgtccggccaccgacagcgccggcgagggcgaggagccttcactataaccgaccagccgacattgccgtctggatcaccgtacatcgatctcagcctcagcgaacggaaattaagttggagaattgcttagttctttgcatggatcttgctcccccaggctacttttggttcatcagcaacttgtgcatgtttttttcattactttttctttcttcttcctttcttttttttcccttcttttttttgggcctttctctcacgggctttgattctattctatagcacatgtcactgtactctttgattcttggaaaggaacacttgataatgcgttgtatctatgacgaataccatcaccagctgtatggtttgctatttaaaatacgaaatgatttcatttcagctgcaggtagctaggctttcgttgccatgctttgcttcccgtctcttcttatcctggttgttagggggaggtaatggttgttggggtggctgcttccgacagagtaattaaccatcttttggttggcgaaattgccatctgatagctctctgcttgcaaatggcgtttagctagcttgctggtttagtaggttggaaaaaagattgtgtgttctttatctaggagtgatgcccaagttaacacgacgacagaaagagacccatgctcatgcaatcctgtgtttgtacgcagtttacatgacagtgacaagttttttttgtttttaaattttgagcctccactcaacggtgcagcagccccgcagtgccaccagatgcaagattagtttagcttttgcaaatgcaaatgatactcaaaatgtagagccgaatgttagcactaatgtggcacaataaattagtacgtggggactgactgaacgaatacagcagtaggctgatctttcttcattgtttagttggtactgtgaataatggaccctagaagagttataccacacggtacctcatcatacccgttaaaaatggcaccgacgatacacttatacataagccctcgtctgaaatgaattgtatttttcggaggactttttgtgaaaattaaactaatttctgtaaaaattctgcgtttcaaaggagctatgagattacatggataggctgaatctgatcatattggagaaagaaagttagcatcagcgaatagagtaagtttatagtaatacgggaaaaaattcttatatcattaaatagcacaaactctcagtctaaatcatctgataaatgtggattttattcgttggtccatcttaccataggatgctgttgctgctacaatttgttgacagggaaattaatttattattgttaatgcccccatgataatatatagacctaacgcatgcgtcgttagcctgttacattccgagtttcaacgctgacaatttgtcaaattgataatgagcaccttcagaaaaagaaactgataatggacggctcagattgcctgtcttcgatttcctgtacccgtgaagcagtatattactccgtacacggattggccagctgatgaaactgggctagcgggctgtctaatgtcaaaccagctggcacactagttgctggcttcaattcgttcattgtagctgccaattaataacatctaatgaggaattaaagacgcatgtagtacgccattaaccaatagtccccagtggcccactacaagtacgaaccgaaccgtttgtaaatgtttcactcctcatctcagatcagcattggtaattttggtagttttgtactgcacctgtaacctgtaaaagtagtaactagccaagccaacctgagcagcatcagccagcaagaagtgaagaacatattggctgtacaatgtgtgctatactacactgttccatgaactgtcggccggcggccattgcagcatgcggcctggcttacagcctgaaagcgaccagctctgccttttggctctggagtctggacaccagcttgctgggtcatgcctcgtcggaatcatcagattctcctgctgctacagccggactgatactattaatttattcctaatcccggttggttgtcctcgtcgatgttctatttgtgtttaagtttagctttgtctgtcaatgataacaaggttcttttggaaagaggaaataaaaaaaaaagataaggactcttttggatggaggacttttatgggaattgaagtaattcatatgaaaatcctgtaacatacatgcattccaaatgagtctttgagtgtttatgtgtgtttcattacgatctgatttagaggaggaactttttccataataatgtgggagttgaactatttatgtgaaatttctacgacattctattg

SEQ ID NO: 65944 - DNA, 8009 bp, Oryza sativa
attcctgcagcccggtctgttcttgctgctacacatcactagcaagtgtgtgcacaggtgaagtgacctggacatgatctttgtgcagttttgcatttggttaagagtgagctgtgaaacctctaatataggagtagcttgtttggttgtaatgatgaggtggtaaagtatgagatgcctagcttggattccgatttgatatattgctacaggtcaaggagtagggaggaagtgatctggattatgatattttattgttactaccacttgataatgcttgcatattgccttgtttaaaaaactgcttgcaaattgcagatagctagtcgttagttgagttttttttttaaaaggaatgaatgtttagaaacgaaggagcgtgatttcggacgtgtaatacgttgtgatagggaataaaagaatgcataaacatataaataaaaaacacatgagaagagttgacgatagaaatcagaccgttcaatagtacctgcgtgcaattaactatggaataagctgcagaccagaaaaatggatatatgacacaaggttgtttattaaacattgttaagcctagtcattggaagattatttatataactgcatgaccttgctgtaatgatcctctgattgacagagcctcatgttgagttaaaaacggctttctggatttcatttcctccaaccagtttcagtgacttgccatgtactgaatcatagtgttgaaaacctgaatagtttatccttcatttcttcaccaagaaggcaaaatatagtagagatatattagcaatgctaatgctgccgatttataccgttttgtgacaacatctgcacatgggtaacaattaacaaatcccatgtagtcaaattacttctaccccaatcgctgattttctcaatcccgataaacaaaacctatggttacacccaacaagtgtggtccaggatcatgctacatatcagagagttgactatgctgatcagtggctgttagctcaacactggatcttgcaatgttcactgaagcatgcctttcaaacaagcattaaatacaagctccatcccgttgcttcacttgataaaacagtaaagcaaagtgaaatgtattattgcctactgcctaatgacgaaaacgaagcacgtccaaacccataagagtggtcatgcattagtagtttggactaaccatctagcttgctaattggtactgtaaatcaccatctattcttagcttagctcacattataggatgactcagccctgacaccagccacgtttgctcctcctgaaagacaatcatataaatagtcgtcactagcagaatcgacaatcgagttagtttaaccaaaaaccgaacctggaaatgctcctacaaaacaatctctgcagacagaggaatcattgtttcattagtcacagtgaatgtgcgcctagctgtaccttgcaagaaaatttttaattgtcagacaaaatccatctgcatcgaaaccatttgattctgattgcttcctaatacctaccatgtatagtgtcatccgtgtctgaagagggcggctttcttgttgcaattgacatagagctctgggttacagatgtgttcgttcttttcactgatttccattatatataaaaaaaagtagaacttttcagtgaacatggagagggttgtaactttaaacttttgtctcgttgtcgccatggaatcgatcgagaccaggtcgaaggcttgatgacaacgcaaagccgcacggtttcttctcctctctcgcctgcggtctgtctgcgtcgatgggcacgggtagaagaagaccaaaggccctgttacatccttcaaaatggcaaaagttttgttattttgtagcactttttgtcattttggatctaaacactaataggaaaagttgttaatttggcatttgctagtccatagtagtaaattgtgccaaaaagtgctttgagaccactccctctctctttctctctcttactttagtgctagaatggcaaaaatttaacatgcatctaaacaccaactagtacttttacaatgccaaaacttttgtcatttgccatttgccattccaaatggatctaaggccctgtttagatccttcaaaatagcaaaagttttggaggatctaaacagggcctaaacaggcccaaaggcgagcatcgcgttttctttatcgaaagaagagaaagttagaagcaaagcatgagcagtggaaagtgacaagttagctcagacttactaatcatacggtaataagggctttaattcaatcgcacaccacagataaacaatgtggggcgggtagaaagtgaaactgccatgtctgctactgattaatagcagtaccagtcctctggtatctccagtgatttgcaatcagcgagttcgtgtcgactgatatctaaagttatttgcaatcgatcagtgggtttaagttgaactaaatcgatgcaatctacagtatttgtatgcttagacaaatttagtcgaacttttaaaactttaagtgccggttttataaaaaaatttataaaatctaacaagtctgtattactatgataatatttttcaagtcaagtctacgcatgccaattttttcaaggccgtagcttgaaaacgagttttcggaggccaacatactcactcaaaagaagtaaagaactcgctcccttgccttgaagatacaggtttaggtttcacctgatgtctagttccaaagaagacctaagcaagcaaagcaaatgatcattttccagtattcctttcaaatgataatgaccggttcaaggttgttcagcggtctgccgcaattgcatctcccatcaagcgccctagatttcattgaatccgtgactatctaatgagtactagtaatgactaatgacatacgtgtcatgatcttcccaaagagaaaatgaaaagcatttacatacagcagctgtatgaataggcccaggacgtgccaccaacgtagctttaggcccggcccaattattcggacggttctatattcggcctggtaagaagtttagagatcggcaccatcatctgcatgggaaactgtttctttctgctacgggccatggtccacaagcccaaatgtcacattcaattgcctctaactttcaccctagtggggagcccatccgccattcgcagcgtcagtgacgtcacctgccgcggccggtacgcgccgtcgacggcgagctcgagctcctggagcacgcaggcgatgatggacttcatctgtatgtacgccatctccttcccgaggcacaccctcggcccgccgtggaacgacacgtaccggaacgggctctccggccggaacgtcgccgccgccgcgtcctccagccaccgctccgcccggaactccgccgcgtccttgccccacacggactccatgcgccccatggcgtacgagttgtacgccacgaaccacccggcctccaccgccgtgccgtccggcaggacgtcgtcctcctgcgcatgcagcgagtccaccggcaccggcgggtagaggcgcatcgactccgtgattgcggcgtgcacgtactgcatctctctcagctcgtccaggtcgaagccgaccctgtcgacgtcgccgtcgccacggcgtgcgcgcaccgtggcgacttcttcgcggatgcgccgctccacgtccgggcgagaggagagaagccagaagaaccaggtgagcgccgacgacgtggtctcccgccccgcgaggaggaagctgatgacgacgtcgcggagggccacctcggtgtacgactcgtcgtggctcgccatgaaccgggacaggaggtcgtgcttctcgaggccggcgcgtatctcctcccgccgcgaccggatgatgcggtcggcgaagtcgtggacgatggcgatggactcgcgcagccgccgctcggacccaatgtggagcgccttcttcaccctccagaaccacgggacagcataccggaaccgccccgcgctgagattagcggcgtcgcggaacgcgtcggcgaacctgccgctggcagtggagccatcgtcggcctccgcgagagcgccgccgccgctggcgtcagggagctggccggggtcgtggtcgaaggcgacacggcagatgttgtcgaacgcgaagcgctcgagcgcgtcctggaggtcgatggcgcggccctccgccgcggcgcgccgcagcagcgggaggaggcgcccgtgcagctccccgtgcacgcaccgcgccacgaaggcgcggagcgaccgcgtgttgaactcgtagctcgccgccttgcgctgcgaccgccacgcctcgccgtcagcgttgaagatgccgcgcccgaggaagtcgtgcagcagcgacgcgaagcgctcgcccttggggtagttgtcgaacccggatcggaggaagcgctccacgttcgccgggttcgcggtgatcacgccccgcacgccgccggggcggcggagcacgaacgtgcgcgtcggctgccgcgacagcacctccgtcatccagtccaggatgcggtgccggttggcgaggaactgcggcaggtggccgaccagcggatacggccgcagctcggccgtcgcataccgcgccttctcatgagatctcctactagcactccatgttcgaacaaccaaggccacactcaccaagaacacgagcagcagcagcaggatggcagccatgctgatccgatttgcgaggacgacgaatttgagattaataatctgtttcatctgtacttcgagcgaattaagcaggtaggagtaccagataactggataaggaaatggcagagtgtaatgactggtgattagtgaaactgttgcggtggtgtcgccatggccactcgtgaaactcgtgatcttgttgtgttcttgtgcacgggctgctgtagtgccaacgtcaggtttgtccggtacgtagggacagacgaacagtgttgatttgttgctggttgggttcacaatttctctgaacgaaaatgccatgtagcaacacatcgatgtcgatgacgatgacattacgactactaactgcgtactctagtcctcagtgtcacgtcgttctacggtggcattccgcgtccatccaaagatttctgctcttgccatgttctcgagtcaacactagactaacccctagagattaatctttaaaatttcagtccgaattggggacttatctgaaaaattttctgaccactatgagttattaatggttttggtccaaattaatggggttttcagcgaacaaacctcaagtgagttctcctatctaggctcgagttcactagctttcgcgtaaacttgcactttatctcggtcttttagagctcgaatggagcctaggatgatgtacttgggaaccttgagctttttcaagagccaatcactagcaaaattgaactgaaggatctgtttgcaagatattcatccatcacatgcagatgcttccattcttttggtcgttaaaattcaacttctacaagttgtaaagaaaaacaaattaaactatgactagttaacgtatattcacagtcaatttttttttgcaacttgtagaagttaaatttaactttgcatgtttgtggagtgatttatcacatatcaatctatcttctgaattattttttataacaatttagatgacaaggaaacaacaagggaatgtcccctcgagagtttaaaataatttcccccttatcatgtaatgataccaccatataccatagagatagcatgcacataatatctttgtgccatcacaaagaatctctataatataactatgaaatatcatatataccttcagaatatttttgtggcatcaatcataaaatatcaatggtgaaaaaaaagttgcttctggactggcgaacaactcctgggtctctgatatccgcggtgccttcactgtcccggtcatttctcagtttcttcttatttgggatgcggtgcttcacgttcagctctcaccgggtgtcgaggattgtctcgtttggcattggacggctgaccagcgctctcagcgcgttcggtgcaccaggaattcttctatgaccagcatttctttgcctgtgccgatcttctctagcacgcaaagtgtcctgccaaatgcaggttcttcctttggttcgcatttcagtagcgctgctgaacggctgatctccttcagaagcgtggcatcgatagtcactcgacctgcctcttttgcgctaaggatcttgagacggcgaaccacatcctcctcgactgcgtgttcgctcggcaggtctggctccgggtgttgttgcctcttggctgggctgccttctctcccccctgtggcagctggttccaggactggtggccgtcctctagggcctgcttacctaagcatctccgcgagagtttcgactccctggtgctcctggtctcttggaaactgtggaaggagttgaactctagggttttcgactctgctctctcttcagtctcagtgattttggagtctatccattcggagggccatctatggtctttagctggtgtcgctacttttggtgatttgtttggagtgtagcgtggcttggtcccttcctgttgcttggagtctatttttagccgccatagtttctctaagcttcagttttttttttcatttgctttttctcccttcccctggtataagccaatctggctgattgcgttgtgtaactaaaactctttttcttctaatatattgacgtgcaatacttttgtgcgttcgtaaaaaataaaatatcaatggtacttgtatgataccaatatgaaattccaaaaatatcttcatgatactactagtactatatatagcaatggtatctttatgacacctccttggtatcatggaggtatcatgttctcttaaagtatcactatgaaatctctgcaatacaaccaagaaaaatttgtgataccgatacctccttgataccacgaagtacagggctgggcaaaattacttgaatctggaaaactaggatcaagacgaataaatttgatcatccattcagtcttagcatctaactgatcaaattttgtttggtcaattctgttaatatactcgattgaccgtttgtagcgcccgttccgtcgtggcgcctagcgggaaaatttaaactctaaaaaccataattgcgaaatctgtttctttgcttgttgtcagtctccgtgccaatccctgatctcgaatccccgatctatcgtcaaattcaaatcccgaatccaaatccttgccaaatcaaattcctccgcaaaagtctattttgcctccctcaggttcggtgggccaatttcctctcggcccatctctctctctctctatctctctctctccctcagctctcccctcgctctgcctgtgtgccgcatgtgcatgagccgacgccgagccgagctctccctctctctctcgttctcccgctctccctccctgctccatccccggcaaactccccgcgcgccgttaccttgcgtgcgcgcgcggtcgccgccgtcgtcagccgcctgctgcccgtgcctgcgccttccggccccgcgccctgccacgctgcgccgcctgcgccgcgccctgccccgcgagccagcacgcgtgccctgctgcgcctgagcccgcgcctgccgcccctgtagccgcgcccttccaaaccgcccccgccgtcatcgccgtcgtcacgacccggccccgccaccaccgcgcatacttccaagggttggaggcagagctcctcctcccactgcctcgtcgccctctccctccttccttcttttcccaaagtggcaagaggcaagtctcctttccctctttcttttcttcttccccccctctcccccccgccggcgtcatcctccctatcgccgttttggccgctagccggagaaccaactcgctggcttgaccgcccaatgtcggttcctccctcccaaaccgacaatgccgccctataaacccgagcctctccccaaaccaatcttc

SEQ ID NO: 65945 - DNA, 7223 bp, Oryza sativa
ccggcgaatccgagccgttggctcgtctcccctcgtcccatgcaacctcccggtgcgctcgcccttgcctgcatcgctgtagatcgccccgccgctcgccgccgccgtccgtcgtccgttccggccgacgtcgtcgtcttcctcccgccgacccgcatggcagccacgtaggcgccacgtcggcgccacctcggccaagaccgggtcaagcctaccccggtccgctgctaccctctgccccgctcgcgcgcgcggtccaccgcgagccgtgaggttgcgcgtgggcccgccgcaaccgcacccaccgcgagccgcgcgcgtgcaccgcgtcccttccccaaaccctagcgcgcgccgcgtgctccctccgcacggtgaaccgtgtcaccgacaagcgggtcccactcgggaccacacgaggtgagcccggtccaccggctccctctctcctcccctcccgcgcgtgccttgggccgtcttctcgggccggccggcccattaagcttggccgagccgcccctttctctcgggccgcgccctagctgcccgagggaagtctgtttcccctccctcttttctctttttcaaaagggtttaattaaatcatttttcctttagaccaaaaatccaataatcttagaaattcaatatcttctcaaccgtatgtccgtttgactccgttcaacttccaaaattcctcaaatctcgagatctgtttaatggcacgtttagaggtcaataatagggctctattttcgccgtttgttgagttgtcccgtttcgcgtgtagtttcggagcccgaagacccgcagtgcgaggatttcgaggatcaagctcaagatctcgagcaaggcaagtcacctttgatcatcttgcacctataatttaaatctaagtatttctttttcgcaaatattgcataaataggattatcacgagtaattcggccgcggcttgcgagatagcctgccggcccccaatcctaattgctgcaattaccctccttgaattattgaacacttaaacctcctttgtcgattgttgtgcttcgatgcatgggccttcgggcacgcgcatcgggacacctcccctcaaatttaaaatatccaatgatgggtaaaacttggggtttttacaaaagacttggaaaaacccgacacctgggtcggtgcttgcgaactaaacgaaatttcaaaatcgcggatcggggaacgtaccgggagtgcggtttcccgctcttgcacttaaggaccgttttccttggaatttcatccgaacataaggcaagtgcgaccacatgggtggaatgggacaccccctggctgagtaactagctaatcgggggaaccatgatgccaagagacatgtggattcaacggggtggtgccggggagaacccccgggtttcctggcacagtatagtctgggacctaacctagtgttggtctgggacccctctcgttggcatatggtgaacctgtgttggctctcgaaatgccttgtcacgaaagcctcaaggtctccagacgtggccgttctgcacgggctgggtgatccgggttagtaatgtcgtgtgggtaaagtgtaccctctctgcagaggttaacaaactgttcgaacagccgtgcccacgatcatgggtggatgtgaggtgattcctagcgtagttttgtttgactactgcttgtgaaattactgttgtggaatgggttcgatgtttgaaaaatctgcggctgatgggatcagccaggcccgggtggccgtttaaaagctgttggccgggtgccaaccttgaatcaattcaaagactgatacattgcacaaactccgaccgaacgagacacactgtctcatccgtgtcgtttgagaagcactcacttagttgtttcaaaaaggagtttaaataaaaacaattgcaaaaacaacagcccttcctttgaagcctgcattaaacacttaattcccatggcttgctgagtactcctgtactcacccttgctctatataaataatccccccagttgctaaagaagatgatgtggatactgctgatgaggagttcttccaggagcaagtcggctacgatgagttttagggtttcggcctagttcccaagttgcgcctgtgatgaatagtccaagtcttggcttccgttttcccttttgtaatgcagttgtgagctcgggatctgtccgcaacccaacatgactgtactcctactctgtaataaagagacctctgctgctgtgatattctgtcttcctgtgataccagcactgtttcctgggactggtatcgattaacaggttaatttggagcgtcacgggctagttccgctcggggctagttcagggcgtgacaccgttaaccgaataaaccaaaagtagcccattaggcccattaagcccagaatcactggaaaactctagccacgtcatctcttaacacccccatccccagtcattcactcattcctcctcctcatgcacgcacccaaccgctgcgccctactccgtaccgacgcgcatcctgcctccttagctcctccacaccaacaatgttgcccaacacgccaactatgatgaatgttgattaagtgttgacccccattagcagcacgtcaaggcagttggcctatcggaacataccgagcagcagcactttcttctttcctgctactgccacaactttatttctcgaccatgatctatcttcaccctttaggcaatgcaatttggtcttgaattttagacgaccgaagtttctctaaagtccccgagcccgaactgattggtctgactgattgcccacccctaatggagtatcatgatacttacttgatgccatgaaattatcatggtaaatttatcgttttatgttgatacctcctcggcaccatagaggtatcataatacttaattgattccatgaaggtataatgatacttttatggtatcttctacaataaaaccatgaagtatcggtgatacatcaatttattgtgatacctcgttggtgtgatgaaggtattaagactttttttatgttatcacagtaaacctctacgatacaaccaacaacatttacgatattttcatgatatctccaaatatttcgtgaaatctttgtaaatataaccatgatgacattttcagatatgatggaaatcatgtggtaccatctacataaataaaacatggagatacatgtgagatatgatagaaatcgtaattacctctatgatattatggagatacatgaggcacaaagtgtaagggtcgatctgatataacataattaagttcacttctaacaagccttatcctaccatgcatatgacccaatagtggtgtatgctcatgtattatccaacacagaggaggtgcttgcccggtgtgtagaggcttggaaggatgtgcttgagggaattgtaaggaggacttgctcgcaagcgtgggtgcacactgcacacgtggaaactgcacatagaagaatcgcgggattgtgatttctataccatccctgaatggtacgacgctctataggaatgtttgtattaggcagaaccattttttaagatatagtctatatagcagaacgcccaaaatagtatgccattatgtggttccttcacagtatgaatacgttcttctcctatgatatctatagaagagaataaaaatgcatttaattttcaccaatcacattaatatgataattcattcacctacctcgagctatatatggattgcaccggccaatgcaccactagactatatattggggaaaagaacctcatccctcttcagccaacataatcaagaagacagggatggagcagcaacctaagatggtgaccggatgggcggcaagagacgccaacgggctgctctctcctttctcttaccccctcaggtgatctctagctctcttgctctatctttttcctgtgtgttcagatgttcctgggtcttgaaatattcaaagagaagttcacacaaaattcttgagttataccgttttctttttatgaaagcaaagttactgataaatagtcaatagtcatctccattacttcgttaattaattgtagtcaggaattctagttttgaacgggtaccatcaaactgtatcgatcgagatttatgaggaatatggaattgcctttgacaattgacgcaccaagcacataaacgctgccgtctacgttttctaccggtctccggtgatattttctttgtgtaatgaccgatgagaagtactgcatggctcattggttctgtaactctgttaattattgaaaaataactaaattgcttcagtcagtcagtagtaaccaatcgttgggttgccactctaacgaaaacatcactggtgtactgctatatagaaattagaacactgagaactaaagaggtagtattgtctgttgagttttgagcatttttcaagaaatttgcagctacacaatgcgttctgaattacattttttgattaaaaagaaacttatgcttggattgcaaagatatatcatttactgcaggaaagtaaaggctacacgggtgatgaccaattatgcactatacattcatcatgaagcctcgattgccatcttttagaaagaatgaatgatagccattcagtaggtagtagtggcgacgcactcatacccaacttccacggctgaaaggaatcaaaccattttggcaccgatggcttgtttgcacgccattgggcgagttcgagtcgttgcaacagcatttcttccattattcacctgctgatttatgtttatgcattgtcaaactatatgcattctccccaattgttttctttttcgtgagtacagaaaagggttaattaatcgtcatttccaccgtgcatttcatatttcagagctaagggagacgaagacgtcgttgtcaagatactgttctgtggcatttgccactctgatctttctactatcaagaacgagtggggcaacgccaagtatcccgtagtaccagggtcagtacgtacacatgcaatgcaaatcggctaatgcgcaacagaattatccagagatatattattgatcgatcgttttgcgtgcttaatccagtcatgaaatcgttggggtcgtcgccgaggtcgggagcagcgtggcgaggttcgccgccggcgacactgtcggcgtcgggtacatcgccagcacatgccgcgcctgcgccaactgccgcgacggcttcgagaactactgcgcgggcctcgtgccgtccttcaacgccgcgctccccgacggcgctacggtgcacggcggcttctcggagctggccgtcgtcaaccagcggtacgtcgtccggatccccggcggcggcggcggcgcgtcgccggcgccgctcgaccgcttggcgccgctgctgtgcgccggcgtcacggtgtactgccccatgaggcggctcgggctggacaggccaggggtgcacctcggcgtggccgggctcggcggcctcggccatctcgctgtcaagttcggcaaggcgttcggcgtgaaggtgaccgtgatcagcaccagcccgtggaaggaagcggaggccgtggagaggcttggcgccgacgcgttcttgctcagcaccaacgccgaacagatgaaggtgaccaaaaaacaccgatctgtgcgccattttgcatccgaattctgaagctaagaaccaccatatgtgcaggcagctgcgggcaccatggatggcatcatcgacacggtctcggcggtgcacgacctgacgccactcatcacgctgctgcggactcacggccagctcgtcccggtcggatcgccgggaaagccggtgcaactagccctgtaccctctgcaatcaggtgcgtgtggttcatcattactgggccttacagcctcacaccaaaccaggcccatcaccagttggcccgcgaatagattgggctggaggcccaatcagagctagatgggccgtgctcatggtgtgcgatgtggcagatgggaagagcgtggccgggagcatgatcggcgggatgagggatacgcaggagatggtcgacttcgccgtcgagcacggcgtcgccgccgaggtggaggtcatcggcatggaggacgtcaacggcgcgatggagaggctgcagaagggagacgtgaggtacaggtttgtgatcgacgtagccaacacaatggcccgtgctcgttagagtttgtttgtggtggtggtttctcagggacagaagaagcaagagatgcattgaactatgatttttcgaagtcaggactgaagaacgtgataagattcagtcaaaactgaagaacatgataagattcactttgctcctccttttacttgccattgcttgtgtttcgtgtaagcgaggagtggagtatgcggctatgcccatgcatcgccgtggaaatcctgtttatcagtgatagaatttcatagtgtattcgaaaatgcgcaagggaatgaaagttttatagattagtaatggtgagctaactttggaaagaagctgaatcatagccataaaaatcactgattgaacggttggcatgtcaataaaaggaaaaatccccttttccatctgagaacagtgcttactactgctgagaataagcgtacatccattgaagggggaaaaaagaagggctgaagattaaagagaaacgtgaatacatgatattattcctcgggtagttgcatacggataagatgtgatagggttacacttttaaggctgtactacgtgctactgctgcatatatacgaggcagttattctatctttttatacttttatctgtgctgtgtatatcacaaacttagaattatcgggacccccgcgtcgctctcgcgcgggcggctcgggggcgaaaccctagccgcccgcgccgccacaccctcatccccctcctccacctcgccgccgccggagctcgccggtggcaaagccggcggcgtgccgggaaggcggcggcgaggcccaaacggctcggcggaaccggcccctgcgcgaggaggacggagaacgccgacgatggcgcggccggaggtggagacgacagttcggcttggggcggcggatccggcgcccctgtggccggatctggcctccccacccacggatccggtcggcacggtgagaggcgcgatggaggcggagcgggcggtgagcggcgcgggcgtgccctgccggtgcagcgggcggcaagatgg

SEQ ID NO: 65946 - DNA, 1968 bp, Oryza sativa
ggcgcctgctcctgctctgcctcgtgcccccgcccggcgtcgttgtcagatggcgcgtaggaggaaggcgaggccggcagccagggcgaggcggcggccggtggtgtgcgaggtggtgctggccggacacgcggccttggcccgatgtccggcggcgtgaggctgtggaggtgctgcgcgaggagcaagccggcggtggtgacggggtcatcaagtggctggctgccattggtgacctcagtggctttctgcagcatgcaggaagcggtttggcagtgaagagttcatcctctgtattgccagcttgacctgcggggtggtagactgagcttgggtgttgaagggatggcgtggtggtctggcgatggtcgttgtgcaggatggttgtgtggggttttgatgggaaaccgctggcgaaagccttgccaggccatgggctggcatgacgacggcgacgccatttggcgccgttcccctccttggaggcgtcgtcctggcattgacccctcgtaacacgaagaaccctctacgcgcaatggtagccttggtggactcctgcaatgtccccaaagctcttcaggtctagggtgtttgacgaggcctcacttccttggcttcgttccttgctacaacgggtgttcatcactcttatctggttactgtggggtagagtcggaactgctttgctgggggcgacgaagcttggcaacaatgacacactgcaatttctttataggattgttgatgctagctgtgtgtaggagtggttccttggtagcttgggctgatgtccttcgtgggtgtcgttcttgtttgttcattttggcgttgggatagcatcacattgaagtcgaagctgctgtgtcacttgggtgacaagcttggcaacgataacatgtgtaagctgccgtgttgtctcaaatggcaagcttggccgatgccttgtgtcgggctctgtcgtggtagtttaggataggttagctgttggtgtggtgttgtagttgtggttttcgctcagttttctctaattaactgaggtgttgtagttgtggttttcgctcagttttctctaattaactgagcactgtaaagtttgatcccgttttcttctcaaaatgggatatcttcttcttaatataaaatgtcggcaacggcctgaccgtaggtttcaaaaaatatacgaggcagtttctcttttgcttttagcctgcaacacgctagctcaaagtgcaacactttgcacatttggcacagacgtttacatccatccatcgaagttattcgcatcagtcagagtgacatgtaaagagtggagaagatgtaacccgatcgaacaaacagacaagctgatcgaacaaaaaaagacagcggttttccatatatataaatcacgatataggaaaatcaagaacatccgtccctacggaaaaagcaaatccgttttacaaagcattattattcagagtacacaaaatgacactcggtgaacaggacagactagtaataaaattcaaagggccttgtcgacgccaaggatagaccgagaccgaaatccaacgttgacacatcacggctgatgcacgcacgcgtacgtttcttttttttgttttttttgggcgcagaaatgcacgggagaggcccgccggacggcttagttctgcttccacagcagcgtggtctcggcgatcatgccggtgacgacgtatgggtccatgttggacgccggcctcctgtcctcgaagtaccccttgccctccttctccgtgtcgcgccccacgcggatggacgcgccgcggttcaccacgccctgcacgcacgcacgcaaaaaatggttatgatctcatggtaggctagccgatcgatcaacgaacggggggggtatgcgtggatacacgtacccattgaaggtgttgatgtcggcggtctcgtggcggccggtgagggggcgctcgttgccctcgccgtagg

SEQ ID NO: 65947 - DNA, 1487 bp, Oryza sativa
aatattttgagcagtgatttcttgcctgtgggccagggaagccaccaactggccagccaaggggccagttcacatccttttgaaggagtgtgtactcctgctcaataccgtacctgtttggattcagagataaaaccttatgagaatggtatagcagataagatagtaaagtagatatagatttgggggtctccacatttggtggtccttaaaaacttttttttattttgaacggccttgaaaacttttagttttcatatttagctatttgataaactaaactaaactattatatttgtgtcaacaaaaatgatctagattactactcaccaagtagtaatttaaatcacttggtgaatataacaatcgtttcagaacttgaaagttctgacatgcttatatttattggaaacaaggattttttttaacaacggagttaaaattttaattaagtcgtatgcaaaaatactttaataatctggagagaacggttcttaccatggcacctcagcaacaacatcagggtggctgaagatcttggcggcactgtgcctcttgttagtggggattggctcaccttgtggcgtgtagcagtcgcacatcacctatagtaacattaaattaaaaaagtaagcaaaccagcgacttcccgatatagggtatgtttagttcacgccaaaattaaaagtttgattgaaattggaacgatgtgacggaaaagttgaaagtttgtgtgtgtaggaaagttttgatgtgatggaaaagttgaaagtttaaaaaaaaagtttggaaataaacttaggcatagttgaaaattaagggctatgcagttactgctttaagctgaatgaagtacatctaccccctttctccctaacttaaaccctaacatccaaagaaaattttaaggagagaaacagaaaccacaatgccctcaattaatgtgaaagttgtattgatttactggtaggtcgggggtattgaggtaataaaacttcttgctttgcggattgacgatagttaagaagatagaaggtgtttattttggaataaatttcaaattccagaaattgttttattttgatacggaaggagtacggaagctattcgtggccaatgtttctaacaggctaatttatatctatacacaagagttgaattccataaagtacgagcaggccaatcaatgatgtaagaattttggcatgtctacatcagggtgtaggcagtttgctggctaagagcaagataaacagctaaaggtttcgagcacatccaacagccagaaaaaataacctaactactagttaacatattcataattttatttttcagaccaagctacaattcaacaaggttaacacttaacagtgcctgaaataatatgtttctacaacaaatctaccatctcacacattcaaattttgtttgcaaaggacctttcgttcccttccttttggccatcataaagtgtcaatatgtcatga

SEQ ID NO: 65948 - DNA, 1698 bp, Oryza sativa
  unsure (1)..(1698): unsure at all n locations
tagtgcagacgaatataagaaatcaagaacagatcaaaagcagaggaggtttgccaaccagatgtactcggcgatgatcttgtcgctgcagtcgctgaggttgaggttaacgaggtcggtgaggttggccattgctcaaagcagaagagatctgaatgagcaagatgcaagcggaaaatgaggtgtagaagaggaagcagggatgaggagaaacagggagaggagagggatatttatacccagaaggagagaagttagctacggtgtgcttgcaagtcgcaaatcgcaactgtggatagcgaagtaggggcaagtatcattcagagacatttttttttcagttatttgattaataatgatattggccgtttaaaaagatagcgtctatattatctttatcttttaacaaaaatcaagggaatggattacctctggtgtggcaagaaactgaagtaatcatctcaaatcgagaggatgctgcagtattttcagggagaaagaagaggtgtaatcataaattcatacgtaatatgataatttgacactattgtctaaaaaaacatggttaacatagtaaaacaatttgttcgtagtcaataggaattaaccgtggaccgtggtaacttaagttggatggaagtttactccacttattattttcttggggttttttttcatctggtgtccaactcatgaattatgtgagcactgtgcttgtgcacatatgtatttccagaaggatgtttacaactaaaaggaggagcaaaatatagtgggtcagttttccaaataatgaggaaaagagtttgtaagtgaacatgatcgtgcaactaaaatacaaaatagtttgttttgtatgcttgcacattcacgtttattaacttttgagttacattgatttaaataattcaaagtcaacatggtgattagttttcggtgttgacctaagaatatgcgagctctatttttaaatgaaaaaagggaaagaaagacacaaaatgctgccttgatacttagacatatttttattcgaaataacgtttgatgatgatgtatagtatagcaaagaatttggccgtatgctccccttgttctgttggatggtcacttatccagaacctaaattgctaatgactgttgcttacttaattttgtgtccttaagattttagagtagaatagctcttatagagcagtacaaattgtaactgctttccattaataagtttcggctatcacaagtaatcaaaaaccatgcttctggttaactacatctccatgacaaaaaaacaaagaattggacgtcatcattccaagccaaaaaggagcgaccccttttctctttgtttttcttatctgttctgagaaatacaggaggtagaggtttgatgtatctatcaggcctccaatagtagacatcagccaacaaatttataaaaaggatcaccaattgatccacggaatctttttttttttaactgttgacctcaacgtgacaatgatcattgattggttcgtcacggtcngctctgtatttgcatagacaataactttccaaatgttaaatccgacaacggccgtggcatacactccacagatgtcaatgatttgtcaatttattacaagtttttagaaagaaatgacacaaggttttttaacctaagaactgaggataaaacactgattattaatcggattg

SEQ ID NO: 65949 - DNA, 3359 bp, Oryza sativa
ttcctgcagcccgattggtaaaaagaaagggtgctgcacaaacctaaaagacaacaagtacatggaattgtagaagtcaactatgagcataaccacacgtacaatttatgaaatttgacttctttcaaaaaaaaatatgcacatatgaaatttcacgaaacaaactaatctcaactctcaaccatagtagcacacccttcagttatctccaagatttagtacaagttcaagaattatttggcaaaagataaacaatcaagacaagcagttctacataactcaccactggttaatcaaatccaagcgtggaactggatgaccagtggtgaacttaaataattcaaatgatggaagacaactccagaaaaaaaaaatgatgttcaaggtgtcaacacacactagttttcagggcagggaagaaatatatagctcatagcaagtgtgactggtcccagcatcccatatttacgtaaggatcttgtatcctgtgtatttgggcatgatttcattttacgaatggttaaacatagattctcacaggcctcacaccatactagacagaaatgcccttcctagtttccatgtaaaatcagagtggcaccacctatcagacgatgctactcaggtgggaagcattagcctgagaagctagcacagaatttctgactgaaacatatacacgtgaaatcatgtcgcttaggttctcataaacagcatggcatcccagtacattaccgtaatttcctctatctttccactcattagataggcacatagattagtattcacatgtagaactggttttatacttgtagactactgggttgagattacattcactcacagctttgtcccatatgtgaacatggatattctatatgtgataactccagcatacttgctgacaattttactggaaaaatctgacatgccatctcaaagctgctatactatattaccactgacatggcatgtgctacgaacagcatcagaagataacaatgctgtagtaaattaaatttcaagaacataccttgtaggcaactacatgagcaagtggaaaaccctggttaccattctgtgcaagaagcgagaaatcaccgataagatctaaaatcttgtggcggcaaggttcatcctcaaaccgcagtggtggattaagccaaccaccagaaatactgccaatagccaatgagtatacaattatataattgaattagaacaacgtaatctgcagtttaagctgtgcaacaatttcaacgcctagccacatgagcccaacatcatcaacaggcatatctttgtaaaaatagttgcactgccactaattgaactgtacacagtatactaactttggatggtgatcatagaacacgaataaagttcactgctaagctattgtgcatagtattaagttcttttcagaaaacctgaaatatgtattcatgctaacctagacaatacaaacattaaatagaaagcactaagcaggttgacctattttttaaaataactagcaattataagatcatttgacttgttactcattcagacattgcgccagacaatatttaagaaacaacccgatatatttaagaaataaagcaacaagtggaagtccaaatttctaaatccatacaggttgggatgatgccatgatctgattattgcccaatatcaaaatccatcatgcaataagtcaacaggtatgtgcttctcagaactacgtcaaggaaaaaaaatcaccaacccacgacaaagaacacaaaattccaggatatcattcctcacctgcaaaccgtagcattttctagcgatcctcctctgatgagcccagcagaacgcaatttttcaacctataaattccataaatgcagcaaaatacaaaaatgatcttccggtcaaaattaaaaaaaaatggaagagaggataaaacaataatgtggacagcacaactagcagaaaatgtaagtacttcaaatacttaggccttacccgtgcaagattcgagaaattgctgactactccaagatatgaaaacagatgtgattgaaagatggatgatctaatgcaacatgagatcgtgacaaagtagatgaacgcgaaagcatatatggaaagttacattgccatgattcttgtaagagacaccataagttgcatgaacaaaacatagaaggcaacatccatattgtataacatcaactactgtaaaatacctcttcaaatatacagaaagttcttgctggggctatcttgcttgagtagacattagcatctaggactgttgcgaagcgctgacacccaattcctggcacctgcaacaggatgcatgctctgctcaagttctaaacatatattttgagatattttagcattgacatccaagttaaatattccaaatattataataaagacactcccttctgatagagtgattttttggacattcaacgacatggttttgaaaacacaactttgactattaatttctattacgacgtagttaagatggtaaacatataataatatgatactacctttattgacaatctgtgcattttttacctccaatatattctcataagatattgatagctgatagatagtgtttataagttactgttactcactctgttcacaaatataagcatttctaggttgtttagcagagattaagggtgaggagaaaatatttttggtgccgctcatcgaatgagggatgattgggggtgagaggattgttgagggtaagatggggataaatttgaatgaggtgattgatgggataagtagttcggtaggacttcttatatatctagaaaaatttcaaatgcttatatttgtggacaaaggcagtaggtagcatacactgtattgtcacctgagggaatagataatatgtggtttattcatgtgattcttgaaccttagaaacaaaaatcttgaggtccaaaataagggaaactttgggtaagctgacctttatttcagtgcatattaacaaaacacccattatttaaacccaattacataccaatcacatgtattgcagcataatgaagacataatcaacattacaaaaggtaagactaacttaattatcagtaatcctataagaaagttagaagaagaaatagaagcaaataagggtttaaaagaactgcataaaataaatgaatgtgcttagaagttagcatttcctgatcataaaaggaagagataaaacatacttttggaaaatcaatcccataggttatacggattcttgaggaagggagtgcagctatgaaacaatcagacttctgcaagtaaacaggctcatggatttccggagccagtttctccagtttctggcc

SEQ ID NO: 65950 - DNA, 3796 bp, Oryza sativa
catcaacatctatcaagctcctcgagataccaaaagggcgccgcacctcgtcgccgccgctgacctggacgcggcagttgtcgacgccgagcgcctccatcgcggagagcaggtgctcgaccgtgcgcacccgcgcgccgccccgccgcagcgcggtgcatagcggcgagtgcgcctcggcattcgccacctccgccgccaccctcgtctcctccccctcaacgacgaagtacctcccctcgccggctcgcgcggggagcagcgtggcggtggttttcgcccccgagtgaagccccacgcccgacctgctcaccgcagcggcgagcgtctgctgcggcaaccctgtctggtagagaaagggggattagtcagtatcggagattcagagaagtgttttgcaaaccatcttactcactggtttccaggagaaggccgcgcgggagacggagttcagggctcgggcggcggagccgcacatgacggcggcggcggcggcggcggcgaagggattcaacttctcactttctcaggtgtggggcgatctctgcggagacgggcgagcccccgatgagtatgacggtgggactaggccggcatttttctcggatccatatgtcagtactccgtcccattcggaaaaaaccggagcggggaccgacccggtgagctcgttggttcaccggtcagaccgccggttccccggttcatggctaattattttttaagtcataattgactttcatatgcttgtggcgctgcattcattgaactttcccaccaaaccaactgtgccagagatatttgttggtttgaatgaaatacctattctatttagcagtttaaagtcaattatgaagtaaaaaataattagccatgaaccggtatttaagtcatgtctagcacggttttcggtccaaccgctccggttttaagccggttcaacagaaaaccttctggttcgatgttttttaccggttcaatgtaaaatttaaaattttccatgcagctagcacggttttcggtccaaccgctccggttttaagccggttcaacagaaaacctgctggttcgacggttttgtaccggttcaaatatattgactgtcttttctgtaaaccgaaccgtgacatgcactggttccggttttccggttgaaccgttgggccggtctggtttttttactatgattccaagtgcagccatgattttccgtgcacaattttaaccgtccgtcttatttaatttttttttaaaaaaaataaaaacataagtcacatataaagtactattcatgttttatcatcttataataactagcaaaaatgcccgtgcgttgcaacgggtaaaaaaaataatccaatgacaatagacatttttcaagcgtacccatatcaatgataatgtttctatggatcgtgtagctaacacaattagaaaattagagcatctttatgtaatgacccaaactcgatgatggcaatctttttaccaatgcttgctttaactaaaataattggattattcatataacaatatacatataataaaaaaatattctttcaatattattcttgcaaccaataataggttaatcaaatcctacactcaggatcaagtctacacaaaatagtcaccgtgcactcttctctaaataacaattaaaaatatgtttatttttaatactattttcatataatatgttattaaaaaaagtctgataatgataattgcatacaaaaagtgcagggattagatgaggaaacaaatgatgtgtaggagatggaaaaatatcgatggatcttatccgacccaagcgtccatcaattttatctcgctttgagtcggacggtttctcggagcggttctttttataaacggcggtttttttctcgcattgagttggatggtttcctctattttttttcgaaatgatggtttttttctcgcattaagtcagacggttttctcgaaccttattttgaaacatcggttttttttcgcgtgttgagtccgtttgtttttttggatctgttattttataaacagtgtttcatcggttagttttttcagagcggcttttttttataaacagttttttttttcttgtgtggttttttgaaaccattttttttagaaatggtgtatttctttctgatagtttttaatagcattttttttgtttttttcagacgaaggaaaccgtatttttcccgcgcatttttttggaaattatttttttcttgcgcatttttttcctttttaacggatgatggaaacttctctttctaaaaagttagattagattgatagattagattagagttaaagagatatatacggataacaaggggcgactttaagtttggtcgggtcgttttttcctccttttctttttacggagtttgagttagatgttttttttcttttttttattacggacgagaaaacctctttttcacgagtcggacttttttttctctacaggagtcggtcctttttttttccttttttttacgacagaaggttttttagagatagatatttatttttaattaggtatttattcacgcgtgtttcccttcggatagaaactttttttttcgcactattctttccttttgtaggaagatggaaactcttttgtcgctcggaattttttttatttggaatcggacagaaactatttctgtgggtaatttttttataattaaaaacggaaatttctttaccggttttttttggatcggacaaactggtttttttcgcccggttttttttcacccggtttttttaccggtttttttggatcggacaaactggtttttttcgcccggttttttttcacccggtttttttgacggacgatggaagcacctcttattttttaagtagtagtagatagtagataaaactactaattataaaaaaatttcaaataagacggacgatcaaagctgggcaagaaaacttatggttacacttataaatgtgattggattaatcaatgtacgagaaccactgacttgttatttcttggctgtttccggcctataaaaaattctccactccactataaaaaggaaaaacttggatcacaggtatattaacagccctatggtttcgcttatactttatggttttttaatcatgatttattttacagcatttacttttttgtcgttaaaaactcgtatataaaagttttaactatcaattattttctacttgctaataaaaggtacggatgaggtgtactccctaggtcctaaaataaccacctaaaaaaactgttgtaccagccccacgttaaagcataccaaagtgcagaactggacaggttttagcacgacagagtagcaagcaaagattcaggtgctccacctgatcacatgtaagctatgataagctgttccccaacttgatcagcccaaaaaactcagcatgttacaaatgtctggagctacagaaacaatattctgaaaaaaaatagagacaatccattatatgccactgagtttgtcatagctctacgatttgccactgactttgtcacgttctataatataccatcgacttttacttaacttctatgatttaccatcgccgtccagttagtctccgttactactgtacaattttgtccaaatgaccaaaatacccctgggataaaacttccaaaatgtggacaaaaattctgaaataccatattataaacataagattgtaaacattcaaaatttgtccaaaaacttaaagtctgacatttcagaatttttatccaaaatttgaaagtttt

SEQ ID NO: 65951 - DNA, 2608 bp, Oryza sativa
aaaaatcgatggcatattatagaacgtgacaaagtcagtggcaaattgtagacctatgacaaactcagtggcatacaatggattatctcaaaaaaatatatggaaagctacaaaacctaaacgttcatccttaaagaatcgtttggtacggaaatttacaacacggtacaaattgaagttgtagaacatgaatgcaacaagagatctttgtgtcgcttttaagagctctagttcactttgcactcctctcctgaatcctgatccaccgcaagtaatgccagacgaatggcatcgcccgcaggacttactagcaatcagcccaaaataactttaccacattaacagccgtaattccgtaattcatactgattgtttggctaaaataaggaggttgcacagatggataatatttgattgatatgcagtctcttggtacccttgggatctcgcaatgacgtcaaccacaggaagagcatatcagagatcatgtccaattgaaccaggatggctggctttctctctacttggtagagcaaatgcacaatcccatgttttacagtgccgagaatacaaattgaaatggctacttattagataataatttctcttctaactctcggaaacctcgatagtcattctttttttggttctgtggaaggttgaaccgcctcatctcagccaacctgaagttacacatacaacataaagtagaaggaaaataatcagctctaactgtaaagtggtttcatgatatacaagaaaatatgttgagatagcaatagtacaaagaagcaggagtattttctaattgcttacggggatcaggtgcttacaattttttttggcaatgtcacaactaacaaaaaaaatgccatgttaaagataaaattgaaatttcacgataatttattcaaatcttagttatcaaaataaattgtgatgattcggttcagaatttcatgatgcgtagttgctacctggctagcataccacacatcaggtagggccaatgtataaggccagtgacttctttctataaagttaagacccaaagccgaaacctcagcgttccatgtcatcactaattctcagccgttcgatcggtgaaagagatcgcatatgaaccgttggatgagaagatccctgggccttgggccttggatcaaagatgaagggagattagacccattcatccttccagttgatctgatccgaattctgaacgctccttgattcccatctctctgtccatcattgctgatatattgagcccagcccacccagtataccaagcgatccaatgtatccgatcggtttccttccaatgatgcatgcatgtcgtgtgacgtgcgtgtaaaaatctactacgcaggtttcaatcgccttcacttcaatgttgtgcccgcacatgtgcacgttctgtctcccggtccatcaattcgcttaatcacattctaccttgcctgaaaccgtcggttggtcgactgccacaagaaacagcttccaacgagattaattggcgatttgtgcttgcaatcctcccttcaagatcatcccttaattccacaattcctttcgcaaggtcatcgatcaacctcaggctgcgcagcgcaccgtgagcaggctatggaatcatcatctggcaagctttacatgatctctcctcctctccttcctctctaaattcatgtgttgcctcctgtttccagctactgatttgttttttggttcacgcatggaatttagacttgagagttgaaggtatgttgaattttttaggcttactctgcactttctatcatatctgttcgtctgtaccacttcttgattttggttcattatgtacttttgtttgctcatcaatgtgaactgatagtttctacttttctccagaatattagaaactgtctctccctctctaaacatttgcagcaaatggatataaagatggactactacgcaaaaaggaattcatatggatctcaagtaccaggtgccaatcatcgcctcacatttaagttttgttaccgcctcatgctgaaaaatatttggattggattcttcacttttacctttctgatggtacacaaatgcaaatttatataggttggtactttgttcgaaataaaggtgcaggtatgtgcttttacatctgagtttatacttgaagtctaatccattttattttgtctaatccactttattttgtcccgtattatatgtggtatttaatccatgctagattaacctcagatcatcccgtttgcatgttatgcaaattccaactcagaattacacatagctaccgcacggatatttcacattttgtttcagttttctttatataaactatatgctcaattttgaaggtgtctttttcctatcaagcatccttttagacaaatactttctgtcgcttttacaattttttctcctattcaaatcaagaataacagttgaatgcatgggaaatcttggggtggcaattaacggtgtggttatctcccgtggttcctctctaattagtggtgcaattctatgttttttttcttgatttcccttataaattaggtcaacactgtcctttctatagtaaattatattagct

SEQ ID NO: 65952 - DNA, 2037 bp, Oryza sativa
gttcaggtagacctttacaggctccaagaagggctcttgcaacatcctagtcaccaactaatccttctccgaggttaatctatcatgtagcatgatagcatagctatgtaaatgccactacaaaatgggttgctgttacttgttagtatagaaaataccatttatttatagacagaattgacagattaccagtgcagccttctcgagatgaaggcatattatatccaatggtaaacaagagccatctgcaggatcaagttttgaacctactcttctcaccacagaacatgcttctgcaacaccacctcttgtactggccaaggagcctggcccaaatttctcaaataattttactgtcagcatctccagaataatttgcaaagttaacaagaaggttcaagtcatcatgaaaaattacagtgactatctaaaacagatttaccttaccaagtgaataagtgcaagtaaagcactacatacagctgcacaagaaaaatgcagaccataatatataactttagagcagcaacttgtgagaatttactgtgatcccacacccagttatagagctatattactatatcacaaactgtaaactcagcaacatgagaaattcgaaaagagttttttgtggatgcaaattcagaggatttagatatacctatcgtaacatgtaaaaaatattgataaagtgcttgcttattttcacacaactaagtaaactcttttgagatacaatttacactgagaaagttgtattacccatttaatgtagttatgtggaaagcttccgaaaccttattggtaattctgtatatagtaaccagtcaagtatatttattaaatgtataaagacgcaatggaatgctgaggatatgctcagatcaccggttttcattgtatgatcacactaccaccgcaagtccacaacacgtcatagtctatcctactgatttgtggtatcagttcatatgactttaacagtaaaagaagtgcaatctttatgacagtttagaacttatcaagtgaatttcacagttctactaactgtcacgatccccatagatatgttggttattcctggtaaaaacaagtggatctgctgtgctgctatcaatagtaaaaaaaatgcttattgcctagtaaccctcttacaagagagaagaaagcaggatcaaggaaaaaatctccaagaaacaaagatagccatacctcccaaagattaaaaggaacagcataattgttgaaaagttgagtaatactcttgagattcagtgaaagctctttagccttgtccatgggacatctagcagtctccacatcagctagaatgttatcatgaggaaggcatcatttggtgattcagtactgcctggcagattttcaagccgtgaagccatgaactattcttacttgatttgcatttggaactgaagaactgcaagtttgccttcaagtcgatctactgcgctgctatcaatagggttcctcgaggaatctgcagtaatcccttcacttttgccctgaaccgcagcactgctcagatattgatacctggatgcaaaaaaagtaggtctcattccatatgacacatggaccttatgaaagcaaggacaaaaactgagcaaaaatcaaataagtaaacaaaaagaagttgagtcaaaattgggagacctctggtcaagagttgaagcttcttccgcactggagcactgtctttctgccaatatcaacaacattctagcagcagcaatatgctcccccttgagaacataatacctggctagcagctcaagatacttggtttgactagttgaaataggtgcatccaaatcagtcaatttagaggcttttgatgcaacaacaggaagtccttgaacctaaatgaaataaatttagaggcttttgatgcaaccacaggaagtccttgaacctaaatgaaataactggtcaggatagcataacatgcagatatccataacacagtagagacataacatgcagatatccataacacggtagagggctgcaggaatt

SEQ ID NO: 65953 - DNA, 988 bp, Oryza sativa
ctttactggtcttatatccccgttgatttctctaatttaatcaaattgctattctgtgtatgctgaactcagtgcttgggatttagtattaaattttaagcagtgtttggttgtactgctaactggacaaaaaatagctgtagttttctttcctgatggtaaaacctaccagttttcaacacaccatataatcttgtccatggattaatctaagtctaaattgtttacttttgtatgttatagtatttacttgagacatctatcctgttaagttagggctatgatggactgcgtttcaggtcttcattaatggtgtgttctatcaagtgtcattttggttgcattaaacttttttgctctattcttccagcaaattgtgcctcctgtgcttacctccttcctggaccaagacagtagagttcgctactatgcgtgtgaagcactatacaacatagcaaaggtaaacattttgtcaagtaatggtacatgaattatgcgtttgctttgctgcattaatcttttctttattgtaggtggtaagaggggatttcatcatctacttcaacaaaatttttgatgcattatgcaagctttctgcagactctgatgctaacgtgcagagtgctgctcatcttcttgacaggcttgtcaaggtacgatcgtttgggcaactgatacatcctgtacgtattgcatccttgattagccctgataaacattgtttgtaatttataaaccaggatatagtaactgagagtgaccagttcaggtatgctacatatgtgatgtcctttttcaatctcaatatcatgcacaacttaatctagtatcgatttctgatagttcctgtatcttaattttgctatttagcatagaagaatttataccactcttgagggagcgcatgaatgtgttgaatccttatgtgagacaatttttggtggggtggataacagtgttagacagtgtgcctgatattgacatgctt

SEQ ID NO: 65954 - DNA, 1226 bp, Oryza sativa
cctgcaatgccaacaaaaaattgatgtttaagcctaggttgaacaccattcagccaattaccaaaaagattagtaatgctagtaggcggatggatcccaaaggttatagacacagcattccagattaatctaaccaaatgacaatcaataaaaagatgttgtatcgtttcattagaatcacaaaagaacacttagtgctacctttccaccttcttttttgcaagattatcttttgttagagtaacccctttttttaagtaccacaagaaaattttaatcctcaatggaattctaagccccaaaggaaagatttccttggaattactccgttaaaaatgagagctctgtacatggagttgacggtaaatatttcctttttattggctttccacacaaagacatcattttgttctgtaagttgagttgacataacttttgagaccaagttataccaagctgctaggttatcccctacaatagctcttctgaaaaaaacgtttaggggcaccttttccaacacttcagccaccattacattttttttcctgactagattatacaacgaaggatacatcttaaaaagaggaatcaccactccaacaatcctcccaaaatctcagttgtgtgccattacctacttgaaaagcgccacaagaaagaaaagagttcttaacctccatcagccctgcccaaaaatgagaatcccctggttgtttttctacaagtgtaattgttttcttagccaagtattttttcctaagtagtttttgccaaaccccatcctcattgataagcttatacaaccatttactcagcaaacatttattctgcacatttagattctgtattccaagacccccacaatccttaggtgtacaaatcacactccatctcgccaacctatattttcttttatgtccatcactttgccaaaagaatctagacctgtagtagtctagcttcttgaggatacctttaggtacctcaaagaaggacaacataaacatggctaggctactcaacaccgaattaatcaacacaagccttcctcctactgagagacatttccctttccaactactcaacttcctctggaacctctcctcgataatttgccaatccttattagagagcttcttgtggtgcataggaattcctaggtatctaaatgggtaagtcccagatctacacccaaaaagcatgacatactcattctctgcaaattt

SEQ ID NO: 65955 - DNA, 6797 bp, Oryza sativa
  unsure (1)..(6797): unsure at all n locations
aacaatttgttcaatccagttacaccatgtttgcgagaatcctttcatcctcaaggtttgttgtaaaaaaagtccagtctactttatcatatgctttctcaaagtccaattttagaatgactccactcctcttttttctatgcatctcatggatgtttcatgtaaaattactaccccttccattatatttctccctggaaggaaggccgtctgtgaaggtctaatgactttctgagctactagagctattcgattagtcattacctttgtaaagattttgaagctaacattcaacagacatataggtctgtattgctgaatttgtctagcttccttctgttttggtaacaaagtaatgataccaaaattcaagctgtggagcggcaattttccttcgtgaaattctataaaaatagccatgagatcttctttaattacctcccagaacacttgataaaactctgcagggaaaccatcaggtcccggggctttattgtgttccatttggataatagcttgttttacttcctcttcggtaaatattttagttagcatttcattctctaaatctgatacctgcgcaatgtcctctttctgtgattccaccatggaaaaattattttcctccggtggtccaaaaagattcttgtagtatttagtgatgtacttttttaaattttcatcacctttaattacaccctcctcttgttctaactgaaaaatttagtcttcctatgcttgccatttgcaatcatatgatagtattttgtattccggtccctttcaattaaatgttttgtttttgacctttggtaccatttaatttcctcctcccttaacagatgagctagtctatttttcaagtagttcttgagatctaactcatgcctaatcaatatctgcacctctgcttttttatctaactcatctgcctttgcacttaattcaaccttctcttttctatatgttccacttgtgctttttgcccaacctctcaagaactgtcttaatcaacggatcttattttgccatctttccatcatcgtagaacccttgttttcttttctccaaacttccgttactaactcatgaaagccttcccttaacaaccatccaagctcaaacctgaacaaaggttgtttggtagcacgagttttggctcccgtatcaagtagcaaaggtgtatgatctgaaaggtctctattcagagccctaactgtagctagcgggtacttttcttcccaatcggtactcaaaagcaccctatccaatttttcaaaagttggtacttgcaaagagttagcccaagtgaattttcgtcctgatagctctagctctctcaagtctaggctgtctataacagcattaaacaagaaaggccatttgtcattgtacctatcgttattcttctcactagggcttcttataatattgaaatccccccaatcaacatgggcaaagattctttactacaagagtttaccaattcaacaaggaaagcctccttatactcctcatgggcagccccatagactgctacaaggatccattggaagccatctaccttgtttcgcacgtgaaacttgacataaaaatctccttcgtctatgctagacaaattgaacacctccaagtttactcccaggaggatacctcccgatctccctctcggcctagtccaatgccataagaaatctcttcctccgcaaatatttttaaggcaagaattagagaagtcatccttgcctgtctccaaaagagctatgaagtctagcttctactaaactaaacatgacagcccattttagggttctcgttctcatcaacaccccacttcacggcttacctctttctctcagcaaacaaggaactaaataactaaaattccagaacatcgcccaaaacaacagctgcttggtgcaccgcccccaactccgctgcaaacttcctcgagttgccaaacaagccgcaccccgacaacgaacgcttctgcagatcaacggcttagccgtgcacagcctcgagtatatagcacgcgattggttccggcgtgcccacctcattgggatatgaggagtaggggtgggaggcgtggccgcgtggcgtgaggcctcgagggccttcctccaggtcaggctgagcggcggcgtcgcggccgatccgctccgagacgtggagccccgtggaggccacatcggggccaatcgcctcgtcctccgtccaagccatcgccggagcaatgcgccttttggggggaggaggcgcggcatggaaaaccctagagcgcggtgagggggggaagtatgaggaacggcgggatgggaggttcggttggggtttttcaggttttgctgcggcgcgcgctggggaaatttccctttgccggttaaattaccgctagcaccgcggtggaaaaatctccccgcatgaaaactaaaatacacatgactttgctagtttaactaaggatgagtaaaaaatttaaaagacatcatgttttcagatcaaatttatataaagtcaaacatttgatatttaaccatatattatgattttaaagttttataaaacctcactcttattcaatttaagcgtgaatttatttaaaaatatatacatatagaatatatggaatttttaattattaagttaaggttgatacttaattctttcttactattttaaaatattttttatgttatgctgaaatttatcatgatatcaatagagtagagattttatgaaacattgagacacatgtgtcagtgtcacatgtcataataccggtgtttttttttttgcaattttgaccattaaacatgatgttttccagaaattattcttaatttattgaagaagtccaatttacttttcaaactatttcattggatcacttaatcctccgtaaactattcttagcttagtttacccctaaactattaaaaattcgtaaactattcttagcttagtttacccctaaactattaaaaatggttcactctactcataatattttttttctcttttaagttgcattgtaagctgactttttttaaacctcacatggcaccatttttccaaaaaaaaaatcatgattgtttgcttgaagttttttattcatgtttaaatgtcttattgtttccaaactttgtacaattctataaatggtaaaaaaaatgttgagacgtaagttacagtgcctctatcatcctacccaatttccagtgcaaaatatgaataatatagagagagaaatgaaagagagatattgttagagagcaaagaaaaatagttcaagggtaaagtgagacaaaaaaaatagtttaagagttaactgctccaatgaaatagtccaagagagtaaaatatattttcccctggtttatttaacagtagggacggaatcttgtcccgacataaacaaggcgtcattccctggcgaagagtagttaaggcaactcttagtggagaagtaactcgagttggccggtgaccaggcaaggtgcttcattgcctcgtcatcctaatgaagtggtgctagatcattggtcttcatctttacgtcatttttgaaactcatgagcagttatacgctcgagtcaacttgcgtcatcatcggttggtcatcatcggcggcagaaggggcgcgatgctacttcttgtggcaagtttgagcatcctggtaggtgacatcgaagattggccagcgtcggagcgctacacctacttgatggttgggcattgccgatgcaaggtggcagctctgcttccgcttggagtctaggcgaggtcgaagctagatgtctttagcatccgctttgtaggtcatcttgatggcgacaatggaacttgcctttgttgtccatggtgttagcaggaggtcgctgtccatgcgaaccgcctgtctaacccctccccgaagtcgactgcctctacttccatcgttgtcctctagtggaatcaaaatgatcacggagccctcgatgaaatgtgccaacaaggtgttgatgaatttggtaccccacaggccacaggtatcgagcctagtatctacttggtacccacccgacaccgtactattttggatcaagagcatgtacaatagtaatcctctaatcagtgatatatcgtataatataaaagaaatgataagttatactaaccaaatgatgaatttacttttccaagtacatgttgtgttgagaaaaaaaaagcttgacgtggtaaattctttgactatctatatatgtttatggtgttatatttctcattaaaaacagttaatttatggtgttatattttgactaacatatgtccacgtttatatcaagaagttgttttttccttgggacggagggagtacgttgtaacttacaaatcctgcatggcactcctataaatttccaaacttacacgatacttctatagaactctctccgtactcgtaaagaaaatcgttttggacagcgacacaactttaacttcttatttctataaaaatatttattgaaaagtgatatatgtatacttttataaaagtatttttcaagacaaatctattcatataatttttacattttcaaactcaacaatgtgagagttattcatgatttatattcccaaggtttgacttaaacaatatcctaaacgacttcctttacgagtatggagggagtatacatgacatactaccttcatttttcattctcaaaaggatgacgtcctataatacgtgcaagaacattttctagaaaaaaagtattatttactccatgcttaaaaaatacattttctagagaaaacgttcttccaccatattatgtagaccacttacttggaactatgccaagtctatttttcaaaatatattgacgtaagtatattatacaagacaataatccactcaaaaatctgataaaccaaataggccccatgattgagataccacgctctaatatgccatctctctgagtaaaacaaaatggccaatttgttacggtaccatcgcaaaaatcaagttgttggaaaataccatcgtacgtgttgtttgacacgtggatctaggctccacacatcattttcacatatgaaattattttgtaactcatgtatctttgtaatggtattttcaaactatccaaaacaaaacaattaaagtagtgtctctagcgcgcgctctctctctctctctatataggatactcatatgggactccatggtgcccgggctccaaggtataaaacacacaaattctctcaaatttttaaaaattttcaaattgtgacctaggtatatgaatttgattcatacaaatacctaacaacaaaacaactcaaactcaactttatttcacaattcattattacatacctaacgaattatatgtttggatgttatatacctagaatcaaaatctaaaaaaaaagttcaaactcagttcaaacttgtttgaacttgttagtaaagaagttaatgttcatatctaaacatttaaaaaaatttcatactcattcaaattaggtatatacttaatttgaatcttgaagcccatactccatgtagcactagttaatttacccctatatatatatacacacacatatacatacacacacatttctacttatgtcgaccatcgagtgataataacgtcagtaatttagtttacttataaaaatactttagctcagtgaaactaccaaatatcagtatcaccacttaaaattactcagcatatatcacccttcatcgaaggaccctcgaacagtcagaactcaggacagtcactcacacagtcacactcctaacaacgaggactaccagcctatgacgaacaaactaggaacaaaaaggccggaagataacacgagcagccgggcagtggctccttttccgtggaaagagaaacctggacacgactacagggaccaccccgcctcatatgcacccagtccacgcaccacctttcccgtgtcctttctcacccctcccaccagcgcggtcctcctggaccgagctcacgcacccgtgcccctcctggctcaatccattagctgtagcacgacgctcagtccaccgcgccaaacctgcctagaccgagcctcctgcaccgcactctccgcanacnnncgcgttccccacccgccagcctcaccgcccctggacccgcacccacgggtaaacacgcgccgttaatggccgccgcaacggtaaacgttaccccgtgtgggaaggggaagagagcagccgcgcccggatccccacctcctcctccccctcctcctccagatcacaccaccgtcgtctccaacctcctatccattgagataggcttcgtcagggtgccccgcgagcgagcggaggtgggcttaggtctttagggtttggcggggcgctccccctcgtggtctctcgtcgtcgccttcgcctgttcggggggctagggntgcgtcgccggtggggggngggggtgcgggtgcggggggcgggcggtcgatgcggcgatcgcgggcgatcgggagggtgtagcggcggcaggggaggggggatctccttggcggtttgttcggagatggccgccgacgcgctctccatcatcccgggcgccgtgctgcgcaacctctccgacaagctctacgagaagcggaagaacgccgcgctcgaggtgagggatttcggctcgtcatagggggtctggttttggaacaatcgacgatggatttgagctggaattgtttttgttcgtggtgggctgtttgtgtatagattgaggggatcgtacagggctgcaggaatt

SEQ ID NO: 65956 - DNA, 3711 bp, Oryza sativa
ctttctgagtttctgcaggaaattaaaaattcaccagtaagtccatcctcattgaaattgcttgtctatctgtatcagtcactgaacagtgagatgcaatgcaacatatgtatcttgcccgatgaatatccctttaataactttgtcttcatttataccacaaaattacatttttcattttttgggtatgcttccaatgctgatttgcaaccttaaatgaaaagaatgtagattatggtcgtatggctgaaatacttgttcggagagctggttcttctgatgaattcactcggttgacgtctatcacatgggtatttcttttgtcttctatgttttcttttgttaattttgatatcgaaatctaaaatatttagtctactttgatacacctgagtaatattttgtcacattctgcagattaacgagtttgtcaagcttggtggggaacaacttgttccttactatgcagatattttgggagccatcttgccctgtatttctgatcaagaggagaagatcagagtggtaattccctctcttctttggacacagacaattcttgaagatgtagcctgcttgtctgtcggaagtcatttctttaatctttatttactttttgttggctaggttgcgcgtgaaactaatgaggaactttgtgctataaaagctgatccaactgaaggatttgatattggagccattctctcaattgcaaagaggttctctactaaaccacttgcataggaaatttggtttcatgccgatgtatctatattcatggatcaagagttaaaaatatgtgcagtcacttgtaacatggcatttgtgaaataacaccgagcctttttcaatttcaatttcagggaattgaatagtgaacacgaggctacccggattgagtcattgcattggttttccactctcttagttcgatatcgtgctgaggtgctcaactatgatgctttttggggctacacaacatatattttaacaagctgtacctgcataatttgttcacatttaattttttatggactgtgggaggtttttcttcagacccttaggatttagctcaatttaaactctctcctgaaagtcccaaaggaatccccctctaacatggacatgtggtacacacagttcaaattcattattggatggtttatgttaatatttttttcttgtgtaacagttcttggcatacttgaatgacatcttcgatccactcctaaatgcactctctgatccttcagatgcggtgagctctcttacaaagcctttgaaactgcaccttttcattacaactttctgtgagcagctgattaattgctttatttgttatacaaatgatctgtgaccaagtcttgaaataaaatcaatgaaggtttaacttagtgagaacagtgtgtgctaatttattttttgacttggtgcaaatttagtgcatcgtgggcctattctttcttccatggataatataccaaggggttacttcatcccttcaaatgtttttttataagtaaccctcatggccctatatcagccatctgagtgtttggctttccaaaacatatacaattacacagacatgattgcgcttgcagtatagaaaccataatgggatgcttttcagtgttggcgttggcaatgattgaatccattttcgcttgctgttggcaaggatagatttgctgttgtttcccttccaaaaagaaaaacacctgctgttcttgccattggatttgtaatatcctttgttcataaatcttaataaagtctacttctccattgtcacctgggcttgacacaattatatgatagctataaataaccttcacatccccccaaccaccactgccaccaaaaaggaaaaatcatgctaaccctttgcatcatagttcaataaatgactgatgggctgatggctttatagggttattgaccattaatattttgctaattcaataaatttgttgtaccgtatcagagagcttggctattgtcatcacattttttcatgtgcaggttgttctattagtgttggaagttcatgcgcgcatagctgaagagtctcatcactttcatcatcttgtatcctacttaatccacacttttcacaacaatcatgttctactggagaagtatgcacatttccccactcaaaagttgattacatagtatatgtttctttgttattagtcctacttttagggttacacagttcactattacataaattgcttaccaaacaatggtttatgacatacttatacagacgtggcgcattgatagttcgtcgactttgtattcttttgggtgctgaaaaagtttatcgagagttctctactattcttgagaccgaaggtgaccttgaatttgcatccaccatggttcaggtatcccccactgttgcaacactatactactgcctaatttaactgtagacattccgtaactgttaaatttcttgtaggccttgaatttaattttgctcacatcaaccgaacttgctgagctgcgttctcttcttaagaaaacattggttgattcttgtggcaaggacttatttcaatctttatacgcttcttggtgtcactctccgatggctacaataagcttgtgtctacttgcgcaggtaatgaccaacttctaacttttgcagtttgtgtttcttacttgggcactgatctttggatgttcttttccaacatgtgtaggcatacaatcatgcaatttctgttatccagtctttgggagaggaagatataaatgtgaagtttctcgtgcaactagacaaattaatccgtcttttagagactcctgtatttgcttacttacgtttgcaggtagagctccattttccaataatacctcatctttgtttcattcggttgatatgaaactacttcctccgtcccagaatataagaagttttagagttggacacggttattaagaaagtaggtagaagtgagtggtggagggttgtgattggatgagtagtggaggtaggtgggaaaagtgaatggtggagggttgtgattggttggaaagagtgttggagaagttgttatattttgggacaaatcctgagggctaaaagttgttatattttgggacggagggagtagttgttttttggtttgcattttatttaaactttttgatatctcctaatgcttccacattcagtacaaatgctgtaaagcccatatgtatgtgttattcagtttatgtgatgtgtcacactgacactgtgtcagtagtagtttatgaatctttggtgacatgggcactgttcttgttatcttacttgtggtataggcgtatagcagtatggagaattgaatgttctgatgatactattctatgatatggtactccaatgatttgtttaataaaatttgcagcttcttgagcctggaaaacatacctggcttctcaaaacactttatggtctcctgatgctactgcctcaggtatgtttgatatctcattttttgtgaccctacggtcttgctttgatagtttcatgcatattctgtttccaaactgagaagcggaacacttgatacacatagagaaggaaattctcgtgtgttagattgttaggttggatgcaggaatatgcttaagttatgcctaacatggactagttagaactgttttagcttacttaaagtaagcaaagtatctggttgatgtggcaat

SEQ ID NO: 65957 - DNA, 1823 bp, Oryza sativa
cagttgctgatcaataaaagctgatgctgaagccgtctgcttgacattcgctgttgtcgataactctctgccgcttctccttcctcaacctatttcattctgttgttgctacttttgctgctcctccctgcagttgcaaatagcttctctgggaagcttgctgaggccatctccacctcctattgatgtggcatggtcacggtctggttggccaacaggataaagctgatagggagatgtcgaggtggccgatgatgtggggagaagcctgtgagaaacaaacggcatggggacagagagaggtggccagctatttatagtgataggctgagctgggctaccccacctgatcacctcttctcttccagagggcaaaaaccattgtacaaagcatggtgagagactgagcttgcttggcccacctggctatgtccattcttcgctgccgtccttttgttcgccaatcaccagcaccacctctgttctctgcagcatgcatggcgctctgttgctaacataaccattacctttcccttttcccctccgttattctagcatcatgcttttcggcctgcatatgctgttcgaagtgaggagcccaactacgctagtatgcgttggttcacatgtccattgatgattttggtgagacaatccatttcctcatttccccacataagtaaacttgcggtttcaagttctgaggtattgattatcaattcatcgtctcattcttcaagccaaacatgacattttcaccagattctgtaggaaaggttgagcttttgtaaaccttatgtgtccctcatgttatttacagactacgggaagttttcaatagtcatttttctaagtagttctagaattgaatgactaagctttatgtgtttgtgcagcaaagtgcagccttcaagatcttgagaactcggctgaagactgtgcctttcagtgaaaatttgaaacgcacatcttcaacaaatccatactctcagattctacaagtgacagaagatggtaatcgaaatcacgacactcagagctacaatgcaatcaatttcccatcccggctccaccagtttgagagcatgcagcagcagcacagagttcatctaaagaatcaactgcaatcccaaaaatctgcttcagctatagtattatcacaggtaatgtttctcttgcattaagccattaacatatatctgattatattgtatacctatacgtagttgcttcccccattaaagtgtaactaggtttttagttgcgtactgaaaatggttccttagcttacctatgcaactaagatctgtgttttcttggtgttgaacacttcttcttcttcttcttctttttttttttttggggggggggggatgggggggggtggtctttaatcctttcatctacaattggttgtgagagtttcttcgtgttaagttgtaaatccttctctttgcagatatattaaatatctgatgtctcccgtatcaactgtaggtctacctgaatcatcatcgcatcataatttaatcttgtaacacatttgttagtccctttgatttgctactaaaatgttatttcccagaaacctgactgttttcagaaatctgccaactgcaactaggaaaagttgctcttgaatggcttctttgattgtgtaccatagtttctcactgcaaaccttcataacttagtcaaacaaaggttgccactaagatgcttattctttgataggaaaaccgctatgtaacttttgtgaattgcatgcaggaaattcaaagatacgaagaagcacattcctcctcgacagggctgcaggaatt

SEQ ID NO: 65958 - DNA, 1535 bp, Oryza sativa
tttcttttagctgtttcactgctcatgtggtttctgtaatttttcaattgaaggccaatgagcaaaatagtatttggagatatgtcacgactgttctgcttatcaatctccaataaattagtgatgcaatgtaaatttttgttcctagctcttgtgatccacgccatctgtaattttctaccacatgataatcgtgaacttttaaaattggtaatttacttcttaatttttagcaaattcatgtcgttgctttaaggacgaattcttgaaattcttcaggttatttttgacattttcttacagtagatatatcatttttcactgtggcgtgtgattttttttaccagatggcgtgtaattttcattcttcattcgtagattattgagctgttacttctaataagtaggagatttctgtaacaaaatgccatgaatacgggatgcctaatctgtgtagagttcatcgaatactttggtcattgcaaccttcatgtttcgtttgttgcgattggctgttgtgacaggcatttagtgccgtggtttatttttatttttatttttatttttttttcagttcagttccagcatagcattcatgctatagggctgagcggatcacagtcgtatcactgaccggtgattgcgctccagtgatgcatagtaagagcttgatccgttggtctaattagtcaatgccaaaaatcaaaaattgaattttcatatttaattttaaagttaattttaagaaatttttggcacagttttttatattgacttttaagtcactaagaacatttctataaaaagtttatctataaattaattcttgttctttaacaagctgtttttatctataaaagtacgaattaccctctgaactatcgtggtggtccgaattaccccccgaaccacaaaaccagacatattagacctcaaactattgaaactggataaattacccccctcactcaatatgaagtggtattgatcctacgtggcatatacatggcgttgaggtggaaatccgatcaacattttcttttttaaaaatggtgggggccacctgtaagacctcatcttcccatcttcctccctctctctctcatcatcttccacgcggtcttggttcccgacggcgtgcggccacggctgcgcggattagacgacccccggcgtgcccaccgccttccaggaccccgacggcgtggtccagctcggtcgcccgccccgcacctcccgctcctgccgcgggcagaagtagaaccacggctccccctcctcgccgctgctgcccagcatctcgtggtgaatctctgcaggtgtatacaggtgacgcggcgctcgcgcgacgacgtacgacgaacgcaatgcacacgtgtgtgctggtacctgagagctgcaacgggtcgacggagtatatgtcgaagacggggatgacgcactcgatgtcgtcgtggaggccgtcagcttgttgcggaggtagaagcatatcagctcctcctctgttgggtagaagcggaacccgagagccagcc

SEQ ID NO: 65959 - DNA, 1768 bp, Oryza sativa
gtccgcggcttgcgtagttgacagtgagaggagagagagagagaggagaagagtaagagagagaagagagagaggaatagtggaatatgagtatgacaggtgggtcctacatttttttaataaataaaatgctgactggactgccacgcgtatgccatgtagaccaaaaccatcgtggattgggtcgaggggggtaattcgtccggtttgcatagttggggggtgaagaatgtccggttttatggttcagaggggtaatttggacgaccgccatagttcgtgggggtaatttgtactttttttcctattagtaaacgtgggtaaccgaggaggtgtaaggctccaaatggtctgtttctgtacttgtttttgctacattcgcttcctgcacattaccagatcgatttattattcatttatgtgcttgcgattctcctcccatcttttcctcatgcagctcaccaagcatccttgtacaatgtccgatggtcccacgattcacagggaatatatccacggtacaaattctggtctcaatttgccaaaaagctctactagaccgagcatggctggtcctagttcatccatggggcacacttctatccaatcttgttggacaaccatgtgcatcgtcaatctggtggttgtaatccattctttcctcttagccatcctctgtttttacccctcctctcctttcatcctgtgcctgttctccgcacatcttgcgccctgctgcccccttttctgcagggtgaaatacacacgagcggatgactgtccaatggcaaaagccatctcgattagcagatcgatcgaacatggataatgcatcgcctggacgcagccaactgccgtccatttttcttttgtttcctgcctccagttccagatctgattggcgctcggcaccatgtttcagtcctcacctgacctgctgatggtttctggagtggttttcctgtttgatccactcggatctcagcgcccggttgggcttttgtcagtttttcaacatgttacccctagaggctgtgactgtatattagtttatacttagttcttcatgacaattttctttaactaaaacaattaccaaatgataattcaatatgaattactctccccagtatgaccaatcctagctgtggtgttcttatatgttgggacatctgtggcaccccattacaatagcacgggtcgcacgaagaatacaaattcgttcctgcatcagttaatttctttttagatggtagcataagttgtctatgacactactgttcgtatcacatgaattgggattagaagtgttggagaaaaacagtgcatgtggaattgtagttaattgacaaggtttttgatggggataggttggacaaaatgaggagtatcttggttgacctttcttcataaaaataatacttgccatctagtaaactaaaactgttgggaagtagattccttggccaattgagacaagccagtggtgcttggaagatgcaagattctgcacagaaaaatgggttgcaaacaacaatttgagttctttgattcaaacaaatagacataaactagctaatttgttctttgggtccccacaaaaaaaaattatttgggacaacaatgttactcttgccaccttggcaactggcatgacttctgtgagcctaaagggtcatcaatctggagatctcatgcccgaccctaacaactgattgccctcatatgaacatatgaatgattgtaggcttgttgcataatatatcaa

SEQ ID NO: 65960 - DNA, 3298 bp, Oryza sativa
tcctgcagcccctgatacctagtagaaatcacctgatatttgataggtatcgcatgatacctcataagtatcatttgatacctcgcaagtatcacattctagtggtaagaatcgtatgatacctgacaggtatcatctaatacttcgcaagtatcacatgatacatgataggaatcgcatgataccttataagtatcacatgataccgagtaagtattaagacatgatatgtcagaggtatcaggatctaatacctaaccggtatcatcccgttccaacgggtttccgttgtatagcagtcggggaatgctacgtagtactactactccactatcttaccacaacaacttctggactctgaacagtttgcgcggccaaaaaaagaagttctaaacagttccggtgacacaaacatgttcacgtatttgaagcgtcgatgagagctcgccgattcatgtttgttagctcctttttaaaatctctttcttcctttttaaatttttttaactataattactattaagtatggtcaatattttaaatttcaaaaatagactttttttaaagttggtttcaaatggctaaaaagattcagatttgaaaataattttttgagagagtttatttttaaaattaaaaagattcagatttgaaaatatttttttgtgagagttatttttttaattaaaaactaaaaagggtaaaacaaaataaaacttctcgtcaaggctcaagccccctgttccaacttccgccggaatcaaatccatccgaacgcgcgtccgcgacggcacatctcagggtccgccccaccggccgcaccagcaattctgcaaccgacccgaccgaatccatcctccccgccagccatggctcccctgccaccgccgcgtccgcctcaccggagccaccggcgagtccccgccgcctgctgcctcttcctactcctcctcgctctcgttctcctcccctccgccgccgccaagtcatcccgccgccccatcaccgtacgtctccctacctaatccctgcctttccttggcggcccctgtccgtctcaccgttcttgtgctgcgaatcccgtggtccaggacaacgagatccgggagaagaagagcgcctgctacaccgacgtcgagaagtacgtgcgccggaattacgcttccccccgtctgtgttcggtgggggtggttttgatggggaagtttctaattgtttctctctctctctctctctctctctcggtgggacagtggattgtggggatgggcgtgcaagtcctcggcgacggagaaggagaactgcgtgctgcggtgcctctcgccggagtgctacgatctcatatacggcggcgacccggtgagtggcggcgtgagagtgagatgtgatgtttcagaggagttttttttctaaaaaaaaaatcaggattcctttgaattttattttgggtgttttgtgttgtggcagcttgaggaaggggagctggactacatccgtggccacgagtacaagtactgcatgcacaagtaagaaacagagatatatttgcaatctgttgttaagtttaggtttttggatgttgaattgggtctaccctgagtccaacttccatgggtttgccgagttagcacatgtgggttactgtagcacttatagctaatcatggactaattagactcaaaagattcgtctcgctatttcccccctaactgtgcaactagtttttttaatctatatttaatgctccatgcatgtgtccaaagattcgatgtgatgtttttgggaaaaaaaatgggaactaaactaggcctgaatatgattgaacgaacacacccatctgctcaaccttgttacaacatgctttctgtgagctataggagaaggggtcaatagttactgaataactgaatatagcaatcacagcaacattctaacaatactacttctaacaaacaaaatgattatgtttgttctacccaagtgttccccgacatattcctcaacctccacaaactccaatagagcaaaggttatgttctccacccagttatcgcttggattatgcagtctagatattgagggccaaccaccaattttggcacatccaaatgttcgatagtctgactgatcatccaccattatattttcagtccattggaacttttttttttgttatcatatactgtcatttatcagttccaccttgttactgaagagggagaatttcactttagtttgcacgtgtaaaacgaatgatatgcttcagtcctcccatgattgattagcttgctaaacataaccaaaatagcctgactaggaagagcattttgttgttttccttttctgattcagatatttctacttgaaagatcataaaacattgaattatcagcaaatgtcctgagaaaataaatctgctactccagatattattgcagttaacgttccaagagtaattgactcaaatttagatactgctattgtgccacattttgatcactgtgaatctgcaatcctgttttatgaaatttacttacgactagctgaagtgttatcttcaggtaaataaaaatacagaatacttaactaaaggaaaatcaagctgttggtgttattacaagaataattctctaatatgaggatgttttgcaaaagacattgacattagatttcatgcatttctgttatgtatatacacgctccaattttgaattgcacttagaaaattatacatctaaattggaatttgtatcaccattgcatgattactgttagacctctacccatcaagttattctgctgtttttctccttaaccgtgatgtctttcgtacaacttgtccaggtcttcccttggtgaaagcttggatggtgtcaagggttccttcagctattcatgaagtgcaaggaagtaggaagagtgttctccgagccccatgaattataatacatctgaacctacggtgtgtctttctgttccactagtcaaacaagcatacatgtatgaattctgttagtcattgtctcgttgaatccaacatatatcttcgctattcaactggactaataataaggcgagcttaagcaatattttgagcataataaattcagatttttttcacatatgagacaaatcagtttgcaacaatgttgcaaggtcttctattgcatatactaaagttttgcactactcatatcagcacaactaaccatcgctgcaatattgatacaaaaatataatcagcaacttagctcaaattatgttgattttaatgtgctctcagattaggctgcaggaa

SEQ ID NO: 65961 - DNA, 3537 bp, Oryza sativa
ctccgacttgttggagaaacgaacaagacctaaggccatgtttagaagtttttgcatgtcacgatcgaatatacggacatacatttgaagtattaaacgtaatctaataataaaacaagttacagattccgtttgtaaactactagaggaattcattaagcctaattaattcatcattagcaaacatttactgtagcaccacattgtcaaatcatggcgcaattaggcttaaaagattcgtctcgcaatttgcacgcaatctgtttaattagttttttttattaatattccatgcatatgtccaaacgttcgatgtgacggggtgaaaagtttttatttgggaactaaatagggcctaagagcgagtacaatagcaggctacaagtcagctataagcacatgtaaaagagagaggagagaagagagaagaaaatcgggctataaatttatatccagctgcaatacgaattccaaaatgttatatgtgtataagaggtggaccatatgttaatgatgtagtatatgtttataagtaattattgtatgaatgagttattagattgactataaatgatttggagccagtagttattaaacttgctctaactgatctaaccataccaaacaaataagagtagatatcacgaaaccccatattttagaacacatctatcacagatccatgtgataaaaacatttatcccaaaaccctgctcttttggagcatgtttgtatcatctcacccatgttcacatttctctcctcccatttgacctttcaactcatgtttggcgttttcagaaggactttcaaccgtttccacaatgataacggtattctctccggtccggtgcgcttcaccgttgaactggcttaggttgacatgaatgtttgtgttgtcgagataggccacttgcctctacattgaggtgcaatggcttgtttgttgtcgacagtagatagagcggaggtgggccaagttcgcaccaataattcacgcttagcaaacaggatcaaggaatcgcatgaatatggacggagacaatgaagggaaggagaggagcaaaatatgaatgatatgatacaacataccacatagagtagggttttgtaataaaaaatgcctagcttgtggcgaggagatgatacctcatttggtttattgctaaaattttggtaaccgaaaaccagcaacacacacatttcaagagatttgccaacaaaccaaatgagcaactttattaattttctcacaaatgactaaactttgtcagtgccaaaattttgatatggttaagtttagcaaacatccgaacacaatcaacatcactgcatatagtgtttcgcacgtcaacatgcatttctaaaatatgcacttctaagttgtttaaaaaagattgatggcttgtttgtattgaggtcaacttgtcggtaccaattatttggtaacttcaattgtataacatagaacccaccattctataaggaactacttcgtaggtgtgaatttggatatagttatgtcttagttcgtactagtcgggaattgtttttttcttgagacggtgcaagtaaatatttgctttgttattagtagaacaatagttcctagccataaatatttatagcatatgttttaatttgtagcagagaccagacgacgtacctcatgtttgatcaagacataacctcgaaataacctcgaaccttgaacgagcatatccaaggtagagactgatgcatctcgagtttccaaacaggtaatccgaatgagttccaagcaagtctataaacaagatccaatactccagagcaaccgtggtgctacagcaacatcagcaatcttttgccaccggatcaacagcttatatcgccagcagatgctgttcaggggactactgtagcggatcccggtatgggtactgtagcatacgaagtgggacagtgctgcagacctgcagtgtcaattttggccattggctccattgatctgatggtgataataggttgcaacttctgatgttgtagtcgctatctacaaaaattatatatagctagaactaagagctaaatatacattaagccataccactcatacaaagtaagagccattagataattcacatacttaatcgtaaccatccaatacatattaactatatgtagctactatctatatttaatttccagataactcaacattcattatcctattgtagtcatcagtttccacaacaacgcgcgcagtgtcatgtattcgaacatgatctgcccaagtgtgcaaaaaggccgtcaattaacacgactcggacctactcgagcatcccaaggcccatagaactgttgggtaaaggccgagatccgccatcgaaaccgagcagattttcaatgatacatgggccagatcgctacattttggacgttcgcgctctgggccaaaattgcgagctcgcccgagaacctgatcggcattagcctcactttctcaccgtgaaccatccccaaacccacgttctcaccggcgatcaaatccgccgtcatctcgcctaaatctcaccttaatcctccgtacccccgcttcctcccgctcaaaccctaatgcggtgatggccaaggacaaggaggtcggcccgcctcctcccccctgcgtcgactccgaccacgaggacctcccgctcgccgagcgacggcggcggctgctccgcccgccggcggagtcaaagcctcccgctccggagaggtgccgcgcctcccttttctccttgttctgtcctgcagatgtttcttttttggagtcctcatctttgtgttgttccggcgcaggcgggaggctagcgccgcggcggcggcggcggaggattccggcggagcggcgcagcaggtgggtttcttttgatttttgcgtgtggttattagacggttagacggtgtaaagttgtaaatcttttcctgctcttgtcgtccggcattcgaatgaaaaccgcatttcttgtgttaccgttcttttgcttttgtggacgtgcggttttggtcagagctgaacatgacggaatatacctttatgagaaataattgaacagctattgtaaatttgtaatcagtcatcaccgctcctcaatttttctcaccctccaccattgttgaacattacttttatctacatctaatagcagctacaaaggacatttctttttcctttgaaacgagtaaaattaattctttaggagggagtcttatgtggattgccatcttgctggtatcaactgtttctgttaatgtttgtatggaaacctcttccatgtgtttcttttaaaactgcgctcctaaaaaatctccaaatgcgccaagagcaattccaagatcttccgtacaaatgcttgcatcatgttaaattgcttctttacttaaatgttgtgcttattgtattgctgcagggttggccaggtcttcccagaggtgtagagtttaatcctaccgatagcgatctactctggcatctggctgcagaagttggaaatggtcaggctcgtcgtcatc

SEQ ID NO: 65962 - DNA, 1138 bp, Oryza sativa
tagtttacttgaacatggatgctatcctactagttaagtaaaaactgcttttgcaattaatgttaccttgactctactcagagtaggtactgtgattctggtatgcttgatcacaaggattcttttagttttgcgtcatttacctgttctttggtatcaatctgtttcttgtttccttagttgaatatattcggctgtagctgttttgcatttctttatcttatttattgcttaatttttaagtctagtcttgtactcattgtaaagttttcattcattgtagttgatttctgctaactttctgaagttaacaggcactcaatttcctggggctttataacaattaattttaagtaacacatgctagatgtttgtttctgaaattctatgcagggtgcttctgcaatcgatgatgattccaaagaggaattacagttggacaatcattcttttaatatgattactgaaaatagttctgttcaaggttcgtgtcctcattcacatccatttattttaaatgcattttttgtaacatagaccatgacactgaattctcttcaggcaatgaaaacaagcaaaagcagacgcaaacagggacatgtcctaatctggacaaactaagtatttcaatgtggtaagcaacatgcatattgggaaccaaattaatgatcatgatgaaatcgaggagcttgatcatatgtctctgcaagagcgctacagaattcttatggcagaaaatcattcttcctctgctgtagtatcttctgaacaatgtgcaattgatggtttggagaattcatgcaagcctggaactaatgggatgattcctaaaaggtgagggggtgagaaaatgtatacatttaatgtaggtagctataatttctgagaaaaaaaaatccctgtacacccgtccttatggtacatccactttcctgtgtactaagttcttaataatcctacctaaatatggagatatagagaaggatgctctatagtaaaactttaaagtcaaagttgattgcattcgcaagagaaaaaaaaagtaacatatctccaattattttgggaattgatgtgaacattgacaagtgtaattcaagaaagatgctctatataaggtttgtactgatatgaagtt

SEQ ID NO: 65963 - DNA, 10667 bp, Oryza sativa
  unsure (1)..(10667): unsure at all n locations
gtttcttgagtacatcatcttcggctggtccaccacaatgtcaagttgtgtgctctcatgatctattggtaaacggcaagactcttatttatagtcgcgacccttcttcaagttcaacaccaacttttggggataaaaacattcagttggaagggacagatgataggacccttttggttgacataaaattggaacctgcattggaaggttatgatatttaccatctgaattttgtttgagcaaaatctcaccactattccttaaacaacagtggtctggaagattgatttagcaccagcatatgtttgtcaaaacccaaaagacatcaatattgattttgaactcttgcatgtcacaggggatttcacagagaaaattacatcttctgtacagagaacagatccaaatcatggcactgagggctctaatctagttgggtctataaactctgtttcttcagcgatctccaaaagaatatcagaagcagcaagatctaacccagagaattctcatgttgaaggcctactgccatcatcacgaataaaaagcgaagttaccgggagtgagttacctctagttgtgtgtggtctcacttctatcagtatcgcagagctcactgccaaaaaaaccaatactctaaaccatgacggggtccttgcttactgttctcgaaaaaggaaaaggaggaagactctgaggtatgctgcacaggcaacatttttaatgttcacactgattctctttttggctagattatgcttataaaaatcatgtatgcagggatccaagtgaaaagacgcttgaagaagattccctcagaaatgatgagggtactgcttacttttctcgtcaaaggcgaaggagaaaaacagcaacgtatgctacatgagtaacttctgtcaatgttgacaactatttttgagaatctgataacaaacgtgatgtacgcagggattcaattgaaacggcacttgaagaagatgccccaggactactgcaggtacccatttgtcgtgttcatagttctattttaattcaataacggtattcagtaagcattcattccaacttctgattctgtgtttccgtatctttcgtgcctgcagattcttctggacaaaggaatactggttaaagagattaaactctacggtgttgaagaagaagatgatatggtcccagactgcacagaaagtgactttcaagatcttgaaaatgttattacaaaagtaagattttaaaatggtacttagtcttataagaatgggtatttttgtctttgagaaagaaaatacattgtacagtatatcattgaaatatctcaacaaccccaccacttgacatgttgaaaatggtttgttgagaatctgcataacatctgatatgcctcacttgcttacctttttcggatggtatcataccactcccgctatttttagcgggtagaggttattctactagcctgggtcaagcctttcctctgcagggcccttgtgatccttgtgcagtaaacccctacgggtggttccccattgtcatgatgtagcgaacaccactgcaaaactttcacaaagacaccttaagtgctccagcttcatatgtgacaagcaacgccgaagaaaaggaaaaggataatgtatcatcttttcagaagcattccactgccactgggaccatgttgtattagtggactcgttcttgcttctccttgttactgttcctaactctccgagtagttagaatgttgaattttccatactcagcaacaacagaagaggaaacatttgcatgtttgttagttaccttgcgttttccttccccttcccaactgaaaaatataatcaccctcccccccagcaatacagcagctatgatttggtttacatgatttcatttgttggtcatgtcaccaggaagttcagtgtgaattgtgttatgtctgtaaatacagatgacttagaggttattggcctaatttccccaaggttgagggactacatctgcatctttagtattatgggctaattgtgaagagcaaatggcatggggtggttatgtatgttatagtttactgacatgttttatttgttcaatacacagttgtttccgcaaagaacatccctgttgaaatctgcacttaggcatgagaagggggaaaaggctatatactgcttgacctgtttaatttctctcatcgagcaggtatttatccacatctagacaacatttgctatttttattttctcacttgtacgaggctttcaattttagtgttttatacacctttatctcttgtagtcccgctatcttcagtttcgtgattgtcctgttgaatggggatggtgtagagacctgcaatcatttatttttatttttaaaagccataacaggtaatctttcttagccaatactattattcaggtactgccggttaaaatggttgatatgcttctttcctttatgccttcctttttttgtttcacaggattgttcttgagcgaccggaatatgggtatgcgacatacttctttgagattgtgaaatcactgccaatacaatggcagatccaaaggatggttactgcaatgaagcttagtggttgtggcaggacagctctgattgaaaataggccattattggtaagatttcttgctttggtatttttttcccctgcattttcccagtgttgtgctgcactttttgactgtcaacgtacgtagaaatgtggtcaaagtaaaaggccctattatcgacttatgatcagaggaggaaaaaaaatcagctctattgatgctggttactggtatatcgtctgtgaccaatagatatgataaagccagtacaagggtaaaattatacgaagtttgatgtgttgtatgtaatcttgaagctggtgattgtaaaaggttacatttgaggaaaaatatattgtaagattttttttttaaaaggtaaactggaatagacttgaaacattacagtaactggtcagtttacctgttaccagcatagcttttcataatgtcttctatccttgcttatgaacacaagtacacaactacccattaaccattaataaactgtgttatagcctttcttagtttcttttccagttgacaattgtttctaggatcctctatcagaatacgcagttactagttttgaagctggatacaatcatacattcatgcactcgactctttttctatatttctttctgatgtaactaagtttgtgatatcgttcataatatacctccgaagaatatatttctcgttttagaaaattttagcaccagatatatgttcacataggacattagcttcaacggtccaatctcatatgtaccttccgtagtgaaaggagtttataattttgtgctacctcagtaccttttactcatgagttctttcatgagtaaaaggagtttgtaggacattgaactaatctattttttacagattggtgaagatttgacggaaggagaggcgcgggttttggaagaatatggttgggtaccaaattctgggcttggcacaatgctcaattaccgtgaccgggtagttcatgacaggtggaacgagagatctggcacagattggaagacaaagataggaaagctcctgatgaatgggtattccgaggggcatttggtcctatctcactttccaactaaagttgggaaaatagaagatgacaccgaaatcaaacaggaggatcctctctgagttatcccctgtcttgtatatgcgcttggtaatcctgcaaagttataacctttagcagtaaaatggctaatgccaccccccttcttcatgtgggcttgtagagttgttgtagtcatcattataattcagaaggcttacaaagaatgaacacaggggtgccatgtgtagcctatctgcacctgtacgtaggaaatcatggtggggtaacactgtaataagtgttgtggatggatagacaggtgaactagcatttttttttgctagctgttgataaacattagatcatctggcaaatggtgggtattcatatatggattcaccagttgagtcatccaaatgcttgattgttggccggatcactgcagatctaacatcagataaagcagtcattttgaaggtgtcatcaattcaggttctgttcacttggaaagttggcaagtcagagcgcatctactagcactaggctgacttggttcatggtccgcattaggtattgaaattgttggcatattgtagtttcatactacatgtcttctctctagactgtagatgttctggattttggaattaagtattgccaatacaacaactattcacaaaacaataggacacgcaacttgttcttttgcattatcagtgcaatttggatatatagataactcataaattcgatacatggctgctactttccttatattacaaggataaagaagataaatcacatccccaggcctctgcaacactctccatgctaatgctcgtataaaattcgatggttgcacatcagcattacaaatcgttagacggtaatttccgctgcaaaatttagcataaactaatactgaatcggtataattctcgctattaattaaaagttgcactaccaagtagtcggtctcaaatctgagttgctgaataggacgtcttgcccttgaggaccttggagacggcccggatcgtcgacggcgtcgtccggcagcatccgccgactaagctcgcgccggcctcctgccacctcttcgcgagcgcgtcgaagctcttgtgcccaaagcactgtgccggctgtgcatgcgacgcatcaaaaaaaccagtcagtttgatgatcaagacgaccaagaattcgcacggaaatgtgctaatctttcttggcgtgccagtgatgagaacagatctgtgctaatctttcttggcgtgccagtgatgagaacagattaagtgtaacaggtcgtgctcaccagccatctcttcgctctgccgtcccaaatctcgccgctgttcgggtacaccgcgatcgccttcttggtttgctgtcagaaacacattcagagtttcagacgattgcagaaccggtgcagaaagaaaatgttggggtgtgtgcaagatggagtcgatggtgctgaaggaagttggtgcaaaccttcttgagctcgcgtatgatgccctcgatgaactgaggcggcgtgcagttgacacccacgatggtcaccttgtcgctggcgttgaggaattggaggcactctgcaaagctctctcctgagcacaggttcttgccgtccactgagctgaagcagatccaggaggggacctggatgttctcttcctccagaagctcaactaaagcctgcatgcatgatcaccaatttcagcaagaaacatcaaaggtggcagcatttcagtgctattgaatgtctggaacacattgcacaatctgtgtttttctttcagagattcagattcactagcctcacctgtgcctccattttgttcgggatggcctcaaacgcgatcaagtcagggccagcgctcgcaagaacctgcagccggcgcctgtggaagtccttcagtttctctgccgtgatgtcttctccatacgatccactgtcagatacaatgttgcatcaatgacacaagcaaaatattatatacgaggttaaggttacaatgcgtgccgatccatggctaatccatggctttgcagtgctgaatcttagaagttacctgtactctgagccatcggcaaggtaagctccatagctcccaatggatgcggcgaccagagcacggttgtaaacaggcttggacttcctcagcgtcgacttccagaattcatctcgtgcttccagtgccaattcaatgctccttcgcagtaacccttctgcctcctcaagaagcattcctctggctaagaatcctgggatagttgccttcagagagatacaagaaaggaaggcatcaatttctctgatgctgaaactgaaagattactctttatgtcagctggggaatgaagatcgccagaccgatgatacctggtatgatgaggaaatgatgacatcggcacctgcttcaagatattgcatgtgaacctgcataaagaagttgaaacaattgtgacatttgatctttcgaaaagaatcgtgatattcacgtccgaagtaaatttgacacaattgaatggtcctgcctatcagaagttggtgcaacaaacacaattcaagtgtacacagtacacactagaatagtcatcctgacaatggattaaattgagtcaaacgatggcattacttcagggaaaaggatggatgaaactgaatgctctgagaatgttcgacattcagagaattcagaggtgcttacctaccttttcctctcgcactcaacagagtaggtaatcttttattgtttcttttttttttccaaaaagcaatctagacacatctgaaaaaaaacttggttggtcggtagtaggtccataggtgagaaagggaaaaggtacagtgttcttgtccaggtcaagaccaagacagcaagacttacagtttgtatcacatcttaagatttgtttactttttttttttgtggaggaaaaggaaacgagagttgactgataacacagttaccaaccgaacgttgtattccaagaccaaagggacgaagaacacacatacacctgtggaataatcgcatcgatctctaacgcaacaccaacacggcaacagctaatatatagcttttcacatggtcaaccgaacaacaaacagagacgcagctcagctggcacatacacattccatcgcggcggtgcaacaacgtgagcaatccatggcgccatgacaacgacgagacagcaagatgcatcatgcagcatgtggcgcaagcgtggcatgagctgacgagcactacgcatgcaggcacacgcgcgacggcccggtcggtgaactacggggagagaagaaaagaagattagttacctccttgatgaggtgcggcttggtgatgaggcaggcggcgctccagagcgggtcgttgatgtcggcgccgagcgcctccagctgcgtggcgaatccgccgtcgatcacggcgcacccgccggccctcctgacgatctcctccaccgccacggccatcgctcgatcgatcaatctatcaaccaaccaatcactcctcgcaccaccacccccaacacgcagcagcagcagcagctagccgcgcgcaagtagatcggactaagagatcgatcgatcgacgagctgaggccacgaggggttaacgcgagagacgagcgacgagatggagcagtatatataccggcgagatcgattggagcaaggagaaggtaggtaaaggaagacttaaatttggcggagaagcaataacgcagacataggtggcatgcagcgggcgggtgcggacgtacgcggacttgttcctggggtaggtgcggtcgcaaaccgggttggcgtccagggaggaggacggaacgaaccgtgaattcgaattcactgtgttcgtttccacggttggaccagcgcaactgcgagaagacaacggcatgagtacgcatgggtaagcagagagagatatgaaaaaaaaaagacgtttgatttatccgtacgtgatgcaacaaatactgttgcaggagtatttacagcagcggcagctggttggtttgccttggctgggctgcctgggcaaatggacaaatgactcaatatggacacttctgcttggcttgattcctcaacttttaatatagtaattggagtacattcaaaattgtactccctccgtcccataatataagggattttgagtttttgcttgtaatatttgaccattcgtcttattcaaaaatttttgaaattattaattattttatttgtgacttattttattatctacagtattttaagcacaactttttattttttatatttacaaaaaaaatttgaataagacgagtggtcaaacgttgcaagcaaaaactgaaaatcccttatattgtgggacggagggagtataaactatcctaattgtcacgatcctcgtactttttttcccttcaaaagcccactgtcccaagtcccaacacaacattggggagccgccgccaacgcgcacgattttttctcgacggcggcacaagcgatgcaagtgcaacagtagcatggcctctctcaaacatagcaccagcttaactctatcgtgtacaacgaggacggcggctacatcacatgataccaatgaggccgtcaaccactgccaccacggtggcgaggagccatgagcataaggcggttcgaggtggcctcaggaatcacggcagcgacatgcaaatgcaaacggctccgcatcacgccatcaggccatggtttaaggagaagggaaagatggtggaacattgttcactccatgtggcatcatacattttgactcattttagattgttcactccattggcttgtggcatcatacaaatcgagatggagggagtatttgctaactcgtgtttatactaagtaataccaccatgtttaattccacccacaagatggacacttatcaatataagcatctttgccagcaatttaaaaaatacagcaaatctggacaatcaaattttgaccaagggaaagacaaacggactagcaacagctattttgaccgtcaataattcaataaagcatgcccggcggaaatgttcaactgttcatgtcagcaactaccagttcatccaaaataagcttaccttaattacctaagcaacagcctctgaaaccttcatcgagtgcccatatcagcagcaaatgggtcagccaaaacaaagtttacataaattaacttcgaccaacagccctgaaaccactagcccaggccacagccagtgtaatagcagtaccctggtctccgtagtacatatataaactacctaggaactatcagtagtcttgcgtacgaggactccatcactttgttgctttctgatgaaccctgagttcctctcgacactcaaggctgttgttggctcgatctttcggtgagttgtgataactacgatttgggagaaacgttgacgatccgactacaactgtacgagacgttgtgttgcgccttagcgatcgatacacctctccgtgggttgttgatcttgccggtgcagatcaaccctattcctgcaagcaaatcgaagaaacaagtaagaacaacataaaagcaatctgatattgcaaataggaatttaatacaaataataagttggggttctgaagaacaagaagacggacggtctagccgacacgcgcgctgcaagtaagtagcaatggctaaactttaatctatcaaaacccgagaaaccctgaaagggtacctagctacttataagggtgggagaacgaccaagagggtcctagggttgtgctccacctggttggggcgcacctcacatgggccccacttgggccggggtcccaaacgaagttacaagcccaaaggcccatgacaggtgatgttgcaccttgtttcttcatctgcggttgactgggatggaatttggtgatgaggttggatccgttggaaagaggactccgagagctttccatcaagtactcacgggccgaaaacggagcttgtatggagatttggcggccgtttgaaatcagcagtgtagcaggtggccgaatcggattccagcacttggatgccttgaccttgatatcttcttgttcatccatgatgtgagcaatggttgcatccgtggtagccatggtcacatcactttccttcaagattgaagatctgcaaattacaaacggctgagaatgacaacaagcaatctagatcaagtgtcctttggtaaactaagcaagcactgttttataatttctttatcaaatgatcatgtacaagattgattcctttttccagttaaatgcaacaatcaactagctagattgagaaagccataaggaatatgtggctgagagtgaaatgttgtactctcctgccttttctaccccacaagattaaagatcattctggccaataagagaaattccagaaacaaaaaagtcaaaatttttagaaacatgggaatgacaactcaacttaatacttcctaaagggatagtcatcttcacaaaatatataaaatgtactaatacattatcaaatgaagttatttgcacatcttgcaatattagggcctaaattcatcatctaaattaaagacctaaaagtgcaacaaaaaagaagaatagcagattattgtatcaatctttgtttcataaattaatatttagcaactaaagagaaaacaaagttaaaaatacctgtgcccacatcatcaaacacccaggtacaatctcttgcagagaaaatgtatttgcctggacagcataatgtcattgtcaagttatgtccctcatatagaaacgaacagagggaaatacacatgtaaatatccagacataaaaaaaatcatataacagtatcagaaccaaggcccatatccatatgcatttactataatatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 65964 - DNA, 2552 bp, Oryza sativa
  unsure (1)..(2552): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntagccccaaattttagttggtaaaaagaaacacgaatattagaaaatgacctaatatcaaataataagaaggggtgaggtttcgaacccaggttatctagcctaccatcttgtgaagctagccggagcccgaaaaacctttaggtgtttctcaaattatagttggtactcaactgatttatgcgcccaggtggtcagatgctagccagtcctcaagttttaattgaagtctataacaaatcctaatcctgttatccaaggttcgattaagaagacaccaaagaaagaggcaaacaaattgtggacgagccgacggcggcacatctctgagcttgttcacggcaagggtgtagagattggaggaggccgagcgctgccgaggctgtcggccgggtggcgatggcagtgtctcggaggaggagaggctaggaaacccgctctcgctagtccgggcgccatttctttggcttctcgagggagcatggttgcgcgagacataaggcagcctaatcaacacgttacgtcagctaaaactgtcgtagaaaccattaggacccccaaaaaagaagtaaaaaaaaagtaaattacacccacagtacaacaacttgacatatggatgcgatatagtgcaagaacttgataattgaacgtccgagtgcaacaacttgacaagtggttgcgttctagtacaagaacttgacaatttaatattttggcgaatcaatttggctaagcatatgctaggtaaggtttttcacgatgtcaatatgccaatacacagtaatcctatggatattaccttataatattgagtttaatttttaagaattatattgcacatacaatttacattcagttacctttaagaatttttttgttttcttcaccttatcaaatatcaaccgaaatataatagtttctacatccagtttaattgactttcagttattaattattaggataaaaatataaatatgtttatacaaatccacgctagtatattgtcaagtatttaaaattttgaatttatataaaaaaatgctccaaataattaagttatcacaacttcttaatttattgtatcaaaatcgtacctatcttgcaagttgttgcatttatacgatcacttataaagatcttatactaaattgcacattcttgccaagttgttgcactataacgctcattttttaagttattacaccaaattgcatccatctgccaagttgttgtaccgtgggtgcaatttacttaaaaaaaaagtctctttcataatatctcgcagaatttctacatttctgttccccaaaaggggccatgaaactggcatgcaggaatccttcttttatgccaagcaacacggaacgcgaaaaagtaatcacaactcacaagcgcaaaacaagtgcttcattatttgaggaacaaagatgatttttttttgggacatggctcgttcaaagatgtcgtcatgattggtttcaagtgcagtttggtcgtaggatactttagcctaatctaaatcgtcgttgtccttccagccgcaattatcctaaattcccaatcaaaattcaaagccttttcggaagcgacactgccatccactggaagaagaggggaacaaaacaaaaaacaaaacgcagcaagattcctcgcagtctgcatcatcagcccatgccgagccaggcagctgaacccaaaatcattcgagcccgtacgcatcacgcacagcaattgataggttctcaattccagcgaaaactggtcggatcagttcaataagacaaaccactcaatatcctgttcatcttttttaaaaaaaaattcaaactgtttttcttgttttgacaaaatctatccaactctcaatcttgttttgccggtttaccaatgttttccgaaaaaaaaacccggagatatcggttcggtgaccggactgtcaatcctgaacccagctcaccaccaccacttgtaggcttgtggcagcaacaagctgaaaatgacaaggagaaatggaagaaaaaggcagagtctcgctgtgatcacagctcactgttggggagaatgaaaaacggttgtactcccttcgttccataaaaaaccaacatattaccagatatgatactccctccatccaaaaaaattaaactaacctagaagttggatgagacataatcttatgtcccatcgaactcctaggttaggttttttttttacggaaggagtacctaaacatatatctatattaggatatgtcacattgatactgatacgttttttatgggatggatggagtactaaaccatttgctagg

SEQ ID NO: 65965 - DNA, 4713 bp, Oryza sativa
tccttttatatttgtagttttgaaaaataacactcttgttccagtttctatctccatttggatctgacatgtttggttctgaaacttgggcggtgaaacctgaccattagcgactaactttgcacattgagctctttacctgcgctgcattttgaaattgcttttgtacccgtttattattatcattttatttttctgcattctgaggcacttgccagtttgctacgcaacgagacggcgccagcattttttttaacacgggaaatcatgttgtccaaacgagacctaagcttgagtaaatgtttgccttttactccatctgttttatatgttttgactctttttttaaaaaccttttatactaaaaacataacaatatttttaatataaaataaatatactattaaaatatattggatgtttggtttatgaaactggtttgctattataaatgttgctaagagtctgtttggttggagggactaaaactttagtcccttttagtccctaaagtcccaaataggagggactaaaaaggacttaagtgtattagtccattagtccctatgggaggaggttattgggactatagctcctttttacccactgcccccacgcatgggtatggtgcatctctctttgcatggttttagaggtaacatagtcattgtacagtgcaattaatgacatttagtccctatattcaaacagccatggactaaagtgtttagtcccactaagtttttctataaatttagtcaaacttaaaagaagtttcatattatatgaaacagaatacttttttctaaaaccaataccatttttttcacaaacttacatgaaaaatttgtgaagtttgcatattataagattgataaagtttgcatctcttgacgtcagatttttgtttgctaccctcctgtcatgcgatggttgtcgagtgtcttatttagaaacaaattggatgaaacttcgcgcgttggatgatgttggattggaaatctacaatgttaacaatgttagtgataccaatttgaaacgccgagaagaactattggagttatatgtaatgttggagttatatgtaatgttgtgttgttgttgcagatttggaattggcattccgaccaatatggacaacccgttaaaaacagatgatattattgagttcacaactcgcagaaacatgttttcatcacgtcgtcctcattaaattgatctcatcgatctctattttgatgagcatcggcaatagaattttgaatgtgtcgacgagtgatactcgttgactggataatttgggtattggggtacgttggaacgaggatctacgtaatacgacatcaagcaaatagaagacaaatattatactggttcaggccccttgtcaggtaatagcactagtccagtttatatgagattgatgacagaaaaccacataatacaatggaagtagacgaaactaatgataccgacgagatcatagtcgatgtattcgacgagatctcccggcgacttggcttcgcgtactccgacttcggaaactatggtgggtgtgttggagatgagattcgatgccttgcacccctcctcgggggtcccttttataccgcggatcatcttgatccccaagtaagactcggagacatcggatcttgtacgatataacagaaactctatttcttccgagtaggactttggaaatcacttggctcgtggagatattttccataattcgtaacaaattccaccaatgtatatgggaatagtctgtatacgtgatgatataccatatctgcgtattccgtaagtcataggatatgaggtattccttatccgtaaccttgacagtagcccccgacttcaacttaaatgaattcacgttgtcgcccgcgacttctcctgttagcgccttgtcgtgctcacctggtcgatctcggtgcagaaccgtggagatgtggagccatcgagaacgctaaagggagtcaaacgttcgaatatgaatttaaattgaagtctgaacaaccgcccgcaacgggcctcaagatttttcggcggcaatatctctccttggaatgcgaaccgctaggtagtgcgcctatttaaaggggttttgggatccatttcaagtccgtttgccaaaaaatcctccatcttcttagaagcctcggacccttcgtctcccacaaagccctagatttctttgtcttccttcgacgattccttactaatggcagacctcaacaagtcttcatccgacgcggccagcctgaagaacctttacacagaaggagctctccctcccaatcaaaccatggtgagagaacaaggaggtattgatccttctcctgccctaggccgtatggcagtggtagaggattttgtccgctgtggttttttgcctcccccttcggaattcctcttgttgatcctaaatttttatggcctttcactcttgcacctcaaccctaattccatcacttccctgagcatctacgctcacctttgtgaggcctacattggggtagtgcatttcttggatctttttcgattcttcacgaacttcgttggatggaagccggcaggatctcggggtgttgtgggttccgcttacatgatggcatgaaagcgaggtacataccctttcaatgccatacgtcctggaccaaatgtcgatcaaagtggttctaccttgagcttgaggaacttgactcggttcttgtcgtgcccgaggtccaaccggatcgccaagagagctagacttccaaacctccattgaccccttcgcttgaggccttcgtgaatattgtcggcgacctgcgagaacaagggttgaccgggtataaagtccacggatctcgtcacggggtacttgttctcatgtcgtagtttctgtctttccttaaccgctattccgtgttctcggttttacctgacttcggctttttctcatgtttcagatcttcttgctgatgtcgtgacgcagcgggtgagggatgtgctaatcagccccgcctcaaccgccgatgagctacccaccccccttcgtgacaagccagcggccgacaaggcggctgttatcaacgtgagtgaaccgaacgcctttcgtcttttcattttttagggagacgaagtgacctcaattcccgcaggttctacctttgacggatgtcatcggcccccttgtcgatcatcagacttcctcttctctcagggagaaagtcgtggaggaggttgccgccatcgccgctggacctgctgccgctagaggcagcgggctcaagaggaaaaggttgggctcgtaagagcggcgcccctggatctcgtcagaagtccagtggctccgaggtaggctattccatccctattttgctaccccatttatccttgcaggacaatagggatgagatcttgattctctatcttactcaggatacgggcagtctttctcctcatccgaagaggaggataataaagaaagccgctgacaagtaagtagaatcctggacctccatctgttttcatgttgatgggtcttttgagtgtatttctgatgtcagcaggacggtctcagcgatctctacgcagagtggggatgaggtcgcgaccagcgcgattcccgccgcagcttctcctcgcgcgggtgctgcgcctgtcatcgccgagtccgccccatccgccgccgtgcccgtggctgcgccgccgcctcccactccgatggggccattaacctggtcacaaaagatgaccgagagccgccgctgtcgacgagagatactcgctgaccggatgagtagagtattggggtacgttggaacgagggtttacgtagtacatcaagcagacaaaagacaaggattatactagttcaggccccttatcaggtaataggcctagtccagtttatatgggatttatgatgatgagaacaaattacaaagagagtagtcgaaacaggtagtgatgtgcactagggttcccgatcttttgaaaggttctgataaacaacgatttgggcggagttgcaacacaaattgatccggcttcttgaacacgcacgctcttgagccccgcaatcgcaacaccacgtctcctctggttatcacccgtgtcgaaacgcggatgatgtcgcgtccgggaaaattgcattttcccgaacgctagtgtattaatccccgtcccaggaaaagccggggtacaccatacaaacatgatataaaagacacatctttattaaatcgataatatttacattattacaaaggcacttaaggcctgacaatcaaaaataaacagcagcggactagcgggcctacggctccatcttcacaggcgctcaactggggtataagccaagactccacctaagacttcttctccaaagcttttcttactgaaggggggagaaagatagagcaagaatgagtacaaccacagtactcagcaagccacaccggcggatgcacgattaatgcaagggggtacaaggggtaatgatataggggttaagttttacagaaaacagcatttaaaagtcacttagttgcccaaagccattttaaaaagacgatcctaaagctacacagtattattaatcaaggccgtgaaccctcacgaacctgccttaacccaaggcctacgatgattcagaccgaactggcaacccgaccctgggtcccagctcgtcccaagccaacccaggccaaccattcc

SEQ ID NO: 65966 - DNA, 8022 bp, Oryza sativa
ttcaggtagcggaactctcgttttctcagtgtgatcattcctgcgggaacatgtgatctcttgaatacagatgaaaactcgtcccaggtgatggtatgtccttctggccgtgatgcttcgtagctatcccaccattctgaagccagtccaaccaactgatgagttgcgaagacaacccgctcctggtctatgcactgaatcaaccccagcttcttctcgactgtgcgcaaccaatcactggcttccataggatcgacggcaatggcaaaggttggaggctcagttttgagaaattctgataacttgcactgttgctggactgtaggtacttgaacgttgtttgcccctgctgggttgttccaattctgtaatagttgaaaggctgttgccaacatgttggtttggttaaccacaatttggattagctctggcgaggtttcgttgatgcttttctcattcccattggcttgggttcttcatcttgtacttgatttcttggctgctgtgctggaacatccaaaggtacaatgccgatactggcctctatcttgtcaactggtggctggggctgaaattgagcattgacaccttgtggtaatgcactcgctggagttggagctgttgcaacggggactataggactgcttcgggatgcatggatgacaattcgctgaggagcaagcttctgattgtcgggagttgcttgaactgacgtgctggcagctatgtttctcggttttgggcacttgtcggcgaaatgaccccttccttgacaattgaagcaacagatatcttcccgaactcggcattttcttttctcattttgattcctctgtcctggcactggagttaggctgaaactgtaatcttggcgaggatttgtgttgccttgatgcttctctccgttggaactggcgggttggttggccatcttcttcgtcagcagaaaactgaattgacaatcttttggtacatgatcagttccttcacagaagaaacaggtgatcctgctcgtttgacacctgtcgggtggatggtcttcctcacaatgaacgcatgtagtggcacacgagctggcaacatgaccgatttctccacaacgagagcatgccttacgttccattttattctggttgaaactttggggagacttctcatcttcatcatctggggagacttgatctgaatcttcactatcagacactctacctccattagctaaaagatgctctgtcaactgtggtgcacctcggaaggtatttcttctctgacgtttggtcattcctggtggaggccattctgtgctggtaatgatcatcttacggacttcatcttcggttcgcattggtgtttttcttttctgctgaggacagttccttgcatagtgcccttgctcatcacacataaaacaaatgatacttgcttcttttgagtcaacatgtggcacgccaccatgggtcttttgggatgctggcggcatgctgacttgtggtgtgagtgattggactgcctccaactgcacttgagcttgtatctgactcaggttcagaattggcgtctgatgctgctgtagtatctctataagcaatcggttctggttaatcaggtgttggaccagtgtcacacaactggtgtctggtgcttcattcactagggagcttgaggtaccaatgtcctgacttctgaccttattgcctttctcattgtcagccatctgttgcaaaggtttggagagggagagagggaaaacaaaggggagagacagattagaaactaaggataggaccttaacagatctaagtcttttgctgttatgatgtatgttaggcttattctgcaagttgattaagcaaacaacctagcatggttacatcacaccccactgatgcaaaccacacgctacacacacaagcaaggaaacacacgactaacgaaaccctagagggtggcttaggttctgcggctggttctccaagatcttaacttcggcttcacagctgacttcactgcttcctccacttcgctagcagaccctgcggtcttccggagcttcggcgaacaattggcgacatctttttcttcgcaaaaccaaccatgtagtactagttggaaatccgaagaaggaagaaaggagtaaacattttgcaaatagcattgaggaaaggagaaaaagggactttcgcaaatagtttcatttataaaataagtccttaggttttatctacttggcttatcctacagtcgagatggctctgataccatcttgtcgcgaccgggaaaattgcattttcccgaacgctagtgtattaatccccgtcccaggaaaagccggggtacaccatacaaacatgatataaaagacacatctttattaaatcgataatatttacattattacaaaggcacttaaggcctgacaatcaaaaataaacagcagcggactagcgggcctacggctccatcttcacaggcgctcaactggggtataagccaagactccacctaagacttcttctccaaagcttttcttactgaaggggggagaaagatagagcaagaatgagtacaaccacagtactcagcaagccacaccggcggatgcacgattaatgcaagggggtacaaggggtaatgatataggggttaagttttacagaaaacagcatttaaaagtcacttagttgcccaaagccattttaaaaagacgatcctaaagctacacagtattattaatcaaggccgtgaaccctcacgaacctgccttaacccaaggcctacgatgattcagaccgaactggcaacccgaccctgggtcccagctcgtcccaagccaacccaggccaaccattccacgttttagttattaagcaggttttaagaatttaaaacactaacttgggtacattgctaggcttgcccataaccgagggcgcggctattcgaatagattatactctgatcagaggtgtacatctttacccacaagacacatcttcctcacgtgtaaccacgtgccacataccaccacggtatacggacggaagacgtgacatagtttccaacccatcctagccatagacaagagtaccgacccaaccccacctacggccggaacctccgggacaggtaggcaggattgagcccctagcagcaggacaccagccctgtgccatgacatctcgactaccgggccgcagctcgtgtagccttcatttgtcctagagaatgtccatcgacccccgacttcatccatctccatccgtgtacttttgtttatgaccgggctgagccacaaactaagccttacccactagacatgtggaagtacggtagtgctttgcaacagaggcccgaagaccggtccttatgtggccgaggtgctactatcaaaaccatgcaccccgagcccagcctaaaaccattttggggattttgaatagagggggcggggtgaatccgattccacaataaaccaacaattccaaagtgtccaggtgatatgaatatcccaaagtctagagttgtaaaaccgcctaatgttacctaattaatcagcgaagcatctacctaaaatcatactagtggtaccatgagtagagtgtccactagttggggttttgtttattctagggtgaacaaggaaataataacaataacaataataaggtcataacaaaggtaaataggcatgactagataaaacagtgatatcgcgggaatttaaataaagcgataatgcaataatttaaatcaaaataattttataaactgggattcaatatgttcaaggatgatgtgacttgccttgctcgctttcccaaacgtcggcttcaacttccacgaagagcggatcttccgaagctgcagcgtctacacgaccaacggaaaggaaaaaggcttttactctaataaactccatataacaagcagaaacaaagcacaaaaatgggttcttgacttcttaaggaaaaattagagacttgaacggtccaattccgagttcaaatggtcaagttatggccatttgaagtttatatgctctttaaatggatatttgcgaatttcttcatttaaattttaatttaaaatcggatttattgcgtcagccgaggggaggggcgcgcggaccgggtccacgggagtggggcccacgcggcagcctcacggtccacggtggaccgggtgcacgcggcttacgccggccggcgccgtgggtcccacgcgtcagccgcacccgggggcgcgggcggctgacggccgggccccacatggcagccgcgggacgcgcccgaaggcggccacgccggcacagccgacgggaggcggcgcgcccgcgccccgatggtcgccgccggcgaccaccggcgcggcggagcggcgcccgagagaggggagggaagggggaaatgaagcggcggtccacggctcaccccgggtcgacggcgacgacggaaacggcgaccggagcggaggaaagcggcggcgcggctcgggtcgacggggtcgacggcgttccggcggtcggcgaccgaaatggaggggtggacgaggtcggcgaggatgcggcgaagctgaaggaggcggcgccgaggcgggagaaggtccggggcgacgacggcggcggaccggagctcggcggtgacggcggagagagagagcgacggcgcaagctcgattctggcggagagagagagcggcgagtggcggaaacggtggagggaggcacggggagtgtttatatagggttgggagggggagagagcggccggagggaaaggaaaccggcgtgacgctctcgggctccatcaatggcgccggcgggattgggggagggtttccaaacgaatccgagggagagagggagagaataatggggggaaagagggagggaatcacggggaatatttcccccctcttgattgcacgcgggacggacgggagcggcgggattcgcggcggcggcggcgctagggcacgggcgaggcggcgggagtggcggaaggtaggggatgacgggtgggccccacccgtcagcgagggtggcgggcgggcccgcccgtcagcggcgcgcgcgcggggagaggccggatgggccgcggggaagaggagagagagggaaagggatgggccgagccggcccaagagggagagggggagggaaagggaactttttagggtttttctttttataaaatcattttaactttgtttatttcttaataattattatttgtgctctgaaaattccactaaaatttgagggctcctttttgaccaaggagaatttaacaaaaattctccgggccacatttgaatttttcttgtacgtattttaatgtttgccaatttcttttcgaattttaattaattctattattccttttagaaaatgatttttatttcgggatgaatttatcaggacgtgacagatgacctcgccgagaaggctaatccctgtttgtgaatcgaagaacacaaacaagaacaaggtataatacaacaaaaattgcagatgaataattaagctcacaagttggggtcttacaaaccgatctagtggcgaaactgttctcgatagaataatctaaccaaaacccaaaccctaaaggtgacggtggctactgatatatagagtttagggttgtgcaaccaaccctttgatgcaaccctaatgggttccaacacgatacacggcccaaaggcccaaatacggtgacgcagcaccgggacagattctggacgttaatttgttcggtcgattcctgttgactcagaaataatttggatgtgggaccaaaaccattggaaaggttatcttcttagctttccatccatataaagaagccccaatccaagcacgtatgcgacctgagcgcccgttttagtgcagactggttctggactccgaattgacttggtttgggcctccaccttgatttggacgtcctcgatgatcctacatgactctaagtccttctccaagtgtttacttgtccactccattgttcctaatcacaatataatcattaggtagcaatttattctcaaattcgtacaaagaagaacataggaacgaactcacctctaaatttaattgtcgcacgcgagctcgtgttatcggtccttgaatgaccattggatgattgttgtgtgtatccgtaggagtgatgtccacatcagatgaaaccgacgagatcgtggtcgagaaattcgacgagatctcccggcgacttggctccgcgtactccggcttcgtaaactatggggggtgtgttggcggtagaattggatgccttgtatccctcccaaggtgtcctttttatactttggatcatcttgacccccaaggaaggtttgaggatatcgaacccggtacggtataacagaaactctatcccttccgagtaggactttggaaatcacttgactcgtagagattttttccataattcgggacattaacttagacttttgaaaggaccatcagcgcgaggcatcaactttgactttcccaattctggaaatctatcctttctcaagtgcaaccaaactaaatcacccggttcaagcttaacttcttgcctacctttactaccagcaattctatacttttcagtcatctttttaatgttgtgcttagttgtctcatgcattttcaaaataaattcagcacgtgccttaatatcattataaaccctctcactagtaggtaaaggcaagatatcaataggagcacgagggttgaaaccatacactatctagaaaggacttaccttggtagtagaatgtgttgcccgattgtatgcaaactccacatgaggtaaacattctttcaacatcttcaaacttttcttcaaaatagccttcaacatggtacccaaagtacggttgactacctccatttgtccatctgtttgtgggtgacatgttgtagaaaacaataactttgtacccaacttgtccatagtgtgcgcaaaaaatgacttaaaaattttgcatcacgatatgaaacaatagtagaaggtataccatgcaagcgaacaatctcatggaaaaacagatcagcaatatgaacagattcatcacttttatgacatggtatgaaatgtgccatcttagaaagacaatccaccacaacaaaaatgctatcccttcccctcttagtcctaggaaatctcaagacaaagtccatagaaatatctgcccaccgaatagaaggtataggaaaaggcatatacaaaccatgtggattcaaacgagacttagctttctgacaaatggtgcaacgtgccacaacttctcaacatcttttctcatccttggccaaaagaaatgcaaggccaaaacatcttctgtcgttttagctccaaaatatcccatcaatcctcctccatgcgcttcctgtatcaacaaaagatgaacggaaccaactggaatgcatagacagttagctctataaacaaatccaccattgatcacaaatttgttccaagtacatccctctttgcaatccaacatcacttctttaaaatcaggatcaagcgcatattgtttttaattgattcaagtccaaaaatccgacaatcaagttgggacaagaaaatatagtgcctagacaaagcatcagcaatcacattatctttccctttcttgtgtttgataacataaggaaaagattcaataaattcaacccattagcatgtctacgattcaaattattttgagagcgaagatacttaagcgattcatgatcggaatgaatgacaaattctttagaccactaataatgatgccacgtctctacagaatgtacaagggcatacaattccttatcatacgtggaataattcaaaacaggaccatgcaacttctcactaaagtatgcaacaggcataccatcttacccctaatgccaactccactagcatcacattctaactcagaagttttaccaaagtttggaagttgtagcaatggtgtgtgtgtaagcttgtccttcaaagtatcaaatgacttctcctg

SEQ ID NO: 65967 - DNA, 5811 bp, Oryza sativa
gccattaatttttgagggaatttgatgctggtacgcagaaactcgcctgtttaggagcaaaagctttcaacttcgttgttggtaattcaagtccacataatctacaaagagtttccaggtccagctcctaaagaagttccaaaacaagaatcaacatccagctgatgattttagaactgttcactaaagctgcaactaaaatgcacaactgcagtaaaaatatatgtcgaagggtggtgtccgcgtacctcgatcattaggatttctgataaatgtgtcaaagggtggtgttgaagtttgtagccactatgattgaagtacattaatgctctaacacgagcctttggcagcaaagcaggcaaaaaaaattgatatgtcagaacgaaatatatccagcaatattaaagcttgtgaataaagaaatgtgctggtaacaaccactagcataacacaaacttgagataattctcattcatactgaaaggatcagaacacaattttaaaacgggtgaggaaaatttaactaaccattgcagcaattcgtttttttgcacaaacaattaaacacttcagcagtatgtgggcaactgggcacctactttacacttaacaactatgtttgtaaaagctagataacagataccatatggatataacaggctcaaatgtacatacagaaggcaaggatatcaccttatcattaaaagggtcaaaattgctgttcggcttacctcattgagaaaaggttctaacagacgcagctgaagatcggttccttcagctgctatggcgcagaagaaacgcttgaagtttcctaggtggtagaatctgcagaaagaagatcagaacatatatatatcaattaagtttaaaatgatgtgtctcaatagttagcacttctgagttgtcccaaatcatactgctgtgcacaaagaagactcaagaagcatgatggctcttagagcatgacaaaaatgaaggctctatgtatgttgatacaaataatatgcataaagttaccttaatatagatctagcaaataccatttcctttgattgtataattgaagcagatagatggccataccacaaagagagtgaatctacctggagataaacaggaaattaggctactattcactagctggagtaagaagaaagtattgggaacaagagaataacataaattagattatttagaaggcaataaaaattgggggcaaaccattttgggtatcttgcagcccaaatgtagaagcacgtagaaggaataatattcagtctctttactactctgtgaattgttcttgtgaattacatcatacatatcaaacagagaaagaaggcacttcattagctgctccatgtttaggtaacacagggaagaagcatcagaatcctgggaagacctagaaagcttctgatgggatagaatatgaaactttatctgcagaaggcaggggcatgcatcagataaagctgtgaaagaggaataatctaccctatatgcttgcacttgaagcaaatatgttcctccaccttaacaaaatgacatccggcagcataacatcaaaagataacagcatctaacgaacaaaaaggaccacttagtggctaacacagatgccaagtagaaaatgcctgaaagaactaattcatgcataatcggaaaagaaacatactttctcccaaaccaattagagagaaaaggcgagaacctcaacaacattttatgcatatcgagtattactctatctaacaagagtttggatgagtgaattttctggcctcaactacttaaaaaggatggaacataaccttacaaggaaaacaaagagaaagttgttgagtagtagttctgtgatagagtataaggatgctcaattctataatgttaaaagttagattccagacacaacaatctaaaccagacaaataagtaccctaaaattcagaggtctatacaataagataaaaacatggatgatatgagtgtaccacatcctcgtatatttgaattgcttgggcattcactatgttctgaatactgaggtcttgcctcacagaccttgtcctatcaaatataaaatcatgaactatctcaaactgatgctctgaggaatccaataaatgcaaaagataatccattgtttctcgcaggactgggagagggcgtatatctgatgcctgtacactcgtggaagagatagttctgcaaaactagcaggaaaccaagtgttagaaaaggaacggagatacacagaattctcaaatagctacctgattctcttaaaacacacgcggttcatgaaatctttcagaccacatgaaactgtagtgcaaatttgtaattataacagtgttttcaggtggcaaattggctattctatgtggttggtaaagattcattatcttacacaccttttatgatttttcagtggcatttttactcaagtttgcagtggcaagtaaatgaattccgacagtttcacctcaagtgtgcagaacatgatatctcattgtataactattattttcgttgatacaagctctttttacctaataacaatggcatgctaaataaataatgtaaaaaaaatcataatctgcttttgcacattgctttcttttatctgcaaacatgaccacatattcaagataaaaataagtattaaatgaattgataatcctgtcctttcatcatatcttcacccctgcaaaaatactagtacaaggtaagtactaagtagggttatatttcatccaataaactataaaaagaaatcaaacaaaataaatataaatctgacactatcgtacattcaatctcttgaaggctaggctacccgaatagcttccttacactctggcagtgattggacaagacaagcgtagatcagatttagtgctgcattgctgttattgcattattggtggcatatgtaactatatagctacatctaacataaagtgttgattgttccaacacatgcttaacggcaactgatcacccttttaagcaaaaatacatgcacagttgcatgcacaaaaaaaagcttccagctccatatcaaatccaatcaaaacagactaaaccaccacatggaatggaaccaagctatagcctgtccatttgcatggagagaacaatccaagcagatacgcaccaaaaatgaccagcagtgaagcatcaccacgacccaaccgcaagttcaaaaagaaaaaaaaaatcaggaatggcctccacatgagtacggagaaaaatggatggctcaccttcttcacggcgagggaaggggacgtgcgcgcggggtcgccgcccacccgctcgaacaccgccaggtccctcagccgctccctctgcgccctctccctcgctgcagcaggaaaaaaaacagtagcatccatgagctaaaacgcgccaaccaaatccatccaattaggggccaactgatcgcgcaatttcgtcgaacaggtggggggcaattcgccccgccaaacgggggtcaggtcaggtcagccagcgtcggcgtgagcgcacgggaggcttggacgaagcgcgttacctgggcacatgtcggggcagctgcccacgatcggcggggcgtcgccgccggtaccagccgcggtggcgctggccgccgccgggaaggaagaggtggaggaggaaggaggaggtggcggtgaggggccggcgccgcggctgagaccaaggccgcggccttctccccgacctcgccagcctcggccccatccgtggccacgagtggaactccggccgcggtggctcgccatgtcccggcgatccatggcggcccttggcctcgagctccgaggggtagtctggtaatttggtggttagttgaaccgtggagtggaacaatggagcttcaaacgaacatgcttttttagtggagagagagagggggggaggccaagatttttttttaaccttttaaaattttaattttaaagtaatgtcctgttttccaatttttttttcaaatttctaacttttccgtcacatcgaactttcctacacccacaaacttccaattattccgtcatatcgttctaatttttttaaacttccaattttagagtggaactaaacacagcctaaatcataacaaaacttatttttaaactgaatctttcgaccacgtcagcaagagtggtgtcatgaaataccgttgccatgtcatctagaacaatactactccctccgtcctctaatataagggattttgactttttgcttatactgtttgaccactcgtcgtattaaaaattttttggaattattatttattttttacttactttttgcttgcaccgtttgaacattcgtcgtattaaattttttttggaattattaattatttttttgacttactttattatctgaagtactttacgcacaacttttcgcttttttatattttcacaaaatttttgaataagacgagtgatcaaacagtgcaagcaaaatatcaaaatcccttatattatgggacggagagagtatcacactaccctggctagtgtgacggtgttattttgccacacgcactctggctgacgtgggcacgtggcaacgttctcttgccaagccattcatattgacatgacaaagcaaaattttcacatcaataaatcgattattgatggtgtgacaatattatttcgtcacgcacagacgaagtggcgtggcaacaaatattcaggtttagaaataagtaaagagatgatttatgtttagaattaaaagattaagaatcataaaaattcaaaaacctaaaggcaagacggtgtaccggtgtttgaggttcaaactgagatgtgggaactttttttttcaattacacaaaaaaatgtatattcacgttatatagtctacgcacttgtgaatgcatcatctataaaacacttgccgagacgggggcataaataaatacaagaaatataattggaagaatgagcagttctttttgaaagctctgcatttctgtcagggttacgggtaaagtataccctctactttttgatatacgtcacatatcgatatggtatacttgcgcgtatacggatgtttttggcatacgttaaggaaattcattatggagttcacagatggaaggaatcctactcggattgaactgggtcgtcattatatcgtatcgggtccgatgtctccgagtcctacttggagaccagttgacctgcggtataaaagggaccccccggagaggacctagggcatcgaatcttaccgccaacacatccaccacagcctacgaagccggagcctacaggagccaagtcgccgggtgatctagtcgaatcaactcgactacgatctcgtcggtatcgtcgagttccactattccctttgtaatctgtggtttccatcatataatcccatatcaactagattagggctattacctatcaaggggcctgaaccagtataatctttgttttctgcctactcgatgtcgtattacgtagatcctcgtaccagtgtaccctaataccctctatatccggtctacgggtatcccccgtcgacagtggcgcgccaggtaggggcacttggtgctcaaggttctactactatgacatccagcttcgtcgacaacggcgtcaacaccaacctcaaccaaggagttcctacttcaacaacactggtgtggactcaagtcggcgaaatcgtcttcccggtttacaccacagtgccgatctcagctggtccgtcaatggccggaaacgagaacgcagtggctataacccaggacgactacatgttgaa

SEQ ID NO: 65968 - DNA, 14782 bp, Oryza sativa
aaatctttccactctccagtgccaaccccgacaagaccgtcaagatcggggcattactaggccaaaaataggaactcgcgctcatcaccttcctccacgacaatgctgacgtgttcgtttggcagccgtccgacatgccgggggtacccagggaggtgattgagcacaaactcatggtgcgacccgacgccaagccagtaaagcaaaaactgcggagatttgcactagatcgaaaacaagccatacgagaagagctcgacaagcttctcaaagttggcttcatcagagaggtactccatccagagtggctagccaaccctgtcatggtgcggaacgccaacgagaaatggagaatgtgtgtcgatttcaccgacctcaacaaggcgtgtcccaaggatcacttccctcttcctcgaatagaccaactggtggactcaacagccggttgtgagttgttgagcttcctcgacgcttactccggctaccaccaaatcagtatggcgaaagaggacgaggagaagacagcattcatcacgccgttcggagtattctgctacgttaagatgccgttcggactaataaccgcaggaaacactttccagcgcacggtccagggctcacttagcgaccaactcggaaacaatgtcgaggcctacgtcgacgacattgttgtcaagaccaagtcaagcgactcattgattgatgatttgcgggaaacgtttgacagcctccgacgatatcgcctcatgctcaatccagagaagtgcacgttcagagtaccatcaggcaagctgctcggcttcctcggctctggcagaggaatagaagcaaatcccgagaagatcaaggcaatcgagaacatgaagtcgcctacaagactcaaggaagtacagaagctaaccggatgcatggcggcactaagcaggttcgtcgctaggatgggagagcgaggacaacctttcttcgctctgctgaaaaagcaagacaaatttgtatggacacagaaagccgaagaggcattcattgcactcaagcgctacctatcaaatccacctgtacttgttgccccctaacctattgaagaattatttctctatattgccgccacgccatatttcattagcactgtcattgttgtcgagagagagaaggtgcaacgaccagtctactatgtcagcgaagctctccacgacgcaaagacaagatatcaacagatccaaaaactgctctacgcggtaatcatgacattaagaaagctacgccactactttcaagcccacagggtcacagttgtatcctccttccctctcggtgaagtagtgagaaacaaagacgttgtcggccgcattacgaaatgggtagtcgagctaagccagtttgatgtccactttgtgccacgaacagtcatcaagtcccaggtacttgccgactttgtagccgattggactatgcctgataacaggtcagacaaccaaatagacaacgaaacgtggacaatggcgttcgacggcgcactcaatagccaaggagcagggggcaagattcatcttgacatcacctttaggagatcaattcaagcatgcaattcacctcaacttcagggcgactaataacacagccgagtacgaaggactactcgccgggataagagctgcagctgcactcggagtcaggcgactaatcatgaaaggagattccgaactagtcacgaaccaggtgcataaagattacaagtgctctaaccccgagttatctgtcacaccccgaagttttcctcccaagccaaaaattgaatttacaaatgaccccaagaaaatgcaggtgaaatcaggagaaaaccctaataaagtaatgcaaataataatcggattggacatgtggaatttttcttgagttctacatgtcaaaattcattaacaggatttttagtggaattttcagagctctagaaataattttaaccaattaaaattgagcaagcaatattgttaattccagggaaaatcctttttctttttctttttcttttttcctctctttttcctccttcttgtcaaatgggccgtcggcccatttcccttttccttcccccccctctctgttgggccggccgcaggccgaggcccagcccggtagccggctgcccgcctccctcctctcggggtcgccgacaggtggggcccacctgtcgggcccgtctccctcctcccgccgatcccggcgcgccgccgcgcccgaaaccgccgccgcgcccacgtctccgccttccccgggccacgtcgaccacgcccgcgcgtgcgccgcgtttcccgcgcccgttcccctctctctcccgctcgcgcccgcgcccgagatggccgggattcgaaaaccgaatcccgcctctctctcctccccactcccccacgtcggccggcgaatcccgcctcttccggccacgtccggccctctcttcccctatttaagcatcgccggcaccccctctcgctttttccccatttcgccgacccctcccgagctcccaatcgtccccgcgccttgcaaccacccgccgccgccgtttttgctacttcggccgccgctagccgccgctaggctcgccgccgtcttgcgccgtcgccgccgttagattcgcggggtcgagatctacctcggccgcctcttccccgttgaggttcgccgccggagacccgtccccgtcgtgcgccggtgagtgacgccatggccgcggccttcggccggcgctctcgctctctcgcgctctttcctctccctctaatccctctccttttgttcgttaggaggttccggagctcgtcccgccgtcgccatcgtcctccgtcgcccgccgtcgtcgaccgttgtcggtgaggccctcctcctcgttttctctctctcccgcaccgtttagccgccgcgtcgccgcctagctgcgtagccgccgctcctcctctagccgccgctctccgccgccggtcggtcgccgtcggccgtcgccttgcgccgctgccgcatgcgcaccgccgccgcgtgagcgctgcgccgccggcgccatggtcgccggttcggcttgcgccgtgcccgcgcgcccggccgcgagctcccaccgccgtccgatctacccttgggtagatcggggccgtcggttcggccgccacgtggagccgccgccccttccatctcccgtgccgctgacagtgggcccgcgagccgccgcccctttctctctctcccgggtcgctgaccggtgggtcccgcatgtcggcgccgcacccctccgtgctgacgtcagccctggttaatattgcgcaataaatgatttaaggtttttcttttatagtaataaacacagtgaatcttctaaaattcataactaattcatccgagctccgtttaatcccattcaagtctcagtaaatcaagaaaaatgtgtagaatccattaaaaatggttttgttctctgtttcagtagtcttatagcctgtttgcaatgtttgctttgtatgtcgctagattccggttctttcgacgctccggtgtacttcgagatagtcgccgaggttcctccagcagcagagcaaggcaagtcatgcttgtcacttgatcatattgatcctatattgcaaatgtcctaatgttttctttcaaatatcgcatttgttttgcaattatactatgggatggttaccttttgttacagccatgttattttgataccatgctcctttgttagcttgggttataacatgattagagttaggactagggtttgcttagccatgcttagttcaactagcacacaatggggagatctcatttaaaacctagactataggtttttatgataatgttggattagcggcaccgctttggtgttggttaattaaaatgaatcacatggtgggctgtgggtgcatggttttgctggtcgcacccatggcagttaaggaccggttcgcgggatgccctggaagaatttatcgtacttaccacaagccagcgtgggcaacggctgggcttgtagtgtagctttcctctagccgacgcatccaggcaagggtgggcgtgatggagtttggatgggccctgcgacggcctatgcggcttccggattcacctaggcacgagaggggactgcccgctgccttgcgagcagtgggggtgaaacctgaggtgtggtgtgcttggttagagggggttatgtgaagggtcctgtcacggcctctttccggtatgtcgtggtggcatgtcggcgcacggaaacgtgtcgtggggctgtgtcctgtgggtacagttgtacacctctgatcagagtaaaactattcgaatagccgtgcccgcggttatgggcggtcaaccagattcaccgtgattagtctcaccctagtgtaatttgttgaacttggatagtttaggtggaaggttgggcctgtcgcaacgtgggttagcgttggacagcggatgtttaatactgcttaattattacaactgttttcgcattaaattcctgtttataaatgccagtatttatgcaaatgaaccactttagctcttctttgttaattccctgcatcatacccctattccggtatgacttgctgagtacagtgggtagtactcagtcttgctctacttttcccaaccccagaggacgggtatgtgtcagatgaaggtttccccgaggagtaggcttcgtccgtgccgtcgaggatgcctgtggagtggtgttcccgctgcagtttagtcaaggcttagctccagtttcttttgttttccgctgcatttctgtaagacttttatgatgtttgtaagacgtggatctgaatgtcaacattgtcgtttgtgtaccccggctggtcctggacggggagtttaatgcacattctgcttggaattctattcgggaatttctgggcgtgacattatccaagtatctcgcagaagtcagaaagctagaaaaaaggttcgatgggatcgaggtccgacatgtataccgcaaggacaacattgaaccagatgatatagcacggcgtgcgtccagacgagagccactcgaacctggcacctttctagacgtcctgacaaggccatcagtgaaagacgcaagcggtgaagatagcccggtctccctcaacaacagctcgggggctacagaggtagagcgcgtcgttgccgatatcgagaccacagacgactggcgcaccccactcatcaaattcataggcagcaaagagttgcccgaggacgacgcagaagctgagaaaatatcctgtaaagcaaaggtctactatatgatcggcaatgatctatacaagaaggcatcaaatggggtactcctaaaatgcgtctcgtccgacgacggcagacatctcctcctcgacatacatgaagggatctgtgggtcacatgccgcccggtcggacattagtcggaaaagcttttcgacaagggttcttctggccaaccgccctcaaagactcctgcgacatggttcagcggtgtgaagcctgtcaatttcacagtaaacacacaaggctaccagcgcaagcactcaagactatccctctcacttggccgttctcgtgctgggggctagatatactcgggccattcccacgaggacaggacggctacaggttcctattcgtggcgatcgacaaattcactaagtggattgaagcgacacccacgggggaaatcaaggccgacaacgccatcaaattcatcaaagggatattctgcagattcggattgccccaccgtatcataacggacaacggctcccagttcatcagtgccgttttctaggattactgcatcaggctgggagtcaagatctgcttcgcctcggtttctcaccctcagagcaatggacaagtcgagagggcaaacggcatagtactacaaggaatcaagacccgcgtctatgacaagctcatgtcacatgacaagaagtaggacgaagaacttccatcagtactatgggccgtgcgtaccacaccgacaacatccaacaaggagacacccttcttccttgtgtacggctcagaggccatgctccccaccgagctacgacatcaaagtacacgagtacagaaatattccgatgaggatcaggaggagcagcgaaatgacgatgtgaatctgtttgaggaacatcgcgaacgagttaccgttcgagcagccagctaccaacaggcccttcaccgttaccacgagaagcgcatccgagcacgcacgctttcgatcggcgactacgtcctccgacgtgttcaaagccaagcagggcgaaacaagctctcacccaaatgggaaggaccgtacacgatcacacaagttctgcggccaggcgcattcaaaattgcagatggcgattgtcgcgagttggcaaattcctggaacattcatcaattacgtaaattctatgtataagtcaatagtatccatacttgtaagacatcttacagcttcaataaagcctatttttcaggtccagaccaaaatcaaagtgttccttcccgatgatcccttacctagatgacacctagcgttgaaacctaccctcatgtccctttacgctgtcttaacaaggcctccgaggaacctaagggaacttcagctggggccgcccagagccgataagaccttgtcggatcctgtagagacaaaagaccatgtaagatctggtcgtgtaagagttctcgccatgcgtattaaccaagccgtgtaatcggaaataaactttccaacttcacggctgggggctaggatcagtgcttgttcaaccgaggcaggtcaaaggtccaagagccttatcttccgagaagaattctccgatgacaatgctgggggctagggagagtgtataactcaaacgactaatcgaagtcgcgaagtgagaagacactcatacacaatacatccagagtaagaaagcttagttggatagatttcttttctatttcacaagtacttcttacaattctataaaaatccaaaattatattacactcttcccctaggacatttgtcataggacacggagactaccaggaaggccaatgctagtccatagactggaagaccttttccgccagcggcgccatcgacttcgccaggccatctatctccgtaggagttctccgagaacgagaaaacccttcatggaggaactcgaggtgcagctgcggacgatgatctcatatacaggccaatacatgcccccggcatattggctcgatcgacgacactcctgcttcagggcctcgtcgatacgctggctgatgccctcaagctgggcgcaggccccattcagccacgggatgtatccagtcgccgatttctcgggatccccacggggtacccggagctctctacagacccttgacatggaggtgcagaaactcttcagatacgagttgaaccacacctcgcggccccggagtgtctccacggcctggtccttcttcacttccagcatagtcctctcgagttccgcgacctcaaacttcgtcctccaatactggatgcgacgatcctggtcagcaagcgcactctcgaggtctgctcagcatggaaacgactaagtcaaactgctcttctctcacgagaatacaacaaatcaagtcgatccagacggaagagtaaaggagatgaaaacaaagataaccaacctaagggagtcgtcgccatgctcgtttccacaggcgaattttgagctacatcgccctccggcacatgtggctcgaacgcaagtgccggaacgatcactggcaactcaggctgcccgcgctgctggacatcctcgacatcaacatctctacagacgacaacaaagtactcaagatcaaaatgctaaagaaagctaaggcgatgactgcatacacaaaggcggttggaaccaatgaaagttttacaaagcatgactaaggagtacaagagagtcaaaatcctactcttcaaaaagtgggagaacagactcccccagatcgccgacttcttccatcacatccttgcgcgcgtcgctagccgccccctgatccaagattttccgcagatcgagtttagggtgcgccagtctcacacacgcaaggacatggcacgccccggtatagatcccgttggacgtctcctctccaatcctagccgcgtgcttggaggggatctcctccatcgccgtcgccagctccgcaagagaagtcgtcggcgagaactcatcgggattcgccgggatggtagacttgataccgcactccccggcgagctggtgcagaccagtataggtgactcgcaacgagccacggatttccgacaagttgttctcgcgctccgacatgcggtgctcgagtccctgccgttgtcgcttattgccggccaccagctcccgcatcttctggaggtcctcgcgaacctccgccaaatcatgcgccagccggtcggcgcgctcattcgccgacgccgccgccgccgccctcgcctccgcgatctcgcggctaatgccgcgagcaccagcctcaaggaggcaccccatctcaacctggagctcctcccaggtgaggatggcagccggcagacctcgaccagtggcgagattgctagctgggccgctaggtgttgcctcgcggctcctgggcacgaccacgacatccgtcgaggccacgataggagacgcgctggaggtccctccagacccgtcttgcgccgccttcgcccacgccgccctgcgaaaagctgcaactgagacaggctgcaacagtttgacgaagtgacaaaacctcaaagtcatccacttgcttctcgccaagcgtcactagccgttgccgacgtggaggcgggggagacgcgtccgaggcctggagtataacggatatgatgtgaggtggaagttttctgactacgtgatgaaagaacaggagaacttaccgagggggtgggtgtcttccgacgatgtccgaccacagaagagaatttcctcccctttttcagaacgttgccgccactcgttgtggcagcagcagcaacagcgtcagacacctccttggcgactttcttcttcagcgacgccgccacctgatggtccacgagcggcccgatgatatcagtcagagggagagcctacgcttcatgaagtcataatgcgatcccggaagaaaaatgcaaaaggaccgctgagtacacttacattgatggcaacgtcgcgctcggctgcccctttctcgcaaagggggacttggacgttgctcgccgttgtcgggccagtgatcatcagttggccgacacggcgctccacggttgcgctgtccaagcctgtagatcgagaccagaatccgataagtcgggaagaacacgcacataagggagccaatttaactaaaaagaaaaataccccgaggagaaacccgggtcgcgtcctccggcccagaataatcaaaggctggatgggctcgagcctggagcggctagatccgcctaccaatgaagtcggcagcgacttcataccccgacaatccccgtactcggaggtcatcaatgatatcgatgaaagattggagggatggggtcaaggcgagtttggcggtccaagatgaaatcttgtctagttgctcctcaggaacaataaaaaccggatccgaatcttctatctgaagatagaaccacctcccccgccatttgctgcgagatgaggggcactggaagaggatgtatcgcgacttcaggccatcccgaagtcggaaaccgacacatccagacacctttttgggttccatccaactcaactcatagtaaaagcggaagaggtcaagaaacggctctaccccaatgtaggcctcacaaagatgcgaaaagatactcatgaaggcgatggaattggggttcaaatggagcaaggaaagactgtagaaattcaagaccaagagaagaaattcagaaggcggaggaagaaaaccacagagaataaagtcctcgatcacaaccatgcgacctaggacaggttggggttcagtacctcctacttctctctccgcggtcccgcgaccgggaagggcgccatcctcctgcaacttctttagcgacgtgctggtggaggtagacttgtcgagatccattgccgccggggatcgccggagaaaggaccgagatgagctagctagggttttttgcgggagcggagaagacgagggacgcttgggggctggagagttttttcacaacaggcggacttcaaattggatccccaaaactcccttaaatagacgcacttccgacggtgcgaattccaaggaaaggagagagatggccgtcggaaatttctgggtccgttacgcgcggcagtttttcggacttcaatttaaattcactcatgaccgttgagcttcacctggcgttgtcgatcactccttgtctctcagtcctcacaccgagaacgacgacaacttcgacatcagaagtcgcgatcggtttcacgagttcatataagcagaagtcgggggctactgtcagggttacgggtaaggtataccctttacccttcgatatacgtcacatattgatatggtatacttgcgcgtatacggacgttttcggcatacgttaaggaaattcattatggagttcacagatggaaggagtcctactcggatagaactgggtcgtcattgtatcgtatcgggtccgatgtctccgagtcttacttggagaccagttgacctgtggtacaaaagggaccccccggggaggaccttgggcatcgaatcttaccgccaacacatccaccacagcctacgaagccggagcctacaggagccaagtcgccgggtgatctagtcgaatcaactcgactacgatctcgtcggtatcgtcgagttccactattccctttgtaatctgtggtttccatcatataatcccatatcaactggattatggctattacctatcaaggggcctgaaccagtataatctttgttttctgcctactcgatgtcgtattacgtagatcctcgtaccagcgtaccccaataccctctatatccggtctactggtaacccccgtcgacaatttcaattataacaaaaatgttgcaagaattgagaacgttgattatctaaaaaaaattgagaacgttgatatttagagccggcttttggcatacctttatcctaaaagctatatatcttaattttgaatttaaaattacattttggttgccggccttatttccatttttacaagagaatgacttaaatttaaaactgatatataattgttataaaaaacatattttacaattttagatattaaaaataactataaaaacaaagatatttaaagaccccgatgaaattgacacttgtctttgctttaatttggactcattgtgacaaactgaattgaattgtttgagaagcgatactttttaaaagccaccaaataggacttggacaccctactccctactaagggtggacaaaaaaaaatcaagaccgaagaccgacaatgaaaaaaccgtatcacgattaaaaaaaacagataaattagtcactggtctcctgttcggtcttagctgtgagaagaccaatcaaattctcggttcttagctcttatttattggttacccggatggccgaataagaccgcagttggtccaatgcaagggaaacatatcatttgcagtactatcctttgactttgagtgactgacatatagacccatgctcattaggcccacgtgtcattgacccaagtcagaggttaataccgcagaggagattcaccccaatgcgagatctgccacagtgccactgcgcggtcagcttggtttagaccgaagatcaaactgcggttcggttaaccggaacatggttttttagataagttcggtttttcccatttgcgcgattgcccggaccgatttctcggtgaggaccgaaatggccgccctcgacagcttgacgaggcaaccacgtgacgggacatcccatccgggccgtccattcctcccaccgacggccgatctagcctcgtattccgtggctccgaatattttaaaattcccccgctccacatcgtccccgacgcaaaatcccacccccaccatgtccaaagcccacactgacacgtgggcccgaagcgcactctggccccacatgccagtcactgcgctggccccgggcaggccgtgggctacggggcgaggaggcatctttctcgcggcggaaagcgagggggacgacgcggctcaggaatcgaggcctgtggggcccacctcccccctgacgccactgccatgtgggcccgggaggacagcgtgggcgccaccgcagcactgagaaggggaggagagtggggctctcggcgactcgagtgggtataaaatatggtctctctggatccatcccctcctcttcttccaatattattttttcgccttttctgttcgtgtgttcgtggtggagttcatctcgccttcccctcttccggtcctcccaccgctcctcgccaccacaaaccgccgccgcctcctcctctcctatctggtatcgtaatcgaaccagcggaaaccgctattcgtgtgcgtgttttttttctattcaatttgtttgctcgggccgcgtaatcttgggagttatctgcaatcagttttcttttctttctttttctttttttttttcattttgaatggagtgaatcgtgtggaaaaggtggctgttgtagagtttttagtcttaccatgaactgattgatctacgggcgagtgggaatttagcctgttcttggattttagcctggttgcagcatctagtgtaattgatccagtttgatttcttttttttttttgggaataaatcagtgtgaggcagcctatgaaccgaacataagtatctagtattagtctgtgagacaaactatccctggctctataagagggaaacctgatgtgtctgaaagaagttgcgagttcaagaattcctatctgaaaaaagcaaagatcaggcaaagatcatcagtttggatcatgtataaatttcccatgttgcagtatgtcttaattaggaggattattcattaacaaatgtcatgcgaaaaatttatatcttcggaaacaatcgctttatcattcatgagcgaattattacttcgattaggcggatttgtgataattgatgaataattctaagtaatccttgacagttcagtgatttggactggtactggatggtaggtgcccatctgtgtgcctttttgacttgtctatatgccttggtaccattgtgaaacttcatgtattcagtcttgttggattttgtaagttgcattggaatgatatgcttatgtaacattactagtggagctgttgccctgatatgttagaaattgtgccattttttgcagtgcggaggaggtataccacacctttggattttggggaagcagtacgttgattggaagaaatgtcaggaggtaggcaatcatactggtgctaccaatgtagacagcgggtgaggccccgcggccaggatatggagtgtccctattgtgattccggttttgtgtctgaaatggatgatgttgatgctctcatgcgccactttgttgggatggatcctgatttccatcgtgatccaagattcggtatcatggaggcaatctctgctgtgatgaggcatggcatggcgggaacgaaccgggaagttgatgtgagaggaaggccaaacatattttctgacctggagatggagtttggctcagggccatggttgctcttccgtggccagcttcctggtcatctctcagaagacaatggttttgatgtattcatcaatggacgccgtggtgttggcatgcgcagagcaaacattgcagactactttgttggacctggactggatgatctgattgagcaattaactcagaatgatcgacgagggccgccacctgccactcaatcatcgattgatgctatgcctactgtgaagattacacagaggcatctcagtggagactcacattgccctgtctgcaaggacaagtttgagctgggatcagaagcaagggagatgccatgcaagcatttataccactctgattgcatagttccttggctggaacagcacaattcctgccctgtttgccgatatgagttgccaccacagagctctactggtgctagctgctcgcgcacaagatcaaccaaccaaagtcagagttcaagtagcaatgggagaaccaatggacgtcaaaggagaaggaatccgttctcgttcctatggcctttccgatcatcaagctctagctctcgttagattagcctggtaatctggttggagtcctcaagactgtttaatcgaagatgctcataaaatgggtgttatgcatggcatcttatcgtccaatctgtaatgtatggcttgttatgatcaccacggaatgcttttccttgcaagtatatccttccacagcttcatatcagatacttcttttactattctgtttacataaaaggttaacgatagtatgatacttgtttagatagctagagaaggttattttcttaatgttgtattacttaatgttctacagcagaatatacttctgtcaactgtcattaagacgtttttttagctgtaaatctcaagggatcaatggtagcaagcatgatgatataatatagaagcaagttgcctgaaatttcagttaaataagtactagttaatgctaggttgtgtccttgtgtcatccatgttggcatattctgcctgattactatttgcctgtgcgttt

SEQ ID NO: 65969 - DNA, 1100 bp, Oryza sativa
tcataagcatgttaatttcttcacttctattgagattaatcaaattggtctatgtctgaacaaggaaaagcaatccgtgcaggttgaacttggaagatccagattaacacataaagaagatctgcttgatgataagcctgtagaggaggttacgctttttgatgtgcaaaaggtgaagtttgtccggcgctctggtgggtcaaatgacagtgcagtctgcgccctcataaatgtaacagaagtagcagtttggtgggaacctgatccctatctggagttacttgaagtagccactcgacttaaatccattatgcacaggatcaagcaccagaattctgctaatgagataaaagatgatacagtgtacacggatactttggcaaaaaaggattcactcacagaacatggccaacaagaaaaaccacagaagaaacaagaattggttattgccgttgatgtggaatctttgaaaatttcaggtgaacttgctgatggagttgaagcaatgattcatgttggatccattttttctgagaatgcaaagatcggtgttttaattgaaggactagtagttagtttttgcggtgcacggattttcaaatgcagtcgcacgcagctatcacgcatcccagtttccatttcagacagccttcccgataagaagttgcagtctgcagctacatgtgattgggttattcaatgccgaaatgcttatgtctgcctgccttttaggttgcaactacgagctatagatgatgcagttgaagacacattgcgggccattaaacttatttctgcagcaaaaatgtctgtattatttcctgagaagaaatctagcggtagcagtagcagcagcaaaaagagcaaatcaaaatcaacagaatttcggtatgtgagggtcattgtacgtgacctcgtagcagaaattgaagaagagcctatccaaggctggcttgatgagcatatcgatttaatgaagagtgtatttaatgagtcgacagtaaggttggatctgcttgatgagcttgcttcagtcaaacataaagactctcccaaggcaaaattggatggatcttcttctgaaaagaacaatggatgcc

SEQ ID NO: 65970 - DNA, 1033 bp, Oryza sativa
aagaggaaggaacaaggcatttcatggttaatgttgtccaacctcaattcaatctgcattcagaagaggcaaatgtgagtatactctgccagcatgtttctcagattataatttccaagcagcacttagcagttcaacaaatatcaggttgtttgttcaatgtatattcttctattacttcagtcataagcttgccatgcaatgaattaatctttatctccattcctctagcaattgccaacttatagcatataacaagattccaaaactaaccaataggagaaaatgacaggctttctaaagcaaaatccatatgtaaatttgaatttcaaatgattatgtggtggttttcatcagctggataatgaaaattcacattcaaattattctagatccaatatgttttcaagaaaaaatattgccaatagactctgctcgtaagctaatggatttaattgcaactttccaagctcatcttttgttattccttagtagtatcgtggtgttacctgtgggagattttttttttcagtatttgttatttacacctaaattttagtagcacttgtgaatgctgaagtgacttaattgcctgttcactaacatcagggtaggtttctacttgctgctggtagcgggcgggtcctggttcgttcatttcactcaattgtacatgttggtcaagaaatgtttgagaaagcacttggttccagcaatgtagccattggagagaccaggcctgaaatgtcttggtcacgttatgaagtttctgtaatgttggagcacgttcaggctcatgtcgctcccaccgacgttgatcctggtgctggtattcagtggctacccaaaatccatcgtagatcatctgaagttaaacgaactggtgctttgcttgagagggtatttatgccatgccaaatgtacttccgctacacaaggcacaaaggaggaaaccctgaactaaaggttcttaatgatttcattttggtttgcaccttccactgaccatcttttggcaggtcagttaaagtag

SEQ ID NO: 65971 - DNA, 3535 bp, Oryza sativa
caagaaatgtcatcgacaagtgcgaattctatgaaatgtcatcatacaagcgactttgtcctagaaatgccatcgccgttagggttccgtttaggggtggtaatgggtcaaggcccgtgggttctttcacaacccatctcaacccttaaatatttttagcacaaaaaactactaaatttcagccgtaccctttttggacccaaccctcacattttctaggctaaaatgttgggcccattaccacccctagttccgttagcagccctccattaagtgctataacatgaataatgcatttaacgggacaggatggatgaaaccctaatagcgatggcatttctgggacaaaatcgcttgtacaatgacattttatggaactcgcactcattgatggcatctcttggacttagctgtttgtcaatagcatttcttggatttttttttcgtattttagtttctgtaaattggattcaactgtagacttcattggataattgatatgttaggtactaactatagtctatttttcagaactaagaagagcaacctatcctatcccctggataatgacgatgatgatgacactggtgaagagtctgatgcagttgtaccagatggagtggaagaggtagaattagcaaagattgatgttgaaataaaagaaagagaatggaagatactgctcgatgatatcagaactttgtctgttggtagtgaaatatctgctgatgagacccaaaccccaaagtctgatgatgctacatggattgttactggatcaagagcaagtctggtacgctgcagagcaaccttagttacttatgtttaaatcctaatttgcataaagttactttttgttgcaatgaattttattctcctgtaaactgtaatggatagttaatgtcttagttcatatttgctttagtcatgaaacagaatttaggatcccattatcataatataaataaaataatttccttttatgtcgctgaatctattgtgatgtcttacataacatctgccaggtaaaatgtctgaagaaggaacttgttaatgttcgcaatggtaggaaagaggtatcttctatgctgagagttgctatgcacaaagctgcacaagcaaggttaatggaaaaggaaaagaacaaaagcccttcatttgctatgcgagtttcactgaagataaacaaggttgtctggagcatgttagccgatggaaaatcatttgctgaagctgagataaatgatatggtaatttaattcatctccagtgaagcataatcttgattttatcttctgatgatacattggagtatttagtttaatttaatatggagaataattatcgttattttcttcatcaagtagacaaatgtacatgccgtcctgctcttgcactaacttccctctttttttatccctaaatctgcagatttatgatttcgaccgggactataaagacattggcattgctcatttgacaaccaagttgtttgttctcaaaaatggacttgctaatgcaaaatcagatactgttctggcaccatggaatccaccttccgaatggggcaagtaaggacactaatatttttccgttacatggtgtatttggatgttcaacatatgatacttgtgatcacaactttgtttttacaaaattgaaatgctgcaataagtactctctctgttccatataacaagtcattttgggtttgtcctaagccaaacgtctttaagtttgaccaagtatatagggaaatgtagcaacagttccaacacaaaacaaatatactataaaaatatattcggtggtggatttaatgaaactaatttggtgttgtagatgttaatatgtttttccataaacttggttaaacttgaagaattttgacttacgacaccaaagtgacttataatatggaaaggagggagcagacaccagacagtatctaattttggcaacctaatttttttagtttctgtacattagatgcttctttcatactatagcaaacattattaagatgctagtattacattttctcttcaagtggtattcagggtttgcatttttaacaataatacgaaatagatgccatttcacagagctatcttaagatactgtaaaaaatatataagactcagttaccaatctgtgacagttcatgggcaatatttgccaactctaccttctctttaattaagctggctagaagtacaatccaataagaaacttctgcttcatgaaaaggaaagtgcacgctaattctgtagcccagcttgatagggcatacttacaatacaaggatggtggtaaatagcatgactagggtctgatctttgttttacagtttacatcatttcatattttctccttcatatattcatttaacacatatagtctagcactgaccaaactgctgcttaactattttgaactcagaaatgcaatgctgcgtgttaatgctaggcaaggagctccaactggtggtaactcagtaatagagagtctcctcgtaagttctctctctctctctctctctctctctctctctctctctctctctcttatgactaattcctaatgcatgtaatttttgtaggattttttcttcttagggctgaggctatgattttaagttttatttgcttctataatttttgtatcagattaatattatgaataagcattagtccggtgtaacagtacacttaatgtcacttttggctttatgcttacctgcatggtgaatgactgcggcttccttttacccccattactgtaggtagacatctatccactgaaaatttatttgactgaagcaatgtacagaatgatgtggggatatttcttccctggtgatgaacagcacccacaaaagcggcaggttaaatcatttcatgttctttgtgctatgatttttccagttctagttatgcactaatgcttcctccactgttacttatctagtatatttgtgccattcctttttcatcaataggaacttttcaaagtctccacaacagcagggacacggcgagtaaagaaaagcacatctattgctgaaacgaacagtcccagtaaacaatcatcgaaagactccatgcttttacaaaagcctgaacttcgacgcacatcttcgtttgacaggacgtgggaggaaactgttgctgaatctgtagctaatgaactcgttacacaatttcagagtcagtcaaatgcgccgcctgaatctcaagatgctcctaaggaagccaaattagtacgatctgctcgctctactcgtgaagagaaaaaaaatatggaccctaatgaggtgaaacaaactagacctcagaaaatgatggacttccgcaacataaacataagtcaggtcagcatatactttgctgaatgtttttctgtttatacaaccagctgaaatattgtatacaacctgctgaaacaatagccattttcattttgtttttcgctaactgaatgaaatatcactgtttcatctgtataacatgaatttggttctgggctgcaggaa

SEQ ID NO: 65972 - DNA, 1998 bp, Oryza sativa
tggatttgccacttctgttaagggattattcagttcacaacgaaagaaagcaaaggcatttgtcctgaagactatgaaaggtgacgctgatcatgatttccagggtgaaaggagtgagaatgaaattgagttctctccatttgctcgacaattgactataacaaaaacaaagaagcttatacgacggcacacaaagaagattaaatccaaagttcctaaaggtgcaggtgagataccttttatttgtttcaaggaagtgatactaaattgttgataagctgattctacctgacacccttaaatagatggagataaagataggcaaagaaaaaggactggttgtcactgtcacttaattgcattccttgttcttaccctttcttggaacttgaaagagaagagccgttttttttttaaaaaaaattgcttaataagaacatatatcatgcatttgtttgtgtatgaactatgaagttgggaaaattgcatcgacattcacccacgcacacgcagagagaattgcaaatttaccttttagtctttctacaagcggactcctggaaaatttacttaaggtcccaagatccaagatccaatgtcccttgaaaatattttagattatatatatatccttgaacaaggaaatacctctggtgcaatgtagcgaaaattcattaagccgctgggacgtatctgcccttcttggagcatttcagttattcagtactacttctgagttctaacatacgttcgtcctcttgttcagctacttcgcaagaactcgggtcagagctgccacctcgtggcccttctgggaaccagacggactcctcctcttccgatgataacgattcatcgccaacggaaacgaacccaaaagattaagccagcaccggctcagaacaattggctctgagcctggtgtccattccagcttcgggtcagcacatcttggcgatgggtcgagagctacgaggcatttgaattttgagaagattttgtagtaggtgtttttcagcaattctttttacccctcatggatggagatttgaaataagtggtactagcaagttatctgtcatgtaggcgactggtagacaagcttacggatctcaaatgtgtagatcgagagtttatgggcctaagcaaactaatttgtgaagtttagagacctatatagtgtattttactctagatatatttttattttctcttactacacttttaatcgaagaatgttattaatttcttctgttccaagaagatgaagtaatcctgactttgtgccagatatagccattgtttaccttagtttgccttctaaaacaaactacccgcatgattatatatgttgcatcaattcccagtttgtcacaggctcacagctctcaactactgagagcaactgagcaagcataaactgggttctgacttctgaaccactattccagttaaaacttctcaaaagagtttcagaaatgtctataaaatattatgttggagacaactgtatgaaactttgagattaaactcaacttcgtgtatgatatctgaaactgaaagaaaaacaaaaaaaaaattagaagcttcccttaactgcaaggagggtgcagcctaagagtagcccgggttgggcctgatggactaatgtaatgggcctctcctggaccggcccacgagctggcaacaaccaggtaggtatataaagggatagttcactatgactcccttaactaatgagccaatctgattcatatccttaactattaaaacagtgccacatatcaggtcaaaactatcacgtaaacgtgacggcagcaaaaccattcttcaaattgcactggttttaataattggaggtcgagatattcagttgaaggatactcagattcagtcattaacaaagtaaaatggacttatatggatgcaagtggagcgagcaagcgggttttttagcccgcttatctcacttctagtttattttttcttctaaatttt

SEQ ID NO: 65973 - DNA, 3054 bp, Oryza sativa
gttccacacgatgcgcgggccgtgcgactactccggtactcccaacccaagacgcggactggaccgggcagctcatcggagtatagggcaccatggccgcctcgtcgtacgacggggtggtggcgctgtggctgctctggtactacgacgaggaggcatgggaatgcgtgtgtacccgagtcgccgccgggttcctcgatcggcgacgtggcagggacgatggggttcttcgtcgcccacgtgagcgacgacggcggcggcggggacgcgctcgctgctcctctcatctcaggggcatcggtacggagtttacaacctcaggaggggcgaggtggtggccgccggcagggagctcggcggcggcgacgacgtcatcctcgcgacgcagtatgtttaccaggagagcttcgcttctccagtggcccggagaggcgtcggcgacggcgctccgtcgccgcgaggagaactggccgccggcgccggcgaggcgtcctcttcgagcttgatcagaaattctccaggattttatggagttctaatcttttctttactttctttaaaatatggtaatggttgttcatggtcctccgtatagtggcatgtgtgcttgccagatatgtgtgtaattttcatctagtagtggattaaaaatttaaaatggttacatttcgaccatcctgatgatgcttatcaattggccttgatcagcagtctgagattaaacaaatttgtttgttttttctaagcactacagttttcattgaaaatatatttcttttctaccaagaagatgtgaagtgatcctgactttgtaagagatataagacataaccgtgtactattcaaccttagttttggtgtttctcaaacagacaactaagagcaaacataaaccgggctttaaagtgtagaacatccaggtatagtacctgtaatggtcgtaatccattgtaaatttggcgaacactatggatatcatctaatcatcatgtatatggaagtctttaaaaattttatagaagccttacatatagaaaatatcagtggatttttacgattaaactctcgctctagtcaaatatatttgactttgcatcgaatatatttcactggagggagtatgtgaaaattgtcaaaaaaaaaaaaacaaaggaattgccatagctgcctctgccgaaatgccgaggaaattccaatggcttggtttgatgctgtttgcggctattaaaaactctaaggcttggtcatatgctccctaccggggaaaaaatgaattacctaaaatgtaaaacttgaagaattcaggtaccgatttgaaatttcattgagctcagggtgcgtttatttctttgggtgtaaagttttcaaaatatacggacgtacatttgaagtattaaatgtagactaataacaaaataaattacagattccaccctgctgtgagacgaatttattaagcctaattaatctgtcaatagtaaatatttattgtagcaacacattgtcaaattatagcgtaattaggctcaaaagattcgtctcgcaatttacatgcaaattgtataattgattttttttatatttaatgccttatgtatgtgtccaaacttttaatgtgatgtttttagctaaaattttttgatctaaacgagccctcaatgcttcagttggcttgaaaaagaaaaagaaccctaaaacgattgaccaaaacagcactacagaagaaattaaaggtggttttgatctaatcagctaattcctttttctaataaatggaaatctaatcagctggagtaataattgtgctggtcgatgaatccccagctgttctctgcaagacatgtacaagccaaagtagaacccatcttgattttttctgcagatgcaagataagagtaggcaggatcgatcgaccagctgatccggaagctgccgcggcgtaggctagctgtacagacagtgcgtgccgtgcagaggagatagccaagcggaccctctacatggtgcaggagtactacctacgtggatctaatgcccagacttcttgtcattcgatcgtgtgatctgcccagacatgcttatgcactcgcagtcttctttgttcgccctgtactactacactactcccatttcagagcatatatttagatcctctagcaaatttttttagcatatcacatcgaatatttggacacatatatagagtattaaatataaattaaaaaactaattaaattatatgtaataaattgcgagacgaatattttaagcctaattgctccatgatttgataatgtaatgctccagtaaatatttgctaatgacggattaattaggcttaataaattcatctcgcaatttgcaggcagaatctgtaatttgttttattattagtctacgtttaatgcgaaagggcatgtagcctagtagttgcaatgacctgagtagcatcccaaggtcctgagttcaaatctccatatgagcgaatttcagattgggttatttgaaggctaagttcctaaaataagccaaaatggctacatatatccggttggatatattatttcagattggattatttgagagctaagttccctatttgatatgctaaattcctaaaatcaaaatggctgcatatatccagttggatatagaggccggacaaaaaaaaatacccttctctaaaaaaatagtctacgtttaatactttaaatgccttacggcgtgcatgtttaattcgatttaccacacatagacacaccgtactccagttcaaacctgtgttagtttttcaaacttcaaagttcaagaatactagtagtggtcacctgttgtagtagtatactagtaccacgcatacatgatcacacatttgaagtattaaatatagactaataacaaaacaaattatagattccgcctgtaaactgcgagacgaatctattaagcctaattaatctgtcattagcaaatgtttaccgtagcaccacattgtcaaatcatggcgtaactaggcttaaaagattcgtctcgcaatttagggctgcaggaatt

SEQ ID NO: 65974 - DNA, 2196 bp, Oryza sativa
tgaaattaattttattcgttaagttattattatgtgatcttgaggtgtaggttcatgacttcatgttaagtagctccaaattattcttcattccccctcctccccctgaaaatcttgttctgaattccaatagaaaagttattcttcctttttcccctgaaaatttcgttctgaattcccaataaaaaggttataaatttatatgcatgaagttcatcgagttgttctgaaaatcttacagttcgttatcaatacaaagactacttcaagtcaaacaagcaggattctacctgatgagctcatcaagttgcacgggttcacaactcttggtggcaaacggccagcatatgacggaagagagagtctctataccaatggttcacttccttttgaatcaaaggagtctgtggtcaaagtatttgatccagaaaagaatgctaaagaaaggtttgtgtgattctagctaagaattttcttatgtaccgagctacatgtttctcaatattagattattatgtcttgcccttctgcagggcgcaaaaggaatttaagatcacaattgaaattgttggcaaaacaaacttgtaccacctccagcgctttctgctcggaaagcacaggggcatagcccaagaaatcatccatgtttttgatgttatcctcagtgataaactttctcggaagtatgagatctttctcatttgacatttgattgataacttcttgaccagggtattgacaatgttgtaaatacaattaccttttttgcagtcatgtcacagggcccagatcctttctttgtactcagattggtcaccagggttacattggtgatggacttgactcttggagaggttaccatcaaagcttgcgcctgagaaagatagggatttcactcaatacgggtacttccgttcagttattgcttattagttttcactgaatataaatattattccctctggtcataactatttgatgttaggacaatatttgatgaaactttaaccatcaataacttctaaaaaaacaaaaaaaatggtatgtgtaatgccttaaaaaagctatcagaaaattattctaatacaaaatttatggtcaaaatttcaaaagtttgaccaaatcttgacctaaatgttaaatatttgtgactggagggaatatttagatactaactaccgtttttgatctacttcattcagatatgtctgcagcatcctttatgcctgtgagaattatccaaattatagatgggttcctgaacataagttacacctcaagacctttgttagagcggaaccgtgtgcaggtaatattcctaccgagggaatttacaaaatgtgctatataatacctataatgactaacattcttttttcaacatgttcagctaaagaaagtattatgtcatgtttgcattgaaacaaaccaccatgatgaccaaatcggaagatataagataacagggatcacccctattcctatgagcaataacatgtaattatctttcctctcacggctgctgttatagcttctattttgtttgcatgctgtaagcaatgggggcaaaaatgtaccagatcgttgatacttgatataatattagaaaggtctgtgttaaggattctgggcatattggtacattaacagtatgtggattttgggcatttttttttctgccatagatatttttttcttgaacatgcaggttctgccttagatatctatctgtgcaattgaaaatccataactattcaattgaaatactgtgtaaatgatgcattacaaacaatttttcctgtccggatggagtatagcagtttgttgtcatcttttcaatagggcctacattttgttgttatacttgctcacttctttataacatgaataattactgttttattcctcccaaactgatgcctgttattcgatgctgttagatgtcctgttggtgaggaaggaacaacaatgactgttcttcagtacttctgtgatatggagaaaacaggtgtgcctagtgttggacattggaacatcgctgaagaggtgatgacatgcttcattgttataactcagtttcgcccaaaactcaaaataacttagcattgctttgttgaagcgaattcatggttacttgtttagcttttttaatgtttaggctcataacttttgttttttatgtggggatagccgaag

SEQ ID NO: 65975 - DNA, 2085 bp, Oryza sativa
ttgccccttttttttctcatttctcttcctctttttcctttttgtttgatgagggtccttctttttccttattattgcatttttttttacaatgatttgaattattgatgagaaagtggttggttggatagtaacaaatagagtaattttcactttggtcaccttttattactactggtgttttgttttggaccacattttaactaatgtttttactttgatccgggtaattttgcatttatgttattttggaccacccttaacttctttttctatttacatcaaacttgtcgtatttcaaataaattgtctatataaagcggtgtgggtttactgatgaatttgagccggcgtacttgaaatcattcatatgcttgagataagagttagagtagtccaaagtataacaaaggtaagattacctggttgaaagtgaaaacaccggttaaagggtggtccaaagcgaaacaccagtaataaaaaggtggtccaaagtaaaatttactctaaaaattgagtaaatttcatcttccatcactttatattaccctagttacacgatgaaataagaatttataaatttttcacttaataataccatctaatcttaccaaaacatagtagcttcgaatagggtactgagttgagttattgcttgagtttctaccatggctatttggtccatccatagaagaagaaagaggtgaacacaagggaatatatgtgtagtgcgacattaggagtcagcccactacttgttcttgtgcagatatggcaaggagctcaacattgcttgccctattgcctagcccaaggttcatcactagcacctctggtatgccaacactcgagctaaaacccctccaatgttgctaatcccatacgttgatgctcctatctccaaatagggcgcccgatataatgaaccactatctctactccgtcctccaaatcaggacacaaaccatcgcccattgggactggggacgctcgctgctgccctactcctgctcccttgtagatcaggttgccaccatcaccactctcctctctcggttagatccaagttacacattgattgggctgcacaacaccgatagtcatgcttggtgatggcaatgtgtgcacgcgagagagagcacacacgcaatggtgtaggtgcatgggtgatgccatgatgtgttaccagatttggaaaatatgaggatgtggtcttgagtgaaacacatagtaaatagtaaagttacacggtccaaagtataaaatatgggtaagctatcagaaacaagggtaaaaatatacgagccaaactacaatttacttattttttttctttataaaacagctttacaaacacatattttgatgatctaattatgtgaaaaacgatcactttttttttgacagctttgatgccaaagttgcattatacatcgtggctttgtgtttctaatgatgcattttctattagaatttaaataattgatatgctaataaataattagtcccttttactttattttttattttttatgtcatttgtaaatttaaataattttttatttgttaactaactcgaaaaaagaatgtcgccgacaaatggcagacgtcgccgcgggtgatgggacgacggcccattacacagcccggcccggctggcacggcccacacggccacacctcaatcctcaataggcgcacgtgcgacgcacgcatctccctgtacaaaaccctagccttccccatcctcgcctcctcctctctccccccgcaccaccgcctcccctcctctcctctcctctctcccgccgaccaggagaaagaaggaaaaagaagaagaaaaatcctctgcgatggcgaagaagaaggagagggcggtgaacgtgtcggggaagccgcgccactcgctcgacgtcaaccgcgccaatgacaagaagggcgcgggcggcggcgccgggggcggcggcggcggccgctcggccgccacggtgcggcggctcaagatgtacaagatgaggcccctcagggaccgaggcgggaagatcctgaagcacgacctccagtccaaggagctccccaacacccg

SEQ ID NO: 65976 - DNA, 5608 bp, Oryza sativa
cctgcagcccttgaaaccttttcgaaacgtcggtaaggtatgcttgattggtggttatggcttgatatacgatcaaaatgcgtagatgccttgaatgaacatttccctgttgcaatatttctacttccagtttgttccacatttgattccggtgacgtaacagcaagtctgcaagtgtgcttatttctgtactgctctgctcttgctacttacaggaaatacacgagtcgttaatcagaaagagcttgaattctttcgggaggaactccagagtcggctttccaataactataatgtgatactgaaagagcggaagcttccactgtcactactgcaggatcatcaaaaggtacaacttcttttggtcattaggctgtcgaaaatgttgggtcttcaatctattttggacattgaagaattaagtacttttgttaaaatacatggtgccttccattttaactgtggcgaagtgctctatagtctactgtctatatcagtgtaccgtatgttgcacttatgtatgtatgtttgcccctgttgatgatacagcaagctagggcgcatcttcttgacactgaaccttttgagcatgcatttggaccaaagggcaagaggaaacgcccaaaactaatggctcttgattacgaatctctattgaagaaagctgatgattctcaaggtacagtttgtatatatgtacccagtactttaatcgcttaatatttttagttatatgtaattactgatatttatgaagaacacaatttcctttaagtttgaaatcctattttgcaacttggacaaatttatctcatgtacatgttgcactcatattccaaaaagatcttcaaattttaatttgcaggcctcctggccattttgctacttagaatcattaatgattgttgtagactattcttggccttgggtatttcttattttcagaagtcaattacatgagcttgtatgctgttatttatcaagaataccactatcaatgtcctgtactcttagtaaaatgttgagttttataggtgcatttgaggataagcatgctacagcgaagttgctgaaagaggaagaggaagatggcttacgagacctagtccggcacacaatgttcgagaagggacagagcaaaagaatttggggtgaactctataaagttattgactcttcagatgttgtcgtgcaggtaagtgttgtgacattttgtccttgcaaaaaatactctcactctgtcaaaccatccagacatctttggtgctttttttttttaaaaaaaaagaagtgggcattgatttatttgttgatcctattgttttgcacaggtgttggatgccagggatccaatgggtactagatgctaccatctggagaaacatctgaaggagaatgccaagcacaaacacttggtattcttactaaataaggtattgataagttccacaacaatacacagtgcaaaagacggactattttcatccttgtatggtggcacattgatgaatgatggtatacattttttagtgtgatctagtacctgcttgggccacaaaaggatggttgcgcactttatcaaaggactaccccaccctagcattccatgcaagcatcaacagttcatttggcaaagtaagctagcagaatcctgaagaagttcattgtttcaccataaatgaccccttacgcatttgaatcttttccagggatcacttctttcagtgttacggcagtttgcacgcctgaagagtgacaaacaagctatatctgttggttttgttggataccccaatgttgggaagcatcagttatcaacacgttacgctccaagagtgtaattctcttttctttaaccggcttcacagatgacatctttttggtgaactttctgagtattttgtttgtatactatatccataggtttgcaaagtggctccaattcctggagagacgaaggtgtggcagtacattactctgactaaaagaatatttctgattgactgcctggggttgtgtaccaaaacaatgattcagaaactgatattgttcttaagggcgtggtatgtatctgcacttgttcgtttttgtcttcactttttagttagattgcacaaaacaaagcatctagtaaaacacctcactatattttttttcaccttgccggtacttttatgtacgacagatatatataatgcattttcgcaaacattatttcaacataagagttagagatgggcttgctgctgctatcttggtctgaggtggtatagaagtcccatgggtagcttttaccctggacaatctacaagactataactattgcctatctgtccggttgtccattaatgcttaaaaaaaattccagtaacacccaaggcaatccaaggatagtgtggattatattttatagttgtttattgcccttcagatatttttctgtggtcacacgctggagcactgccacttttgaagcatatatttatatttatatggatgtctatcctagttgattaccaggcattttaaagatgctacgtttgtgtacttatctagatgggtaatttcattcatcatgtatttgcatttgttgtcaggtgcgtgtgacaaatttggcggatgcttctgagcacattggtgaagttctgagacgtgtaaaaaaggagcatcttaaaagagcttacaaaattgaagactggtatgcttcttttaacatttagtttatggtttcattttaacaattgttctatatagatatgaacataacgcttattatttccacacaatgcgttccctattggataagtatgttagtatttgggttacttttcttttctcataaatctgaacattaagacttggcattttttatgacactattctgttagtttactcatagcatatttgctctcttttgataaagtatatccatgaagaggatgcgcttgcttgtagttagccttgtgatgctgttgtgcatggaaacaattaaaccattggagacagcacatatcttatgttggatatgttatctttctgcagggttgatgataatgattttcttgtccaactgagcaagaccactggaaagctactcagggtatggctttagcatatatgttgacatgttgtcagtcatgtttctatcaaatatattattcttgtggtgaggctttatgagattggggaattggagaattgtaattgtatactgatttacagtgttttacaaattttaacaatataatgtgtcaataagatgggttaattggatccatgccattctaaatatatgaacagcttaaattaaccatctatagaagattctgagcaaaaaaaaactatctttagaagattaaccaacaatttctgatggtgcttacacttgtggttcacagggtggggagcctgatcttacaacaacggccaagatggtgcttcatgactggcagaggggcaagattcccttttttgtgcctccaccacagcaaggtgaagatagtccatctgaaacagctgaacctgtggagaaatccgatgaggaaggggtgagcagtgacagaactgctgccgccatgaaagcgatagcgggaataatctcatcacagcagcagatgaatgttccttgccaaaaggaatttggtgtaactaatgaagatagtgaagtcgcggagcaatcagagtgatctacaaaaggctaggaaccatgcatgataaagaacagggcacaattttgccaaatacctagagattttatgaagatttggtgtctaacaggaatggtacgatgaatgttacgatcgttcagttcaccggtgcgttctactgcaacgaaagagcgttcactgcaacgaaagactggaatcaagggtgtgggactgggaaacttctgtaacttcatatattgtgtgggcctttgttgtagaccagatagagtgttttggtagcttaatataaccattttgttccaactgtacttgaaacaaatttattccaatacattaattccgcaaagtcgttcgtatttgtatggggtcaaaagtgaaatactcttttgttgacggtttaccttttcgtttcacctgcttggctgctgcctgaactgccccttgcttatgtatgcatccatatgggccacaaaatattggtttgttatcgttgggcggacctaaccattgaaaaagggaggaataagtctattatccatccctcaactttacgtcgagtttaatttccaatcctaaatcataacacaaaaaatcttcacccctatcttgataaaaccgtctgaatcaggtcccataacagtatggatggttgcttacgtcatcctagtcacggaaaataaaatgttacatgtaagtgattgagaggatgagggagaaagggtagttgttcgggctcccacgtaacagtgctgaggctgccaccagagccaccgccacccgaatcaatcctaacgagcgcccttcgaggactgcctcgccaccgttggctgcctgactacagtgaagctcacaactagccggaggagcttatcagtatgaagatgaggtgaagagaagaaaggatgtggaaagtagagggccactttgcaagtgagcccacatgtcttaaatttttttttactgattatgatgacacgtcagtaaaaccaaccatccatactattatgggatgggacctgacttgaatgattttattaagatggggtgaagatttttagtattgcggtttagggataacaattcaacttgaagtaaagatgagaaacaacaagtggacttattcaaaaaaaggatgaagtgttatgaaaatttccaactgacggagtataatttctgtaaatgtagcactattttttttatctattctaattttggtcattgctatgggtttagggttcatagggggtataaaatttggatttctaatttcttttagcatggtgtcgtagtcaacactaaatagttgaattaataaatatgaaaatttctaattaaactggcaatacgactaagaattgtttatgaaaaaataatatcatttatgtaggtttcagacggttttcatccaaagaaaaatgttttgatgctctgaaaggggaaaaaaggaatgtgtttctttaagacacagtacaagcatagacaattataaaacacgcaccctcactcttataaacatacacacaaacaccctacctgtatgagtgcctccagaagactagaccgctatcaacgggtgtgtcgcttaccgctgaaagaaaattagccgtaaatgcgagcacccgtgtcagtcgtaagtctaagacttgaattcggatgagatggttccaccacaaggaacctaaccagctaaactatgtccacttcatggaaatgtgtttttttaagaattaaaaggaacttttaatagttcaaagcgcttggcatgtacaagttcacgatttggaagatcataagtgccacatttcaaattgtgaagtttaatttgcaaatttcagaaccatcctcgttaccttgtcttggtgggttaatcatgacatacatggcgcaaggaaatcttttacaagaactatttgaaacttcatagttatatactgtcggat

SEQ ID NO: 65977 - DNA, 2895 bp, Oryza sativa
ctttagcggggtcaataataacccaatcatcaagccgggcggtgccaactcaacatagaacattaattgggtgacaccatgccaaagagaaaccatggtggtcaggcctaggcctagagcatgaaggagattagtagtgcaggaccgcatacagaagtctccatggacatctcgattgatcacgattaggtaggctagctgctagtcatcactgaaaactattggaagtcccattctttttagcaacaaaatatatatatcatctcaacttgtctcttgcatcaaatccattggctcgcacagtactatggcgctatggcaattggcaacactagatccatggggttgccttttggtttggcaaccaatgcttgggcctcagagtgtcttgcttggacggtttggagacttttgaggcgctctagggcaggacgattcaaggtgcagagattggtgatataaggacggagatgaatgatacgagaaaggagatgaatgatgtgaaattgtggaacaatcaagttgtgtgaaaagaagtgacaattaagatccgctgaaatccatctcgtggagttaaggccaactctagatgatccggacctatgtatactactaaaaaatcgaacacgaataagtagggtctcaacatgagcccttaccttttgtgctagcatagttgccaaaattaagaatccagacgatgcatatcattcagtcaatgtttaatgcatatcccatattaaacaagtttcatggttctcaatgtgtgcgttattcataggaattaaaagaggaacttcaaaattggaacatagcatggcacaatcaatttaaaaaatgaggtcgttggacaaagtcatgcaccgatagaggctgtggctcatgcaatcttactagcaaaggtgagacgaataacatgaacacggtagcgtcgataaagagaatgctagagtgttagcaagcccaatcctgtcaatttagtggcctggagcgaagctagaaaaatgggccctctaatacaactatagtaatgtgcattttgggcaacatgatttcactctaaatttagaaataagcaagtgatttatgaaaattatgtcatactagattcaattcaacgttataataaaaatgagtgctggtaaattaccaagatgagaactagagaaaatgactattcactgtcctagttgcacagctgcaccgcaaggatccctaaatcctaaatcaaaatttcagaaattagaagaggagcaattgggagtaacattttgcatcccaaaatttaaacacataaacttagcatacatcaaaggggagagcaattgggtacctcctagtctcctagaattgaacagagagatcggatttttgcatccggctgccagttgcagttttgccgccgagcacgacgccgtagacatgtagccgcgcgcagtcgtcgacgtagcattgcgtagctgagacgcggctggaagggcggcgaatagccgaacaggcgactgcgagcgaaggcgaagcaatcggacggaatcacggaaggaagccaaatcgacacaattttttttcctgtacgtgtgcctcttcatctactgagctagtgggcttcctaattcctataggctattatgttagcatatatggggttgggcccccatcacttcgcgggccctgtgtggaggcccagctcgaccccctagggctgggcctgagtgttagctcagaagtcccacgaaatagaatgtgacatgagcgaatggtggtggcttggtggaagtcgacgaggagataataatgatgggaggttttggcgaatggcaggcgggtaattttctcttaatttaatgggcacttccatatttcattcgcttaattcttttggggaaggcaaataccacaccacatgccttgtgtaaaaggatggacagactcttgttgatattactggggaaaccgtgtaacaaatactcatttggtagaattcatcttgaaatttgttaaaatcacccaattgaagagacaaaatagtgggccgttcattagtttagatgaaaaatctggactcttgagtaaaattcgcatagttgcatgaccggatttaatgtgagaacgaaaaatcccgcgtccccccaacgaacccaagcgctagagagagggaaaaaaaacctctcgccgtcgcatgcactcccggttcgctttccctgctcccctctcttctcctctcgcgtcgtgctcgtgcctgcccccttcccagttccctccctttggcttggtttctctcaccaaatgccaaagccaccatgccttctctactactactactactactactactccccaccacaacatcccgcagccccccctccccaccgcctccttctccctcctctccgtcccccccttctctccccccctccgctccccaaaacctaaccctaatctccacgcctccctccccgccgccgcccgccgctgcgggggctcgactccaccctccgccgcggtccctcccgggggacctcgcgtgcgcccgcggccgccggctcctcctggttctccctcttcctgcttgcgtctctgcgcgcgtgggggcgggggcgcggtagggtttcgggatggacccgcggcgccctccgtcgcgcgggggcgccgccgccaacggcggcgggctctcctactccaccctcttcaacctcgaggtactgcctgctctctctctctctccctctctgtatgtgcgtgcttcggtggatggtggttttgacgcgcgcggtagtggcggtgttggagtggggggcgcgttgtgattggggtgggtattggtagtgctcattgtcgctgggttttggagaattctctccgggcgctgtatcatcacttggttgtttttttaag

SEQ ID NO: 65978 - DNA, 3556 bp, Oryza sativa
attcctgcagcccagatcttcatgtagacttgggctactttagtggcttccaccgatcaaagtttcgtgtgtttcagatagtgacagagtgatacgagtatcgtgatcatctgttgtgccattcatgtcgctaatcaaatgttgatgccggtaacttggtcgttatattcatgcaacatttccaatatcgcatgcgcgacgatgatgaccttgttttgttgcgattgcatgccatttcttttttctgaatttagttaatgctatgtttcgttcatagatgagtattgtcagttgctggcatcatctgtgtatgttcctgtgttgtctgttgtgattgtggtctgcatggcgtgcaacatgctgctgcactgttatcattgttctggcagttttgttgttttttttatcgctgttcttttattatttttcttgataagtatggtcatgcataataaagttttttttcttgacatgtgtgatccttgcttcgggtttaaatttattttatttgataaggttatgaattgggggcctgcaagggtacattggtttactacgtaatcgcatcttttatcttgtcatcctttgtttttgatactactatagtgttattgttgcttgtctatccgtttggtctatatggatgcaggtctctttatttgtctttggtagggttgaaaattatatatagattttgtcattgtgaagcatatgtcttcccactcatgttaataatatggtttactttagttgaatttacctccattctgatgtcaagtttttacatgaactgctgatgcagcctttgctgaactttaaggtccccttgccggaagatcttgatcgctataggcgtagtagcccaaatgggagtatgagtagccaaggtaaaggctatttaaaaaaatccacctcctagcattgacactccatcaaattgtggtcttgccatttctttacatatatctacttctgtgtttgttctgcttaccctacttttccttttaggtcaagggtccttgtcagaccagtataatggaattaatgatgcttcccatgggctacatcggaagcgcaaaaggaatctggatggtgctagcgatgatgatgaggtagatgcctacagtaaccaaataactgaggagcactaccgtacaatgctgagtgaacacgttcagaagtacagaaggtcaaagtttaaggaggatgtttttagttctgatcctcctcaggtgatagttcctcagaaacacaaaaatggtagtgcaagagttacaaagtacagaagtgatacaaggaatgttgcaatgttgggtggggtagaagccacagctgagtataatgggacaaaatctactaatgcatatggtggtttcaataaggttgtagcttcactggattcttcctatttagatatgggagataatgtaagctacaaaatcccagaagggtatgataagttggcactatcccttaatctacctgttttttctgacatacgtgtcgaggaaactttcttgaatggcacactagatttacgcactctagcggcaatgctcagtacggaccaaaaatttgagacaaccaatcgtggtggattagctgaacctcagccacaatatgaatcactccaggaaagggtaaaggtgcagaaattttctcttcaagtaactgaggatcccttcgcaattccagaaggagcagctgggaggatacggagatttattatttcggaatccggcagtttgcatgttcattacgttaaagtcttggaaaaaggagatacatatgaggttggttggacctgttcaaatattgatagcatgcttttgttttctatatacttagcagttaacctataaatgcagattatcgagcgtagtttgccaaagaagcaaataataagaaaggatccttctgaaattgcaagagaagagtcagaaaagactattaaactttggcatgctattgctgttaaaggcattcctaggcaccacaggaatttcatggctttgctgaagaaacggcaagtagatgctaagcgtttttctgagaattgccaacgggaggtattgcacttctctatcttgttggctattttgtagtttggttcactctagtttttgatcttgctgagttaatagcaatgctgcagctttattgagttttgtgtttaaaatgtccaggtaaagttcaaagtaagcaggtcactgaaattgatgaggagtgccgccatacgtacacggaggctggctagggatatgttgatattttggaagcgagttgacaaggagcaggttttttttaatctcttaagcttattgttttttagttccactgaaaccaaattcggaattattgccttttattttttttctaaacaacagtatatggggctgaatactatttaaatacttaaacttatgagttgtatatggctatgtatttcagttcttccaagccactgaactgaaaccaaacaacagtatatggggctgaatactatttaaatacttaaaattaggggttatatatggctatgattccagtcgttccaagccactttaatttctatatacatggttaaaacttaaaaattagcaccaagtattgtattgttttgcatagcacatgtttttctttttgctgatttttcttatgcgatcttatgatgggagttatatatcttttttttttgtctgtttcatagtatgaattgaggaaaagagaagaaaaggaggcggctgaagctttgaagcgtgaagaggagctacgtgaagcaaaaagacagcaacagaggctcaactttctcctatcccaaactgagctttatagtcactttatgcagaataaggctggtgaatcagcaccatcagatgaggcatctgtccctgaagaggatgaggaagatcctgaggaagctgaattaaagagagaggccttgagagctgcgcaacatgctgtctcccaacagaaaaggatgacaaatgcgtttgatagtgaaactgggaggcttcgtcaatcatctgactctggtattccaactgatgatttagctagtatggagcctaacaagattgatctattacacccgtaagttccactcgactggtttggttgtccttgttcagaattgagcatgttagaaagaatgaaaggacttctaacactggtttctttggggttatcttattttcagctcaacaatgcctgagaagtcgtctgtgcagacaccagaattgtttaaaggtgcactaaaagaatatcagttaaaaggtttacagtggttggttaattgctacgagcaggtacactgttaaaaagttaatgcatctgatcattttctgtgacttctctgctgtttcacttcaatattttctatttcttgcagggattaaatggtattcttgctgatgagatgggtcttggcaaaaccgtccaggctatggcattcttagcacatttggctgaggttggtgaatttgccctttcttaaatccatgttatctttctactattggattaatacccaatgaagcaatctcttttggccttt

SEQ ID NO: 65979 - DNA, 1150 bp, Oryza sativa
  unsure (1)..(1150): unsure at all n locations
ttgtgggtctacgcgcttgggagagtccgcgtattctgttgtgagaacatccgcttgagcttaacttttcctactcttgcaattttacttcttgctcgactcaggtgcgtctttgactggtttcttctctcctccggtcttcggtttgtcgttcttgcgtcttagtgcgtcgtccgcgtagnnnnnnnnnngcgcatcgatcgacaattgctcccatcatatttcactattgctcctggtcagaatctttcaggccatcggacatctcgaagtgaacgaccgaaagctctacacccatcgctgggggcggtgggttgtcggcgatcgtacatccttcgtggatgtctatctgatgttgaggatgaggaagatgacaacgatgacgatgggtcgcttggttccggcgtacgattacgaggacatcggctgggttctcgagaatcctgtcgtcgtctcccgttgttgtttcggcgccgatctccatcatcgtcgtcattatggcgacgtcctcgaccagtatcacccagcacccgccgttcgcgatcgtcgtaatcgtggcggttgtggcggttatcacggtctcggtcttcgctcgaatggcctcctcgttcttcgttatcgtgacgccgtgaagagacgcgatgtcaggaatggttctcattgtctcgtgtgcgtagcgcctctcggcagccattcaggtgatcgcggagatcaccggtgctgcgaggtggaggggtggctcgatgaggcgattcccgctgttcagggttttcaccattagcatcgccagttggtggctgttccgggtgtgctgcagcagcggcctcttcgaacgcgttgctgaggttggtcactgattcccgtaaccgttctgtccatcgtgcgagatcgtcgttcagaacgggatcgtaggtggtttctcccagtattgcattgacaaccctgatgtgctgggccggtggtcacttgattccctgcttccgcattggcgcgcgctgacgtgctggtctcgtcgataaccaatacctcgcgcggcgtattcgttgacgatgagccatagtcttcgagcagctgcaagactgatggttcgtggggatccatgtcgattactccaacaaatcgatctaaaattagcgtcgggctgcaggaa

SEQ ID NO: 65980 - DNA, 902 bp, Oryza sativa
ttttgccctttctccacagagatgctagtttccacattctcattacaaattatcagatacttgtgaatgaagagaagcttttgagacgtgttaagtggcaatacatggttttggatgaggcccaggctattaaaagttcaagcaggtaacaattcatcttgcaagtcctttcattttgttgaaaaccaaaatttcatggctcatgcctgtcttcatttattcatctgatatttttccttcgttgagactcttatctgggaattattgtattttatcttttcctccctctgctgcagccagcgatggaagacattactgagttttaactgtcgaaatcgcttgcttctcactggaacacctatacagaacaacatggctgagttatgggcgcttcttcatttcatcatgcctactttgtttgacagccatgaacagtttaatgagtggttctcaaaagggtacttacctacattacaaattatacattctttgttttagtcattatctttattgcttatatttctttggcctgccagaattgagggtcatgccgaacatggaggtgctctgaatgaacatcagcttagtcgactggtaagatacacagccctacactgaacggaacttttatgcatgttatggtttagttaatcttttgaatagtcttgtttgagactgacgtggaattataatgagggcttgaattctcaaatacagtacatgactaaatgacagatgctcaattctcctgttttggacaaagttctgtatagctttggtatatttttgagattatataacttgttctttttctccacagcatgctattttaaagcccttcatgctccgtcgagttaagattgatgtcattgcagaaatgaccaaaaagaaagaagaaattg

SEQ ID NO: 65981 - DNA, 963 bp, Oryza sativa
aatgtatttattttatctacacaagctatcaatgctcaattggtgctactattgaatgactcattacccttttctttcgtttcagataaatgtctggtgcgcagaccgaaattttgcctacaagttaactgatgagatgcatgatccattggccaagaaactggttctgggatttgctcgaacttctgagttcaatggccctagagaaccaaccagccctcattctctgatagaagaattacatactgatttgccattccccgagccgatgctacaactgccatataggatatttgggtcatctccacctatgagtaactttgacccagctaaaatgcttacagtaagtgttctctaatttcctctgtccatgatgctagggtattgcctatttagatttttcttcatctgcacaattctgtcattcatagttgtatttttttttcccaatgaactgctcaattgctttgaaaagctctaagatttgtgtagaatataactttatcataataagttggttcaaacacctgaataaaggacaaattgtttgtgttttcattaatatgcttttagctgtaccagtgagttctttttactaacatgaaatgctcaatgacaggattctgggaagctccaaaccttagatatactgctgcggcgcctccgagctgagaatcaccgtgtgctcttatttgctcagatgactaaaatgttagacattcttgaggtagtactggtcacttcatgcttgtccactttacacttaaaagtataataccaccataaggtaattgagttttttcttaaaaaaaaaactaaaacaagtgacttttgcttgcgccttttactcataagtgatatagagattctctaagtgcctggagataagttgttttattgcatacaactttagatatgtttttggcattctgcaagtcaacaatctttggtcaattatcagat

SEQ ID NO: 65982 - DNA, 1319 bp, Oryza sativa
taaaggttgcaaagctttcttttaaggggttacctctgatgaagatcacacaagagtactatatcctcaaacaagaaagagctacagtcagctgtgtccatggctgaacagtattgtccactgacccaccaatccaatttgctaaatactgatgtactgttgtcaatgccatctggttctaatgcttgcacaaataaaggtaagatatgtatttcaacattgagaattggatccaatcctccagtttttgataaatcaatcttaaggtccttgatgccgagagcagcttttggagcctacaataagttattaccaaatagtcatcagaatatacaagacaaacaaacaaacactcaacaaaatttcaagtcactgtgactcttgttaaaccctcatgtccctagagaaacagcgtgatttgcaaacagtaaatgagaatatattgggagaggaacgtgagcataaaattcagcagtaataaatagattaaatagataatcatttttcaacatgaacctattcatacaaccagaacataaaaattagaagacatacggcttgaattcaattaatcgacatttataatgtatttgacaaggtggcggtaccttgaacctcagctccactatagaaagcgacaaaagactggcaatgtttgttataagcctccatttcccttgtcctttcggctttccttttccttttgccggtgaggtcgaggttgatttgcgagggggaggtttctttttcttagcagattttgcaggttgcctgagcacaatgtccaggtcagagatttgcaattgcaggatagggccatggtttagtatggtaaatcccagttgggtgagtggccttcgcaggccaagtctaatttcacctacacagatggagtcaactgcaccctgaaaagcgaagcacacgagaatcaatcgcacacatcggcattggcatcggcatcgacagcagcatgaagtaccaagaattgattgatgaaactaggcaggcagattaggtacctttggggattttatggtgatgtccctgagataattgaagctgaaggagcggcatccgatggagagcttggccgtgcgccgaagcacccaggccacaaccctggcaaggaagctgcaataggatcgaaagcattagattcattcttagttatttctttttttttttcagaaaaaaaaaaggaaatagtacattgatcatcccctctgaagtctgaagagagatatcagacagcatatatggaattgagcgatgaaactgaaaccggagcaagaggcgggggtttggtggggggaggaggg

SEQ ID NO: 65983 - DNA, 1471 bp, Oryza sativa
cattggtaaaaagattgccatcatcgagtttgggtcattacataaattacataaagatgctctaattttctaattgtgttagctacaacgatccatagagtgcgcttgaaaaatgtctattgtcattggattatattttttacccgttgcaacacacgggcatttttgctagtcaatataaatgtgaaaaatgttagaatgacttacattatgaaacagagggagtatataaaagttttatttacaaattatttttcgtttgcaaatatacctaataaaccaaacgatggcccggtgagtttggaagggatatgcttgaggcttaaccggaacgtttgaacataaaccagaagcaacacaattacaacgatcacttgcagtccaggaaaattcatgtcaagtaacaggaaggcaggcatgaagctaggtgaatttctattttctagcatggcattgcaacagtggcacaaatcaattggctgctgagcatgattagcctcatttggatgatgaatcaggaaccgagtacaaagttcatcgtgtctggcaaaaacggcagctctggcctctggccctggccaaaggtgcaaacatttctacagagtggttacagaaacattcactcacttcctccctttgttcttccgtttaccctttgcagcacctcgcttctggtcgcccttcttagatttactcttattcctgaaggttctcttcgatggcttcttctttacacctagactagcactcttcttggagacgctcttgttggcgtagcccgtcgatgcaggggtgatccttttcgggccaaggtcttcatcgtcatcttcaggagtgatttcgctcgtggtgaccgtaattttagtcccaccatcttcgtatgtttttacttctacataaacagaacaacttatgaataataggataagaagtcatggttgtacaaaggtagcatggcaagagctgttactaaaatctggtcaatggtctcaccaggttcaggcaaatcatcagtttccatttcatcaccatcattctcaacatcttcaccatcagcattatctgatgacaggactcttccatacagcgcaatttctttctcttgctttctctggaacaaaatgacatcactcagtaaaaccacaaggaagtaatctggattgtatagttcatgttataaatcagccacagtaaacacacttaagcataatccacttgaaacgacactaaagccttgcccctccagtgtcatccctacaattctctcttggtctagtccgttttctaatccaagaagatctgggtttgatgatactttttcatacgaaaaaatgagaattatgtacccataacagaaagcaggtacccacacataattcagctgtgaagactgcgttacaaacagccgctaagctaggcgctacgggtgaaattaactgcttttgctgctatgctgacgggctgcaggaat

SEQ ID NO: 65984 - DNA, 3653 bp, Oryza sativa
cctcttcgcgctactctcatcagaaaactactccaccgaggggccgaaaatatcgctacgaatcaaagaaaagattagaggacggacttgagggctttcttgtcgagggagacggagagggccttgttcttgagggcgcgtttgttgatgtgcttgggcaccatcaccgtcggcatctgccccaccaccacgtcctccgcctccgaccccgacccctccatctcctccccgtactcgtactcctcttccaccgccgcctcctcctcccacgccatggctacgaagttcgctggctcgctctctctctctctctctctctctctcttgtggggagacgaggaaggaagccgccgccgccttcgtgacggccagcagcggaaggggcagctaggttacaagagatcacgtgcaagccgcgtgattgatcttgctcgtctctactcaatttgcacttatacccttaaaactagggataattgaatccacgttattataaattttagcgtattgcatatcgttagtattcacctatttgcaactataccattataattttacaagtatattgaaaaaacaccacttcatacccattcgctccatttatcaatctttttagacgccatgtcttctacctttatcccttcttcctttcccctctctcccagccaataactccgacgagcgtgtgtagtcgaccaaccacccacgctgttagaagatctggagcaagatgccacacgtcgctgagaaggagctggagaggggcaggccacccagtcgggacatgctgcttgccacgggatttgatcgctgccaaatggagtgatgtctatcacacggttgtgttgtcacattgagacttggagtgagcagatgctcatctcaagcagtaatggcggcaacaactagctagaacatgcaagcctcccaggcaacacgtgtctcttttcttggattccatgaattctcgttcgagacttggagtgagcagatgctcatctcaagcagtaatggcggcaacaactagctagaacatgcaagcctcccaggcaacacgtgtctcttttcttggattccatgaattctcgttcgtgccagctgactacaacataccgtggggctgcgagtcctcagaagtatcccacacagtcgcatcatggacttccccgaggtgtcagaggcattccaaccggccttcgatgactttgtcgctggtgccgcctcgccattggttgagcaaatgagggggtgaaggaataaagggtagtttggtcttaaaattagtgaaaacgatgaaaggggtcttcagtgacattgctccaatacttgtgaaattataatgatatggttacaactatgtgaatagtaatggtatatttgaaaaatgtaaaatttataatgggatggttccaattaacccttaaaactatgggaactattccgaattgtgcggttataccctgcgggattggaagagatttgtagttatcccctcatgagttttcataggccagtctggtcgcacccattagtagcgaaccaaacttcggtgggcctaatttggtttgctaccattcatagcgacccaaattctagtcgtcccaataaatctgcactgttcgtagtgatccaaacccgataatatctatcgttattagcgatccaaaatttttcaattgaaccaataagatcgccaccattgattatgatccaaattatctaggaagagagaatgagaaagaagaggtgtaacattgcaggagctgtgatttcatcaccactgtcattctatcaccatcgatctgatagatcaagctgagaaagaaactgagcatggaggattttcaagccccggaagacacaagatgttccttgaaaatgctactcatctgtcccataatgttcaagtgttccgtaaatgttacttgaaagtagcaacctaatactttaatggaatatatattagaactacatattctataatattatagtaatctaatattagataaaacacatctaaaactacggatactatgttgctatatgatatacatagacggagccacggagcctatagagatagtattagtcctttagtgctcatccgatgaaatcttatttctatgcttctaaggacgtggtgtgttattagtagtggattgaaaaacaaagtctctcatttccacgcgtacgtacttttgccgaattgctaaaagaaaagttgatttaaaacataatattaattatttttcaagtttatataattaatatttaattaatcatctgctaatagcttacgtatcttttcaatcgttttatttctctcctctcaaacacaccccactctgaatcatccgatgtcagtattcaactactatgaggatggctgtcgccggtcgggtatattatgctcaattattggggtcatcacacatcaagcggcaacaggttctaatcagcagaagtttgtgacattcaagaattcgcctgaattaggccatggaccgacgggggacaaactacagcagatgttgacctgttgtgtatcactgtatcatgacagcatgtcgcaaactcgcagttgggcttgggcatattcttgtcgatgtatgttcatcatgtgaacttgagattactgacttctggtaatccgtggaaaatgtcagttctgtaggtagttatagtgtataccacttcctccgtactaaaaataaactaatgtatataatataaatttggacataggttatagcttgattttgagctagagaaattacaaatgttgtggttctttacaaattattattgaatagataaaattgtataaaccaccctaattactctggttttgagtttttaccccataacctattttgttgtaaaagcctacccacatgatatggtttcacatcaaaattgacccctccgtgcacataagtaattgaatatgtccatatcttctaatgtggatttattgccaatcaccgattcttatcgcctccgcgctcggctctctcatcatttatagtcatcttactactttgagcagtctaagcacaaactcgagtcgaactcacctcataaccacgttggacgagtccaacctacttggtacggtccctataaatccacatcggaggaaattgtccgaatcaactactcacatatattgggtaagtggatttttcatcaaaataggttatagaataaaatattcagaatcttatatattggcatgaattgtgtgcttctatcatacatattcagttgaaccattcctctgattgttttagatagaattatcatcagaatggtagattttctgttaggtcaatgtatatagctttaattaataatggatatattgaatgaaataagattatttagaagcttaagataccacttaagattaagatctttatgtggtacttgcttaaaggggttgtgctaactaagaataagttggcaagacgaaattggaatggtagtttaagattttgtttctgtatgaaaaatgagatcattcaacatctttttcttgactgtcattatacaaagatttgtttggagagcagtacagttctcttttggtttataccttccaagtaccatatctaatatgtttgatgggtggcttatgggggttgacaaga

SEQ ID NO: 65985 - DNA, 7405 bp, Oryza sativa
tcgcaaacttgagacgacggtgatgcaactctttacaaactatagatggagattcacaaatagacttaataaatgtgtcctcctcatcttggtttgccttttattttgttgagtgtgtttgattacatttgaactacactctttatatgagtggtattctgtaataattggctgtaactctgttgagtaaaggccaggatatttattccattatctgaaaaatagaataaaatatcaaaatagaagtaaaattagggtggtttatgcaatttttacctatctgataaccaagattcagagcgtacaatatttcggaagagactcctttgacataaagtcagagggacatggtcattagcatgtagggaggctcccacgtccagctccctccatgagttcttggctccatgcgctcttcaatgaaaaaaaaaaacatcaaaaagcaatagtactttcaaacataactggctgaaagccggaaacagttgttgcctggtgtttcctgacaagcagtgatgctcacgaatcctttggttctttgctctactagtgctgtgtttgttacggttggatgggaacatgcatagtgcttatgaaaaacggagtagtctattagcgcgtgataaattaagtattagctaattttttttcaaaaatgaatcaatatgatttttttaaacaactttcgtatagaaactttttgcaaaaaaacacactgttgagcagtttgaaaagcgtgcgcatgaaaaatgagaggggagtgttaggaacttgctcttacaaacacctcttacaaacacagcataggttactagtgttgaattctgatctgcctactgctgtagtgggcttagtataagtgtgcaaggcaagtatttagaatttctgatgccaatgcccttgtctgcttgatgtagccatctgcacattacagttacagtgtaaatctccagctgccatgttccatgaattattggagttgagagtacatcatgatgtacaaatatagtacaaattgcaatgattgagctatagaaatagtttctgtttgctataaattgccacatgccaagtttttggaacagccaaaactccagaacctcagttcagcaccccaagaattgtaagtggggaaaaaaagttccaaacggagatcttcgtttctaccccactcttttttagaactgaagacagattcagatttcaaagcgagcaagatcatcataagacgtggtgatgaattgcttgcagatttcagtcccaaagaagaaccgaggcagtgatcaagcagcagttcatcacaggagatcagtggcactagacaacaaacaacacacagctgagaaaagtctgaatattcaacattaggctgcttgctattgcacatcatcagaacattaacaggagtgcacactactacattcttcttccacttcttctttttggaattttcctagacgaactctagatgaacattaaacttacaaggcaacactgaacaaaggttgcattttgttcatactttttttagggtcattttggtttatactatacaaaaggacacaactaaattcctagataaactctagggacaaacccagactttgagtagaccacaccagcagcagcagccgggaggaaggaagcaaagcaaaacaccgcggcgcaaagacgcaatgcttttgctacatcctttagtttttgccatcctagccatcgcagcctagcgaggctggtggatgacgcggggagcgccgccgctcctcgggctgccggcgtacttggtgggcttctcggagtgccggggcttctcccggagcccccgcggcgcgtcgccgcccttgggagacaccaggctcagcgccttgagcaccgcatctgcacacacacatgggagacatggcgatgaatttcactgcaattctcgttttagactcgatcttttgatgatcaacaaagcgagcaagcgagtgagtcagtcggtaccagtcttgagagcggcgggcggctgcgggggatcgacgaggaggttatgggtctggtcgaagaagaggtcgtcgtcgtcgtcgtcgtcgaaggcgtcgtcggggaggaggccggcgaggtcgtcgtcgtcggcggcggcgtcgtggagggcgagggagtcggccatctcgtcgagctgctggtgctcgtggaaccagtggtcgcggaaccaggcggtggtcttgacgaggtcccaccactgcggcgagaagtcctccacctgccggaacgccgccgggatgaagagcggcgcgtccgggttcagcgacgacaccgccgtggcgctcatccttccttccttcctcctctgtccagatcaagcggattcagatcggagacacatccaaagaagaaacaaaaaaaaaaaagaaaagcaaacgatgaatttccacgatccggaagatccgttcactctcgcggaaccgcagatcgcgaactgggctcaaaaaattgaacctctttccacagatctaccagcgtacacacgcagatctgagccgagcgagcagagaagcgattgctcaccttttttttttctcctttgcgatggcgacgggagcagggggagagaaaatatccgtggaatcttgggggagtgatgggtagtggaaggagagtagtgggcgcttgggatttatagaagtggaatggattatggatagcctcaaatcatatgagaggaagctacgagcgagccgggccggccgggacgcggtgtggagcgaggccgaggcagcttccagccggtcgggtccggatcgggctcgtgcacggtcagtctctcacgcgcaacgcacggaatttgccgtgtagcggagctctacagttctaccgcggagactgtagagtgtacgagtcacagttggcaacttggcgtcactcgagacttgtcgagagaaaatgatgttggtgtcagttggtgtggtttgtctcctcactctagtgatttagtacgcgttatattccacacgaatagataggacactattacgctgtatatcactaaaagcacaaaactgctgtcgacgggtacgccgtctattattaaaagcacaaagctattaaatcctgaatagataggacactattatgcctcgctatcaacgggtacgtcgcctaccactgaaagcacaaagccgttaaatcatggaaaattcaaattcgctgtcgacgggtacgtcgcctaccactgaaagcaccgttaaatcctgaaaaatttaaattcactcccatggggagtcgaagccagaacctaaggtatcactgagactcttataactactggggtacatgccctttcacattattattattattattattattattattattattattattattattattattaatgtaataccttcgtcttgaaatatattgttatgagtggaacacatgctacgaacctagacaagtttcctgtagtagatgtatctcattcaatactagttttttatattttggaccgagagaaactaagatcagattacacgtattctattacttcggtacttcctatgttctcataagatgtcgttttacagccttcaaaatgtccctaaaaggtgatcatttcagctttgtggtatcatctagtttttccttggatcattctggtccactaatttgaattgagtccatgctcattaattcattgttgtttaacaagcatttaacatcagctgattaaatatggaggccgatttaattttaccctatgagctattttgtctcttaatctctgcaacgtcaatctttacgaaggaagtactccctccgtccagatttattgcgttgtccagattgatgtacacatccttctaatatcgcttatcttataggatgaagagagcactatgaatctaaatataaatcatgactacattcatactatcatgtatataattcagttttagatttgttatattttagaatacggatgggttagccagcctgagtttgaagttttacccccttctatttatatattaggaaagtctctggtattcacgttttcacaacaatgctctcttgcccttttcgtaggtgtaaaatttctccgaggtgtatacgatcataatgctccataactcagactcatcgatcggcatgattgtgaaaaacggacatcatcattatctgataggattaggattaggattagacagcagcaaggcatcttctaaagtaaacaagctccttaatcagccttgcgtaaattccaaaccgaaaggtgcttatctgaaaggcgcgcgagctccgccgcagcagcgcacatggaggccagcgtcgaggcgacacgctaggcgtcggcgcggccgcgcgcggcggagcggaaaagaaaaccatccatccggcatccgccgtctcgtacagcaccacaccggcacacccgcgattcgcgtttgcgtgcgtgaacggtaactagggaacacatctcatattaataataacatcatcacgactgtgtgtgtgttttttttggctttcccatcctaaccctctttttttcatacacgctttccaaactactcatacatttttaaagaaattttctatataaaagctgttttaaaaaatcatattaatttattttttaaaaaaattactaatacttaattattatgtgctaattagtcgtttttttctttttttttaatgcgggaaggattagttcgaattaacttcaaacaactcttgcttttggtgggacacctggccccacggagaagcgtgaaatgacaaggtagggacaccgaggcattattatcctctcagtttgtgtctggcccatgagcaatgatttggttgatcgccctttgcaatcggcatcataaacccatgttgaataatggaaactgcgttgtgtactccagtctctagtctcagctccatcacccatcatcaaacgaacgatgatgtgtttctgaattctgatgtgtgtagtactccgcgtgcaatttggcaagaacagatggttctatactaatactccctcgaatagcgaactacatgcacaatgtcgagatcaaagttttcttccaagggcatgggagtggattggatcattgatgtacatgtaaatagtcataatcatctgaccccaatgaagaaatttcatatactagccaactacccgtgcgttaccatggaatccaagggcatgctggggattgagagcaggtacaatagcagactagaagttagctataaacacatgtcgagtagataaatgaggagagagaagagcagcgggctacaaatttatagccagctgcagcacagactacaaatattactagtgtagtatatatttatatgtaactatcgtatgaattggttattaaattgactatagatgatttggagttagtagttggctatactctgagaatatgaagcatttgaattagggggcacaaaatttctcagaagttgggaggaacaaacgtcagtgatatgagatggtggtggcaccactgctaatatttaaaatagtatagatatcgtttcatccctacgtgaattggaaaagatatgaatatttcctttcaaacggaggatttcttcccagaatttcataataatcaaatttattcatgtaaaattcctgctctgtaatttttgaaagttggaaagtgctgtgatgaagtcgttagttgtggttgtatgactccatacactgcagtataaattctattgaccatgaatattttgtactaatctgtcctttaaaaaaaagccaatcctggctatgaacctggaccatggtaggattagtttttttatgggacagaggagtacatgcatacacgtcttcaatactattcattaattaaggcttggaatttccattcattttggtctatgtaaacatgtcagggattatatttgtaggtataaacatatgggtaccctatattaggtgtgtatagtagtgttatgtgcttgcacagatttaaaaggagctcctcatgaaagctaaattaaaattcctgacagtgattcaaagaggccatcatataaactaataagttcatttgggtccctcaagttgagcgcaagtttgaaaatgtccttcacgataataccagatataacccatccctaatctttgcagaccaggttaaatgagatcccaatgcagtattgaggacagttttggctgacgtggcactagaagaaaaattaaaacccaagtgagacccgtatgtttgtgaaacaatatattcttccttatctatctccctccccaacttttggactcagcggtagcaaatgcggtggaggcaccatgtaatcggcgaggagatgatggtcaacacgcggtgtgcccgacggcggcagtggaggaggcccaatagttaatggaggtgtgccttgctgcctacaagccaaagtgtcgacgttgcccgctcatcacacgacagattgggaggggcagcgactgacggggagaggggcagtgattgcggcgaattggaaggtctcccaatctcctatgtcatgtgtagtggcggccggattgaggatatggcgaagctggagacggggacaccagagaagaagtagtgggtcgggcggagcaggggatagaatcgtcgagcagtggcggcatcaagatctgcacgagtcgaaggcagaggtgataggctgagctggccagtgtggtagaggagatgagagtgacagaggaatcggcggggagtagattaggagctcaggtggatcgagtgaaaggtgcgccagcatggtcaagccgctgcgccgtcgtcgttcctgttgcgtcagaagctgcccgcatgtctctatggcccacatggccacctccgcgcctacccgtgctcgcctccttaggcctcgtggtcgcctccacacctatcacagccgatgccaactcgtggccccacgaggccaaagttgtcttcgtgtggcccacactgccagcaccgcctccgcgtgttcaccccagccgaggtaggcccaaaagcgtcttcgcttcgcaccgccgccgtctccgcctaaagcaccagacacaagtagcacgtgcagcggctagcaaccaatcgccccctcctgcgaccaaactctggagccgcgttgtgcccttcctcaccgtgacaagtgaccaagcgtcccctgccccacaccggcgccatcatgtccttcatgtgccacgcgctagagtctgacggggctggcaccgagcacatccactcatcacggacgcgtggcgtcgatggtggatggagtgagagagagacaggagaagagaggggtagtgatttttttttgtatgacatgtgggtctcatgctgacttagtttggttgaccgaagtattgccttgagactaaaatataacccagtttgat

SEQ ID NO: 65986 - DNA, 4391 bp, Oryza sativa
taagattaggatgcgttatatctagtactagataataccccgcgtattgctgcggaatgttgtcgataaatatatgtgagatagggagctaaggcaactgtgagctgaaaacacttggaaggaaatataaagatgtttagcaagtgcttatcaggttttatttgctgaaacatgcggaatcaccgatatatttctaaaatagttaacttaggtctcggtacatcagccaaagataacttggtcaatgtagcaataacgtaggctgtagcaagctggtgtatagatgatgtgacattgctaaatgccctagaaacaaaaacaaatagctgcaaactgtaaaaatgaggcaacataaactttatttttatatcaaacatagagcaatcgtatatgtttaatttttttttgggcaaaaggaagcgacattcaacgaatgaaacaatcacgaaacattgattttgcctcgatctgtactgctgcacactttttttcaggtgaacagatgaaattatctccccgcaaagttactttttgatgaactaaagaaattatgcaccttttgattgatgcatggaatcggtaaccaaggaaaatgctgatccaaaaagcataaaaaagtttatacacatatatttgtacactaaactcaagaacagtatggctcgctcattaaggtggtctttttgactgcctctgcttcggtttccttgattttgtggcacgctaattagggtggaggcgagaacgaagctgttcaactatcagggtgctaggaggttgcattattttcatcggttacagggggcggtggagtggagcgatcagaatggaagaccgcgagagagaggccagggagctgcatgtcatccgttgtgtcttccaccaatgcaggaatcagaaacgatctaatctcctgccgtgcaattttaatctaacaatccaaagcaatcagtgatgtggagcaaccacatcacagaaaaatcaaattaattgcacgtagtgaggatcaactgtatagatatatatagatatataggataggattcctcaaagggacgatttcaaaactcgatgacaagacgaggaagctgaagtaaactcttctccctacaaattacgcagttccagctgggtaaagctaatgggcgatcgatcgctccaggcaatcgacccccatccccctatgcggctcctctccccttcttctcttcctactacaccataaattaaaaaaaacagttagaaaaatttatatatagaaatactatatatatatatatatatatataatatttgaattcaaatccaaatttgaatcgggcatataaaattttgacttataaactttgggcctataaactttaaatgtatagaaaatacaatatataaaaaatatttgaattaaaattcaaatttgaattagatatataaacttttgacttataaactttgggtctctaaactttaggtgtatagaaatactatatataaaaaaattgaattgaaattcaaatttgaatcgggtatataaactttttacttataaactttgggtctataaactttagatatatagaaaatactatatataaaaaatatttgaattcaaattcaaatttgaatcggatatataaacttttgacttataaaatttgtgtctctaaactttaggtgtataaactttagatgtataaacttaaggttgtacaaattttagatgcataaatttactaaaataaaaaagtaatgcggtgcaaaaaaaaaaaagaaaccacgtgaggaggagggccgattgccctgatcgcgatcaatcgcccattagcttttccggttccagctacatgggccgtatcagaaaattctctgataaaatgaaggcccacaaggcccaattctacctaaagggcctaaaacccctcgagctctcctctcttctcctcactccgccgccgcagcgaactcctccctcctctctcgccgccgccgatccccacccggaagcagcgagccgcctcctcctccccaattcctctccagaatggccggggcgaggagcctgctcctgaggcacctccgcgtggcggtggccccttcctcctcctccccggtggcgtccctcagtcccgcggtggtgctgcgcgaggccctgtgtggccggcagtggatgtcgtcggaggaggccaaggggtcgttcctggacaaggccgaggtcaccgagcgcatcgtcaaggtcgtcaggaaatctgcggcgcacaatgttgatcggacggactagaattagccaccgtactttggccgcacccctcgccggagagagaacaccggcgcttcgatcgccgtgaacttgccggatgaagaacaccggcgccggcagcgcaagagttggtgctagccgccgacatgatcttccacgctggagaaaagtgaaatgcagatttcctcaacagcatgagcaatctgatgagattgctctgcaactcgtacagtgaagtgccacaggactttacacggttgacagttccacatcacaaattcacaattcacaagacggtaaacaacagttgttagtagttatgttaattgttaattaagcaaaaaaaatttaaatatttcttcctcaattcaaggctccaaaataattaatagtagtataatatttttgacagttgagttcatacattatataattatacaagtgccagaccaatcttgaatggtggtctggtaagctaaaccatcacagcctatacaaaatttgtaagagcccacaatacatgtttgttcagatagatacatgtaattacatttcataaactctcaacacatcagtaggagaaaatgaacgacatagacagacattgacacatgcataacaaatcaatacacaccatgatcaacaaatctacacgtatagtttagagtttaactttagacccatgtagaagcttgacaggtcagtggagaaccagaacgtcctttttgcaccaggtacaaatgtacaattgcacccgagtatatgcatgtcacttagtagtataaaaatctagccgcagtcaaataatttcccggtttgtctagcatcatgatcaacaaatatacatgtacactacagttgtttagcatctaagaaaaataattcacttttatgttgatcaaattttccggtaaaagcaaagcacaaacaacatgctcatctcatcaagatactgtatcttcttttactgctatcaagatttgtaattgttcaattatgcagactcaaagagagcatcattcacaattcgctcacttagcatacatcatttgaccagctagacaaattgaagaaaagagcgcagcctaacctctctgacagtagtacagcagcgcagaacaacaacctggagtagccttcttcaacctggagtagccttcttcaagtaactcaacttagaataatggacacaaaacaaataagaccaatctaggaatgactagattaattttgaattaaggagagggtgaggctcgaacccggaccggctagctcgcagcttgcgttgctatccaggaagacccccggcctttctcaaacgtagaataacggacacatgtcgatctctgacagcatgatttggagtggtcattctgaaatgttcgagagcccgccatagctggttagagatgtagtccgtatagctgccttgtgggtgtagcattttgaacattgtcccggctcgagcttcgtcgaggatggctttgcccagagcaagttcatacttgccccctctgaaagctgtaagatatatccacctcaggtgatggctgaaacaaccaaggtcacggaagaaattgttcccttgatagatgtgttcatcatccgctttgaggagcccttcttctggtgcaacctcatcgtatctctgcagcaaaggcacacacgcgcaccttaatcagaattcacacatgataattctgcaagtcacgcacaattcaaacagaactcagacatattatatattactagtaccattgaactacagagacagttggtagtaattctgcagcaaaggcacgcacgcacaacccaatcagaaatcagaattcagacatagtctaatactactgatgcagagcaattaacagcaaatttcaggacaataaaatgattgattgattgattggattggctgtttattaccatgatctccagtttctctaagcatgggaaacacttcagaatctgctctatctcacggggcaccctgtgacccatctctgtgtagttcacccgtaagccgagaatcctgacagaacgcatctttggaggatgcagcaccatcccagcctgcgcatgatcagagtatagtattgttaattagccaatttggatttggatttgagttaatcgg

SEQ ID NO: 65987 - DNA, 5658 bp, Oryza sativa
acacggacacgattcgatttgatttgatcatacctgaatcacaatgcctttgatcacgaagacggggttgaagagatcgagatagccgatgcttcgcaggctgggcgcttcaccgatgaagatcttggatggtctcgtcggtggtaacaggtgcagcttccggagttggatggcgtcgtgcacgacgaccgtgccctgcaccacgttgttgtgcatctccagagagcggaggcgcgtggtctggacgaggacgtctaccagacggctgaagtcgatcgtcagcacccggatttccgattcggggcggagtgctcgcaggatcatgccagggcagccatacagcccgaggacgcggaggttgacgagggagtcgatgtggtcggcttccatggtgaagaagaagacgtggagtcccttgaggcttgtggcgcagtcgcggatgccctgggggagctcggggtgcccttccatggtgaggttggcgagggtgacctcacgaacacggccgcgctggagcgcggcgcaccagcggtggagttggtcggcgcgccaccgcgtggtctccactcggaagctgtagacgcggccgatctcgtaaccaccatctgggatgtcgtcgtggccgtagatgtcgtcgtcgctgatgacgccgtcgtcggcgcctacgcctccagggaatcggaggcgacggcggccggcgacacctccaccgtcagaattgttgacgactccaccgccttgatctgctgcctcgtgttcgagttcgacggcaaccccgggtccagaatcgtggccatccacgccaactacctcgttgcctccacctccatctccgtcgtcgtcgtcgtcgctcccgttctctccttgtacgcctacgaactggacgccgtcgcctacgtggagctcgagaacgttggcgatggcgtcggcgacgtcggcggcggcgatccggggagaggcgaactggcggtcatggagatacagcggctcggcgcgccagatgtcgagccagcgcggggagaagaggtagccgaggcggaacaggtcgacgacggggaggcggacgagcaccctggcgacgacgtcgtcgggtagcccccgccactcggcgtgcggggcgtcggcgacgggcggcgcgaggacggcggccggagcgtcatgcgtcagcgtcgcccgcggtggcttcaacctggccacggcggaggcgacgattgtcgcgcggcccgcttccattcctctccggcgagtcggaaatctggacacggcggaggcgtgtggagcaagctgcctcctctctctctctctctctctctctctggggtttcaaattttgatataccggaggttggatatttatagagagagtttttctctggtttttttttatcaatctggtgcgcacgttactgatcggacggtctgggtccaattccggataggaagaaaaaaaatctacggcttcttctggaaatacagaataaaactaatcggttagtagcaaatctacggcgcacaatgttgatcggacgacacaccgagcgccacctcacagtcacttcgccgtggacttggcaagttggcgtcagcagaaaagccatcgataccggtgtctcgattctcaattatctcatcagcagatgagatttttatcgataagatttctgcaattcatactgaaacgccacaaacacatttttccacaagacttgcacatcacaagatagtagacaactcatggttttgttaagcaaaatgaataaaaaaaatccatttattattcttcctcaatttaaggttccaaaagtgacaatgcaatctattgtcagttcatatgtcatataactacaagtgccaatccatattattcagtggtcaggcacaaaaattgtaagagagttcaggacatgtttgctcagatagcatgtaattacacttcagagagacacaagcatacatacatacttcctctgttccacaatataagtcattctagatttccccacattcatattcatgctaatgaatctagataaatatatatgtctagattcattaatatcaatatgaatgtggaaaatgttagaatgacttatattgtgaaacggagggagtacaccagaatagaatacacaccatgagcaacagagcagaatacaacagcataagcatagtatagacttgatccatttcattcaataaccatctcactgcagccaaatattttgtcggttcataaaataggttttatttgatcccctgagactgtccctttgcctgaatagttgatcacatgcctcataacctgtcaggatcagccaaccagaattgctccatcactcggctgctgcttccactccaaagctctggttccatccatggaagagtagtgtctcgtacatcagcagaaaccaaagagttcatcagtgatctgagaagcaaaattgaaacatacagatatggaatcaagatatcaggataatttctgtactaaatactccttatattcagatacataataacgctggagtaaagaaatatagaatgcactaatatgtagtttgtattgtaccccttagatgaagttccaacggtaggtcatagaagagaacaagcacaaacttacagtgaaatttgggagtcctgaaagtgttagggttgtctattggatcacctaggtttagatctagtcgggtggttctatttgcgatggatgattgaacaacaatagagaataagggaaagggtttagggatgtgaccggttgacgcgttggatgaagaggaagtcccagccatcgtcgttgtcgtcgctctgcttgacgtgggcggcggcggcgatggcggtcgtgacggcgacggtgctgcgcggcagtggtggtcgtaggggatcccggcgaggtcgtggcgcggcggtggagtcttcccgtcactggctgccccccctcgatcggttagggtttatggggtggagtggcggcggcggcgacgaacctcgttccttgtgtcgttatgtcgtcccgtcctccacccctctttatatggcacagtgtgacgggggcccaccagccattgggctgggcgcccctgatcagggcgcgggtcaaggcccccttgagccgttgggctcaaggggagggagatccatctaacattctcccccttgatctcactatttcctttagctttttctattccatcacagatttacatatagagcatgtttcatcgtcacggttaattaccgatggattcgacagccactatacacatctctattcagaaacagatactttaacttttgggccctatagtccaggattcataaggcttcccttaaaacccatgcatgctacatgttccttgaacatgttgggaggtaggcctttcatgagcggatccgcgagcatcctttctgttcttatgtgctcgagactgattgtttgatcccggactttgtctttcacaacataatactttatgtcaatgtgtttggcagcaccacttgactaattgttgtgagagtacattactgtgggttctttatcgcagtataactttagtggtttctcaatactatcaaccacctttaaaaccgggtatgaacttcattagccagttcacctgccccgtagcctcatggcatgctataaactcggcatacatggtagaccctgcagtggtcgtctgttttgagcttttccatgaaatagctcctactgccagggtaaacatgtatcccgatgttaactttgtattatcttttgcaaagtcagaatccgaataccccactatctggagcgattctgcttttctgtaagacatgatgaggccttttgttccttgcaatcacgcaagactttctataccaatttccagtgctctaggcctggattactttgaaatctgccaaataacccggtaacaaatgccaagtcaggtcgtgtgcacacttgcgcgtactataggcttcctacagctgacgcatatggctttgttttcattttattgagctcatactgatttctgggacattgcgatgccccatacttttcgcctttgactataggagcaggtgtagcactgcatctgtacatattgaatttcttcaacaccttttctatatatatgctttttgagaaaatcccaatgcatactttgttctatttcggtgaatctctatgcccaaaacatatgaagcctcaccgaggtctttcatgtcaaagtttgaggacaagaatttctttatttcctgcagtagattgacatcactactagctagtagaacgtcatctacatacagaattaggaaaatgagtctcccattcttaactttgaatcaatacagttgtcctctacattctcttgaaaacccaaatttctttattgttccatcaaacttcaagtagcattgtctcgaagctttgctttaacccataaatggatctctttatacggcatcccatattttcgtttcctttcatgacaaaacctttcggttgcgccatgtatactttttcctccaaatctccatttagaaaatgccgtttttacatccatctgatgtaattccaaatcataatgtgccactagtgccattataatcctgaaggaatctttacaagagactggagaaaatgtctcattgtaatcaatcccttctcgttgcgtgaagccttttgccacgagtcgcactttaaacttttctatattccctctagagtcatatttggttttgtagacccatttacagcctactgttttggctcctttaggaatttcttctaaatcccaaacatcgtttagtttcattgatttcatttcatctttcatggcttccaaccattcagatgagcgagcgcttctcatggcctcttcatatgaggtgggatcatcctccatatgcgactcttctatattataaactttatagtcatcacggatagccgatcttctgactctttcagaccttctaggggcctgcacatttggcacatcctgtacctgaggctcttgatgagtctcctgtactggcacattatctatttgaggctgttgtagctcctcctctggtgtggcaaccatttctgttgaatcctgtataacaggttcctcactctcattcattgttgccacaggaggggtaacaacaggtgctggtaccgcaagggcatgcattgctggcacaacattagcaggtagagagaagaaaggttcctgagtcgacggagcgggtacagacacccgcctctcctcaagatcaatttctcgaattaccgagctccccctaatcatttcgtcttccaagaagacggcgtgtctcgtttctacaaactttgtataactgtttggacagtagaaacgatgaccctttgatctttcagaatagccaataaaatggcagcttactgttttgggttaaatactttatcctttgcaggactcccccacacacggaggatccatagttcatacggtgttttgggcaccgatgcattctatgcattgtatgcattgttctaaaactgagaactccaatggaggaagaattacattcttaaccagtctctcaattctccccctcgaaatatggcctaaacaacagtgccataatttcgatgagacatcaggagttcgctttcttttcttgggctgcaggaat

SEQ ID NO: 65988 - DNA, 4193 bp, Oryza sativa
ttgtagttgacaacaaggttgtcaaagttctttggcaatgaggacaaaaccagatggaccagaaagtcatctgagatgcccaaatctttttgcttcaatttggaagccatgttgctcatcctaagaatgtggtcttttacaccacctccatggtacctctctgtaacaagctgcattatcagctgtgtcgcataaaactttgaagaaccagtaaactggctctttatactttcgaggtacttagagacagtgtcatactctgggattgagcccaatatggttggctcaatcgtgttctttaccgcagccaaacaattcttgttggctgaagaccatttcgcatgctcaatgtcatacgacatgatgagggaagcattgtccctctctctcttttgccattcagcatctgactctttttcacctctgaaaatttcagcaggttctataggacatggggtagtcaacacccagtccacctctcccaagataaaagcaaggtcgagttctcttttccattcttcgtagttatctcctttcagggtcggaatatctttaatgtaacccatcaaggagtagccacctaagataatcatgtattgtgagaacaaaattaacattaaaattattatgtattaagtctacatcaccgttgggcagaaaatagacataacacataaagccataactataacattgcaattatcaacgttggtcagaaaaattacaacatcatagcacataattaatgttcctaaaattaaaatctcccgttggttcgaaatttaattttagaaacactaattttcatcaatttcatctatttgcagcggaagatctatatacaattcatataaattgtaacaaaactctgttgtttacgctctgtaaaattctcccgttggttcaaatttaaacagagataaaacatgtaaaaacaattcaaaattctattgtaatttgcatgaaaatatacaaaatacatgttcagaagcatttctcacatttatctattctctaaacaattttcacgttggttcaaattgcttagaaataaacacaatcattaaacatattgaaaatgcttccttcggccgagggacttttattaaacttcctttcttttgattcggccccgagggacctaaaatgaactttttcggcctttgccagtcggcccacggccgccttgcgcgcgggcgggcgccccctcccctttccccaggccgcaacctgggcctgggccgggaaagtggctcgccgtgcgctcccacatgggccgatttcggtccggccgccgtcggccgtccgatcgctagggtttcgatcggacggtcgcgcggcggatcgggcaaacaaaaccgcccccggccgccggcgccgaaaccctagctcctcttctcttctttctcttgcggttgcacggagcggcgtcgccgtcgccgaaaaccctagcacagcgccggcggcggcatggcgacacggcggcgccgtcgcactccccttcgccgatgcgcgcactcactcaagggtgagtgcgccgccgtcgagcggttgtgccgcgacgccctctcctttctcttgcgggcgtgcgccgtgccgagcggcgtcgccgacgccggcagccttcgcgccgccgcgccatggccgacgccctcgcgccgccacgccctctattcttttctcttctcccccccaccgtctcacccctccacgcgagtgaagagtgagagaccggcgacgacggagatggtggcgccgccgcgggccccctcgccggcgcgcgcgtgcacccgcgggtgcgcacgcggctgtcgagtggctcctcggcggtgcctctttgcccctctccccctccgtggccggcgtcaacgacggccggcgacgaggtaagattagggttagggtttcgatcttttcgatccgttggatcgtttgcttttctttgcctttcttttggatttctttccccaaccaatctaaacgctaggatggctctgataccattgttagggttgtctattggatcacctaggtttagatctagtcgggtggttctatttgcgatggatgattgaacaacaatagagaataagggaaagggtttagggatgtgaccggttgacgcgttggatgaagaggaagtcccagccatcgtggttgtcgtcgctctgcttgacgtgggcggcggcggcgatggcggtcgtgacggcgacggtgctgcgcggcagtggtggtcgtaggggatcccggcgaggtcgtggcgcggcggtggagtcttcccgtcactggctgccccccctcgatcggttagggtttatggggtggagtggcggcggcggcgacgaacctcgttccttgtgtcgttatgtcgtcccgtcctccacccctctttatatgacacagtgtgacgggggcccaccagccattgggctgggcgcccccgatcagggcgcgggtcaaggcccccttgagccgttgggctcaaggggagggagatccatctaacagaaaggtcactgaattatgcgtgtcaagattgagctacttcctgccaaacatttgacatgcctcaaatcatctgagaactttgaacccagcaaaaccctgatgcaattctgcctaaagaactggcagacccacattatgctacagccacaacaagtaaacaacccgatatctctcataaccagcccttttttttttgagaaagaggggcagaacgccattttattaatgaaatgagcaaaagctagaggttcatataatcccaaatccatttctagcagatcaacaaaatgaaagagcaacacaaattccgattcccaggtaacatgactaagacttttcattatcagcacgcccacatcatcgcggcagagattcaccaggcgatcataaaaataaaatattcaaaataaccagccaatttacaacaggaaagaaaatatccacacgatcatcctctaccagaagagggcttcgatcgcaatctcgtattgagataaaagcaaagtttagaatcactggcaaatgacaatgcaaacaggcataattcctatgcagcagtgcaccatatttctacaacagcagcaaaagacatagcatgattatagaaggcctcacctatcatcagacatttccatcacatcagaaaaccaaagctgtatccaaacagaagtaaagcagaatagcatggtagaactggtaagcttgtgaattctgaattgataagagcaattcgaatcggccttagcaccaaacaactcaagtagctctcacatcagaccttgataaagtgcacacaggcacgcagttggcttaacagaattctagccatgtactgaagacttaacctaacccaaaacataggtagtatatactacttaactaggttaatgaccagggtgatgatctgctaatgataactaggaaaaatgccatttgcggagccgttcacaggtgtcccagcacattctgcaaaaacagcttcacttcctgtggactcatctgatgatcttgcagcatccttttgtggcattcatccttaagatcttccatgtcgagtgcaatcgcagcctgtacagagaaatcagattagaaacatataaacatctgtctgaactctgaacagagaaatcaggcagcctactatagtatatctaggacaagtttcaaaagtggaagtactttagtcactatatatcttacataatactactatatcttacaaaagaaatcaagctgctaattgtttgttttattcccaagatctcagccaaaatttgggccgttggttctagatccaacgggttctgtgcatcttctacctctagaacactgaactctctctctcccctcacctatcgattagctgcgcaactgcgtgtctgcgccttccccgtctccaccggcgcagcccgccgcctactcggtttccctcgccgtcgccgtcgccgtcgtcgaccccttccaccgccaagccgcgagattccgatcaacgggagaaagagagggagaggaaggtagaggttgaagacgaagtacacacaaaatcgcaacgcaaaaccacacagtcggaaaaatccctaacaattgcaagatgcctccattcccggcgaggagaggagaggagcgaggggcgcttacccttgtgaggtggccgagggtgtccaggtcgtggacgggctgcagga

SEQ ID NO: 65989 - DNA, 6343 bp, Oryza sativa
ccgccagtcgccccgcgctgctcttctcccggggtcgccgtgaagaagatggggaagagagatggagagaggaagaaagaattggtcgttcacatgtggggcccacatggtcccatgctgactcagatgcaagtcaatacggggtataaatactgtcttagacctctggtaatccggttttgtttctggtaatgtggttcagggataaaattaaactcggcgacaaattgaggaacttattattacgcagttcaagctacatgggccgtagaagaaaattctctgagaaaatgaaggcccacaaggcccaatactacctaaagggcctaaaacccctcgagctctctcatctcttctcctcactccgcggccgcagcgaacccttccctcctctctcgccgccgccgccgatccccacctggaagcagcgagccgccgcctcctccccaattcctctccagaatggccggggcgaggagcctgctcctgaggcacctccgcgtggcggtggccccttcctcctcctcaccggcggcgtccctcaggcccgtggtggcgctgcgcgaggccctgtgtgcccggcggtggatgtcgtcggaggaggccaaggggtcgttcctggacaaggccgaggtcaccgagcgcatcgtcaaggtcgtcaggaacttccagaagatcgacgaccccgccaaggtatcactggccgcagcataccgttcttcccccctcccttttttctttcttacttgtcgaatcgaatcgaatcgagaagtgaattggttctcgatttagcttgaattgatcccgtgggatagcatttcgatgttgcctggcgagtagtcctgcagatctggatgcattccgcagtttaggttgacgctctagcctgtggcaatgctgtcggcacgtgtacatgctctttagtggccttgttgaaaccactcttgagtttggtcgaggagttgcgggggattgtgatttgtgagtatcatctgtgctcagttggatgttaattttagcaagttatgcgtatatctgtgatcacattgaggcatacagtaggtgataaaaaccccgtttccttatttttactggaagtttggttaaaaacatagtctgtagcagattggtagaaccacctgagtaggtaaagagtcacagggggactgtgagcaacatcttctgtgttcagttggatgttgtaatcttagtaagttatgccatttccatgcgtatctgtatgacagcatcgaggcttgcattaggtgataaatccttggttctttagcgcataagcctatcatcatcagtagaacaaaggttgtggtggttgaggttgtgatttccacttttcgagctctacacttcgttggaaacaaaatgtaggcagttccacacttgtgtaatcctttacttttctcttctgtcccagaagccatcactctagttcatgtaaaatttggatagagtcctagagtatgacgacaaagtatggttgagcaaactgcatggggtttggtctgtttctgttactcatgtgctcatggaacctactacaagtaaccaatacttgggttgccacagtagccagcaggtaaattgaagacccaacattcactcaattttgagaattgtttggtggattcatcatttatgttagcttttttagaactaatgttagtttaaaaacatgtgcctggcaaatccatagaaagtatgtaggctgcctcaagtgaatctattaaagcaaagaaaaaaaacattctgaagttattgtcatgtttcggttgttcaacaacaaaaatgttttatgcataataattatggaaaatcatcaataatctgtgagaacatgaaattattcatattagctctaactctagttctgtcaaatatctggtttcaaaaggttgcttgggttcatttaaggttttcctgttgcagctaaatagctagtagtcatcttgattctgttccttggacacatttctgtgcacttagttacaaccattataaatgaattctttttgctgcatatttgttttgaagatttaaatactttgggttccccattgatgtgctttaatgctggtttgctgtgattgcaccttgataatctgcagcattttatctgtcgtgttttgatgcctggaatttgcatacggtgccttttgttttgctccaggattgagttgctttagttcatgatacttaagatggatcctttccttacggatactttttaaatatcccagatttgcatggcaccaattagttcacgctaaattcttagtcaatttcttactacgtcctacaggtcacaccagatgcacatttcaagaatgatcttggtctagacagtttggacgcagtggaggttgtcatggctttggaagaggaatttggttttgagatacctgacaatgaagctgacaagatcgactccattaaagttgcagttgatttcattgcttcacacccccaagcaaaatgagcaaatcaattgtgttatactcgttaattttctatgttttgttgtcacggagcctgtctaaggtggaagtcatctgctgtccgcatgatgtccacttttgcaatcagcattgtaccaatgctaccgttctgaatattttcttctgcctgtgggttttctggaccaaataatacttgattctgaggcggcagcccgccatcttgtatggagatttcgctggatatcaaaggtttagtttcatgccaagagtctcactgattctgtctttttccattttcttagattttggtgatatgattacatggctttgcacataattcccaaactgcatgcttggtgcaatcctgaaccgtggattggtgtttaccactgaaggataaatatgttttgataactgtagcatgcatgtctatgtagaatgcacaaatcacaagctgaagagcagttggtatggactggaacagcaacaagattgaatcttgccacaacttcagcaatcgagttaaaacatacttcctccgttttacaatgtaagtcattctagcattatgtctagattcattagcatcaatatgaatgtgggaaatgctagaatgacttacattgtgaaacggagggagtatatatatatttttacaggaaatacctcacggcccagcttatattgaaagccacaaacgagttaaaacaatttcgactgtgaccttttagtctagaacataaattacttcactgcactctacagctacacgctaacaccaatgatatggtgcgcataaatgtccgtgcatgtagttgtagtgtgtgatcactgcaggctggtgcatgagtgcgtcatgtccatgccctaatgagtccattcctgtggtagagcgagctctgggcacgggctggtggttgccgctggagcaccggcgagctgctgcatgtttgccgccattgctcgcgtgagctcttgctgcctcctcgccatggtcgtcgccgcagccgctgcctcgttgcctcgccggtgcctttgtgcccgacactgcctcggtggaacattggtagtaggggggcctcgccgcagccgccgtcatgtggtggttcgcgtggcgggggtcggcggccgtggtgcgcggcaagaagaagcctgtgccgctgctgcgccgcgtcgtcaccggcggagctgctccggtgacggcgccgccacggagtagcgggtgtgggtggttcatcgccggtggcggcgctgggcgcagaaccatggtgttccttgggccacccgtcatgacatgccacggcgcggccggcgctggcaatggcagtcgactattcccaacaagtcgcagttgcagcggcggcgtggcggccacccttggacggccggcgcccgcgagggcgtgatggtccctaagcatttcaccaccatccccgcccgtcacctgtggtcgatggtgacaagagaagagagggcgctgggcctggcgaggtcgatcctcgacgatggcgaggcggcggcgctcgtcggcatctgcgatcccgatgtccctgaggacctccgacggcagccaccggtggacgtcatccatctcgtgcatgtaaacgcagcagcggtcggccattgccggcaaagctagcttgagcttgagcttgaggaagccgatgagtcgacgctggatcgggctagacgaagcttgtgcttcttgttggttgcaactacgtaggagaggtgaggaggaagaagagatgctttgaggtgtggagaatgatgggggtcaaaggagtttatatagagaggtgagagctggactaaagaggaaggagataaatagacatgctccaaataaacatgtttttttgttggctatttttttcttcgtacctagctagatttttttgctattttttcttgatggtttttaatgtgtttttggtgttgagaatgccatttacatgcacgtattgttgtctgaaaagaagcacacttgaaaatgagctagctgaactgaaagttgctataattagatttttactgcatggtaatttcttttttttttttttagtttcagatctctagacatgagggggaaaaaagaaatcgaccggttggtgtgctctgggctattgttgtggcaaaatggctgattgttcatcttgggaagtgaagtaattaaggagaaatttcaatacatatacatatttaatgttttatttttctattcttaaagtcgaaaacgagagtctcctaccgcaatatatacatacaatagaacaatatagaaggaaaagttacagttacaaagcaaataaagaaacaattttaaattattggatccaaacccagataaagtaaggttttaagactggattgtacttccagtcatattttaatgccaaagttttactttcgatcactcttagtccaatcactagataactttatatttgttactctgttccacccctggtctcttctctagctatatctatccacttatcctcaaatgtatgtcttgcctataggtgaggggagatcgctagggcgaaaccgatacgctcgggattgttgatataaatgaaaagattggataaagtgtagtctaaagtaaaactttgataataaaaaatgactcaaattgtaatttaccctttttaaaagtgttttagaaaaaaaactctaccgctagtgtgtttcatcttcatgtattgggaagtcctagcgttttcctctcttcatatttccgggataactacatatgattccttttatggttgtcttgttgctagagctatcttctcgtacaagcgcttagtaaaagttgtaacggcaccgttgcatccatattgtcaggtggagaaaagcaaaagtaccaagtctcgtagtttagatcgactctttttaaactcgtaaccataacaagtcaagtcaagttgggattatatgtggcttgactaggagcataatatgcttgaactttcatgaaggtgctcttcgttttggaaacaaaagtagactaatactacgataatcaatctactcgatgaaatgagaagtgtcaatacacttacatactccctccattcttctttacatgatatcgtaaaactagtgccatacttcatgaactaatataaacagttaatatatatatcacataattttaaaaaatgtatagcacacaattctaagaaaatgtattgcacgattagttcattatcaatgtggtatgagtgtggctcgagtctaataatgggaaatgtttgattgaaaatgtcaatctacaaaatattttcacaatcatgccagtaaaaatgttcccaccataacttaaaaccagttttggaaacaaaacctttgatggctggcttctcactggaataattagtaacaggttaattttacattcatacttagcttagttatcttcaggaaacatatacctctcatcttgtgtggcaggctagcagcaaacatagttttgattaaaaaaggaacttagtttttgattggtgaacacgtgtgcatcttttggaacaagattttcaatagtgctaaaagttcaaagcctcttatggtgagaatatatagggccaacgggtacctagacgtctatagtgcaaccacatgatccaagggttgaaaaatttgcagaaagtggaactagcagaatatttgctaagtaacgttaattgctccatcaacttagaattatttagtagaaacaataaaaccgtcacacttattacgcctttaggtggaaccccaattatataaggtagtgcaattaccgttacttgatagaaaatttggtaagtaataggaaatggtccatcaaattaaaattatttaagtaaaaataatggggg

SEQ ID NO: 65990 - DNA, 4009 bp, Oryza sativa
ggagagatatttccagcacacgcaaaacgagacaactcactaccacatgattaattaagtattaactattataaaattgaaaaaaatagatttatttaatttattaaacaacttctatatagaaacttttgtcaataacgcacaatttaacggtttagaaagcatgctaacggaaaacgaggaagttaaagtttggagttgagaaaaagaaccgagccttattaccactccctctcaacatagacttgtttagtcaaaataaataaaaccgacatacttattacgcttttcggtgaaaccgcacttccgtgaatacgatatcatgaccaaccattccctacattttatgactagagcaacataacatcattagtacatatgattaattcgacgagatatgtaaaacccaagctgatggtatcaactctcccacaactcagtaaacccattctcgagggagggcgagcttgccgcatgcttgaggcagaacggtgttcgaattcaccgtccacggacgccaattctcatcatggctgcctcctcctcgtattgctgacgctcttgacatggacgaggtggccgcttcacgctggccaaccctgacatccccatggccacattggtggatcgcccggttatcgtatgccttggctcttgcagcaagaaaactccgttgcatccggcatcactccacttaatttgcaagatggggtgtctgcagggtgccagcggcgctagcactggttgtggtgaccgcatcaccggagcaaaacctcggcggtgcaacaagcacaccagattttcatcgtttctcatgaactgccacactttcatcggtggtggggcacaaaatttttgaccatatgagttggccgacctaaccagagaggggtgggagcaagaaggacaatggtgagacgtgcggcgaggtcctcgacgatggcgaggttgtgcccctcagctgcacgtttgtcgaaaatgctgatgtccctaaggatctccaacggcagccactggtggacatcgtggaccattgctttctacgcttctttggaggaagagaggctttgaggtgtggagaatggagggatcattggatgagtttatacagagaggtgatgaatgggctatatatagaggaaaaggcgagtaatagacacgtttttttaatcttatcaaaagaacatattcttactgattttcaccttaatttcaaggtgtttgccttatttacttgatgacttttatgtttttttagtgatgagaattaatgtgtcccacatggagtcttaaaaagaaatttgcattatctggagagatgatgtgattcaggcaaagataacttgggtggtgtgctctctctgcttgtgtcaaaattaatgaatttttcctcgcaaagaaaagaaattaatgaattttcatcactgtatattttacctttaaactataactgagcaattgattggcaaaaaaaatacaataaatgatgacaggcaatgcattaattagatgtacttgctggtgcaataagggtcagtactacgtattccatccattcatcttgacgtcattaaagcttaaacccagttcaaagtaatttatcaaacaaaaatgttaatttgaacttttcaaaacattgcaattccacacagtttaatgtggatcatggaatgatcgcgcacatgatgctcttaggtgactttcctcttgctcctcttctctctttaattatttcattcgaggagttactaacttatggtttctatccaagtaactaattaatgcaaatagtatttattcacctctactgttaaaagatagagttctgttcatgtcatcccctcgaccaccatacccaatgtatcacatggaaactgctctgaccaaaaatagaccgacacaaatgaaaaccgcccaacctagaaaaaatgaaccacacttaaatggggtccaacgagccatcgctcctcatcatccccgaaatgccactcacacttgccactgcctgctgcatcctctgcacattggccttctcccatgccacggtaggagattgtgctcatgtagttcagtggttgcagtgaattgaatagcaccctaaggtattgagtttaaattttcatagaattaaatttctgaattgttttaggagctaattttttaatttaaaaaggttgcatatgtccagttgaatgtagaggccaggtaaaaaatactcctctagaaaaacgaaattgttctcatgaccacagccatgaaacaaaagtggtcagcaccctcaagtatgaggcagacgaagcagacaagaagggcctgcaccttcttggtgaagaggaatagtctacccccaactctcatctccacatttctttctcggcctctccttatttggattataatccctcgccctactcctatgtgatgaaaacaactcaacatgatcggtttaaggtgtcagaaaatagatggataatcaatttccagttcattaaatcgtttgctttgcactttgcttgcaatatgtaaatccatttgaccagaacttagaagtggcataaacaattaacctcttcgacttatattaggcatgtagtaacaccctacgtcaggcgctcgacactctggagaaatatcggaaaccactcccccctcttctctctctcatctcattatgcacttgcttccccacagcaccattttatgtacaaatgaatgcatctttatatggttttttttcttaaattacttctctaatttatggtccggccatactattaaatttgttataattaaatagttacaacaagaatacacattccgatgaaaataatatttagctttttcaatagattttttaatattgcatctaattttacttaaatgtttcaactagtgctagttaatttgcacatgttacatgtattaattctttgaatgttttagttagtatttcagtttaatgtttcaaaagttagttttatacatgatataaaaatgtttcaacaatattaagtatttgcaaatatactgcatttttcatatgatttttttatgtctcactcgttgggactcaatgcttcatacaatgattgctagtattgcagtcaatatattcaaaatgttgcattttttttgaaacatttttattgagtaagctggaacatttaacgaagtggtgaaacaaatttttataaatggttaaacaacgttcaatttttcttatcaaaatataattctatgagatattattataaagatttaattacaatgagtataatggtcaaattggattattagcctcataggatggctgtttgaggtgaggcttttcagcgaaagcccatcgcctcgctgattaggctgagagctttcagccagatatacatggatatacaagagctaaaagctaggagctacaaccaccagtcgtagaaattcttcttcgaaccatttaagcaaaacaaaccaaccgatggattttctttggctgaattgaagaaggcaactttggctgatcagccaaaacatttaactttccgatgagaacctataaattagataattaatttagaagaaaatttcacttaaagacctaagaaatagcttaagataagcatataaaatgggcttaagccatatatgaatttatgcacatccatatagcgtcttgcgtgtgttagatagccaaccagagaaaaagattagagggagtaccgccagcatcagggaatgaagcacccgattttttatttttatttaaaaaatcagacgcctgatttgtagttacttccttaagcatgttttgtagttacttccttaagcatggctggttctgttttgcaatcacatgataccaattgccaaaccaaaatttcgcaacattcaaatctatgctgaccataaaatataacaattagcaatttagcatagggattagcatagacgttcataaatggtcgaaaatgtttccaatttggaagcacagcagctttcctgctatgttctcttt

SEQ ID NO: 65991 - DNA, 1287 bp, Oryza sativa
agaagcaaagatgacaatttcataaaaaaaaattgttgcaagtctaattaaacctacgcattagtactcttcctctaaatgcacaggttatagagatgagttataattcaagtcaaactcgagctaaccaatatagcctaacaccaaactcatatataggagtacatgctcctgtatatggtatagaggtctgtcaactgagtttaacatggacaatttatcaaattcaagcagtgaaaattatagccccacaaatttgaacttttacgctctacttagcttaaaattgaaattcaagattgtgtactgtgtatttaaattaatgtctcaatgactttgtgtgcatttgtgatagacagcaatcattcgggaaactgcagattgttctgactattttctactatggaaatagctaactcattgcttggaggcatttcttgtgttcacctttttgcttgatgtgttatcatgttctgcagcccctgaagtttgatcatccaagtcttcaagcatcaaatctccttctttgtcaaccttgatgccctttgtacgcctcttttttagtcggtcctttgcctaaaagggtaaatagaaatgaaaaacattgtcacccgacttttttccattgaaattaaataaaacatgttgacattccatgccatactcaatatttcattataacgaaaactcaacggacattctattaagaaaccaattcaaacaacctcatcttttgccatattactgcagcaattttaattcaaggtttgttgttctacagcatgtaaaacctaataacatgtaataagatgacatgtgtaacaattgttatagtacaataccaacaagaaaaaaagttggtcgccaaactcttccataaaccaatgaaaggtttccaaatgctttcatgatgatacgttttctaatgcaaaccataaaatgaactaggcaaaatctcaaaaacaaacaggagaaataagcttcgtacttttttgaggttgttttcttaagtttttcaataatacactacataaactccttgataattggcagaaccagaaatcaaccaatcatgaatcaagtcttaactcaataaaagtagtaaggtttttgcactgaatctaataaggggtgggccctatggttggtttattgtcccaatggggatagattttcccaatcatcttgagaacattaataacacggtgatttgcaactattcaaagagtttgaatagcatatgccaaacaggtgttactaaatggggaaaaaatgaacaaaagcatg

SEQ ID NO: 65992 - DNA, 883 bp, Oryza sativa
  unsure (1)..(883): unsure at all n locations
gttgattgagttgctgccgtcaatcagaactcgtgcgaccttgatattccgaatagtgggttcgaccacgatcggatatcgccctgggatgacagcagtcttgaggtggtcctcttcagagaattctatcttctgctcagactacttcatcttgggcgcagctccctgccacgtcgaacagacttcacgttccaccttcttatattctcgctttgaggagtatgtcgtggaacctccaaagatgtgcgagacatggagatcagagtctgggtatgctgagtccgattctagagtagccgcttcagcgtccttctcgaccacatgcactcgcttgcctttttccaatgccatgtgtattgcgagcgacttttttgaagacgaggcaatcttatagagagtgtctatctgacttgtgtatagggcaccatgttttcttcgtgtcgctgtcttgtgggtctacgcgcttgggagagtccgcgtattctgttgtgagaacatccgcttgagcttaacttttcctactcttgcaattttacttcttgctcgactcaggtgcgtctttgactggtttcttctctcctccggtcttcggtttgtcgttcttgcgtctnnnnnnnnnnnnnnnnnnnnnnnntcgatcgacaattgctcccatcatatttcactattgctcctggtcagaatctttcaggccatcggacatctcgaagtgaacgaccgaaagctctacacccatcgctgggggcggtgggttgtcggcgatcgtacatccttcgtggatgtctatctgatgttgaggatgaggaagatgacaacgatgacgatgggtcgcttggttccggcgtacgattacgaggacatcggctgggttctcgagaatcct

SEQ ID NO: 65993 - DNA, 2332 bp, Oryza sativa
tttgggagttaccctattggaaattcttggacgtcccccacgcaatcgacgtgatgcacctcactaagaacctttgcataaaccttcttggcttcctaggtgtatacggaaagtcgaaagatacactggaagcacgtaatgatctgaagcatatggaacaacgcggcgaccttcacccagaaccaaaggagaaaggaatccattacttgagtccagccagctacactcttagcaaggcagagaaggaaagtatgtttgaatgcttggagagcataaaggtaccgtctggatactccacgaatatcaagcgaataataagcacgaaggagaagaagttcacaaacctaaagtctcatgactgtcacatgttgatgacacaactgctaccagttgtaataaggggtatctttccagacaatgtccgggcaacaataacaaagctatgtgcattcatgaacgcaatttcgcagaaggtcatcgatccggatagattagaagcccttcagaatgatgtggtgcaatgtctcgtcagttttgagttgatatttccaccttcatttttcaatataatgacgcatctgctttgtcatcttgtcaaagagatcagtattctcgggcctgtgtacctacaccaacatgttttctttcgagaggtacatgggcgttctgaagaagtatgttcgtaaccgtgctcgtctagaggcaagcatcgccaagggttatggaacagaggaggtcatcgaattttgcgtagaatttattgaagaacttcgcccaatcgaggtacctgaatcacgccataaagggagactatggggaaagggaactctcggaaggaaaggaataatgacggtagacaacaatttattccgtaaagcccatttcacggttctgcaacaatcttcattagtagctccttacatcaaggaacacttggctctagttcgcgccaggaacatcggtaagtccgatgcatggattacatggcatcacattgatactttccccgcgtggctacgacaacatctcatgggtaacgagtcgatcaaccaacaacttgccttcctggcgaggggaccgtctgggtcgatcgtgacattccaaggatatgagatcaatgggtacacattctacccgagagcccaagacatgaagagcacgaaccaaaacagcgttgttcgtgtcgatgccatgggacacgatggaacaactggcacgtattacggtgccatcgaggacatatgggaacttgactatggtcctctcaaggtccctctgttccggtgccaatgggttaggttgactggtggaggcgtaatgattgatgacagtgggatgacaacggttgaccttaacaaggttggatactcggatgaaccttttgtccttgccaatgatgtaacgcaagtcttttacgtgaaggacatatctagcaaaggaaagaagggcagagggcctgacgagcctaagcgtcacgtggttctcccaggcaaaagaaaaatcgtcggagttgaggacaagactgacgaggattacgatcagttggatgggcaaccccctttcacggtgacgattgaccctagcatcctcctatcaaatgaagacaccccttactcacgtagcgatcacaaggagggaacaatagtgaggagaaagtacgtgcggtcaaccgtcaccgccaatgtattgccgtaattattgtgtacacgatgtaaactattttggatgtattgattatccatataaatcaattgttgtatggcatatgttaattacgcacgattattagaggttttaacaattttaaatcatgtatatgctagttatatgcgataattacaatttttaaaagttttaaatcacgcaggtggcatttacatatgttaattagagtttttaacaattaatttactatcattcatatgctaattatatatgactattcgaatttttaaaagttttaaatcatgcatgtggcatttacatatgttaattagtgtttttaataattaatttactatcattcatatgctaattatatatgattattacaatttttattaattttacatcatgccgtatgtatatacatatgttaattagagtttttaacaatttaatatcattcatatgctaagtatatatgattattagaatttttattaattttaaatcatatgtttgcttattacgttttatccacttaatttattacagacaacaataaattttcgaagtaattgtcattaatttttgtactttaaataattttaatgcattattttctattttagaaacacatatgtaatggaaattaatattcagtgcgctt

SEQ ID NO: 65994 - DNA, 20311 bp, Oryza sativa
ctaaagatctaggggtatatatattcccgatgcgcgccctcgtcttctccaccaacacttagaagtttttgcccgatcgatctctctcggcttctccttcgccgccactgcctagggcatccccgcgccggcgccgccgtcgtatctcgccgtcgtctcgcgctcgtcgtcgtcgccgcctccgcctcctccgccgccgccgcatctctagggtgagagccaccgccgcctccctctcagctctctctctccgatctcgatctctctctctccctctcgattgccgctggccgcctcgttgccgacgccgacgtcgtcacgacacgacgccgcggcggcatggcaccgccgcgccgccacgccgccgccgcgcaacgccaccgcgtaatgcctccacgccgccgccacgtcgccgccgcgccgccccgccgccgctccgttgccgccacaccgccgctccgctgccgccacgacatcgaacgaattaacgtgaacgtgaacgaacgtgaacgagcgaacgaatgtgaacgagcgaacgaacatgaacgagaacgagcgaacgaacgtgaacaagaacgtgaacgagcggacgaacgtgaacgagaattgaatgtgaaagaacgaacgaacgtgaatgaacgagtgtgaacgaacgtcaacaaacgtgaacgtgaacgaacgtgaactaacgaacgtgaacgtgaacgaacgtgaacgtgaaatgcaatatatgcaggtgaatgaacgtgaacgaacgaatgtaggtgaatgaaacgtgaccttaacgagaacgctaacgtgaacgatcgtgaacgaaacgtgaacgtcaaatgcaatatatgttacttcgcgtttatcctaatacatctttttgtatgttgcagaaaagacgttgtcggagtcgtccctcaagccggagtggtagctagccctcgaaggaattcgcgcaggcaagtgacgtaattatatatatgattgttatatttgtaatgcaattaagactattagatttaatatacgacacttagacttagttttaatataagattattatagttttaatataagattattagatttgtaactagacttagcatataagattgtgtagggttctaatatacgacagttagactacgcatatatgactatttgagttttagtataagattatttgagttttaatataagattattagatttgtaattagacttagtatataattattgactagctagggtcctataatatacgtcacctagacttagcatatatcactatttgagttttagtataagattattagatttgtaattagacttagcatataagattgtgtagggttctaatatacgatagttacacttagcatatatgactatttgagttttagtataagattatttgagttttaatataagattattatacttgtaattaaacttagtatataattattgactagctagggtcctataatatacgtcacctagacttagcatatatcactatttgagttttagtataagattattagatttgtaattagacttagcatataagattgtgtagggttctaatatacgacagttacacttagcatatatgactatttgagttttagtataagattatttaagttttaatatacgattattagatttgtaattagacttagcatatacgatagttagacttagcatatacgacagttagactaagcatatatgacttcgcatacacgacagttagacgtagtatatatgacttagcatatatgattgttagcctataagattgttaaaacataaatgtctcatgacttagcagttgtttcctatatgaacagatggctaatcgcgatgaggaacagatattgtacgatataatcgtagagggaagcagccagtactggaacgaagaagagggtaacgaggatccaaaccagtatttgaacgaggaagggaacgtggagagggatgcgtaggggaaccaggaggggcacgtggaaagggatgtggaggggaaccaggaagaggaggctagtggaagtcaaccctccgctggacagaagagggcacgcgggcaacgaggtgccgcgaagaagcttgagggtcggcacatcataacggaagtggacgaagacggccgacctagtgccccggcagaagccgccaagaactatgtacatcacagcggttgggttgtgcgggataatgtgcctgtcagtacggtgtactggcgcagaacaagggcacgcggagatcatgagagctttgacacagattcggagaaagagatgctgtgggccacaatgctcgagacattcacccttcccgcgggtatataagacaaagtaaaaggtggactctgaaggaaatggcagaacagtttcaaagctttaagggagatctgtaccagaaatatatcctgaaggggcagacaccgaacttcgatacattcccaaagctaagagatcactgggacaagttcgttgcatataagacaggtgaacaagggcaagcgatgatgggaagaaacaaagaaaataccgccaagaagaagtaccatcaccacttggggtcaggcggctatagcgtcgcgatgccgaagtaggaggagatggaggctagcttgcttgagaggggtatcgaaccggccaccgctaattggccggaacgatcgaagttctggtactatgctcacggtggaacgctcaacccagctgatggctccctagtcttcggcgatcagatacgcgaggctgcgcgtcaactaacagacgcagtggaagcctcttctcagggcacgttccgaccggacagagagaaggacgacctgtcactcgccctgcagactccagagcatccaggatgaacacgagggaaaagggtgattccttggaagattgggttcaaggaggacatccacacatacaggagtcggatgaggagcaagagagataccgaggcgaagattgtagatcttgagttcagggtatcgagctacgagctcagcatgcaagaggaggtggcaaggaaggttgatgaatgcatggccgcacatcggtcccatgatccccagccgaccatgcctcctgctatggtgagcccgtcaggaaatcgtagcagctgcgcctcaacggggtaggtaggatcacacagcatggacgccatgcaaacccaggacgaaaccacctgccccgttgatgacatcactcagcggacaccatgtgagctgcatattcccttcaagaacttatcaataaaggtaagctcgtagtttatagattttagatttggccattccgctagttgctgcttatatatgttgattactaataaataacctctcaccacatgaaggtggcgtcgagcatggccatcccaacggacccttcaggtacttaccactgcaggccgattccagcaggatactccaaggtcgaaggcgcgtacgaggacctcgagctggattaccctggaggagacggtgagacgcatctacgagacacaagccatgctattattctatggcgcaagcggtacatcatcctccctaggcgacaagcggcgtctcgtgcaccatctcctccggctccgccatctcctcctcaggctcctgcaccgtctcctcctcatgctccagcaccgtctccacctcaggctcctgcaccaactcctcctcaggctcctacaccgactccgcaagctcctcttccggcaccttccaagtcaagggccccccaagctccaccgcctgcccccacaagggcaacgaagaaggcgaaagttgacgccgccaagaacaaggacccggggtatgattgcacgcaagaggagcttgatgcttacgtggcatcagaagtcaggagacaattcaagcctcgaagtctagaaaagaagattcctatagacccgagtgtcaggaacttcttcaggggtatgtctgcacctgccaaggaggccataaagctatcggactatgagcgaacactcaaaaaagcatcttctggaaagtccaaaccagtccctcagcttggagagcaaccaaaccaggagatcgagccgttggtgaccggtgaagattttggaatacaagactttattaatgacaccgggctaactacggatcaattgctacgagacgcaccaatcgaaaaggcagaagtgaaatacatgtacgaactcggtaaactgcttgtcaagcctgagctgctgcagtccctacccacacaaatgtacaagttccatcagctgtacatggagatgagcgccaccggtagagagatgatcggagcgaggatcagggacacagacttcttgcaaggagatgacattctctggatcaatttcaagggaatctacgaactataccagctggacgccctcgacgtctctattatgagttgctggattttgtaagtatattgttcagttagatttcttactacgtctcctttaattaattaggtccttgtatataagtagactatatataatatatactcccttttatcgttgtagaatggagattcaaagggcccgacggcggggggtttttgatactggattcatcgaccctcggaaagtaaacgttgcaatgctcgaccaatatccgcaagccacaaaggacaatctcgtccatctcctgaaggcgcagcattacaagacgttcatattgttgccgtacaacacagagttagtttaattttactgtcttcctataccaaattttattcccatacgaacatgctaagtgtttcatatgtaatgcatcccacgtacattgcagattccactgggtgcttttactcttcgacctggaggcctacaccgtcaacgtatatgactcaatggataaaaaagagtctacgtttgacaaggttttcgaacttatagacaggtactgtcataagttcctatgttaattaagaatcttgttatagttaattgctactacaaatcatagctttaaactccatgtagggcttggtatcggttccgtcatttggtccgcggcaaatggagagaaagacttaggcggaagttcaaatttcctgtgagtacacatgctctacatttatatttctccgattcaaatacatacaagtgtacattaattagatctctcgtcgtttgtcatttatttatagtgcgcaaagcaaaagcagggaactaacttgtgcggctactacgtgtgcgagtattgccactgccttgcagaccaaatcatcaccacaagagagctcgatgtacgtacaaataaattcaaaatttcattacgtatcgatttgttgtttaattactaatcaatttcatacattcatataatttattcgcatgagggataacctgatcacacacaaggaatttatcacggcggttcaagaacaactcatgggattcatcaacggacaaatccttgatcccaagggtgaattctactacgacagaaatacaattcataggtccttagcttctgagatagcgactactactacgttgaaatcgtagctagctaggacatataatgaattgtaattaatacatgactatgtttctatatgcatgtgtacacattttctataatgtaaatatatattttggtcatatatatatatatatatatatatatatatatatatatatataaaccatgcagcaacagggccatgcaaaaaaaaggtcagctacaccaaccgggactaaagatggcttagccggccacgtggctgagccatctttagtcccggttattttatccgggactaaagatagcaatctttagtcccggattggtagtcccggtttggaaaccgagactaaaggggggttacgaatcgggactacaaacgctttctccaccagtgcttggagtccgtgctgcagctggctacagatctgtagcccgctgctcttctctctcatcttttatcttattaaaatatatttatagctggctaatagtctgctattgtacctgctcttagggagaaacaacagtcagtattgtggctcagtggctgcaacacagtagcagtgctcatcgatcattacatgacaatatgacgatccacagcacgtacattacacatttacacggcagcaaagtacagtagctactcctaattagtttcatacagaatgttggatgaatatatatactgttcctatataattatccccattagctctgattataggtagccatatcatcttatttatttcagtcactagatcaatatcaaactccaaataataaccatgcatcaaaccatgtgtaatgcaacctttgtatatcacttcttcatgttctatgtcaccatgcatgtatccgtttaaaatagctaataatcttcacaaatgactcttaatttttttagacaaaatgttattgcaacgcgcgaggcatcattttgtttcatgaagggatagttgcctatcgagatgctcctaattaattaattgtggggtagctactttgttatcaaaaaccatttaagtatctgttgattcattaatttagtatcgactttgcagtagcttatcaattgtttttacaatgaaaatatccttatgaacatacaatgttgtaagttgtgttatctcgttagaaggttcaaaaacactttttcctcaattttgcctacatgatacgatatgttagcgtgtacctcacatgaatcccatacattaggtcatttcccttcttcgtctccccgttatctccccagtagctcacaacattgtttacacttttggaaaacctctgaaaattgggtgatttcggtggtgaccaaaaaatcatgatttttggacctttttcaccaaattattgaaaattttaacaaattttgaacactattttgactacatttcccaaaaattgaaaaaatctaacaatttcggtcgagatagttacattgccgaggggtctgaaatttcaatcctaacaacatgacatcccctgtgaatgtcatcgatctgtcaaagtgcaccaacttcccacccaccgcaccactaaactcacctctatcacatcgaacccttgcctcacccacccaccatcacaccaccagcctagattaagccaaacaagagaagaaagagtcgcgttgcccgtctgccaacgacgtagggagagggtatccttgatgtacttgatgccaagccattttctggagcgggtgaagggtttggtgtcatctcagtagcgaaggaagccgtatgagttgaagaggctatacttgatgacctacaggccttgtagtctacctgactaatagagacgccgccatcagttgcgtggacatggtggtgggtagtgatggtggcaaacgatgcgaggaggaacacatagtgcttgttgctatggtgaggagcatgtgtagagggagttgtcgttttctgaggagcaagagaacatgagtgtgaggcggcagagcattgtgggaccggtgagcaatagggagaggaagagaagatgccacttgagtaagtgggctccataatagagtgccacactagcatgttacgatataggcgaaagcgtaaaagattaggaagtctgatctccagagaaaaaacataagacgaaactaatagtgccatttaaaataaataatagtgccccttgaaaaggtgacagtttggttagtgacaaatagttacattctcgttgggccaccgcggtttgcttcccacaagcctacaggggtgagggggcctggccttccacaacaagtccggctcaatacagccgcaccgcacaaaacctgggcccccaacgtcgacgctgcggcgctgcctgctacgctcgctttctcctcgtctccgctccgcttcgccggttgacggtgcgacgcacgaagcgacatactctgatactcgcgcacgctgcagctgcacgcaccgccgaggcgccaacacgacgctgtgccgtggcgcgccgacaatcatcgcgcatcaccgtggcccgtgagaactgaggtaagtacgtacgtctccttccagcttgccctggcacagcgtggtctccctatactcaattgctggcttcgccccctgcctgcagtggcccacgcctcggattcgaggatgcgctgcctccgccgcccggcaacccacctgctctgctccgctcggagcgcccacgccgggaacgcccccagggtgctcgacgaaatgccccttccgcctctcgctccatcacgccgcacgacgactctggtccgcgcgcaccacctgctcggcgcaatgcgcgggccggggttctgcaccaccgtgggctcagaatcagatgtggagccgcgattcacggtggtgccgggcgccgcccaggagggccttgcaccgggcgtgtccgaggcggcagaaagggtctgccgcgtcgtgtctgcccagccggagcatagaattgcgccggtgctcgatgctcttggggtaaccgtctcgccgcagttggtggccgaggttctcaagaacctaagcaacgctggcattcttgcgcttgctttcttccgatgggcagagaggcagcaaggcttcagatactcggccgagggattccataatttgattgaggctctcggcaagatcaagcagttcaggctggtgtggagcttagtggaggccatgcggtgccggagctgtctgtccaaggacacgttcaagatcattgtcaggaggtatgcccgggccagaaaggtcaaggaagctgtcgagacatttgagaagatgtccagttttgggctgaaaacagacttgtcagattacaactggctgattgatatattgagcaagtccaagcaagtgaagaaggcgcacgccatcttcaaggagatgaagagaaaaggtaggttcatacctgatctcaagacatacactgtcctcatggaaggctggggccatgagaaggacttgctgatgctcaaggcagtgtaccaagaaatgctcgatgcaggcatcaagcctgatgtcgtcgcgtacgggatgctaatcagtgcattttgcaagtctggcaaatgtgatgaggctatcaaggtgtttcatgagatggaagagagtggttgcatgccaagccctcatgtatattgtatgcttatcaacggcctcggttcaatggagagactcgatgaagctttgaaatactttcagctttctaaagaaagtgggttccccatggaggtgcctacgtgcaatgcagttattggggcttactgcagagccttggagtttcatcatgctttcaaaatggttgatgagatgagaaagagtggcattggcccaaatacccgtacctatgatattattcttaaccatcttataaaatctgagaagatagaagaggcttataatctattccagagaatggagagagatggctgtgagcctgagctcaatacatatacaatgatggtcggtatgttctgtagcaatgaaagagttgatatggccttgaaggtatggaagcaaatgaaagagaagggtgtcctaccctgtatgcatatgttttcagcgttgatcaatgggttatgctttgagaaccggctggaagaagcttgtgtatatttccaggagatgttagacaaaggaattaggccaccaggtcaactttttagtaatctgaaagaagcgcttgttgaaggaggcagaattaccttggcacaggaggtgactcaaaggttggaaatgttacggagaacaccaatgcgtggttgagtaatcaagcacataacgtaagacggcatcttagctcttttgactctttagtttgtcagaaaacggatgtctcatttacaacctacatgatactactagtaaggtgcccatgtgtctgcaagaggtcatcaacctcatgttcggccgtatctttatgcttctcaggcatcacattcgactgcattcatgaagaatgcgcatctccggtcaaaaaaaaaaaaaaggaatgtgcatgaatgcagcagattttttccttcctttgagtatgtctaaatacgaccgaagacatccatatatctatctacatcgatatccattggagctgacatggcatgattgtgtggcaggatgggaactgggtggtaggcgcgttggcctgactgtatgcaagcagcaagctcttataccgtcctcacttggcttggccgggccctaaaaatgaatttgtatttcttgtttaaaatttactcctgaaatagtttacatcatctgtattgtatagagggattgaactaaataaaaggcgctggctgctcaaacgtttcaaattcataaagaaggtaagcaagttaccaaaccaaattacacgtttcaaatttataatgtggatggctgaaattttgtttatgacaaccacaaatgatttaactattacaaagctcaaaagttatttaaaaaaagcaaagagatgctgataaagaaagttctttagaaatcgtaccatttggtaaattgggatatgtaacatggcctaacatagtgataggttcattggaaatcttgaagaaaaagggccaccaagccccaaatatcacaatgctgcggaactaagcttcacggttctgtttttccaagttgcaatcatgtgttctatatatttctacctagattgaatttagagatttgagcagctcaacaaaatggagacacatcgcaatttactgtatataaactttatagtcatacaggtacaaacttataaatgcatcgacatcatgagtgaattactaaccacaaacattttttctttagtatactgtacacggtaacacgggtacggtacattacaaaacagacagcttgaattcgatatctcacatgccattaagtacggagtactacccaggatctttcttatttcagggacagtgatataagatgttcttccatgggtgtccgttttaatttcaataggacattgcttattaactgggacctgcgttctggtatgatacaaacaccttcagttcttatgctgcattctaccgctctctgcaccagcataaggatcaatgataacatttatcaccgctggcttcctggcacgaaacgactctgaaagggcggattttagctcatctggtgtctcaacaagataaccttttcctccaaaagcttccatcattttatggtaaccagcagctggaacgaaagaggttggggcaggatcatctttgtacggtccggttatctcatcagggcttctccgatcaccgccataaactccattattgttgaagacaattacaacaacaggcagctggtaccttaccaatgtctgcaaagtgaacaacaaagtataaacgttaaggtacctttagtacaatattgtgaaaatagaacatagtaccgccgataatatatgacaccattgttttctttaattcgtttgactgtcttttcaagaaatatgcaaatagacaaacatacacggcacgtttaaagtactattgatgacaggtctagtggtactcttttcacttaactaagtaactgaataactagtgtaactattgatgacaggtctagtggtactcttttcacttaactaagtaactgaataactagtgtactattgttggtcgaagtttaaggaaaatgtcaatggtgccatatatttaaaaccagagggaatagctatgtactactctctttttattaaaagtgcaactagttagcaggcacagaagcagtgaggttttctcccatctttcggaggagtatacctccctaccacttaagaggcaaaaaaattaaaatggctgatctaatcataacaagaggaacaattgacaatatttggcacataaatattaatcacactatatcacataatttaatttgcacagttccattgttgcttgacccacacatcggccaattgatatccaactatcaagtagtagtagcaaaccacaaattctcaaacagttattaatactcgaagcgaattattgagcatgagtcctacaccctacaatttaggagtgctccactaataattcattgaatgggttaaacacaactatatactaaatcatgtcatcttataaatttattattaaacaagctatacaactcccacatcagatatagcattgagaagaacataaagcttggaatggccttaccttacagctggattttaattaataaattgaagcatatcattttgttataatgacaaaaaatgagcattattagtttcaagaaaattatgtgcattaatgtaagaaacaacaaggttaacataaatacagaattgcatggttgccaattggcaatatttccagataggcctctcgtaaaatgctgtaattttaggttccctgtaaaatgtataatttaggactaagggtatcctgaatttctgattctttttacttcgatattacgaaggtacaactacgatcaacatataaaaaatacgagtaaatttcactttgggccacattttttaccgatgtttcactttggatcaccctttaaccaatgttttcactttggaccaggtaaccttgccattgtttcaccttggaccatcctcaactcttttatccatgtacatctaatttgtcatatgtcaaagaaacggtctacaatagtgatcaatttgagttgacatatgacaaattagggaccaatggtacaatagtgatcaatttgagttgataaaggatcttctacctttttatttaaatatatacaaacaaccagtgcgttggctgtgtgccttatggcagaagccggtgatgtaaaaacattttcattatctaaaagaaataatacaaccagcacagctataaatgatacatgattcttgggaacgctatttaaatgccatgtcatctttatctatttgttagaggattttatttgcatgatatcccaatttcataacttaaggggatttgttagctcattgtagttggcagtctcatagttatactaatattatgacaggtagttattactatatagaattgtctgaatagttttgatatcatgacatgcttaatcaactactttttgcatgagcaaaaatgaatatcacttgcaccgcacaacagcatggcaggagcaaaagtaaagaatatgagccaacaaaggtgctaataatagcattgtgcaaattaaatcaaataaattgtgaattgtggtagatgttttatttgtcaaagtggaacaggaatgccattattcatacctcaacctccattgcactgaatccaaatccagaatcaccctccacagcaaccacaagtcgatcaggctcagcaactgcagctgcaacacagaatcccaatccaactcccattgtcccccatgtacctgcatccagtctagtcctcggctcgttctgcacaagcactgccctgccgacatccatggtgtttgccccttctgagaccactacaggagcagggtttccctcagcaagtatagcatcccggataatccgcaaaggtgtcaggaaattgaatggcacaacatccttggcaagctgagcctccatcttaagaacattgtccctggccttcttggtgattgcttcaacccatgggtgtgatggtgccaagcagaatggctggtccttgatctccctattgataagctccacaactctcttggcatccccaacaattccaacatgcggcttccggagctcaatctcctcctcgcagacatccacaagtatgaatttcacatctttggaccatttgggtggctcaccgaagtgaagcaaccaattaagccgagcaccaacgactaatgccacatcacattgcccaatggcgagagagcgcgccgcggtggccgacagtgggtgcgtgtcgggcacaacaccctttcccatcggcgtcgggaggaaggggatgcccgtggtatccaccagcttccagatggcgtcctcagcgcgagaatacgccgcgcccttcccaaacacaaccagaggccgctccgcgcggcggagcagctccgccgccttctcgattccctcgtccagggacttgtgcttgggtggagaagaatcggatttggccgaatcggcggcggcagcgtcgatgagggcggcggcctccgattccgtgagggtttggtggaggacgtcggatgggatgtcgaggtagcagccgccggggcggccggagacggtggcggcgagggcctggaagacgaggcgagggatgtcggcgatggtggttgccttgacggcgatcttgatgaaaggcttggtggcggcgatctggtcgagctcctggaagtcgcccctgccggcgtctggctgggagcaggagccggagaccatgaggagcggccaggcgttggcggtggcgtgggagaggcccgcgaggccgtggacgcagccggggccggagacggtgaggagcaggccgggggagccggtgaggaagccgtaggcggcggcggcgtagcccgcggactgctcgttgcggaaggcgaggaagcggacaccggcggccgcggcgcgggacgcgagggaggtgaccgggatgcccaccaccccgaacatgtgccgcgccccggccgcggccagcgcgcgcccggcgagggcgctgccgtcgaccttcatggcagctggagcggcggtgtcggtcgccattccctctccctaggctggctgcctggctggggttgcgtgccgtcgcctgagcagctcaggcttatagcgggggcggtcgggggagagccggagagtcgccgcgacggcgactgcgacggcgacgcggcgacgccgcagttgaagctggaggcaggcagatgaacctgctgctaggaagttggaagacgcggtgtatctggacgagacaactccaaagaaatactcctatcctactcgatcatagtacacgtcactcgggcacttgcagacttgtttgaccagagttgtcaaactgccgacacatcgtatctgtttttcggaggcgcatgaagcgtccgattttagcaggcagttgatcgaaattgtttcaccgggtacattgtaaatgtcaaccaaatcagcttatggaacattttgctatagcgtatgaaacaaacagttttcaaaaaaatcagacgatgtttcaccctatataaaaacattgttttagcaaatagcgaaagaatgtttcaattcgctgcaacatatgatccgtatataatgaaacattacgagtacacttgctgaaacattgttggtggaaaaaaaaacgaaacggattcccttaataaagcgtttccgtaactgtgcatgaattggggtgtgtggtgacgggtgaggacggcgcggaggcgcaggagcgcgggaggacggggcgtctgatgcatgtgtgcccgcatcaggcgcccgatttaaagaattttcgctgtttttctggcaaaaatttcatgttatgggactgtttagatcccaccctaaaattttacaccttgtcacatcgaatatttgaacacatgcattaagtattaaatataggctaaaaataagtaattgcacatattgcgactactttgcaagacgaatcttttaagcctaattgctccatgatttgacaatgtggttttacagtaaacatgtgctaatgaggcttaataaatttgtctcgcggtttactgacggatactgtaattagttttttattagtgcccgaacacctcgtgcgataccctatataatatctaatgtgacacgccaaaactttacacccctagatttaaacacccagtgtcactgaaaaatgtgccatttgagatgccacctatttttaatttttcatactgatcattagaaatgtttatatctttactacttaaaaaatttgtagtggtggtggtgagtcctaaacgatcaaatggttaacattcatcggaggatcctctcacaggcatcagcggatgagattttctcccacgatccacccatcgcaccacttctcatctccctgatccgcatcacgctccctctctctccgatccgtaatttcgcatcgcactccccagccccccatccttcctcctcagcgcgccgcctcctcaccccaccgacgcgccgccttcccatcccgcccaacccgcgccttcttctccggttgtcctccctccgtattgtgccgtccctcgctccgccccctccctctccatcgcgccaccgccccctccataaaccataacctccctcaaatcccgatcatctgcgtagccatcgttatcgtcggaccgagctcttcgatcatcactctctgttgccgccgctgcatcggacccatcggaatggtggataggaatgtggacctcagtatggttgaggggtaggacgagatgatggcggtggttgcaggcgcgtccaccagcacgctcgctggagtgtggagaggcgcgcgcccgctgctgcgagtcaccggcggtgtcgtcggcatcatcgtcagctagctctgcatattaaaaacataatatgagttgtcaagtaaagttagtgcaatgtaataagatgtttttaatttacctatgagattcactattagtatttcctcttgcatcaatttagtggaagatatcaaaaaacaacagaagatattcaaaaaggaactatttggatggaaatatgcatatattgatggattatcaacacccggaagctaatggtaaatacaatttatttttctcgatagcctagcaacataatttcattaggataaaacctttattcgtacctaatatatttccctcttgctaagatttagctcagggtactcttcattcaatggcctagccagatccatgctgcgtgttaattatgacatgggttgtgctgtttcttgttggagaaaatcgttaagtatctcctggcattcatgccgctgccatcaacattctttcttgatggctgtgagcatgtcatattttatctggtgttatcccagctgatgagcatcccattcgattttttttctttgtttacattggttaagcttgatgcatttttcagatttgcttccatggatcggtttggtcaggtagtcttgttgcaatgcagagttttagaaatgaacggttcatatacttcatatcatagttgtacatagtggtttgttctaatcattcccatctgattcttgggagtagccaaattagtacatggtcagatattaggaaggaagagcagtataatatctatgtgcagtttagttctaattgaccggctattctcacacgttggcttttttattgactaagatatcatttttcttctgttttcactgcagtccaaatgtgctggtcaattcataatcgatcatcaggcctggaatttgtctcaaggtatatacatggaatagtgttccaatatgagtagtgactaaagcagattaatttgaattgtgaactcttttaccaagtgaacagagactctgtcaaataatcaggtaagtactaaaatcctattaatcactataaaattacaatctcatttgatgttgccttttccctggtgatcataggagtgacccttttttttcatgcttcaaaggtatatggtttttgtataaaattccatttctcagtatagaagttaaaactctcatttttgtctgaactaataaactattgttcttctccaagatttgttcactaagttgcaattgatagcacatttttacattttcttggcgcgtccatttgtgcctccacagttgcctcgtatgctaccactgacatttcttattattcattcctatttcttagagaattgtatttatctatgcaaaatcgtaactggatgtactgaggattctataagtttttaaagattaccgtgaacgcatagtgtactgtccagagaattactcagattcatttatatctttaatggattggattccatgtaaattcagttgtaatcctttaagatgattttcagttttgtatatatatatatatatatatatatatatatatatatatatatatatatatatatatatatatatatatatatatatatatatatatatcgtctgttcaaggcatataacttaaaatttagcatgtaccagaagattattatcagtagaccccaaaaaggtcacactccaattttgatttatcaagtgcatgacccttgataaatttactcatgtgtgtgatgtccgtgactgcttcccgaagcccaaccaattttgttttgaggaaaacatcaactaactatgtatcacttaagagggtaatattcagaacttgtgatcttagaaaatgaaaccgtattcttctatgccaatgcctaatggttagagaaaattcttttcaagtatacttgatagtctgatacattaaccatattcctttgtttagagaggaacattagccacattctatcctcctcatttgccagtcataacaggcgagatgctttaatgcatacattttttgccgttgcaacgcatgggcacccaactagtattgagaaaatccaaaaaatatcattgacaaacactgaaatccaaaaaatgcatcgacgaatgcaagttccatgaaataccattcgtacaagcgattttgtcccagaaataccatcaccgttagggttccatccattccacgcacgttaaaaacactgttcatcctatagaacttaacggagggttgctaacgaaaccctaacagtaatggcattttatgaaacttacattcgtcgcatttcttggattttctcttatatattttgaggatggaaccaggtgcgccgatcatatgattattctaaacattattttctttgtcatttatcttattgctatacttgtttgctttcttgtgatagatgaggtgtagacccaaattacaatagagccctgggataatggaagtagtatggaattgctagatttatgtcatcataatttttggctaattacagtcagatcggtcaccgttcaaacggtgctgagatttggtgctgtcgcacgcccgcgagaccgtttccaatgctgcatgttcgatcgatctctgatcaaatcgtgtggctgagacctgctaagggtgtgacatagctgctgctctgtctttcttcgagtattcttttctttgatcaatgcgcagagtagtgataaatcataatgttagggctatagtgtggttacatcacgtttaaactagaatcacatgttagctacacgtgacttacagtataattataagtttagttatatgtgtatgtcaccggttccaaagtgtaatattttacaataatatctaattcaaacttcaaagtgaaaagaatacgtagcctaatttacttttaatgataaactaactcctagcaatatatctgatataggtactttaggagcggagggagtacacaataaatactgctagaattacctagaaaattacatggcataggccaaagtctgtaagactgcaaagagtcagtgatgtggtaattagtaagccacgttacccaggtctttgttattcgattagttttgctatccaagtatatgcatcgtatctcctaaactcgttatcaatcggcatcaactagtaaatcccgcaccggttacctatatagagtactagagaattgttgctccgtgatttttgatgtttagtggctcccccatccgaatggagatcctctatcttcaaacatcgtgttttattattgacatatggaactaaagtttttgttagatcctcggtgacaaggtcacgtaaggatcctgatcctatctccctatcctaacgaccagccaggagaggacgagtcaaatgcagagaacatctttgtctgaacaagggcgacgctggctagatagacctcttcccgcgcgcgcgcttgcacgtctcgtcagtcatgttagcatcaagccagcgatgatgaatgatggcccagtgcatgtattttcaattaaggaaaaggaaaaaaaatagtactccctccgtttaaaaatgtttgacaccgttgactttttagcacatgtttgaccattcgtcttattttaaaaaaattgtgaaatatgtaaaactatatgtgtacatgaaagtatatttaacaatgaatcaaatgatatgaaaagaataaataattacttaaattttttgaataagacgaatgattaaacacgtactaaaaagtcaacggtgtaacatttcgaaacggagggagtatgagtaacagaaaatgatgaatggtctagttgaatcgctaggtcgttttcttctttttccctctttcgtcaggcggagcttaagagatgatggagtttgcagggagcaaggaccgggctagttgggattgctaatg

SEQ ID NO: 65995 - DNA, 2490 bp, Oryza sativa
ttgtttggttagtgactaaggttgccacgcctaaggttaggcgtttgccgctagtgtggcgaatgatttgctcgccgcgtctttgaccagaaaaccaatggcaaatcaactacgttgtggcaatttttttgtggcagccaaaaatctggacaccaaacaaacggtaggctaagcaagtgtggcatgcctaatatgaggattagctggttgaggcaaccatccaaacagcccttaagtcctctaagtgctagaattcgattcggccacatgctacattgctaacttcaaatggccgccagatttgcatacgagctccgttttcagcccatgagtacttgatggaaagatctcggagtactctttcaaacggatccagcctcatcactaaattccatctaagtcatctgcaattgatgaaacaaggtgttgcatcacctatagtgggtctatggggtaacttcgtttgggaccccggcccaagtggggcccatgtgtggtgcgccccaaccaggtggagcacgaccctagggaccatttggtcgtcctcccacctccttaaatagctatgtactccttcagggtttctcggattttgtttagattaaagtttagcttcactactttgccgtgtaatcctgtgataggttatatcgccagtttcctcattatggaaccccaacttatcatttgtatgtaattcctatttgcaatttagattgcttttatgttgttcttgcttgtttcttcgatttgtttgtaggaataagattgatctacaccagcaagatcaacaacccacagagaggtgtatcgatctctaaggcgcaacacaacaacgtctcgtacagttgtagttgggtcgcaacgtttctcccaaatgcattaaagatcgtcccactgaccagcactaaccccgataaattcgtcaagatcggggcgacgttgggcagcaaataggaactcgagctcatcaccttcctccgcgacaatgcagacgtgttttcttggcagtcgtcagacatgccgaaagttcccagggaggtgattgagtacaaactcatggtgcgacctgatgccaagccagttaaacaaaaactgcggagatttaaacctaatcgaaaacaagccatacgagaagagctccacaagctcctcaaagctggcttcatcagagaggttctccatctagagtggctggtgttggtattacttaacgtcatagatagaatgcgcaagtggcatggaagataccgatgtagcacttcacccgggagtattccaaggtatcgatttccacagtgaacgtgtttgctcagttcttctccatgttcatcgaaggacacaaagcaaagataggcaaagggcagagaagatttcctagtgagaaaaggtgtctacagaaagctcagtttaatcctaacgcgatacttcgggcactggcagcctgctgctcccagatatggctctactgcatacccggatagagaggacttcagtgtgattgaggactgtcaccgcctctacacccacctgaaacctactgtgggttacaaagcaatcatcggaaaattaactacctagacaccgcgtctacacaattaataactactctattgccggccaaacactaaagtaatcactataaattaatggacgatagtgaacaatgattcagcatgctaattatgaactaaccaagaataattctcactaagcaaatcttaattacttagaataatatttctattgaagcagagtaattaacaaagtataagaataaggagaggattaccgacaactccggaattcctccgacttcttctagtttactctctccctaattataagtatactatagaacatataaagaacctaaagtatacttagagcctcttgtaattcagctctacatcttggtgtgtgttgaaatgaaggaggtgagggggtatttataggtcgaggtgccttgggagtgtggagatcctccatggactcctaagggcgtattcatcctctccttgccatgtgtccatttgaatgatggttggagcgccggaaacagccacaaccgtcatcaggaaagaagttgctatcgaactcaacttgggcctaggccaacggcctctgtcaaggttcggtcgaacttagggttctgccaaacactgaccagctccgttggccccggttttcggtctagacactaattttgggccctttattctattggtatggatgtttggctcatttggaagtgtttaatttggtttttgggtccaaaactttataagttagggtacggtttgattctcctcctccttcatgtatatttcttctcagcttaggtagtttgtcacctacatacgaatatactccaacactcgtgaaaattgttagaaataaactctaccactatgttggatgttttatatttatggtcttacgcaggtattaacggcgttaatttggcacttaacagccgtcaatagctgg

SEQ ID NO: 65996 - DNA, 2603 bp, Oryza sativa
tgttttcttctacactagaatgcctttcgggttgattagcgtaggcaacacgtatcagcgcgagatccaaggagctctcggtgaccaaatcggatggaacgtcgagacatacatcgacgatgttgtcgtcaagacaaagacgggcgacacactgattaatgacctcagggaaacattcaacaatctccgacgacatcggctcaagctgaatcccgagaagtgcgtgtttggagtaccatcggggaagctacttggttttctcgtctccggacaaggcatcgaagcgaaccccgagaagatcaaggccaccgagaatatgaagtcatccacaagactcaaggaaatccagagactaaccggatgcatggcagcactaagccgcttcgtagccaggatgggagaataaggacaacctttctttgatttactcaaaaagcaagacaaattcgagtagactcaggaggtcgagaacatgttcgtcgcgctcaaatgctacttgtcaaatccctatactcattgccccacaacatgatgaagagcttttcatatatataactgccactccttattctatgagtacggttatcgtcgtcgagagggaaacaatacaacacctggtgtatgttcacggtcgttatcgatcagtttcgaccgtcaatattaccaaaatagaggagaactagtgatgcttgcaatgcatatatctgttagaataataatattccactagtattaggtttactaaccttttgcagagaatgaccataaagtggaggagaatcgacatcaacacggacgataaatcaatcggacgatgtcgagaatcagacttatgtatgaatgggccaagaacacagaattgacatgacaaaccgggccaaaattcacaagtctacataaaggagcaatagaggagactgccagccgaaaggtgggctggttgggccagcccctggttcagccgaaccaggaggttcggccgaacctccctcgcctccgttggatccaggttttggctggatggttgagatgaagccctaacgacggttggagggtattaccgaccaatccaaccgtcacaaccgtcatagtttagctataaaaggagctcctcttctcacttcacacacacacctcaagcaagagctctctcatttctctcaagtttagtttagtagtatctagctggtggaataggaatagagtagaaatcaggagtccggaatccttcggaagagttcgggtatggctctagtagtttttctcttctcttttgtaagctttgtacttttattagaatactcttctatatacatttatggattgaaatactttccgagtatatgagtacctgctttacattatgttcatgttatactgaatatgttgctagcttatctagtagatgctttggtgcgagtataatgtttgcttatgcaattactctatgtcatgacgatgatattagagtagtatctggtagtttaggtgtggtgtctagattacgggatatcattatttggggttatatgctgcggatgagaggtgggccgctgatggtgacagcttagtacgggtattcctccgcgcctgtatataatcctaagttaattccctagggagggtattcctccgtatttagcccggttgtatggtcatgacggactgtcgtaaggagctcggcagtctggggtgtcttctcgaagtaccaggagggcatcggatagagggtattagctagtatatcagttaactagaatgtatgtatactatgtatattagaagtataggaatagattatctttctcttttctttccatttagcttagataatatattatgagaatgagtagctcatgcttgtgtgtcactctacccttggattatcttacccctgcttaaaatataattatcacaagtaatatataaactattagtcaagttctctctacatgatcttcccacgggataaaataaatacgatactcttggaatactctcgggtgaaatgctacaatggtacatccgtgcgcttgcggattaactctgtaaccataatatactagaagtatttctgcgctattgctaggaattatatttctagtaatggcgcttccttggctatcccattggtccctgcagggttaggatatggcggatcacgagtggacttacctcccctcgtcgtgatcaccttaacatttttaacggaggagtcgggttgccctggaatcctccccgattcatttgcaaggactaatgaagccaattgagctagccgggtttctatcattttgttgaagctcagctagttttggaaagcagaagcaaagccatctaacttaacatttatgttctgtaggatcttgtcattggtagttagctttttgcttaatgcatcagtagttttagcttgcacaaaaacgagatccttcaagtagggttggttagaaaagttaccattattattacctccttgatagtacgggcgtggctggttccacccctaacctccttgtggacggtacccgttattgttgttgcccatatacatcgcctcctcacgggtttccgggcagtcattccaagaatgacccgtgttg

SEQ ID NO: 65997 - DNA, 20011 bp, Oryza sativa
tctcccgaggagagaaatagaaacatccttggtcgaatggcgtctggactgacgccctttatagtgtacgtgcaacagatctccggaaactgctgcagatgagcgttggcatcctcgttaggcttgccgcagaacgggctagcctgtgccatagtgatgaggctggacttcaagtcgaaatccacgtctcccatgttgatctgcggcccaatggccacattttcagcagatggagcggcaaactcgcgaagggtcttgtcagccatagtcttgaaagtcggtggcactggtacggctggtttctctatcggtagagttttctgcggaggaatgactcgcggcctgacgctccggaagaaagcttctggattttctttgaagttttccggcaagttgaaaccaataatgcactaccctgttttcacaacaaaagtgaaaacaaccaaggttagcctgcaaagagcagtgattatacagaggtaaatattaagtattagttcaggtaatctctattatgaatcttccccggtaacaacgctagaaatgctagttggtatttcttaacgacattactagaaatataatttcttgcaaaggcgcagaaatacttctgttatattatggttacagagttcatccgcaagcgcacggatataccattgtagcatctcacccaagagtattccaagggtatcgtatttattttatcccgagggaagatcatgtagagagaacttgactaataatttatatattacttgtgataatcatattctaagcaggggttaagataatccaacggtagagtgacacacaagcaagagctactcattcacataataaaatatctaagctaagtggaaagaaaagagagaaaatctattcctatacttctaatatacatagtatacatacattccagttatccgatatactagctaataccctctatccgatgccctcatggtatttcgagaagccacccctgactaccgagttccttacgacagcccgtcatgaccatacaaccggggctaaatacagaggagtactctccctagggaattaaattaggactatatacatgcgcggaggaatacctgtactgagctgtgaccatcagcggcccacctctcatccgcagcatataacctcaaataataatatcccgtaatttagacaccacgtctaaactaccagatactactctaatatcatcgtcatgacatagagtaattgcatatacaaatattatacccgcactaaagcatctcctagataacctagcagtattttcagtataacatgaccataatataaagtaggcattcatatactcggaaagtatttcaataccataaatgtataaagaataatattctaataatagtacaaagcatacaaaagaggaatggaaagctactagagccatacccgaactcttccgaaggcttccggactcctgatttctactctattcctaatccactagcttaagaacactaaactaacttgaaagaatatgagagagctcttgcttgaggtgtgtgtgtgaagtgaagtgagtgagctccttttataggcaggtatgacggttgtaactattgcgaaatgtctgaagcaccccgcaaccgccatcaggagaagatctagagcgtccctaccaaaccccacatccaaaggtggagagggaggttcagccaaaccaggggccggcccaaccagcccacaatttggctggtggcctcccggacttctcttctccgcagtcttttgaattttggcccaattggttgtgtcatttctaagttcttggcccattcatacataagtctgttcctcgacatcgtttgattgatttatcgtctgagttgatgttgattctccttcactttaaacctaatactagtggaatattattattctaacatatatatgcattgcaagaatcagtagttctcctctattttggtaatatattgacggtcgaaactgatcgataacgaccatcgacaaaacccctcaagcttgaacctttgctcgtcccaagtaaaggacgaaaggaaacaaaaacttggttattgatcaggagttgctactatgctgtatatctcaaaggtacaggtgcaaggtatatttactctctctcagattaaataatctttggcacggtggcttatccttacccatgattcccacgagacactgcttctccttgccttgagcggttgaaagacagaacaacaattagagtgccaatcacccaatctttattcgagtcttattccggaagttttcaaatgattttgcaaaaagaaagccaagttcctcaaatgattcactcagtctctctaagtgtatcaatttgaattcctcaccatttttgcctttttgattcctactctaaaatttgatatgtggagctcgatagggatcgaacatggcatacttgcatttacatttattactaagtcaaagacttagactaaaatagataactaaacatactcaagatcaagatcgtgcaaagtgtgtgtgcaaagtgtgtgatatatggtggaaatggtatatgaaaataaaagaaaaatgcttctcttttgtgcttatatatatatatatatttatatatatttatatatatctttactacttaaaaaattcatagtggtggtggtgagtcctaaacaatctaatggctgagagctctcccaggatcctctcgcaagatcaacgcaccagcccactccccatccatccgcgctcgcatcgcgcatccacccacccccacgcggctgcgcctccatccacgctcgcgcaaccgctcgtgtccgcgatgcacgcttccatccgcgcatgtcgcagcgctcctccccctttgacgccgatacatggctaggaaacgttgattccctatcaccgggcacacggagtgcaccatcagcggcgctgcggcggcacaccaggcacgcggagtgcgtcatcagccacacgtcgatgcagcctgggtggaacgcatgctggcactgggacaggacgcggagcagctcggcggtgtcgaacgcgccgcggcacacggcgcattcggtcgtctggtccctcaccacgtcgcgcagcgtcgcccatgtcgccgaaccggaacaccggagcgctcccacggcacagttgctcaggctggagcggcaccgcttgcacgaagacgacgacggctggaacccgaggcccagcacggcgacaccgcgcgccacgcccaggcagcggtgcttgcagtgcttggtgtagatgaggaagaggaagagctagcgcgaggaggatggccgtgagcaggcccactacgacggacacgtccacggcgagcgtcggcggcagcgggggtggtgccgacggggaggattccttcgtcagaatcatctctttcagtgaccatggataattaaatcttacgcgaaattaaaaatgaaaaaaaaagtttgtgaggcaaggcgtagctggaatgatatagatctgctcgattcgtaaagtgaatgggtgaaatgggcttgaggaaaaccgtgctttgctccaaatcctcaattcttctaaaaatagcggaagctatctttgatcaaagcaatttttagttgttgattttcggttctggattgcttgatattgatcatactacttcagaacatgtacatttgacgaaatagtgcggccaagtagcagtatcattcaccacaagaaagaatgaagcatccagtaataggattacgaattacaatacaagcatcacaatcgcagactcacatttcaccgctgatagctttctctgcaatgtgctgttgagagaattaatgagttaataatggtacaagacaaagcgaaatcagtagctgaaattaatacttacgaatccctgtttcgatagtacgtctaaacaggaaagtcaatacaacatcagctctctgcgacttgcattttcgaaacgctctgctcttggatcttatttctgtaatcttcttggattgcgatggagatattgagcagaacagttgagttgacctcccgccgatggatggaccatagctgcatcgcagaagatgctccgtgaaccgtgaacgaaaactctgcggtgcagtggcatcccttcaccggcgacggccttcttgggggcaaaagctcgttgtatgtccccgctgccgatagttgatccatagcacaacgcggggcgggcaggtcgccccgtccaataaaaacaccaggctccactccgttgcggatgcagctaacgagtttggggttggcggaagaccaaatgggactccaaggggagaggatggggatatgctgagtacatggtggggtgcgggtggggggggtccagactcactgaggtcttgtttgattaatccccttaaggctttgttcggtttggagaggattgaagaggattttggattgagagggaataaaatcctcttcaatcccctctaaactgaacaaggccttaggaatataccgcgcgcgtattgcttccagctccactaaatgcatcccggatccccaacacatccctgcgtgaggataaaaactacatccccaccagtcgccatcatgttgctcgagtcgaccatcgtgcctttttgcagtgctgtacacccatcacgctgctcggctcggcagtggtccatggcggtggcgccgctatgccggcggcccacgggggtggtgtggcaggggaggcccagggcggcgtcgcagagaggaggcccagggcggcggcgcggcgaggaggcccgcggcagcagcgcaacaggacgcgtcgatgtggttcacagcggtcgcaggctgcagcgcgggggctgtaggcgccggcgagtagagtcccacatgcgccggcgaggagggtaatttctgtgtgcttttctatgtgcttgctgtttcttgctgtccttgctgtttctgtgtgttttacttagaaattttaggtacccatgattcacaatcgagctcaggggtgaatttagatgtctatgaatttagatgtgggtagaaatatgcatgaatgcaaaataatattgtgtgagcaaacattatagaatgatgttgtgtgagcaaatggatgcctaggggtaagattgtcttttcatacaacttaacggagaggagttaacagcagttacggtatgatggtatttttgggagaaagaggcttgtgcaatggcatttatgggaagttgtctttgtcgatggcatttctggaattagggtgcttgttgattgcatttcatggattttctcatagaataatgtgcaaccacgacgcctccttggctcacaatgcttggtagagattactagattagaggttaggcagaggcctcatgaaaacaatcttgtccacgaggtagtaggtgacatgatttgatttatatttatgattgtttaagtgatgatttttcaaacggatatatacccgttgcaaagcacgggcatccaactagtgtgtgtgtgtgtatatatatatatatatatatttcataaccatgcctttccctccttctatcttcttttttttgaaaggattttctttttaggagaagaaagcatatgaaagcatgaataatttattttggtggtagtatggaaatggaatggaatattgcttagctcccagtgtaggagtttagcatgtgcatatatgtgagtatatgatcttgatcatagagcatgagaagtatctacacaagtcacaagagtttgacaaagttcaatggaatgacaagtaaccaaaatgtctatatggttcaatcatgatagcacatttttggctctggtaggaatttatatcaaatgaggaacttcaaatttatcattttgaaaaataaaacatccggaatttaagtcaaactaggatcaggatcatagcaactcttatttactatctcatatcttgcaacaaccaagacttagatcagcaagtgcagctcatttacctcagcttcccaaataattgttagatacttatatttaacctttgagagagtacttacctacgaacccatatataagagatataaaacagagcaactattcatcaattcaacaaagagaactagcctatcttacctagcatgactcaaacctatcctatctttttggtattttctattttgcaaatttttatgttgttttcaagtttataggatgcaattggaaagcaaatatgtaattggaaagggaaatatgcaatgtgatacaagttacctgagtagggggagagatgtcccccccctcccccaagcttggctttcgctcagggtccttggtaaggattgaacccctgaaagcggaagtacgcttaaagatcgtcgccctgttgatgcatcatgttgttgatgttggcgaactgagcatcagtagcctgttgccattcttgcatctgggctatgtgttccgtgaggttgtactggatctcccccgtctgcatatcaagggtgttcattctcctggtgatttcacccaactcccaacgagaggaactcgagcgccattcacttggagatggaggcacaccacttgatctgggaggttagttgtccccccattgtatgtcatgaggcgcacgccatcggtcctcactagcacttgcctggcttgagaccccgatgctgtggcgcggagcttgggtccatccgggtgcatccgcagttggctcccaaccagcctcatacatctgcacgggtgttgaggatgatgaactttttcgttcgttccttgccatgttgcgcgtctccctgtatgctccacctgcacgagattcttctatggtctgcaggggaatggttagttcacgatagttgtacaaatgataccctacatttggcagcgggatttcatttgtacaaccggggaaaaagtaaatcaaagatccatctactccatgcttgagaatatgcccttgcactagataagtctcatcaatacacggacgagtggctgagataaaaataatttggttgctaacgacccctagcccttttgctatccgagtaatcagagaagtgcactcaataggagcagagaactttatactttctaaccattgccttatcatacatttcacaggagcaattttgatctttctaaccatggcaaacatgataatcaattcatcccccctaatgggtctaagatcacctctagaaaacaaaatcatagcaatccatttgtacatgagcctaaggtaggattatggatatcattcgtactaggtttcttgcaaattggagcaccataaatgtcttccaaaaacctatttttctcgaacccagaaattcctttctgaagatcgattttacaagaatcgtgaaaaccaagaagtgtacttaagcctttccatgtaagtgagtactccttatggaaaaagcgaaaggaaattccatattctatttctttcaaagtgcatagaaattgcaaagtaagcaaatgagaacgaggctcatctaccatagcaaatctctgccaaccaaccgctttccaaatagaacgaaattcaacatccatacctatctttttcagcagctctggagagtattctcgcgtgtgagcatactcccagtcgctcagcatgtagtaggcttgtctctcccgatcattgacatggtcgatgtcggtgccgttcaggagtcgtcgcggagctttggcgtcttccatcgagacaacagctgatgaacgagtactagactcgtcatgatgacttgatgaagagccggaccccttgaacagacgagacaatcgcctcctcattctgcacaatggagcaagaatggactaactcggcgcgggttaggaatgacaagaatttcacccgccggttagttcaccaaagcaacttgtatatatgcaactaaatatttgaatttgagggaaactatcaaagcttgaatgaacttaagagcaaactttggagagggaatgaaaatgtgttgaaatggggtggagttccctctcccggccggttggcttaagtagtgcacccacaacagtcaaaaccgacctgtggggcccactagccgttgcctcaaagagggaggcagccgaccgttgcctagctggttcggccaaaccagggtattcggccgaacacctggtgggcccaaccggccccactttcgaccgttggattccaacagtcagtgtggtcgtggcacagcgaattttcgttaaaaattttattttggtttgctttgaaaaattcaattgaagaatttcctcaaaattcaaaaatcctaaatgcaactttgaaattcaaacatgcgatgatacaaaaaattcaaattattgaaagcaaaaatgcaagtacataccaatttacctgtgtggtgaaggtcgagtcatttaaattccgacgtgcaagaccgtacctcctttcagtttagtttgcggattttctacccgtctctggaggtgatggagcgggcatctttggcttctccctccacaccttcgttggctttggtgcggagggcagcttcctctgagttggctgctctagcttcttggccggtatgggtggttttaccggcgtcctccaataatggttcttgagcatcgttgtttccttctctaggaaattctgcatgaacttcaacaggctgtccgtcttgggtggctccacttcgaccacttgaatattctacggattcaacccgtactttatcctaaccatggaacattgttccgtcctcggttgaaactcaaacttcacttccttcccgtcgatgtggaaacggatactccccgttcccacgtcaaagttggctcctgcggtgctaaggaacggacgccccaggatgagcggcgtctcttttcccgtgtccatgtccagcaccacgaagtcaaccaggatgaagaagtctcgtatcttgactggcacatcctcctctatccctgctgtgtaacagactgacgaatcagccagttgaaggcgcattggtgttggtgccaacaccgtgaagttgagcttgtcgaagacgtcttttagcatgatgctgacactggctccaaggtcgcacaaggcctggtcgaactagtgtgccccgatcgagctggtgatcgtaggacaccccggatctttcttcttctccgggagcttgtggagtgcacggatataccgatgtagcacttcccctgcggagtattccaagggtatcgaatccaaaggaacgtgtgtggtcagatcttcctccggttcatccaaggataccaagcaaatgataggccaggatagagaggattactagtgagaaacagtgtctagggaaagcttaattttaatcctaatgcaatacttcaggcactggcaacccgttgttcccagatgtcgctctactaattacccggatagggaggacttaagtgatcttgagggctgtcaccacctctacacccacctcaaacgtactgtgggatacgcagcaattactggataacaattacctaaacaccacgtctaagcaattactatctactttagtgtttataactcaccaaaacaatcactatatttaagttgattatagtgaacaataattctgtatgctatttaggaactaaccaagaggtaattctcacaaaataaatctaaattactcaagaagaatattgtattgaattcagagtaataaacagaataaaagaaataggagaagattaccgacaactccggaattcttccaactccatctactctactctcttcctattctagtacacaatatagtacaatagagcctcttataattcagcttaagcttggaagtgtgtgttaaagtgagtgagatgatgtccttatataggggtaggtatgacagttggcgaaggggaaatgtccgaagtgccccgcaaccgccatcaggagtgatctgggacgtccatgccaaaaacctgggatcaacggtgatcaccagggtttggctgaacctgggggttcagccgaacttgggctgggcccccctagcctggactttggtctggctcctcatctgatcctcctctatccattcttcggtgtttgggctgattctctgatgtttctacgaagttcacaacccatccttgtatggatacatatttctcctcactttagtctagatttcctcccaacatcggggtttatcacctgcatacaaatatacaccaacactgtggaatatgtgagattaagcacctatcactatgttggatgttttattatctgaacttgatgcaggtgttggcggtatagaatcggcatttaacagccgccaacaaaaccccgccacacttagtcctttgctcgtccctgagtaaaggttagtgcagaatgaatttcttcaagatatgaatcaagcttataaatcattcacaaccatatctgcacctgtgaactttatcagtggctatcttaccatcttaagtaattgacaaatggaatgatctcgattccagtccttcttgcttctctctcagattcatgggatttttatgaattttcgcaaaccagctcttttcctcatattgactttctctcgtctctcaaagatgtatactttctttttggatcctcaccaaggcaaaatgtgccataattcatccctattctaaagctgatatgtggagcttggtagggataaatcgggacatacctgcatcatatatattgcaaagccaaaaatatggactcaagaagatcatcagtcatactcctagatcaagggtctttatttgtggatggaaaatgaaaacgtaaaatattttgtggaatgatggaataaagaaatgaatctcctttttttctatactctatcctcctttttgttttcttggcatgcatatggaagaggcatggctatattatttttttttcaactttgctcaatgttttgggagcaagctttatttccttctttctttctcccttttttcatacatagccatgccttgccttcccttttctcattttcttttttttaaccaagaacttttctaggagaagaaagcatagtctgaagtaggagtttatttgaatggaatttttgtggaaagtcatcttccagtgtacaagcttagcccaattatatatgtggaaatgggaagtggaaatgacaatgaccccttgatcatgagagtatgaaagatatctaacacgagtcacataaattcgacaaagctcaatataatgtcaagcagtcatatgtataacaaggttcatcaatgatatacttgcatatggccttggtaggtataagatgaagtcaattggaggattgagcttttaaaacaattttattttgaaaacaaattcccaagagtcataacaagagttgcaaggattcccttcatcttgaatcatctcacataaagcaattacttagatgcacaaggttccctaaacatggatggttgttcacaagcacaagttcagctgagaataatgaatatacaagatcaatcacatgaagaatttcattagttggaaattttatctttcacttatgcttgaaccaattgttttctgaattttcagctctagtactataccgtggtggagatatacagatacaagacgtgctcacctgcttacctatgaaaattgggagggattggggccagctttggttcggccgaaccactctgatgcccaattcctctgcaatttttttgcaaagttcagtgccttccacgtgttcagatattcagcaattttcagagcatatgcacgtcagaggctgggatatctcccccacacttattcaaaacctgaattttattaaacatgaaacaaaacaaactttggcaaacattggggttaacactaatgagccacattattcatagcaagtgcttacatgattggaaaaataaaaccaagcacctactactattttattcatgggaaaggaagcatctaattagcataatacttattttcctttcccatttctacgaatgcacgcttgatcttagcctggcacaaaccgcgactaagggtatcgaaattatttctaattcagcaagctctacccctagctccgcgttgtgatccctaaactctatgttctccttgcggagtttcttcacttgcgcagcgagcttatggattgagggctccggcgacttcacctcatcttcttgatattggcctggagtccttactattggagggggtgtcaaatgacgcttcaccttcataggtggagggctacgggattccgctgccccctccttctccgatgctatcaacggccggagtaaacccttgccatacccaccgccgggagtttgcactccctggatgcggaatcgctcctcctttggagtggatggagtagcggtgggtgtaacttacttatgtagcacctcatcccctgccttggtgaacagggtgcccacatagtgctcggcgggaggcggcgcggccttcccgtcatcttggaaaaggcgtcgcgccttcaacaagccgagttctcccgttgtcggccgtcgcgcaggcgaatccccccgaattttcgttcttgtgacatggcgaggggagacggatcgcactaccgaacggagggccgaacagggccgagaggggttcggccgaaccagggagctcgccgacgggctctagatttgcagtggagcccggcacagctgcgaggggttgagcccatatagcatttaccccttccatcgtgtattcttccaccggaatcaattgatttgccagcgtcggctctccggtgagattgtaagtggaattggaagaagagccaataaatgggatcagtgatttgcttgccattggtgaattggaggtgatggagcaaggtaattgggttgagatagagaggaggtttgcaaagtgggaaggaggaggaagaataggtgctttggttggatgcgactgatccacctccgagagcgcatcacaatggactatagacgagcgggagagattgctattcgaaaatggggccgaacgagcgccgctctggttcggccgaaccctggtgggtccggcaggcctccacttttcttcctaggcccactaattcctaagctaagcgcagaaatgacaactatacaaggttttaagcatgcactagatgagatcatcatggttcataatcgattaattcaataacatccacttcttcatctaaagtttcatttggttcaaggaaagtctttaagcgttgaccgtttaccttaaatatgttgcctgagtcgtcgcggagtgtgattgccccgtgcaaagaggtgtcgatgacgtcgaacggtccttcccatttactacgtagttttctgtggccaaaaagcttaaccctggagttgaacattagcactttgtctcctggcttaaatttcttgatttttatccttttgtcatgccagcgcttcgtcctttctttgtatatctttgcgttgtgataagccttctctctccattcttcaagttcagcgatttgcatttttctccattctcctgctccctcaaagtccatgttccagtttctgatggcccagtatgctctgtgctcaagttccacgggtagtcgacatgacttcccgtagactatctgatatggggacattccaatgggtgtcttgtaggctgtccggtatgcccacagtgcgtccggcaatctatccttccatcctgttcccattttgttgaccgtcttttgcagaatattcttgatttgtttgtttgatgtttctgcttgaccactggtctgtcgacggtaaggagtggccacattgtgtttggctcccatctctcgtaggaggtctcggaaggttttttcaatgaagtgagaacctccgtcacttatgaccattttgggtaccaaaccttgggaagatgatttctgtgaacatcttcttggcatgcctcgcatccgcggcgctgcacggcatagcctcaacccatttggagacatagttgactgccaccagaatgtactcgcagttgcgtgacttagggaaaggtcccataaagtctataccccaaacatcgaatatctcgacttgcaaattatatgtgaggggcattgcatctcaagcaagtgattcctccttgcctttggcagcttgtgcatcttctgacgaattcttttgagtcttcgtacattgttggccagaagaaaccactttgccaattcttggcctgggtgcggaatgcaccgtaatggccaccatagggtgaggcgtggcatcgttctatgatcttaagtacttcatcaattggcacacatcttcgtagtaagccgtcagagcagacccgatataggtatggctcatcccatatatgacggtgactttcatacttcagttttcgttgattttcccctggtggtatgtacttggataccatgtagtttactatgttggcatatcacgggttggagtcacgaaccgttatcaacatatcgtctctcaagaaatcattaattggttgttcctgcatgtcagtgatctgcagcctggacaaatgatctgctacagaattttctactccctttttatcctttatttctaagtcaaattcttggagcagcaaaatccatcttaagagacgcggtttagcatctttcttagtgagcaggtattttaaagcagcatgatcagtataaattatcaccttggctcccgctaagtaagacctaaacttatcgatagcaaaaacgaccgcgagcagctatttttcggtagttgcataattcaactgagctccggttagagttttgctagcgtaacagattgcatgatgctttttatccttggtttggcccaagactgcaccaacagcgaaatcgcttgcatcacacatgatctcgaaggacagagtccaatcaggaggttgaatgattagagtggagacgagtgcctttttgagaatttcaaaagattttaggcacgcgtcattgaactcaaagggcgcatccttagctagcaaattggtcaaaggcctggcgattgtagaaaagtccttgatgaaccttctataaaagccggcatgtcccaagaagctgtggattcctttgatgttcacaggaggaggaagctgatctataacatcaattttagcccgatcaacttcgattcctcgttcgaacactcgatgcccaagaactatcccttcacagaccatgaaatggcacttttcccaattaagcaccaggtccttttcttggtatcgttctaagactttgtctaaattctgtagacaatgaccgaaagtctttcgatagaccgagaagtcattcatgaagacttccatgatgtcttcgatcatgtccgagaaaatagacatcatacatctttggaaagatgcaggagcattacacagtccaaaagacatcctacagtatgcataggtgccatatggacatgtgaacgtagtcttactttagttctccggatggataggaatttgatgatacccggaatacccatcaaggaaacagaaaaaggaatgatttgccaaccgttccaacatttcatcaacgaagggtagcgggaaatgattcttttttgtagccttgttaagtttcctgtaatcgatgcacattctccatccggttacggttcgttgcgggattagttcattttgagcatttgcaacggccgtcattcctcccttctttggcacgacctgaactgggctaacccactcgctgtatggtacgagataaataatcctggcatgcaggagtttcaagacttccttctttacaacttctcgcattgcattaatgagccatcgttaaggttccctagagggagtactctcggggtcaataggaatacgatgggtgcaaagcgcgggattaatccccctgtggtcttgaagcgagtagccaagaacagaacgatgcttttccaacacggtgagaagatgttgagtctcgtcttcagagagcttgtcactgattatgacaggggccactctgtcattgtgtaggaaagcatatcataggcctggaggtagaggtttaagctcaagcggaggtcgaggtggcgggtccatgattggcaggtcgagagtctcaccaggatccacttactctttgatgaaataggggacctcatcttccagaagggcctcgggagactcgtgagggggaactgcaataacctcttccgctgactcaatttctgggagagggtcggtcaaggcgatccttgcccgtgagaatggaattgaaaattcagtctctcccagtgttattttgaggctatctaatcggggtgtgttgatgagaagttgctcaattggcagcccgattaggatgtcaaaatcttggatttcaaaggcatggaaatccaagatcgcctccctatcttcaaagcagacaagcacatcttgcacaatcccaaatccttcgatgatatttccgcttggatgtttgaagaatttgtttgtcggggtcactgtcttatcgcttaaataagcgaatgcaaaagactctgaaacgagattggccccgacagttagactgtagagaataccgacgtcattcccttccagatggcaaggaatgattcggggagcggtatttattcgaattacttcggatgaaagctctgcctcccttaaccattcatcactcattatgaatgttaactcccggacagtttctcgtaggaacccgagttccataggacctggaggtgacaaagaaacgggtggtttcctcttgctaaaatagttcaagttattgccgtagtcttcatcaaagccgtccctgaacaggattgcggcacgatccagagtctgaatttcatcattctcgacggacagctgctcaggaaccttctcatcaaccgagctaacagaagtggatggttcagcaagtagctcgatcgttagaggttcctctatcttggacacggatacctccggctggggttcattggagtgcgtcatgaaggaagtattttctagaatgcgatccaaaattgttcttccttctgacggcgttttgtgcaggaacgatcctctagcggttatgtccagatagaatgcagactccttatccaaacctgatgaggacatcccttccaacgatacaaccacgcctattgcacagcaaggaccaatgactagagctcgagctcgtgaacttaattatcaggaatatgggagaggaaccaaatcgcaagcagcactagcagcgctgatttgatgaagtcaatgctcttcactccggagggcaaacggggcaaatgagtacttgttggaaagatctcgtcgtctactttcagctatgtgtggcctcaccatcaactttgacccaggctgctcagaatgacgaaaatagttctttacatcagaaacttgggcttgggccttgtatcattacagccatcattacagcccattaggggtccacaaaacctagggtttgctcccacctcctctcctggtcattcctccacctatataaactcctagcagccaccattttgcactttgggttttgttttgatgtaagtttagctgcagctacttccttgtactcgcgtgtgtcggctagaccacccggatacttgtattccgaaccccattttggtttgtttaagtttcatcatttgacaagtgccgtgagctgtttccttgtcaacttgttcttgcttgttcttcgattgcttgcaggttcaaggttgttcttggcacggcaagaacagcaacaacgtggagtcggtgtaccggttgctaaggcgcagcacccctgtggtagttgtagtcggaccgccaacgtcgtatccttccccaaatcgaagtttatcctcctctcatcgaaagatcgggaacccccgttgctgcatcaagtggtatcagagctcaagttgctcggtgagagattttatcacttctttgtttttacctacagcccaaaagaaaaaccactaaaataggtcagacccgaaatcaccaaaacatgttgagcctttgctgttctacttagtctttgcttgctgagttttcgattgcatcgattggttgagttgctggttctagtagtttagtcctttagagtttcgagttctgctcacgaattcatcaccgcaaacacttccaccatcacttcatttatcttcatcccgctgccactatcaccaccatattcaccacgaaatccacctccaaccccaccaaatttcgtccaccacaaccagcagcaccctcatcaccacatcagccacccccaaatgcatttattgctgcctccaccaacagccaacccttttgcaactttttgaagtgaatcagcccttcccaagaaagcatttaagtgctctcacttttgacttgttggctgaatcatgtaactagccaaccaacccatcattacttcttgttttgacttgttagctgaagctttgagcttgctgtacaaaaaaaaagaaagaaaacaaaaaaaaagaaagaaaaaaaaatcagaagtgaagagaaggaaaaaaaaaggaagggaagagaggaagttgttgttgttgttgttttgtttgtgttattttcgtgctattttgagtggctacgcttgtgactaggctcgcgtctctaaagggttttgcctaggaccagtacaataccatcgttgaatgattattcaacttgctttgattaatgtggttctagctgtaccttgatattacttgcagccacctatagctccacaaatttttatctactatatcacaggatcgtgcttgttgtcagctccggtactactaaccattgttgctgttcttactatttgccaacgccttttacataacaaagtaagaacatgtaagaactcgtttgcacaagtttggtagaagtgtagatggacaacacctagctccaatagttgataggacatatttcttgtgaattgtttcttcccattaaccatgacaggaggatcgggggagcaccctcaacattcaccacgtacgaggggcatcatacaacattttgagcgccaagtgagggagcatgctgaaggccttgatgaggatgttagggtcgccaatgatcgccttggtcaattggaggctgctcaaattgacaccaactccaagctttcctcattggagaggtcccttgtggctgtgaacacttctcttgcaggtatcttgaatacgttggagagaatgggccaagatggtcatgatggatcggctaggcgcaaccacaatggccatgatgctaatagcagcatcgcagcaagggaagaactggagtatgctgctgacactgagcatgatgaggaggtacttggtcgtccacaaagacaacagcgccggcagcgccatggcatgggcgctccaccacggcgggaggtacgtgataatgatgattctttaggcaagatcaagtttaccattccttgctttgatggaaaatatgaccctgatgcatatcttacttgggagttagccattgatcagaaatttgcttgccatgattttcctgagaataaacgtgttagggctgctactagtgagttcactgattttgcatccatttggtggagtgaatttgttcgttccaatccaaataacactccccaaacctaggatgcaatgaaaagagtcatgcgagctagatttgttccttcatatcatgcacgtgatttgctgcacaaattgcaacaacttagacagggaaacaaatctgtagaggagtattatcaagctttgcaaacaggaatgcttcgttgtgattggtagaaaatgatgatgctggtatggctagattcatgggtgggctgaaccgagaaattcaggacattctagcctacaaagaatataattcaattaatcgtttgtttcatcttgcttgtaaagctgaaagggaagtacagggacgaagagctagcttcaggactaacatttctgcaggtcgtgctagctcttggacatcttctaacgctgctgcaccgtcaactcgagcagcagcaccatcgtcctcaagcaacaagctgcgtccctctacaagggctgcagg

SEQ ID NO: 65998 - DNA, 2202 bp, Oryza sativa
ttaccgacaactctggaattcttccgacttcttctactatactctcttcctattctagtatacaatatagtacaatagagcctcttataattcactcaagcttggaggtgtgtgttgaagtgagtgagatgatgtccttatataggggtaggtatgatagttggcgaaggggaaatgtccgatgttccccgcaaccgccatcagggagtgatttgggacatccatgccaaaacctgggatcaacgatgatcaccagggttcggccgaacctgggctgggcccccctggcctggcctttggcctggctcatcctctgatcctcctctatccattcttcggtgttttgggctgattttctggtgtttctacgaagttcacaacccatccttgtatggatacatatttctcctcactttagtctagatttcctcccaacatcggggtttatcacctgcatacaaatatacaccaacactgtgtaatatgtgagaataagcacctatcactatgttggatgttttattatccgaattttatacaggtgttggcggtatagaatcgacatttaacagccgccaacatggagtatcacgttgctgcattgctccgtcagcgtgaccacctccgttgttgtgagcggtctcttgttgttgagtatgtccttgagataacgggagtatgttggcacttacatagcgtccaacaatggcacgttgatgtggatcttctggataacttcaacaaaacgagcgagctgctcgtccactgacggtttcctactccgttggggaaacgacagcaaccgtgtgtcgcagtgctcctgcggcatggtcttctctggctgaacctctttgtcagccgagtcactagatgacgcttcttttgatatcccattagttcctgcagggttaggatatggcggatcacgagtggacttacctccccatgtcgtgatcgccttaacattttcaacggaggagtcgggttgccccggaatcctcccagtttcatttgtagagaccaaggatgctaactgagctagctgggtctctatcattttattgaagctcagctggttttggaaagcagaagcgaagccatctaacttaacatttatattatctaggatcttgtcattggcagcaagctttttgcttagcgcatcagtggttttagcttgcgcaaaaacgagatccttcaaggagggctggttagaaaagttaccgttgttgttacctccttgataatatgggtgtggttggttccacccctgacctccttgtggacggtacgcgttgttgcccatgtacatcgcctcctcacgggtttccgggcagtcattcccagagtgactgtaacgccccgattttcggtcgggattaaaaatcattaaataatgcatttttctagaaatttaataaaagttaaatcaatttaatcaagtgaattactgagggaattaaaaatttccttttaaaaatcattggccgggaatattttgtaatattctttgtgccttaaaatactctccggttttttctgtgaattttcggagctcaagaaataattttaaagtcacaaagttcattttatcaattaaaataaaaagaaaagcaataaaatttcctcctctttgtttttgggccgcccggcccaatccccctcctcctctccttggcccgctcgcctctctctccctccctcctccctctcgggccgacccctcccttctcggcccaatcgttttcccctcgcgtaaagtctaaataaccccctgggcttccccctctctccctccccgacaggtgggcccggtggccccacctgtcaggtcctcctcctaccttcggcttctcaggccgaagccgccatggccggcggttgccgcccatgtcccgccaaatccggcgccctcccgctcgcgtcctcgcgcccaaaccaagtaaaatcggtccccctccatgtcctccaccatctcccccactttcccccaaaaaaacggcgccggtttgacctccccacgagctccacgtcgcctcccatttcgacgccggttgccgcccatcccggcctgagccactccctcccgagcctataaaatcactcccccggccatcctctcccttttccccaactttcccgcactccccgcgctctctcccgctctccccacgcgagcccaagcgccgccgatcgccggcg

SEQ ID NO: 65999 - DNA, 11915 bp, Oryza sativa
ttcctgcagcccaccactcaccgacgagctccagccgccgctcctcgccgctccagccactgccaagccgcgccccgccaccgtcggcttcgctgcatcgcgtggtaccccggccgctcttccaccttcgttggagaccgccgaatcaccgccgtcgtcttcgccccgtggagtgctgccgcctccctctgctcgagccccatcagcggcctccttcgccgccatgcccctcggtgggctccgccgcctccctcttcgcctcctccactcgttttcgccgctccccggccgccccctcgctcgtcgggccgacgccgccatcaccattgtcgtcgtcgtccttcccgcgtcggtgagcatctccctcctcctcccctccctttctttttctctctttgcccgccggccgccgcatgcgtgtcgccgtcgcgccgcgccgcgccgccgccggtgtcgccgccggtggccgttcggcccgtctggtcgggttggtcggcgagccaacccacccctccgtcttgcacctctaccgtggactcggtccacagtgggctagatccttttgcccgctgacgcgtggggcccgctcatttggtggacccggtccaagcccgcacctcctttacccgctgacgtgttggcccgcctgtcggcgccggcgccccttgctgacgtcagcgaatgccatttcctttgagaaaatatttaataattgcgcaataaatcgagtttaattatagaaatcaatttaaatggctcaaaacttctaaaattcatatctaattcattctaactccgaattgggccattcaacttgcaaaattcatctaaaattgagctctacatgtttgtttacttttcatgtactgtttttttggtttttattagagtttttcctcattttgcgtgctagcgtgtagaatccgtcgtttcggaagatcgcggtcgcaaggataagagtttggaagattgtttgaagaagcaaggcaagtcacacatttccccttgagcatgttgatcccaaattataaatgttttagtatttgcaactaaatatgcatcgttttgctaattacatgggaccagggtttacctatctgcttgcttgtgccatattatttgatatatgtccttcgtcaaccgtgggtgataattcgactagcttgtgtcacttatgttgatctagctagaactttatgcttagccatgcttaattaccactatctcagttgatgggataattgcagtattagacatgttagtatcatgatgagctgcgtgctcgagacatctggccatgtttcatggtcgtaattatccaactaaaatacgactgaatggtgggctgtgggtgaatggttttgctggtcgcacccatggcgattaaggaccggttcgcgggatgcactagaagacatacagcgcttgccacaagcgggaatgggtaactgcctgacttaaagcatagcttttctctggctgacgcatccaggcaagggtgggcgtgatggagcggggcgggccctgcgacggcctctgtcgcttccggattcacctaggcacgagaggggactgcccgctgcctgctgggggcgggggtgaaacctgaggtgtggtgtgcttggttagagcgagtcatatgaagggtcttgtcacaatcactcgacatggtgacgtgtccggccgggcacggtaacatgccggtggattgtgtcttgtgggtacagttgtgcacctctggccagagtaaaactattcgaatagccgtgcccgcggttatgggcgatctaccagaatcactgtgattagtctcacacttaataaatcgacccaatgcaccgtagttcaggtgggttggttgggcctgttcaacgtggtgtagcgttgatcagtggagatttaatattactttaattactcaatagttttaccgttttgctcaataaaatgttttacaatcgcctttatgcaaatagccacaagccatccttgtatcccattgcacgtctgcatcgttggtgtggcttgctgagtacggtggttgtactcagccttgctattattccccctttttcagaagtgtagtgcttctgagttgaagacgaagttataagaccaaggctcagaccccagttgtgttttgcctgtggagtagagctgaagccccgctaggatcgcctttttccgctgctgtcgttctctttcggtgtgaggactaagtgcctcttttgtaagtatttacgctttatttacgtttggaactgtatattacttgtcgttttgtgtgccctggctggtcctggacagggatttaatacacaaaatagtctggaaatttgggctaaatttctgggcgtgacagtgacccgtgccgccgcagacctcacacgtaatgtgccagtccaaggccttgacggtgccttgtggccttttgttgtggtcatccaatcgcttcatgaggtctagcttggcagcaagcaaatccgtctccttgatggtatgcatgcctcgctgacgggtttggagtcgttccacgctccaacccatgttggagaccatcttctctattagatcaacggctccttgaaccttttttagagaagaaagttcctccagctgccgcgtccaggtgatcgtgggacaccggggtgagtccattgtaaaagttctgcaggatcagctagtcgtccatcccatgatgaggacaggcggccacgtacttctgcagtcgttcccaggcttccggaatagactcgtcccttgtctgctgaaaacttcaaatccttccacgaagggcattggttttgcccatcgggaagaatttcgagaggaatgccatagagcatttgtcccaggtattgacagcagcacggttggcatcgaaccactactttgctctcccgagaagggagaacggaaacagccacagtctgacggcgtcgggattgacgcccttgatggtgtacgtgctacagatctccaggaactgttacagatgagcatcggcatcctcattaggcttgccacagaacgggctagcctgcgccatcgtgatgaggctagacttcaagtcgaaatccacgtcttccatgttgatctgcggcccaatggccacattgtcagtagagggagcagcgaactcgcggagagtcttgttagccatagtcttgaaggtcggtggcgctggtatggctggtttctctgtcggtagagttttttgcagagcagcgattcgcggcatgacgctttggaagaaagcttctagattttctttgaagtttttcggcaagttgaaaccagtcatgcactaccctgttttcacaacaaaagtgaaaacaaccaaggttagcctgcaaaggaaaatgattatacagagataaatataaagtattagttcaggtaatctccattatgaatcttccctggcaacggcgccagaaatgcttgttggtattttcttaacgacattactagaaatataattcccagcaatggcgcagaaatacccatggaatattatggttacagagtttatccgcaagcgcacgaatataccattgtagcatttcaccgagagtattctaaggatatcgtatttattttatcccgtgggaagatcatgtagagagaactagactaataatttatatattacttgtgataatcatattctaagcaagggttaagataatccaagggtatagtgacacacaagtattagctactcattctcataatatattatctaagctaagtgggaagaaaagagaaagaaaatatattcctatacttctaatatacatagtatacatacattccagttatccgatatactaggtaataccctctatccgatgccctcctggtacttcgagaagccacccctgactaccgagttccttacgacagtccgtcatgaccatacaaccggggctaaatacggaggaatgccctccctagggaattaacttaggattatatacaggcacggaggaatacccgtactatgctgtcaccatcagcggcccacctctcatccgtagcatataaccccaaataatgatatcccataatctagacatcacgcctaaactaccagatactactctaatatcatcgtcatgacatagagtaattgcatatgcaaacattatacccgcaccaaagcatctcccagataagctagcagtatattcagtataacatgaatataatgtaaagtaggtatttatatactcggaaagtatttcaataccataaatgtataaagaagaatattctaataatagtacaaagcttacaaaagaggaaaggaaagctactagagccatacccgaactcttccgaaggcttccggactcctgatttctactctattcctattccactaacttaagaacattaaactaacttgagagaatatgagagaattcttgcttgaggggtgtgtgtgtgaagtgaagtgagtgagctccttttataggcaggtatgacggttgtaattgctgtgaaatgtctgaagtaactcgcaaccgccatcaggagaagatctggagcgtccctaccaaactccacatccaacggtggaaagggaggttcggccgaaccaggggccggcccaaccagcccacaatttggctggtggcctcccggacttctcttctccgcagtcttttgaattttggcccagttggttgtgtcatttctgagtttctagcctattcatacataagtctgttcctcgacatcgtctgattaatttatcgtctgagttgatgtcgattctccttcactttatgattattctttgcaaaaggttagtaaacctaatactagtggaatattattattctaacatatatatatatatatatatatatatatatatatatatatatatatatatatatatgcattgtaagcatcactagttctcctctattttggtaatattgacggtcaaaactgatcgataacgaccgtcaacaaacattagtatagatttttcaagaacaagtaacaaattttatctgtgatttttattctaatggatgcagaggtgagaaactccctgttcaaagaaccagtcctgcatgacaccaataaggttggtgtgaactttaggaagcaaaagctattgcaaatggcagaataaaataatgccccaggagagccagaagtggtgatagttgaagatgctgaagtggtgattgagcctgtgccaaaaaagaagtgcactggcaacaagggattcactatccctccaggagttgaagtcattcatataccctccacccctcaggcataattataatacgataaattgtccacatctcaataattttaggatattgcccctaatgaatgtgcaccaatatcataactagtgtgagtggccacttccatttcaataatttattgtgctatgtatcttcttcctttgagatatcaatctaattttcttccatttcaaatctacttttcagcctaacttgcaatgattactgtaattcataactaagagatcaacgcattgagctgtctttgcttcatgtagatgaaagatgtttgatgatttgtattttttccagggatgatggcttgtactagtagtgactgatacagactttactagctaaatatgttttcatcctcaaccttaaagtttaatgtgttgtgataatgatttttgacaagcaagcttgggatgcgttcgattcccctgattgggaactcattccctccacatggaaaacagagcggtccattagtacgtgattaattaagtattagctatttttttaaaaaaaaatagatcaatctgattttttaaaataactttcgtatataaactttttattaaaaaacacatcgtttagtagtttgaaaagcagccttggtagttttcttgataacttttgttgctacctgtacctgtggtgaccactgaccagccttcgtgaggaactcccaagtatttaagctgttaatggaaaaaaaaggcattattgaaaatctataagtttctttgatataactaattgtcactctacttagttccgctggttatttgtgagtaacaattgatagtgcaatgcatatgagtaaatcatgtgtacatgtatttctttgtgacctatatttgcttccatatcataggcatagtatgatatgcgcacgaggcataaattaccattcatagatgagagttgtgtgcgtggtttagcttaggcatgttccggtggttgtgttttgcttgcatacttgaaatttactaactaacgtaacttaaacaaattttgattgattatgtattttctttaataatgttgacgtgccttacacgtgcatgctcactagtgaaaataaatatacgagttttctttttttaaaaaaaagacagcagaattatagcaacagggactctgtaccgcacggcagtattgctcatcgatctgcatcaactccggactcggactgtgtcacaattgccgttagatcatttgtctcggaagtcgtaactccgggcctccgggcataaggccagtcacaatgggggtttcactggtgtgtcatgcacatttaataggggtaagactgaataaaaaatgattatttgcatgaaatggggatgagagagaaggaaagagtttcatcctggtgaaactcgtcagcgtcgtttccaagtcctcggtaacagagtgaaacccccgttgaggccgattcgtttcattcaccggatctcttgcgtccgcctccgccgtgcgacctccgcattctcccgcgccgcgccggattttgggtacaaatgatcccagcaacttgtatcaattaaatgctttgcttagtcttggaaacgtcaaagtgaaacccctccactgtggggattgtttcataaaagatttcatttgagagaagatggtataatattttgggtagccgtgcaatgacactagccattgtgactggcctaatagcacatggcacctactgtactgaacgcgtggtttattaaaaaaaaaaaggaataggtgaccattgaccagcgaccatgcagctaccacaaccacaaccacaccctcttgttagtattaaactgttgatctataaataaaaacaaagaaaaatgtagcttcttcgttgacgcatgtactatagctgtgttcggtttcacgggatacgaactaatccctcccgcacataaagcggagcgatccattaatacgtgattaattaagtatgtcctattttaaaaaaaataaattaatttgattttttaagcaactttcgtatagaattttattttaaaaaacgcaccgtttagcagtttgaaaagcgtgcgtgtaagagagatgggttgggaaaagagggtgccgaacacaccctatgggtagtttggatacatagactaaactttagtgtctgtttagatcgcacccaaaattttacatcctgtcacatggaacgtttgaacacttgcatgaagtattaaatatatgctagaaaataactaatggcacatattgcgactaatttgcgaaacaaatcttttaagtctaattgctccataatttgacaatgtgatgctatggtaaacatgtgctaacgacggattatttaggcttaataaattcgtctcgtggtttactgacagattctataattagttttttctattagtgcacgaacacccccatacgacaccctatataatacctgatgtgatacgccaacactttacacccctgatctaaacaccccttagtccctgtcacatcagatgtttgaacactaatttagagtattaaacatagactagttaaaaaactaattacacatatggaggctaatttgcgagacgaatctattaagtctaattaatccatgattatcacatatttactgtagaactacattgtcaaatcatggactaattagtattaatagatttgtctcgtaaattaacctccatctatttaattagttttataattagtctatatttaatacttatgtttagttcacgctaaaattgaaagtttggttgaaattagaacgatgtgacgaaaaagttgaaagtttgtgtgtaggaaaattttgatgtgatggaaaagttaaaagttcgaagaaaaagttcggaactaaactcggcctcaaattagtgtcaaacttctcttgtatggctttgtttataattccaaactttttctttaaacttttaacttttttatcacatcaaaacttttttacacacctaaacttcctactacttttaaccctgtcaagtgtcgactggacaagagaaaacctaccccctacgccgctagctacacccgagcctatggcggccaaggaaaaaggatatactagtagtagtaataaaatagtagtatttaaacactgcaagcatcttcacacgggaaacacgacgagaactggttcgtttcggccaccattattccacatcatttccacggcccctattgtccgcttgctctcgcgtcgctcccgtcccgtgccgtgcgctgcggccgccatgggctcctccgactcccaggcgccgctgctgctcccgagggggagccaccgcaaggaggaggaggaggaggaatacgcggcggcggggaaggtgcggggctgctgcggcggcgatggggaaggagggtggtggcgggaggcgactgcggaggccgggaggctggcgtcgctggccgcgccgatgatcgcggtcgcgctgctgcagctgatgatgcagctcatctccaccgtcatggtggggcacctcggcgaggtcgcgctcgccggcgccgctatcgccaactccctcaccaacgtctccggcttcagcgtcctcgtgagtgcccttttcccttcgatcatctttttttacccttctgtgcgtgagaccacgccttctagggatagaatgggattcacttcgtgccctgtggctgtggccgtgtggtggttggcatctcgcgcagccgccagcgaggtgcttgtggaaatgccccgcacgacaatccgccatgtggttttgcaccgctggtcaaatactcgaaacatactaatcaacgcaccaaaagttggtagaacgcgagctggatcagtaattgcgtacgcgaatccaaatccatgtgctcttttctcaaatggtcgactcaccttcgttgcactgatttgtgttaattgctgttttgggttttgattattggagctgactgttttcactttacgatgctactcctacttgactatatgctattctcagttcctcacatatgaggctaaggatttggaagcttcagttcaggttcaccgtgcgcattggaaaggcttttctgtctttccaaacatttcgtcgttgtatattgattataagctaagcgccagctctttgatttgagattgcttccatatgcatgtttcgtcctttaggttgtggaccagtgcttcatctttcgtataacaatgaaatatagtacccgactaccgtgccgtggccgtgtatgtgcttagggctctaggacaccctttacggaataattaattatttgccactcttacggatggtgataaaatgtcccactctttactgcagtaatcaagttcttttttttggttttacattatgtacttctgtttggcaatgtattgtccacagctttggaatagttgcatgctatagaaacagagtaaaggattgcggactttgtaaataaatgacaaatacacatctatattcctttaaaagcctctagtggtggcagtgaatctgcccacccccactattgcttttgcagttttttacaaattgtccccctgatattttctaatattgtggaatagtccaacattcagttcaaacaagtgaataccagataatcataaaagcaaacaagtgatactaagatatttgataaacaaatatttttctatgacatattatgattatttttcttctgcccatagcaaagcttgggcattttgctagttattaataatatacacaaattcgaacatttagagaaaatggatgtcacctttagttatctaaatgtacaacaaattacacttttaacttttaaaattttctactccttttgttccaaaatataagcacttatggagtttttcaccgcgattaaggagagagaggtgaaatcaaatgacggattgttgtgattggttgagatgaggagatagatggagaatattaaatgagagatggctgtagttggttgagatgggactaggtgcataagttactacattttgcgacaaaatttaaataccagaagtagctatattttgggacggagggggggggttgttaacagccatatcttgtaaaagtaggtcaaagcacaccttaaaaggggcatagccaagggtcccaacctctatatagtgaagacgagacaagcaatggattgaacatggagtggacaagtcacttgtgtttattacttcagaaaaaaaaactttgtagaggtagcattactcttacataagaaggcttgagtgatgttaggagctcgtctagtacaaaggtttgaggcaattggacaagcacttctaggaagacgatgtgacatggaaggattcaatattggtgttgacaattgatggtacttgttatgcagacaccgagatcctcctccatgtcacagcctcaccagtcacactgtgtttctagaagtacttgctgaatttcttaaggctttggactgaaggagctctgagcatcgtgatcaggagcatcttcttctacattggctacctctaatgagtttcacctattgtaactgctgctgaatatataagcacatattgatttaatttattccataaataaatcatgacattgcaaattaaaactagcatcatcatatcatacgatctacacatgtaaactagatagtagcgaatgcgtaccgagggttctagaagttcggctacacaacatgaaggactcgtggtactgggcattgacgacggcacgcagcacccgagcgaagaggaaggcgagccgttgtggatgaatagcaagcagtcgcgtgaagcgcttcccaaaattcccgccttctcccagtgtaggacatcaaaggcgaaggttccggagacctgctctcccgatcgtcggtgcacaccgacgagcgggatggagtagactacgagtgacaacgcagaactgaggaggagacaaaccctagattgatttcgcgtgtgttgcaaggaggcgacggctcgatttatataaagatatcaggacacctgcacgatctccacaccacgtaaccgaaccgaataagtcgcgcgtaactcatccggagtccactcctctccacgcaccggattattcggtgtgtttccaaaaacaaaaccgaaatttgcagcaaagcaaaattgcaaaaggaagctgcatctcgcctggccatgcgaggcgagcgagcgcgcgcgtgtgttcttctagttttctccaccacacatgcctcaagtggctaggagagcaacctcccttgtaagaaggtctccctcctctagaataggcaaggtggtactaaacttcccatgtatgccatcccatgaggtgggcttttgtgattttccgaataattaatcttcatatgggccttagcctacataccaattccaacaattgccactagatgatgagttcggctacctcccatgagtttcctctgtcataaccaacatgaatgaaattttcgccactttcaatctgtattttttttctcaacttcattttgacccaatagataaatcaaatagatgctttcaaagttgagggtgtattttggacctgtgcgacagttagaagttctaaaatggacttattcctataaaagaaagagctcccttctagctattactataaatagactgcatag

SEQ ID NO: 66000 - DNA, 731 bp, Oryza sativa
agctgcccgtcaacttctcctggatcgtctcgtctaatcttgtatcgtagtgctttgcaaacagggcatgcttctaggttctcttactcctcaccgcgatataggatacaatcattcggacatgcgtgaatcttctgaacttccagtcctagagggcagactatcttcttagcctcgtacgttgtctcgggcaatttgtttccctctggaagaatgttcttgacgagtttcaataaatcgccaaatgccttgtcactaaccccattttttgccttccattgcaagaactccagagtggtatccaactttttgggcccctgctcgcaacctgggtacaacgacgttctatggtcctttaacatcttgtccaatttatgggcccccttttcactttcgcagtcctccttggcgtcctgcaacatctgaccaagatcatccgcaacgtcgttaccatcagcatccctttcctcctcacctgtttgatttccttcaaatccaatgtactgagcaaagtccggaatattgtcgtcttccacttcatcttctttcatttcaacaccttgctctccgttggatgtccaacaattatagcttggcatgaaccccgactcaaacaagtggaaatgaatagtcctggatgcagaatactccttctaattcttacacttattgcatggacaacaaataaaacccttttgcctgttagcttcggccactctcaaaaaataatg

SEQ ID NO: 66001 - DNA, 15819 bp, Oryza sativa
  unsure (1)..(15819): unsure at all n locations
ctctctcatcaacttacaactaaattttggagacaaaaaaagtgtgcaaaacatagctccaaatgtaatatggcaaaaaaaaacattagaggatgaagttgcaaaccttttaggcaccttcgatttgtatgtaatcaccaaaataaattcactagaaattttggcatgacctctcctcttttttgaagaaattttgaagcttgcttgggcagctagaggaggaagaagacatatatataggggtgggactttagtcccgggtggtaacaccaaccgggactaaatatcccggggggcctgacaggccctgacagcatttgaaccgggactaaagatgatctttagttccggttggtgttgatcaaatatgcccgttaccctttttaaccgggactaaagatcatctttagccccggtttttattgcatccgggactattgtggaattcagccgaccgacaaaagatggtttctccatcagtgaagacacaatgtgtgtatgataggtgggaccatatattaatagtatagtaagcaactattactctctccggttccatattaattgacgttttagacaaggttgatgtcaaatttttataacttagactatcaataactttaaaaatatttagtttaaaggaactagaacaacatatatatatatatagatttgtcttttaaagtactataacaaaagtaaacatgcatttatttattatatattataatagaaaaataaggtcaaatatgtatcttgtagaccgtgtcattgtccaaaacgtcaattaaaatgaaaccggagggagtatgtgaattggctataaatgaattggagctagtagtggactatactattaacctggctcaaatgccaaaattggcctgttcagtttcctcgtagctaaactcttggggtcaaaaaaaaaaaagtcctgttcctgatgagagagtgagacgtacaagcaaaatcaagggagaaattatattagcttgcatgccgtccctttgtggctgatccgacattcgaggggggcgcctcttccaggatccgccttctccggctacgcgcctctcccaacgaacgccaacccagacaggctgcctgttcgtcccccaccacccattccgattccaccgcgcgcgcacgccatgagcgagccggccaccaccacccccacccccacccccgccggagaccacgacgcagccgccaccgcatgcaagcctgcggagacgaccacggccctgatcacctgcaggagcagcagctgcagcgcccagcagcagcagcagcagcagcagcagcaggaggagccgctcggcgacgaccagctgggtgagctgcgggagatcttccgctccttcgaccgcaacggcgacggcagcctgacgcagctggagctcgggtccctcctccgctccctcggcctcaagcccagcaccgacgagctggactccctcatccagcgcgccgacaccaactccaacggcctcatcgagttctccgagttcgtcgccctcgtcgcgcccgagctcctctacgaccgcgccccctactccgaggaccagatccgccgcctcttcaacatcttcgaccgcgacggcaacggcttcatcaccgccgccgagctcgcccactccatggccaagctcggccacgcgctcaccgtcaaggagctcaccggcatgatcaaggaagccgacaccgacggcgacggccgcatcagcttccaggaattctcccgcgccatcaccgccgccgcatttgacaacatcttctcctgagaatatagcatcagtggcattcacatgcatcgatcgcggctgttcatcagccgatcgcttcgtcagatgtttgggggagatcagatcagatcagaattcagaatcagatcagtggggtaaatttaggtcaggtgttcttcttcatatgtgatcgagctcttgtgaataacgaataaatctttgtaaaacaaacagaagtaaaacatacgaatttcagtttagaaatgaactattcgtgcattatctttcttctcatgttggtctgttctgcaatggtcgtcctcaagcaaggtcattagtgattgtagttgtaggaaggatatcaccaagaaaaacaaactcaagcttgtataataatagtataatactcccccctctcttttatattataagacgctttgactttaaactgttttaaatctgactaagtttatagacaaatatagtaatatttataatactaaattagtttcattaaatcaataattgaatatattttcataataaatttgtcttgggttaaaaatgttagtattactttttttctataaacttggttaaatttaaaacagtttaactttgatcaaagttaaagcgtattataacctgaaagagaggtagtaatgttcatcctccctgtgttgttggagttggacgttggtctcaatcatctgatggtgaggtgctggatccattgctggatcgatcgttgattcagtgcattgctgatccgtcaatcttcgtactcccaaatataaaattcagcgcattgctggcaaattattgagttttccctctgtcttcaactttaagtttattggtattctagaattaataagtgctggacaactgatataggcaatcatgcatactcgcctttcatgaactcggtcttaatagccggaaatattggatgagaatttgtcttgtcagatctgtccagctaaaattccagaacatttttttttcatttttggatgaggccaatagttcctcactacgaatagtttggaacatttcagatctgtccagctaatagttgctcactaagaatctattatctattatatatatatatggtaaataaaagttcattaaaaatcctatagacgctcttaagcctgatgttgcattctataaactcctaaaccgccacgtgacagcggcggcggcgcccccttctccttgtagcggcagcggccccttctcccgaaagcagcggcggctacaaggaggcagcggcggaggcccccttctccttgcagcggcaacggccccttctcccggcagtggcggcagcccccttcgccggtagcggcggtggtcccctcatacagatccggggaggaagcgagaggaggcggtgctatgcgcgggtaatttttcctcctgtggttgaatcggtgatgaatgtcgtgtgagattgatatgatcgggaggggaggagaagcgaagcgagcgctcaggaggaggggcgttgcggcgctagcttttttccgcatctgattattttcgttcttttttttttcgcatccgcttttttccgccgtaacagatggacatagagatagtgatagagaagagaagtagcaactctgtgtagttgctttgcacggcccaataactgctgctcggcagctataggcctctagcgcttgctcaagcgcgccagctcgggctcgggccggagagaacggaatgcttcatctcaacaaggcccgcgggcgcatgacctagatcgaacgtcccacacttctccacaccttacgcgaccccgaacctaaaccctctgcgaaacgctcctcctccggacctccgcccaccctcccccaaaacctgacctcgccgacaacacccggcggcggcggcggaggcggagatgatcaagcggcggtacttccgacaggaccacggcgacaagagcggttcctcatcgtcctcttcctcctcctcctcgggttcggactcggacagggaacctgcggaggaagcggcccccactgaggaagtagaggaacagcaggaagaacaagaagatgagcagcatgtgggggaggaggattcgggagaagagcaggaagaggagctagagccagtggtcgaacaagagagtgggttcctataatttgtgagtttacattttctcgtatttgcgcaactgggatttccgaagtgaccacgtgagttttgctttgtttcctcatgccaaccaggttcagggtaccaaagtgagtacagctccggtaacgatgttgatgaaccttctgcaggtattctgcgttcctgctgataaatctcagctttttgtgtggacttctctcattcgatttggcgtatgagagatctggatgccatcgttattgttatttcttttgagatttgcaggagttttgtaagaacgtgaattgtggtttagattaagttgcattttcttgctcttctaaggacctctattatgttagatttcgtatgtttggctgtttatagcatatggaggctacttgcctcttgcatttatattctgcatacaaaatattgggcattgcgtaatttaacatcgctatctctgttcttttattccttttcattataattttgtagaagtatgatcatgcagtgttatgtgtaactagcatttcttttacatagtctctctatatatcggtgaaccaccactgttagtttgtgtttccttcagtgtttgtggtgatttatgacacaaaaattaagtgcctagctaatgtggatgtagttgtcttaagctcagggatctcattttggtactccatggtttagctttttcaaaagtgtactgtggctagtattaattacctgcccccagcgtccttgtgcttcatttagttcaatctgggatctgatcactttttatctttctgatggtcatgtggtacacttcttatcattttggtatcaatagttcctgcctggctgcctatcataccaatttcagtatttgcatggaataatgagttaatgactgttagcaaagattcatatctcatttctcaatgaaagctcattaatcacttggcctgaagcattctataccaaatcatcctatggaatgtgtttgtaagaataatcccgtgttatgaatttattctgaaatgttgccgcaagataagtctctaaaatgaattgtttactgatggctttgctttcagatagtgatgagcatatcatcctaagacatgaagaagatcctgagataaattcgtctgttaagagagcctcaagtggtaaagctgattcaaccaaagatgcatctgacacggatgatgctcttgaggttgatttcaataactacattctgaagtgcaaatctgtgtacaagtgcaagctttgtcctagaatcatctgcttaaatgaggagatggtcagggtacatcttaaatcaaaggtgtgtaattcaggtggaagnaatataaatgatgggacttatctggtgagaaatacctttgtctcatgtcttaattttggtttggttcttgtagagacatgctcgatcaaagaaattgttaggagaaggtaggcttaagttgatgcttaatagtgatggtgagttggaggaagagcaagagacacatgctgaacgacatgctcgaactgtagctcttgctcaggtgtttgcccaaatcattttataagttttgatttcttatgtgcaaaatgttttcgtaaattaaatttgtacttgttatggcatctaattctgatcatgctgctaaatgtttcagcaagtacaaaaatcaaagaaggattctggcaggcagcgccaaaaccgaaggaggaagaaggtaaagtcacacccttttgcctatgcttttgttgcaaagcacatatcgaaggctttttaggcttcatatagaaaagcctattgagctcaaagcttgtgcaatatcatacttatcgtttctctagatcataatgatctccagcagtaccaacaccgtggagatcatactaggatgatgaacatgcttcaacaacaattcagtttctattttgtggtatttgcatcagtaccctcaatgtggatgctttcctcacagttatctgcttttttttttcagagatctcagaatcatgttgagaagaaacagaagccactaacatctgacaagaaaaaacgcaaaattgaaaagtaaagtggatggtcagaaatgttacaagtttttccccctttctcaattcgcatatgctaacttttagaggtaaaatcatgtgatgtttctcgagcctttgctggctgttttttggtggtcgcatatgccatcttttagaggtgaaatcatgtgatgtttctcgagccatttctggctgtgtctgtgtaagatttgttagcgacaatttgctgatactatgagatcacgttgaatgggaaattaattgtctcgcttttttcactttcatgttacaagaatcctatttatggtgaaaaaaggttctataacgtttgtcagaaacacactcaaaaagcaatgaataaaataccacgaatgcataataaatttccaagtttaatttttattctcttgttacgttttctggaggaagaaaagtaggtttgaaagagatgatactggcggtcataaccagggccgtttgcgggcgaagaggaggtcgaagagtgcgcttgaaaacacaaaaatgaaaatggtgagcattgcaatgggtcgataccaccgtaaattggctgagtgtaacctatcgcatgatttttttttttaaccaacagctttttatcgggagttttcatttttatgtgaccaggtaggaacacagttattttagagtgcgagcaggaactctttttatagtagtagaaaaaaaataatgtaatcgatcaacattacgggagatcaacgagcgattgatctctacgcgccttcgagatactattttcattctaaaatataataatttttagctatatatatggccataccttcttcggagagaaggtagacacatcaattatttcgcgtgttcttatgagttacgagaactaacccaaatgtgaagttaaaaaaaatataagtaaggaaaaaaaataaatttccaggttatttttaataatgtttattaagctgtaacagctattgaatttttgaacttggttatataattgattcgaagtttatttcctcattcttcgttggttgccttctcttccatatccatactgctaaaagccaaaagtagaagtgtaaacgtctcaatctaaaactaatttttattgcaatgatcacgtttcttcagcttgtaaaccttcggccttgtttgtttttgcttttttattcttacaattctgcttctttacagtgattttcagaggttgaattattaaaagctaattctgatttgcctcttgataagaaagaaacgtagaatttatatgatactcctagggacagttttagaacattactcaaaatccacaaaagcagctccatatcagcttttcgatgttagtaaaacaacatactgccaactactgactctaaaacttctatagccaatctaatagcccatttatacaatagttaactataaaaatatactacaccattaatacccggtcccacctctcatacacacataatatcttggagtccgtgttgcagccggctataaatctgtagcccgctttattatttctcttctattttcttttctcgatatatggttatagccggcttattacttattgtacctgctctaagaatcaagctgtttgtttttgtcctttaagcaaaagaaacatggcctagccagacccggataaataccttccaagttccaagcaagaccaagaaaacaatgctaagtctggcttaatgcctcgattgtagtgttgctgtggtcatttttcaaacaacagccaaatacccatgtgttacaatggattttcaaaaaatgcattcataagttttaaacttgaaaagttttgtatctgaatcctagaagagaacacttagctcgcgaataaacatgaatccacaaataacattattaaaatccaaacgcacaaattcctatcagggtgtctgttaattagaggtatggaggtgtccatcacttatcagttttatttataaagtacaggttattttaggaatggtttgtgatagtaaagtattttgtaagataactgttgagtggtagtaccacgtggcttcctttaaatttcaaaaacatacacaaggctgaaaactatttttttttaaatgttgcttcaaataattctagaaaatcttgaaagtattgagaaactataaaaatcgcctatagtaataaaacttatttgtcacataaaaaacaattttagttctagaaactattttatgtgacaattatatttgattttgtcggtgcataatttgtactagttaaactactctctgcatttttaaaacactacctttagttttaatatgacacattaggaagctatgatatatgggccctatgaaaattttaagtcaaattttgctacaggacactgctatagtgtggttttagccgtgggacactacccaaactcacttttgagggaaaacacttcataaacgtgataatttgtcaatggacatcacgccgattaaaataacgatttccggttgaggaggagagagaaatcacgtgaaatgtcaaaaatgcccttggggccacatgttagctctccatctctcttcctccctttcttttccttctcccttcttcttcttcctcccaccgcagccttcttcttcttcctcccaccgcaggtgagcagcggcgtaacgcacagtcggcgcgacagctcgagccggggcggctcggcgcgcggccagggaagcggcggcgcaacgcaggggacccaccaccaacgatgacgaggcgcagtggccacccggcgcacgacgcgacggcaagcggtggcaccgagcacacgagcacggcggcggcacaatgtcgttaaaattgggcacaaccggctacttctacacgatctagggttcatagggatgtcaatttcacgataatataacctatgttgcattgggattacgtttacccacagggagcacaacggtggcacaatggcgaccgggccgacatggctacggaggcgcctgcccgaaatcaagggggccaccggcttctaggtcactaggtgaggctcgcgacgtgcgacgtggtgcggggcggtgcagaggcgaaacggcgtcggcgcccgattcttggcatctgggatgcgacattgggagcaagattccagcggtggcgatggcgagggcggtgcggcggagcaaggccgggtcgagctcgaggccgacgaggaaaaggaagaacgttggcgtcgtcgaggactccgacggcgtcgtcgaggactccgacagcggcgtcagcgaagtacgccgtcaggtgtggaggatgaggtcctctcgcggccaccggtgccgactaggccgcgcgcactccaggcatcgccgccgtcaccgagcaagccgcgaccaggataagagagaaagaaaagaaagagaggaagagagatggagagctaacatgtgggcccaagggcatttttaatatttcacgtgatttttctctcctcaaccggaaatcattattttaatcagcgcggtgtccattggtaaattaccacgtttatgaagtgtttttccccaaaagtgagtttgggccgtgtccgacggctaaaaccacacaatagcagtgtcctgtagcaaaatttgccaaatttgaattgggaaaggatgtcaaacacgtggttttagagttgagagacttctacttttagccattactaatgcaaattcgaggttcacaaaactagtacggggttgtgtccttgtgggcctttttttccagtagagtgtaactacttgcaactttcaagttgtgcccgtgtgggtcttttcttccgatggagtgtaactatttacaactttaagagtccctttgaatcacaggaacgagaaaaaaaatagagaaataggagaaaacacatgattctgataggactctgatatgttatggggggtcgaatggactttattccttctattttagccattactagtgcaaattctcatgttcgaggttcaaaaaaactagtatggggttgtgccctcgtgaaccttttcttctggtggagtgtaactatttgcaactttgagcgtccctttgaatcgttggaatgaaaacaaacagataaatagtaaaaacacaatattctgataggaatgcaaatgcaaaataaaggattacaaaacaaaggaataaccatttgattcaaccgaaataaaaccgtaagaattggatgagagacatagactcaaagcaaaatttccaagaggtagaagctcttgctaagttttctccaaaatctctataggattgttcattccataagaatttcaaatgattggatagaattcaatcttttgtttcaaaggtcttttataggattttttaataggattgaaatcctctaaaattcgtatagtattccttcaaatcaaagaggcccttaaaaatagataatctctaaatgccatttttaaagttgattctatgtgttttgccatggaagtgtggtaactagtttttttctacttccgccaacctggcatggcacattgaggtgctaacatggaccactaatgcataaagtccagcttgccccttctggagcccaccaataagagaaggacacagacacatcacttagaacctgatacactcacagctgtagggtgacctgtactttcgatgagttgaagataacaaaagttgtcgacctgactacaacctatcatatgttgttatgttgcgccttagcgatcaatacatctttctatgggttattgatctggccggtgcatatcaaccttattcttgcaagtaaataaaagaaacaagcaagaacaaggaaaaacaatataaattgcaaacagtaaataaagctcatgacaagggaggtttcaaagatgagtaactagacggccctgccaacacgcgcaattacgaggtaaagtaacactggttaaactttaaaataacaaaactctgaaaccctgaagaggtatctagatatttaagaggtgggaggacgactaaggcatccctagggtcgtggtccactaggttggggagaactctacatggggccgcacttgggttaggccctagatgaagttacaagtacatagaggccattatagatgacgcaacaccttattcctagagtgccgctaactgagattgaaatttgaggcgatgctgaatccgtaggaaataaggatctgagggctttccatcaagtacttatggacctaaaatgaagctcgtatgcacatttggcggtcattcgaagtcagtgatgttataggtggccaaattggatttcaaaacttgtgtagctgatctcaatgtctttcagtgaacctattatgtgagcaataggttgtatccatagtagttaaggtcttgtaacatcattaattattttagcaaatacaactattctaggatgtgagggcacacaacaaagcataaggataccacgttgctcgccttgcttagagcatccctaggagatacgctacccgatcctccatctgtaatatggtgtataagagcggaaaacccacctctagcagatgcaccatccagtcatccaaaagtggcggatgttccaaacacggagagagaaaagccaaaaatagcgtgtctctctcctcatgccaaatcacaaccaacgcgtatggatcaacctcccacccccatctagacttccgcgacctcctctccatcgccgtcatcaccggctagcaaaggtgagtattctgtgccagtttttgttttattttcagcggagggaggagagggagggtgtagccatggagtgagagtggagagggagaggcgtaccagatctagaaggagggtgttccttctctgcgccctcgtccagttgtccaccaccgaccctcggccgcacgcccgccgccgtccctcgccagcttgcctgccgcccctcacctgcccgaccaccgccgacactcggtcgcccgcccgctgccgtccctcgccagctcgcccactgccccttgcccacctggccaccgtcgaccctcggctccacgcccgccgtcgcccctcgacagctcacctgccgtcatgcctgctagctgcatacgtgaccgactgctccatccctctgcagagaagggtagtagtagaaaagaatcggttcatttgaggagagaaaagatagtagtacgttacttgcattgcttttatgtttattgagcagagaaaagcaatagaagtagagtacaaactagatttatgttgctatatttttgctgtgcttttatgttcattttatttatgttgctacttttttcttcctaggtgaattcatggacagctatgttaatttgttgggttcaaacattaatgtagaaacttgggatcctagtcaaaattctcccccaactggacagtagccacaacacagtcctatggttagtgaacaaccaagtgctgaagttggtgggatcctctagacccaacaataagagatcaaaaaaatttagcattgcggaagatcaaatgttggtgttagcttggctgaatacaactttagatgaaatcacaggtgatgagcaacatcgtgactcttattaggcaaggattcatcaatacttccatgaaaacaaaaaattcccctcagatcgtaaccaaaattcacttaacaaccattggggtaccattcaagaacaaattaacaagttttgtgggtattatgagcagattcttaatagacctcaaagtggaatgactgttcaaaattatgtaagcatctaattgagctagcatctttctttcttaaagaatgttgttttttcttcttattgaccttgccaattaatgcagataactcaggcttctactttgtacaaatcataacagaagaagacattttttaaatgcattgtcgggagattttgcatcatcatccaaagtggaatgataggttgtcccagaaaaagccgaaggctcacatcgatcctttggtgagaccatatgcaagcacaaactttagtgaatttctttgcagccccgacattaatatctctcatcctttggtgagaccatccgggaaggtggaaaaggcataatgcacacgaggtaatacttcttcatgctcaagtgagagtagtcttgtagttattgcattaaataacatgtggtcagagaaaaaggatatgagtgcacaatctagggaggaaagaaatgactggttggctgaagttatttcacttgagaaagagaggttgaaagtagagaaacgaaagttagatttataaacctatgaaagagaaaaaagaattatgaatatggatcttagtgctatgtatgggccaagaaaagcatattacttgcgtttgcagcaggagataatatcgcgtcatatggatttagttcatgatgtatggatatgtactatttattaccatttcttaatgggttgcgaacttttatgttgtacgccgtgtaggctttgatgaattatgtactattgcttgtaagagctttatgggttgtgaatttttatgttgtatgtcgtgtaggctttgatgtattacgtaatggttattgttagaatttaatggtttgtgacctttatgttgtatgaaaaaaatgctatgattaattgtgagcacaaacaagttgcatacataattagaattgcatacataattgaggattgcatacataattgaggttgcatacacaattgtgttgcatacataattgatggattgcttacataaatgaggttgtatacacaattgaagttgctcactacataactgggaggttgtatactacactagttactaccatgaaattgccatagatgctcaactagatcttcttgaagctgagagcgagtctgtctatttctaatgttatgatgattctgaataaagtcatgcagttcagctataggggtatgcaaaggtgtgactcgctctccctcatcattatagttgtagcaaagatcttcttcatccctctcatcttctactattatatcgtgtaaaataatacatgctgtcatgatttcacttaatatgtctgaataacaaaatctagatggcccacgcacaattgcaaaacgagcttgtagaactccaatcgcacgctcaaaatctttgcgatctgcttcctgttgttgggcaaagtgttttttcttatttccttgcggttctgatattgtcttcacaaaagtggcccatgagggataaatacgatttgcaaggtaataaccaattgtgtagttgtggctattgatttcataattcacttgtggtgcctatccttttgctagccttgcaaagagagggaaggatgaagaacattaatatcattgtgaaatcccagcaaatcgaagaatgcatgccaaatccaaagatctcttgaagcaacatcttccaaaacaatagtaggcatacttgattttcctttatactccctccatccctaaataaaagggattttggtaggatgtgacacatcttagtataataaatctggacataagcatgtcttgacataatgaatctggacgaagagagtacatgccttgccatgctgaagggcaatttttccactcccaatgcatgcaatctatggatcctagcattccagaaaaacctctctgctctcgaagtgcaagtaatctaaaagtgtcagcactagttggataacgcaagtactcgtcttcaaaaatctcaacaatagctctcacaaaccttttcaaactctctatagtggtattttctgcaatttgcagatattcatcttgagtagcggctgcgactccattggttatcattctaagtgctgcggtaatcttttgcaatggtgatagacccaaagcactggcaatatttcgttttttcacaaaataattataatgggctaccacatcattaactatgcgcaagaaaagaggacgactaattctaaacctgcgcaacaaaatgtgaattaatagaagtagtgaacaaaatgggatcaaccaaaatatgtaaattaattgcaaacctttgccggaataagactaggccatatgtaggatgctccgagaagtagtcgtggtgcaacctatcatggccggctcgatgattacgacaaacaacctaatgaccaggaacataaccaccttgtcgtggagcattcgactgctcatattcatcttgcgcgactattgctgcagtaacgatgatttcatcgccggatgacgataattcatccaacagaacatgtctcaaaatgaatctcattgagtgatggaagaactatgcacaataatgtggatggagcaaaaagatagcaagtaatgtagcggtatgtatagagctgaactttacatgttgcatgtgctagccgttggataatttgaatgagctagctagccgttggaaatgtagccgttcgaaatgttgccgttgcacacataaaaaaatgcttcactcaattcaaatatatcaattaaaaaattacccattaaaaatatatccgttaaaatttactcattttgaaatattatcgcgataaataacaccgtcaaaatttagtcgttcaaaatatatcccttaaaagtacaaatgtaaggttagttggagaatattaccccaatataggatggtgtgatatgaatgatctgttggagtgaaagggatatgaatgaggaatcttttatcttttttggatgataatccatatgggcatttggaggatcaaatatggatgagctcctgggtatgctcttagaagctaagttctcgcatggtgcagttgtattggtgcatggtaacaatattaagcgatttggttgctttcttcttccgaaccaacgtgactatttaaatcaaaacaacacaaactcaagataacattattagttgatatgtcccaaactact

SEQ ID NO: 66002 - DNA, 12509 bp, Oryza sativa
  unsure (1)..(12509): unsure at all n locations
aaaactgctactagaaaattgcaaaaatatcactagaactgtcattcgagtggcatccttgtaatattgaaaaaaccgatggaaaatttgcaaatgccccttttcctaaagttcatgtttagggtttggtccctgccgaactacctggtggcgatcccatcagcttctatctgaatattttgccgcctgattggttggagaagaaacaaggtcaaggaagtcttacctggttttgttgtttggtacatgtgtatgcctcctcttttgttcgtgtgtgaaagcacgggtggattagattctaagtgctttggtatatcgtcatcatattttctgaattaatttgataactgttttatttggtaccgtaaaagagagggataaattagggtactcgctgttgggtactcatcattagtcatgatactactcccccgtctcaaaatataagaacctaggaccggatgagacatatcctaggttcttatattttttgatggagggagtactttctagcttgctatttttatccacaactataggaggtcctaaatctaaacacatgtaaactttgtgcaccaaatatattcctctatcattatatttgccaaatatatgacatatagtattagttgatctagcaaacaatttctccttcaaattaccaaactctcaaaagtcatcaaactgagcatggcttagagtatttaaagacaacagttgaaattcttcattctcgctagaaatgatcacataaaagaataactataggaatatcttgtccattcacaagttgtggcttaaatatatgtgaagtattatcacacaactcaacaaggaaatcttgatgtggctataactaccatagatacaaccattattcgaatcataaatcaaccataagatatcgagataaagccgcagaagttctgtaatccaactcggccacctacaacagtgttgacttcaaacagccgccaaatatgtatacgagctccattttgagtccatgagtacttgatggaaagctctcggagtgcgctttccaatcggatatatacagcctcatctccaaattgcatcttagttggctacaatcatagaaaaaagatgttgtgtcacctatattgggtctatgggcttgtagaatggcataataaattcgatttgagcaagattataataaggtagctcatacgcttcatacagagaaaccgtcatatctttttggtgatgaaggtgttgatgtcgagcatgctatctcatatcccgttgtgtgtgcaagaaaaaacatacacaaaaatatacacgctcctatcaactactaggtagtgtaggctcaacaacaccggatttggtggtgatcagggcagaaagaagtgggaaagtggcagcggcctccttctcaaatgtacagggcgccgtcaccacccaaatgtacagggcgccgtcaccacccagaaacattaggcgaattagtccgagaataatttatctactctaatctaatccgatgtcgtttgcttaaaatgggatggaagtgttacgtatcaagaaaaatcagtggcctgtgctgtgcttttggtcaaaagcggaaaaatcgtatgctactacctctgccccaaaatgtgtatccgtgggtatccatatcaaacgtttgaccgttcgtcttatttgaaaattttatgaaaaaattaaaaagaattagtcacacacaaagtacttgctcatgttttatcatctaataacaacaaaaatactaatcataaaaagaattttaaacaagatgaaccgtcaaacgttggatatgaggggtattttttttggactgtctatgtgacatgcggcttaaaatttttgttttgtcaaccgtttttttttccgctggccgtgcgatcggcgcacggacgatccatgcgcgcagaaagaaagtagcatgatttttttttcttttttttaggccacagcccatttctgtttttttaggccactgcccacatcctcttttctttaaagaaacaaaaagcccgtcacaatttgtgcagaaaaaaaaggaaaaagtacaccgcaggtccctcaacttgtcatcgagttacagaatcatcccctaaccacaaaaccagatatatagcatccctcaacttataaaaccattcattttaggtccctcggtggttttaaacctggttttgtcctatgtggcggctgagtcagcgtgggacccacgtgagtcccacatgttagcgtcgctacgtcatcaccctctctcttcccctcctttctctctctctcactcttttcttttcttctcggctgaggcggaggccgccgggggagaggaggaggcggcaggcgacgaggcggcagcaacgccggagaaggcgagggcggaggccggtcgcgaatggcgtcgacgacgctacgtcgccgccggcggcgaagcggccccgcgcgggcgggcgccgcggcgttgggtgcggaggcggaggtggggccgggcaccacgacggtgggcacggaggtggaggcggggctaccgggcgcccgcagcggtggacttggcggactcggagccccgtggaggtggaggcccccgcctcccttctcaagcggcggcgacggcaacgacatgggaggcggcggtgacaacgatgtagagataccgctctgctcccctgatcaccacgacacagtcgcccgtgcgcacgtagcacgacgagccggcgctgtggaggctcgactcgagtactcgacgcgcagaaggctggccaatgtcgccgccggcgaggccgtggcacgcatcctccacgccttcctcggcaccaagggagatggtccagtgccctgatggcgaagccaccattagtaaccacctgctaacctcctctcctgtcttccctgtttggcttacttcctgttgttgggtgggttgcttccaggggatctggagttctggacatttcaacggtatgctttgaagcttagtgcctttccttagatcaacatgcttgtttgattcttgatttcactggaatgttctgtacgaggtgcaagtgtagcccgtcgtttctgcagttgggttaattgctgcactagtgagggaatgtgcaccctaaagattaaagatctgtttgatggatcagttcttgtcatacatgtgtcgatttgggggtctgggtttatggttttagcagttgatcgtggggttatgcatgtatgttacttatctgaatcagtcccctgaccaccacgccacggtcgcccgtgcgcacgtagcatgacgagccggcgctccggcagcggaggcgacggtgggggtggagtcggcgacgagcacggctgtgagggatggcttggcggagagctggagccgctgattcatctatctctcctgccctcctctcacccacctccggcgggagcacgagcgcgccgccttcctcgtagtcggcgttcgcgtcggcctcggcctcggcctcggcaatgctctcgggattcgagtgtgacgaggcagacaagtacagtggcgttggcaccaggatggtggtctccatcacagccggcacgccgagatgacgagcacagggggctccgggcgcggcgacacggacgcggactaccgaaagagagagagagaggaggaagggagagaagaggtgaaagaggagatgatgacgtggtcaccttgacgtgtggggcccacgtgggtcccgtgctgactcatctaccacgtcagataaaactggagtcaaaaccgccgaggatgcttgcactggttttgtaagttggggatgcgttgtatccggttttgcggttagggatgattttgtaactcgagaagaagttgagggaccttcggtgtacttttttcccagaaaaaatacaaacaaaaaaaagcccactagttcacatggcccacatcccacagcccatgatgggattaaaaagcatcatgacgatttatctttgttaataaaagcccacacttgcaaggaggagagaaagcaagaaagaaaagaccatatacacgtgttttgtccccataaaaaaagcacaggaaaaagaaagatacacatatcacgcctctcatatgccagcgtcacccacaatcatcacccgtccaccaccttgcgatccaagaaagaaaaaaaaaagaaaacaaggggtcagctcaatcgggaaggagtgaatattgtgtgcaacgaaaaaatctccatggatgcatcgttgaagatgaagagagatgagaagagaggcgattcaatgctgaatattggggaagccctaggtatgtgcagaaatagatgaaaaactctaggttcaagtacttacctccctgattctgagtttgaaacccatgaacttgtttttctatttgactatcagatctggaatttttcaaatcactctgtgttgctttcatttgtggtggttcaccttgtcttgatgcatgaaccatgtttgataaaacacacttggttcagaataaaaactgaaaaatattcagaaaactgccagtagataaagttgcatcatgcaacttttgattacaaaaagttgcattacccatagtacagagatcaagacacaaactagttcttagagcccctgatatgttcaattctcaatgaaaacaactgaaaattgcaaactatataattccattagttgtctggagagcagagtgtcacatgagttggattgttctttctataggtcatgttagttttagattttcagtagcttaatagggacaaagacaaagacaaaacatatggttcttgaggtttttttttttttgctaccgtatcagatcacaaaacaaagctatggtaggtataagttaggtttaatctgaactagaaagcagttctcaaaaaaaaaaactagaaagcaaaaaaaaaaaacaaaactgtatacaactagtagaactgtactaactaaaaatgtgctgccattttttctggagatatatgaatggtagcgttttctacaatcttgagtcaattcgttgaacgctaattacagcagaaccgaaagtgtgtagaactctagattctactagaaatggtcaggcatatcggaaactgaaagatccagtctgaacagaaacagaacagaaacagtttgaacagcagtcttgcctctgtagtttgcacaatgtgaagtagcacataggaattgctcactttggcacatttggaattgcttgggtctccagataggcatcgtcagccatggcccctaggctcctcttgctctgaactcctacagagaaaaataatagaaatatgtagctaaatcttataaaagttgataaagacaaagacaaaaccaacctagtgccaagaccaacctattgccaagacgcatgttgcaaatataaaaatctaacaaagacaaatacaaatacaaagacaaagaaaaaaaagacaaagacgcatgacgcatgaaaatataaaaatctaacaaagacaaatacaaatacaaagacaaagaaaaaaaataaaaaaacaaactcagagagtgtgcacaaagctgacacgatataacttcacaaattacaaaaaatcacaaatattacatgttgtgtttttcaggttgggtgaaagactcacataaagaagattatgtaatggcggatatgtatgatcaacagtccttaacgagacatcagcaggtaaaaatggttcttcattgcattctccctattgtacctgacaaatattaatgaaaaatatcatctcttgtcaggttcaaaataaattgtgattagagtttacatcaatttgcactggcagaacatgaaaagtttacatcaattcagctatctcagtacatgtatctacaaaactgcagctaaactgtctattgataaatatccatgtatccagtgagaaataaatatgcatcttgggggcgaacttgcttgcctcgtgttctgctgttggaaacacgtccttgccaaccaaaacagaagaaaccatcgaacccttggcaactgatacgccaagctcaagggccccatccgtagcaggaattgcctacaagtttttcatgagtgacatataggggaagtcccaaaaatgtatactacaaaaatccaaaagatacaccacaaaagcatgacaaagttataatttcaggatgatcatgccacaaaacactcacatataacaacaaattatggtcacgcgtgctgttcaatgcaaatagtgtcagcatcccatagtctagttgagaaacatgagataattaaattgagcgatcaaatcatcgaaagccttcgtttacctaacaatgttgataatacaatgggaccaaaaaatggaacataccaaatttcatgcagccaccaaattgcaaactgaacatcaacaagccttcattcggttgcagcgcgcgtcaagtactcaagtcgatctgatattcagttttagcgtctctcttgcactgtcattttttagagattttgcatgataaatagcgcgcacttacactgtaggggcgacaggagtgcacagccatgcagttgttccaacaaaacagatatggattggacatagcggataatagaagaagaaatacgctaccaccagacaccagtgcgagggtgacatactgatgaatagcatacaggccaccatgtactgaagtatactgaaagtaacttccacacgtgcaagggtagaaaaaaaactttgcatatggtataaacaaaaactgaaatgcttaccactccaggatgtcatagtagatgtttagttttttttctcagacaacactaagcacaaatcaaatacaattttgcacggggaatcaaatatgagtttgcacggggcgatcgagattagatggccacattaacagatctgactcacagatgaacgtttccaaaaacaaataacaaaaaactaacacaaattacaaaacaaacgaaacctgtgtagccttgaannnnnnnnnnnnnnnnnnnnnnnnnnnnnnttggaggtcgatttgcccccatggctgactgagagttcatggcaggggcggatccaatgggtaggcttcatcaggctcgagcctaccctccgatttttgtaaaaaaattttaattatatagcatctatcccatgggaggagttggagaaggcagggagaagagaagaggcgaacaactgtctctggcggcacgaggaagaaaaataggagcgatggaggtagctgaaccggtacgcagtatgttgcttcttttacttaacatttatttatttctaccatttatgtattactaattttcttcatttatatattcaggtggctgctcactttaatctttgctaaggccaaaaaaattagcatcttaagtcaaggactcaaggtattcttttataagtatgtttttctatttaatcatgtaagtgttacatttgaattgataatggcatatgcttcattttaacattattaacttagatttagacttatagtccaacctatcctcaattttgtcctggattcgccactggttcatggatcagagatccaactgcgagatccaccaaatggttggtcccctcacccgcctgagagagatggttggtcgcctggcccaccggagagagaaccaccatggccaaatcagtgccacgcgcgaagtattccgtcgggggctcgctgacagacgtggctacctcgcggcggagcagcggcgacgcggcggagttgcggcgatagcgccgagaactccgcctctgcctgtcctctcgaacgagcggatgagaacgaaggagaaaaagaagcgaattgttttttgaaacagtgcacgggcgcgtgtgtagctgccgcaatgacatgcgtcatgggttgggctgggtatactgtgctgcatgggccacgggaacagcccacagagaaagagacagatgggtcgggccaaaatgtgctgcgtgggacacgtgaatagagaattttttttatttatacttttttttattaaaatatttacaaaaataatttgttgttttgaaaatttacaaatctaatcgcctgccgccctttgggagggcgatttttaaaaatcgcccttccacagggcggcaagggacctaaatgtaaattttccagcataacttgttagctctatgattttacaatttaaaattatattatataaagtcagatgaaataaaactttatatcaaaagtgtagagctcaaggagatctacaattttgtagttaataactttttcatttaagatgtccaaatattcgttataaaatataaaacacattttaaaaaatctcagatctacatttcaaacgatattggatggagataaactttatataaaagttgtagatcttgatgagatctataactttgtagtttatcacttttccatttaaaatcatttggagtatcgaataagcattattagtttttaagcaattaaaaccggtgggaagggtttgaacacaaataaaaattttgtatttaggtcccttgccgcccttggagagggcgatttttaaaaatcgcccttctagagggcggcaggcaattagatttgtaaattttcgaaacaaaaaattatttttgtaaatatttttataaaaaaatgtataaataaaaaaaattccgtgaatagatgggttcgttgcacgcatcttgagcagaaatccaacgggcaagaattcggctgagaatgaaaaaaatttcagcaggcagccgtctagtaattcccatttttttttagcgggttgttttgtgtgccgtagatggaattttgtcttccctaatcggacggctactcgcgtcgggtagggttgtgagtttgtgacgtcgtcccctgcaaaaccacaattctccacacgcagccgccggcgcccgtcgaaatgctggccaggcctgggcggctcgccgcttccacccttcccaacgattccgccgccgccgccgcatccaccgtcctctccatactccgcggcgaggaccccgccagcctccccgcggccggcatcgacccgtgccccgccgtgttccagcaactccgcccgtcgctgcccaccgtcccggactccgcgctcccggcgctggcccgatgggcgggcgaagccaccgccgtctccctcctgacgtcccgcggcctctttgctgccgcctggcgcctcctcctggccccttcccccacgcctcctcccctcgccgccttcgccccgctcgtccgacgctacgcccgcctcggccgcgcccccgccgccctccgcgccttccagttcctccgccgccaccccgaccgctacatggccggcggcgacatccctgccgcggcgtccctgctaaacatggcggtcgacgcgctctgcaaggagggccacccgcgcgcggccgtggagctcttcgagcggtggcgccgcgaggagcccgactcgccaccagatgagcgggcttacaatatccttctccacggctggagccgcgccggcaggctcgacaaggtggggaaactctgggccgagatgcgcctcgccggggtgcgcccgacggtggtcacgtatgggactctcatcgaggggctctgcgtgaagcgcaggccagaccaggcgattgcgcttcttgacgagatgcgggaagaagggatcgaggccaatctgcttacttgcaaccccattgtgtacgctcttgcgcaggccggccgattccaggacgcccacaaggtgctcgagaaatttcctctgtacggtgtcgcgcccaacatttccaccttcaactcgctcgtgatgggctattgcaagcatggggaccttgctggggctagcagtgtgctcaaggtgatgacagaacggggcatttcgccgaccacaaggacatacaattatttcttcatgacctttgccaagaacagcgatgttgagtcagggatgaatttttatagcaaaatgatcggtaatggctattcaccagatcagcttacttatgtcctcttggtcaagatgttgtccagggcgaaccggcttgaacttgtggtgcaaatgatacaggagatgagaactcatggttttgagccagatttggcgacgagtaccatgctgatacatttgctttgccggcgtcatcaatttgaggaggcatgtgctgagtttgaggatatgtttaagagaggaattgtgccccagtacatcacttaccagaagcttatgagagagctcaagcgacttggtttggttcatctgatccaaaagttgacaaatttaatgcgctcagtgccacattctacaaagttaccaggcagctatagggataaggaaggggatgactccatggaaaagaggaaattgatattgcagaaagcacaggctgtttcagatgttttgaaggagtgtaaagatccaaaggagttgggcaagctcaaagaagatgaagagactgatgttgaggtcgcagataggttagtagccaacattagaagaagtgtatatgggggtgcctcaacgagctctgtaatggcacctctttcttgaatatggagttgcaaaaatgaaaatcataaagataagggacatgattgcatgtgaggggatttactgatagattgcattgttcatctcagaagttgaccacctaaatgattcgtgcacatgtttactgttgttgtttgggcccttcaagataaaagataacagagaagaggtagtgacatactactgtggttgtggtttactggatattgtcccatgaaggaattagctggttgatgtgtttcttgttttagggaaacattgatatggcagttatttactgatggtaaatttctaacatgagatgtcttttcttgatgtctaaaaatttcatacctgaacatttttgtgataaatgtatcttattgattgcagtgctcatctgcagatgtcttggattgctatgagacctgtgtatgcctcatgcagtgatattgcattgaatcaggcaactcaggaaaagatgatgcctcattcgaagtctaaccagtgaacatagaattggtaggacattatttagcatgtggcagcccttgggtttggccgcttgtgcaactcatatacacaaaattttccattgtgtaaagaattttccgttgctttgttggtcggatacttcttcagatgctgttgttaaattgagatcatttagaaatcccatttcctgttaaacaaatacaattaaactttgactctccatttcctttatgttcagataatcttgaaataaattgctcttagaactactcaatattgctagcatggctagaaatggactcttgggatcttttcaagaattgagttcgctcacccttctcctttgccaagaattgtctcatttgcgtcagtttgttgttaaggaaaatcttggtgctcatttctaactacctttatcgcccattctgacaacttgctgatgatcaataggatagatggagttatacatgggggactgatgtttttttttttaatttgcatatgatgggatcgatgcaggttcctaagccctttttgtggacactgaaatccaattgtcttagtaagtggaaggtattctttaatttttctggctgctgcttaaagataggaaatactaaagatttattaaggctgaagaacatatagcgattgagagaacatgctttatactttgtcataaccaaatcaaagaaactgagacatttgtttttcacttcttacagttagagatgttggacagatggtctgccggtctggtttgaagtgctgtttgttgctagctgacatgattcacgatggaacaaatgctcaaaggaaataataaccatagcatatttgtctacgagacaatttagaaccatcgcaataaattaaggacttttttggcagtaaaagcctccatgcaagcctgcgttttggtctagtttttcttatagttaatctaagggtggttgtttttataaatcatggctgaatattttgcttttttttttctttacatccttctccttcaactcttcttgtaaataaatctcttttaaagaatttcagtagggatcttccctcctgtttacgtgaaaaaaaggccgaagaaattaacggcagatggctaattaaatgtggagttccaagtttgtttaacaagcctaatgtccaagaggatgagcttaattctttttagattgtttataccggatcattgaaacgaactattttctccatgcttcaaaaaagcaatttcttataaaaaattctttattatattgtttagaccacttattttaagttatttattaaatttgtttatcaaaacatttaatttatcctagatattcgccgtaacaatccgctcaatacattgtttcagatttcaagcctaatataagcacacctaacttgttactcgacacttttctatcatcatacttcctcatatcatggatcttcgctaacttcaaagttggagagggaaggggctagcaacttagggtatgtttagatccatttgaaatggcaaatggcaaaa

SEQ ID NO: 66003 - DNA, 7601 bp, Oryza sativa
cccttcatccaaaatatagttgtctttagactatgaatctggaccagattcatagctgaaggtagctatattttgggatggagctagtagttatttgcgtgaaggtggagaaaggaaggagtggtgcggttttataagcacgtgtagtacaaaagttgaaagtggtaagagtgataacgcacgttgggcaaagcatccgtggtctccaaaagactatacttttctacatgaatctaaaaaagtgcctatttagatttgtgcgtacctaagagtgaactttttttagatgggtcttcagactcatagctatatacgtggttaataaaaagataacacatgtgacctacatgaataaatatatatgctatggtcttaatggattctacaatgatacgagacatctaggctggagtaacgttcaaatctctactattagaaaaattaattgattcaggactaatctcatttttgttggtcaaactgcattggatatagagtatttgtgttggtcgtccatatgaaaatcgcggacagcactacggcatggcacgtccgctagggaatcagtctagtgctggttgcttctgcttgcaaggcgtgcagtgtcatttagagaagcaaagtttttcaggttggttatatttttgtcatttttatctattgtgatgtataaatatactagtattaattatgttgggtctatgaaaaattattcttgtcatggaaaggtctcgtgtacgtaatcagtgatcacacagatagtgttttctgaattcaaacgtttgttggaagaccacttcagcacagccaaaatttgtgttcgctttgttgcagcaccaaattgctgctgttttccgagcgtaatgtaagggtcaactgatgtggtaaaaatcgaaactgaataacgtagagacatgcaggtaggaacatgccaaaaacggtgctagaagtcaaatttactacataatcaaagatgctcaccaaggcaattcaagaatctgattttctgcaacaagctttacaaatgccccattcatcgaatggccgaacttacagtccatcttctcataacactaagcaacagtcatcgagcagccgacaatcctatatgattacacagggtacaagtactgtcaaatttacatcgaactaacacagtacatccccgttaatggatagcacactaagcaaagggaaaaatcaaaccatccttgaacagctgaaccccaacgaaagcatccctgtgtggatcaaatcacatgaccagctgacaaaactggccacaatgtagaaccacaaagtagaaaattgcacaaaattgtgatatgatcatttccttacagctcttcccatcctcagtccctccactcccttgatgtaatctctcaacacaaaaaatgttttcttgcccagagtcatggtttattgtgtgcatggattgaagctcgtacaacatgatgaggtggtggagctttttcattaacaagaatctgttctggaaagtccacacggattgatttgaactgatagcgctgtttgacatcaaagaaatcaacatgtaaggtagggctacatttgtaaagggtaattaagcttttgcaatatattcatataatctgatgaaattataattctatgaaagtactttctaaaacaaaactatacatatgattcaacatgtctaaaatgacatgttttcaagaccaaacggagtaactactaacaaatcgctacttgtagcaactcatttaaataataagatgctaatacatgaaccaagaggatttggttatacaagaatacaagggtactagtaccaactaccaacacacttcttttacttccttttttccttctttgtaattatttctaaactctttttattaatgaaaattaaccacaggggattcctctgctgtgtttgcattaaaaaaagcaacgcggttgttttttttaaataaaaagaaatgaactattagcctaactctctactaattaaaaaaaagcatgcggtagtgtggtttttgtagaagaccacactcgaggcatcaggcctgacttcatgagcaccaggtttttataaaatgtactctattgtccatgctttctggtgacaggcacatttttactaactagatatggatcaaatatcaaatcttttaaaataaaaaaattgaaatcccatacctgttctttccaagatatatccagaattctgtagtaaggatccaacaatgccactcgatcaccttctttaatctaaggcatataaagtttacattagcatagtacaggatattagaagaaactacagaaagacaaatttgcagtcaacaaaactattttgcatattggaatataagacagcaactatgtcaacaacagagaactcacaatattttcagcaaatatcttaaacctaaaacatggttggataacttgatgggataagtccattttacaccctcgaactctttgctttgtctaaagtgcaccctcaaactctaaaaccggttatatgacaccccctaactttcaataccgtttaaattaccccttccattcaaaccaggatggtttttcttaaattatgctgacgtggcaatccaatcaaccaaaaaaaatttaaaacaaataattggtcccacgtcagctgccacctatctcctacccaaaatctctttcttttcactttcttctttccttcccgagcgagaacgacaccggcgataagatcgagttcgcccttccccgtcgtcccccacccctcgagcgccggcgagctcgagctcccccttccccgttgccctctctaggtctcccttccccccctctctacccacgtgagacaatggaggcgagctcaatgagcaaggcagcagcgatggtcgcgaacaccggttgcgtcgaccccatgctccgatagcagatctggaggtggcacaaggagccgaggaagttgggcggtcttggtggttggagatggcacggacgccgacgagcttgagggggataggaaacgcaggtggtggcgagctccaccctccacgacctcagtgccgcccacctcgtctgcctccgccgttgcctctgcactgcatcgccgctgcggcaaccttcttcgaccttaggcaaggggacgggctctgtgtcgagctcagccaagcgggcgggcaaccccgtcttctccgacctcaggccggcggatgatggatggatgcggaatcaggcgtggcatgaacgcatggaggcgaaaggatgcgaagattgggctcgacgcgcgacccgcgtccactgccacctctcgctcactcgatccatcgccaagaccaggggcggcaagctcggggaggaggagcttcagtggagccgttgcttgagatgcggggggagggaggttggagttagagctcgagctcaccgggaggaggcggcgcttggggaggcagtgttcgagctccccagcgctgatctcatggctaggggtggtcaccagcgccgatccatggatgagagaagagagagatgtgcctgactgtgagggtgagagaagaggaagaggggctcaatgacgtgaggtcatacgccacgtaaccgaaaaaccactctggtttggttttgggggtaaattgaacggttttaatagttggagggtgttagatacccggttttgtagttgtagggtgtattttagacagacataaaagttcgagggtgtaaaatggacttatcctgattagttgattccatatgccaaaagaaaaagttaactctactccccctaaactaatgcgtcggcgcacttaactactagaattgggtcacttcacacccgaatgaaatttatcttttttcctttcaataatttatgtttctatttggataggtcagtagaacacaaggccagttaacccccgagtccagaaatatgaaaaacttgcaaatggtcatgaaaacattcagaaaatgtctttaaatacaggctcattatcatacctaaaaaaatatttcaatagacttctataagggtaaacaaaatagacaaatatggagtgaagtgacatggttttcagtgaactagtttaggggaataaagtggacctcttcctatgcaaactaattatttctttatatgttttagatactgatgatttcaaacacttgtatctactttttatataacaagcgaaatatcatattatgaaactatgtcatgtaaaagtataatgattttacatgattaacttaaggggcaattaattaccctttgggatattactgatcaagtatataaagtttgactgtaggtttccgaacatcttgcactgcatcgcatttctgaacagcaaggctcaatgagtcatgatagattctaggacatgcatccaattgaactatacagttaagtcaaatcaagctttgcaacattttacaaatgaccatgaagaaaatgaatactatgcaataatatagcaacaacgcaaaacaatcagcttactgccatcactacgataaaaagaattacaaagtgcaaatttccatttatgatagcacaaacattcactggtattaagagatcttactgcttcattccgtagaccatagactgagagtatgaaataagactgatccaagtcgcatgttaaataatacctgaaattatcacatttcagtataaatacaaaggtacgcaataatagaacccaatacaccaagattggtgttttagtatgccatctttgattgaatagagatgcatattgaatctgattcatctaaatgatcataccatgtttgagcagcatacaataaccccaggtaaccaaaactagtagcaaaagttctagttcaatgaggctaatagttaacacccattctattcatgtgaaaaaaacaaacccattctattcacgagtattatatttgcatgtttaactgaccgcattgtaaaacctattacaatgattacaatcaaggttaaatatgccagtcataaccgctcagacccaaaatactgtgcttaaataatgaaagaaaatagaggccaatactttattgaattcaactaaaatatttaacagaatttagttgagcagatcatgactagtgcaatcttactgcttatctttggcaaaaggtcctgaagttaaataaagctcaaggttattatttcagccagtaaaacaaatccaagatccttgcaaaaatgttgatgtatagtaaagcaatttttaaattcaagcttatcattgcagtttagcatccacaattcccagttataaaacagttcttataaggaaataaaggaaaactgttttggacaatgggtggacaatttgctgaaatattttcccttttgtggatagagttagaagatgaagacatgccagttacactgctttcttaactacaactaggtgcttcaaagttagcacactttctaccaggtatagtatctgtgtgcaaatttcaactttcagttaatgtaactaataattcttctaacaaaaagttgctaaattgctctatgctatttacaacaaaaatcatgatgttccaaagaagagcactcaggagcataaaaaaaatgtaaatttgtaatgggtctcgcataattaatattgatttcaaggattaagagaacctacattggagcaatgttgtcgtgtcttatcaaaagaatgactttccccaacacagcaactgtcttgttcaaaccctctgataggatgcctatggttgctttcttgtgagatgattttactagagagaataaaggagaaaacgtataaaaaccaacaggagtacaaaagaaatcttatacaggcttgaatatatgccaagtgacagtgaaagtattactgttgacttcactcaaagaagacactgatgatgctaatctcttggatcgtaattgtccctgtggaagaaattattcataagtacaaataaataagaaaataagttattccaaaacaaatcattgtcaattcatgacaaatgaaacttgaagccttttatgcaggcaaaaacaacttgaacttcagaatggttttatgattatgtgtggcaccatgcaggaattactgttcacgcttgtgaacagtaagcgcggaactctagcatctagttgcgttaggagacaatttgcttgagttagcagtttgattggagatgagatttttgggttgtttaagttatgtgttagcatattcgagttaaatctatccctttcttattaaagatatgttattagaccataaacggctaaatcactacaaagaacaagacacatctaccattcacatcaaccaaagtttctacctgaagttcatcattccaatctataatgttctctcttctgttcaaccaacgccgcttgcttgtcttctcagcaatattttatttacccaatgaactaaaggtttattagtcgcagtctagcatatttcgtaaaagtaactccatagatcgctatagttatgaaaaaagatgtattctattttgtgttattttgctttgttttgccaagttgcatgaatatggacaacataaagttcttatattcatggttggtaagtaggaagcctctttgatttagaataagataaaatgcgagttcaaaaggttaagatggaagaattttcatctgtttatgttaaactctggtctacatgccatagttacatactccctccgtcccataataagcgcagttctatccgtcttatttgaaatatttttatgattagtatttttattgttattagatgataaaatatgaatagtactttatgcgtgacttaacttttcaatttttttcataaatttttcaaataagatggacagtcaaacgttgggcacggaaacttatggctgcacttataatgggacggagggagtagaagataccttcattgcactatctagcttatcaaggagactgatgatcttctgaacttctgtatcagcaccaagaccaggatcttttaaagctgcagcttcaaatccacgaagtgctctttcatagttctctaggtatttgtcagcctggaaggaaccaaaacaaataacatattacacaaaaggatgtcctatacttggcggaaaattcagttgatttagctacccagtttaagttatgatccgggttactcactgtggcacaattatagtagaggtctggattacatttcgtagtctcatccttttcctgagcataaaatgaattcaattatattcatataataaaacaaacaaggccacccaaccacgcccacccaaaatcaggaggtgggggtggggatgggggtgggggtgaggggggtcaactctagcacccattacctaaccgttcgctttgcagactctaattagtaactactccctccatccgaaaataataatagggaaaattgattatagagcaccaaaagtttctgtttttggttttatagcaccaaaaggttccggttcattttagtagcattgcaagttacctccgttactgattttggcactatccaaattgacgttatctcccccaccttgccccgtctatcttcttcatcctccccaaaaggtgagttccattacatggc

SEQ ID NO: 66004 - DNA, 4127 bp, Oryza sativa
atgctaatgcaactgtcttacttaatatttcaattttcaccaggtgtttccaggggctgtggatggcagcatctaggggcctatgttaacctaggtgcattctatcttgtcggagttcctgttgctctcttttttgggtttgcaatgcatctaggaggaatgggtttttggatgggcatggtagctggtggagcgacacaggtcactcttctatctatcattactgcaatgacaaactggagaaagatggtaggttccttttttccatttcttctccataaagttttatcagtacaggctgtctctaaaccgtaatgcctcaaaatttggataacaatactaacagattcttgtgagtgatttgggatattagaaaccatgcagaaaaagtaaagtgagcctgataccaagctcaattcaatccggtttggaatgttaaacttttaatatagtctgcagtcaaatgaagtaaaaaaaaaaagcagttgccagttgttacggttttaacatggtagtcagttttggaggttttatgttgtaccaccatacaaaagaagcttaagaaatacccaaagtgtgttaactttacttgtgtaaatctatttcaaaagagtttaatgtaccaaaatgcacaaagggtcctacttagctaaaaactacatcgagggacattatcaatgtttccttgtcttggtatattgcaatggtctatgaaccaattttccacgtttcagtctacaaaacgaagtcctcttgaagtcatatacctgatatatataaaaaattgattttgttttttatactatgttctgaacgttttacattcttatctttctgttggttatttgcttgcaggctgaaaaggctagggacagagtatttgaggaaaggattccgacacagtcagtctaaccacattgactaagttttgttggattcaatcttcaaatttttcctgtacggtacatgttctttttttttttcttgaggattagtaacagaatggcaaatgaatcctgtagcatcttagctcgaagagttagtcaagtcccaggaagacttgaaagatgtgatgttacatcttttttacttctctgtaggaaagcatatataatctttgtgttgaacaaggagcaaagtatactggaaaacgaacatctgattgcagcgcaaacatcctccagggttggaaccatacggtttggaaaaaatataaaatcgatataaacaaaagaaacgcatattggcttaagtcatgattgttttggcatcactagtacctgctgtttgtatatcattcgtaaattgttgtaaggtgtagacaatccacttgtaaatgtaagtgctgccatgttaagtgaagcctctatgtcctgatgtccatcatgttcttgcaagtacaccaaaataagctcttgcacaatccaaacaaataaaaaatgcgcatcgtatatacttccccaaacaaataaaaaaaatgcacaatccaatacttacctcttcatatctgattgtatgaaggcttacgaagccatgtctgcaacaagcaagacgtgacttacatcaacatggctttagtagtgcttgtttctcatacaaactttgatattattcgttgttcctcatacaaaattttgaacattgtggagattctttccgatgctaatgcaactgccttgtttaatacttgcattttcatcaggtgtttctaggggctttggatgggaacgtttagggaccaaagttaactttgggcccaagttcctgatgatctccttgtccgaggatgatcttattatgacttaaaattgcgaaacatgttaaaccaacaaaacttgtgaaaatatgtgagttaaaaagtaagaacaatagcatatgttgtcttttctttattttattgaaaacaattgacggtcgagttgggtttaacgaccggcaacaggaggcccatggggcatgtttaagccgacctgcccagcccatcgagagaaggtgaaaccattacgaggcaaaattattaagtgtgcgtgtggtgtatgctacagaaggaaaataaaaacatatagaccgtgtgaaccatgcaaatactcattgtccgactattgtagcttgcttaattattttttgaggaattttacggttattgagaagaaagtatctttaagttatctaaattttacactaaaattttttatatctttagatactctatatgtactaaattttatactagaaaataataatatcgctatgtacctcctcagaaatggtaaaattaccctatttttttcttgtactagctagctagtcttgcagtagctaccaccaggtgtatctatgttgctgtcatacgatattttttaaaataagaagaaacataaacaaatatgtgaagtcatacgctctcagctgatggctcactggcagtatagaactatagactggcaatcgcgtacaacgtgaggtcagataagcccctaaactaaatactaagcactttaatattcgctctgatacatcacactagtctgttaggttgcgccgtaccgacttcttttttggtcatgtcgacattcccgagagcagctaaacctaattaggtaattaagaatgtggagaagcactacacagtacgcgaaaaaaaaaaagagctaactgatccatcagctgatcattgtcggcgatcttagtactagcttctgcagcatatcgaatcactttcctggaatctccatcattcctgcctcataataatttaagttatttctcttcattttcttctcagaaactatatatttatttgacttatattacatgaatcatgtaatcataattattcttgtaattaatcatttcctacacaaatactacctgcgttgctgcaaaacgataattagtttgtacgacaaaaatgctaaatgtcagactagcaaataaaaatcttttgactttttcatgttaattttttgaaacattgacgctcaatttccttaatacttagtttcagaatataaagatggtagatgaatatttatgttgaaaatagcattcataatctcataaacttaatagaatttatgaaaaagtatggtcaaagtgccaaaaaaagatattaatagatttttcatgaaatgcacttttatatactagtttaatatcttttataaacatatagttagtaaaagtaataatcaaatatatatatacgcattagaaattgtgtcgattgccaaattgacaagtaaaaaaagaatgatgcagtaattagtaggtgccaagaatatattttcatggcagatgaattgtactaagatgttgataaatttgattgcaagaaacgatgctcactaatcatgatttcaagaacgttgcgcctcagcgtccagtacaccaacttcagaaaaggttagtgattttgatggagaacaatcaaccaaaccacgaaggtactcattcctatgagcaatcgagaactggcaagaaaaaaaaataaaaaacaaaaaatgataacttaagggtactcattactaagatgttccaaagacaagtaaccaagtgatgtagccaactgcacacaattacatgatgaagtaacaatgcctaaattatgatctaacaaaacaccaaatgaacttaagggggtggcttagtatttatacatgaagtgatctaggacagtgtgtatgacatggcacgtcgccctacgacaaaccagacccatctgcccaagtggaggtgatgcaacaccattggttttggtttctaggaacaaaccactcttacgatcagattggttggatccgtcggaaagagaattccgagatctttctatcaaatccccacatggatttttagatcaacgggtatgctcgtttgaatttggggtggtgcagcaaactgaaccgaaatattctatcttgcatcctcgttgagcttttgttcatctctaccgtcattcctaatcacaataacatcaccactagcatttagtagtactacccaattcagtaaatcattcttatgcaaccctacatggtaattaagttgacggacacgagctcgagcgattgatccttaatcactggttcagcttgtgtgctccccgttggcgtgattatatccatgca

SEQ ID NO: 66005 - DNA, 7761 bp, Oryza sativa
cgtcacatatgaccatcatctgtggcgggcaccaactttaggcccgattgagataacaactaggctcatcacagatgactcatcattgacgggctatatactaattcccgattgagatgacttaatctctatcgggcattaactaaagcccgtcaccgatgagtttttttttttcatttttcgtatgaaatgtttatatttgtaagttgaactatagcaaaataattaagtgcagtataataattcattttatgactcaaaataacttcagggtagtaaatgatttcaaatggaaaaaatgtcaacaacaaagttgtataacttatcaaaatttacaacttttagtttggtcatttttctatataacatttttttgaacagtttcatgagccgatactgatgtgctccaccatgctaaaactgatgcgcttgccccccgagccaatattgttgttcctccattaaattctccaccgtgaccatgatcttggcattgacttcttcttcatacatgtggatataaaattcgtggtcccaccaagcgtgccaatttgtgttgacgaaaaattcgaacacaccggcctgggagatctgcttagctcctgtgcaggtccaaatcttgatgagatgcgagtgtgccagtcagtttgatcctgcaactgacaagatatgcaaatagtagatcaaaacagtcgatcggctgacaagccgatggagtagttccagccgatagtcgataataaccgatgccgataccagccgatagcgatagggtttaagcaatcggctatatgtccaatgtagataataatataaaggcaatcggctgatgatgatgtaataacaatatagtcgagtagaaaccaatcggcaaataatgatatgataaataagcatcgatccgaaggttaaagcacacatcggctggaggtccgatgtcatgaaatccacaagattagattaaacagtgaaacctttgttgtcatcgactaaatccaatttatatgtatatgcaatccttatgagccgatgcaacgtccagataactcaccggctgaaaccccgatgaaacccttattggcaatcaagaagcaggctagagattacggttctaagcacgacttagtagaccaaacttaattgatgcagcactaagtatgaaaagaaacataatatctagacaatcaagccgttgactgagttttcagggtggtagatgtctaagctaatctaatctagcaacgagatttagccgataccggcagaaaccctaaaacgagaagcagccgatagagctaaattgatatgctaagactagattaacagagacatttgataaattggtaggcaaatatatcatccaaaccagagcaatccaagaggtcgaatgtactgatgcagccttgaacgacaccgacgtaaacgatacaattgcctgggccgacggaacattggacttaccccttagccggagatcgaacaccaatgcagccccgcgtcaggtgccaagtcccgccggacgataaaataaagtagaaaaggtaaaaggtggcgatgcgccgaattatattgatcgtgaagatagattacatagaccccgggtgtacatatttatacccatgggttgataaaagtccttgtcggacaagaaagaaactttcctaaagataaaaggaaaagataaagtccttataggacactaaacacactttcctaaagataaaaggaaactaacaaactattcctaattaatagataacttgccatgccgcattctctttgaactcggtctcttctggataagctttctttagtagatcaatttctttaaccgaatatagcaagaatccgacaactgacgacttgacaactctcatcggctaatctcaggacttcgaagccgatgctgactctaagccgatgactactccgggcttatcaaattcactgttaacagtaccaccttgctagtttagcacgggtgaaacaagcttataaggcattgtccctccaaccatgctactcccgggttaacccttttacacgaagcgaggatgaaagtataagtgggcccgtccgtcggttgggctgggctacaaatggattgagagggatttggaagaaatttattccacacctactgaggtatggaattataatcattactggttttaggctaattcaacagttgcatatcacgattcatcttttagaggcatgagcagctcacatagcacttggctagtgtttctgaccatgtaaaatcttcctacatgggctttgtcaaaagcaaaagtacattttactctatgtccttatacaaggcccacgatagcctggtattgacattgatgtatttcttgaaccattgacggaagatatcgaagatttatgggaagctgggatgaatgtgtgggacgagtatttaagacaatactttacagtaaaggcccatcatttttattaccattaacaattaccccgcaatgtttcagttccggggcagattaaagtgaaaacatgatgtgtgatatgcttaaatgggtcctactacagttaccttctaggttccaacaagcttgtttacatgcgtcaccggcgtttcttacacataaatcataaataccgcaagatgacgtcagaattcgatggtatcgaagagaatgatccaccaccaaaacataaaactaggaaggaaatacatgccattacaaagaaaatacaatgcgtgttcggaaaagggctgaaaaaatgttcggagggaacaaagcgtaagaaaccagatgataaatcatgtcccacattcaagaagcatcgattttctttgagtacatgtggtactggaaagatttggagatttgctatgccatatatttcatgcatctatgaaaaaaaaatgtgtttgataacactgtcagaattgtccttgacataccaaacaagacaaagaatagtgtactatcacgtacctatctaataaatatgggaatcaagtaagagctacacccgatagaaggtgagaagaattaaaaagtatatctccctccagcctatttcacattaacatctgaggagaagaaggcattttacattaacctaaggagaagaaggcattttgcaagtgcctttacggtgttaaagtgcccatagatttctcatcaaacatcaggcgactagtcttcatgaaagatttgttgatatcctgtgacaattcacatgactataagatttgttgatgtcatattcaccgtgcttctcgccattgctataagggccattaaatcagaacatgtaaaggttgctatcacaaagatgtgctacttttttaatgcaatatcacagaagctcatcaatcctgaagtgttatcactaaattgtttattctcacatgagaccaagtgcaaacttgagatgtgctttcctgcatcatattttaatatgatggagcacatcatggtttatatagttcctcagataattgcacttggcccgttgtatcgaggcaaaatgaatggctatccctggccgcattcatcatgaggattatattccagatgattatgcgaaaatgcaaccacaacatgtgaatgaagggttcaagacatacgatttagacttcctgacatgtgatggtttagctgtacttggggatgcggtggaatatataatactatggcacaaaaaggatataatctttgggacctccatcgatgctccgctgaaaccaccaacacctccacaaaagaaatcggcccctcatgaggttgaaaaagatagcaaagaacatgaggtggcaccttgtgatggacacattgaagtgagcaacttgcaggccaacaagcaaatagccaaggggaagcagctgtatcagccatagtatcaattgatggacagaccagaaaccgaagtacaacttgtgtcctatgtccaacatgatccagaagacacaacgggtatggaatgggaagaaatagaactcgatgtgtatgaagaccaatgccccaccaaagaggacatagacacacccaaggatgatgacaacagcaacaataagtccaaagtgcctagtgtgctacgaagccacaacccccaagtcagagaataagcaaaaggagaagtggatgataaccaccttccgagttgggataaaacatgccaaggaatgcttgattgatcagaaaatggttgatgaacttgctagagaggaatacattccaacggatgaagtaccggcgaagtttgaaaatggaaagtcgtctggtccaatcacatgcttgaagaaggtccacaggagatgagaagattacataaatggtacagggatgctagcaaaaaagggcttacgtccataacgtttcgaacatcgccccaagctttcatgagcggtgtaggtttttatggctcgatttcgctgaccttcacgtcgtgtaccgccgtaaaaagatggacgtgaactttgtggttgcatggtgcctgtgagtataaatgcacattcatacaaagaaataaatagacaatataatcccgaaaatgattaataatcatttttttaggatgcaatacatggatgatgagaagacacgacaacccatcggttacctggaccgaacaaggatttgtcaaacacatcatatcatcactctccaagaaaattccaaatagcttaagaacaagacacctaaagagataaaggaatataagaatggcttgcacaaaaccaagttgcttattgtggccatctatattggacaagcattcctaaattttcaagatagaagagtcataatagccagataaaattttaagtaagtctggtagatctgtgtatatatctttatttaatctatgattaactaaatcatcattactatgtagcgatcattacatttattcttgctctacccgaagcatgggactgttacagtcctcgactccctcgattataatcacaagtcatatagacaatttctaacaatctttcaattaatagtaagatattcttatccttgcatgtgtactatcatgaagtgttaataattattaaattgtgttcattaatacaaactttattatcctattatgtgtacagtgcgtacaacaactacaaagcaaaaggcgaggaagaactggcaaggagggagaagttgctagtgcatacatatgagaatataattactaaacatactctacacacttatttacttactttcttttgcctgcgtgtataactaattccttctatatgtatgtcataatgaagtgtcacaaggaacctaaaggttgtgtcctttgtggatattatacttgcgtgttcctccgggttaatgtaattctctcaactcaaagtataagtttaatgatagaatgcacatctaattgatattgctatatattctcgtgcatgctgttgtctagaatcgaatatcgaactagctttgatgatgaaggcactaaaaacatatagcgggacctctaccacttcatccaccatgagtgctaccataaagatggactgttcttcaacctcgaaggcagcttagcgataagtgaagagtccaagtttcttggggagtggagtcatgtgcttgtgtaattaacaatataatccataattatgacggtactgtaaatcttattgtatggcctgcacttttcactaatgcatacaatatatgtgtattatatccgtattacatgtctattagttgctagatatatttaggcaaattttgccacaggacactgcgactttgtggttttagctttaggacacgtcaaaagtcgatctttgggggaatgcactctcaaaatatggttatttgctaatggacactgcaaacattaaaatattaatttctggttgaataggagagataaatagcgtgaaaggtcaaaaatagccctgggcccacttgacatattcttcccccacaactcactccctctcacactcaagccacaacaccacctccgctcgctgctggcaaccacccgacgctccttccttgcctcctccacctccgtcgcggtggtgtggtggccccgctccccttagcacgcgcgggcggcggggcagcacgatcctgttcccgggctcacgctaaggggtcggtcctccctcctcccccccccttctacctccgtcgcagtagcatggtggcccgactcccttcagcatgcgcaagcagcgacgcgccctggctccctggccagccctccttcctcgcctcctccacattggtggagccaagttctcaaccctgtggggtcaaaatgcataaatatgcaactatgtggggtcaatccatacaaattttctttgttttatgtactttttcactatttttcacatgatcaaggtgtatgttgcaaaaacatgtggggtcagctgaccctacagttttaacgtggctccaccactactcctccacttccgcagttagctccttatatcctctttcaggggagccggcattggaggtggatccaaggtggcctggaggaggcaagggcggcatcgaccggcgtggtgaagcggtgcggacgagtcggggtggagaaaaccggcatgccgagcaggaagccgatggggtggacgatggggtccacgaggaagctaggaatgagtcggccaatggcacagttgcaggagaggacgctggccagaatcggaatcagaattgaggaggatgacggagaaggtggtgttgtcctcgatccggagaagcggtggcgcggaggagtgctgggaggagctagggcgccatgcagggatggacgcggagcatcagagccatgcagtgcatgggccggagttagcggcagcggatgctgctaatgcgcccatggcttgaggtggtgcgtcgacggtgcagcaagaggctttgcccgtggatctgccaccctcgcctcctctaggccgccacctcgatgccggctcctctgttgcgttgatgctggggagggaggaagaagagaagaagatggagagaaatgaggggcaatttggtcactctgtgtaaatatttgagccccctttcagctttcgcctcgtcagcacgaatatactattttaatcggcacggtgttcgctggcaaataaccatgtttagagagtgtcttctcccaaaagggagtttgtacagtgtcttacggctaaaatcacgaaatcgtaatgtcctatagcaaaatttaccatatatttatgtattagttaattaattgtagcattattgattaaaatatactattagaaaatttggtgggaatattttcgcagatggacgtaatacattttcttaggcgtaataaattgatttgctggaataaaaaaagaaagtagcacagaatagagcctaaattaatttcagagcctaaatccccttctatttgttgatagggacgacccaggcgcggctgtactggtacaccactgaacttcacattcatcgcctacccaccaccacgcgctgctgctgcgcccactagctactccgagagaagcgagatgcggaaagccatcaagtgggcaggtttttgtcccacggtctgtgggcaatcggctcttgaaaagctgcaacggctgggcccatgtccgatcatgttttacgatctgcataggtaggtcgctgccttttcgatcactttgttgtcgcgcccctccgccggcagatggaccatgcatcttcttcttcacttcttcttcttcttctgcatacatagatacagatatactccctccgtcaaaaaaaaaaaaaaaaa

SEQ ID NO: 66006 - DNA, 10046 bp, Oryza sativa
gtatatgactgtcttgcgattcaaggaaaagaaataaactttgtgtctcatttcaatgaacctgaattcgatgcgtgtacacctggcgatattcttctcaaaaaaacaagaccagtgtccaaacgatatgattccaaatctcacgatatataggaaaaagaccaaaatgaaaaaaaaaaataacaaagagagtgggtgtgggtcagtgataagtcatcatacaaaacatggtgtgaggagtccaattgaagtcattattttattttatcaaaaaagaatactacaaagcacctatagtagattttggcaaatcttataattacaacacagtattattttattgcatactagctcttgtgccattagtaactgataagaagacggataaaaaatatttctaaaatctattatattattaagacagctcaaaaagaaggcaccacgttcgctgtagaggctaaaaattcccacattaatcgaagaaaaagaaaaaaaatctacaccgctagatcatgacagacttatagtttaaccgttgagattgatcggaatagtataagtaagaaagagtacatgacaaatcctactcaaactatgtaaaaaaaaaaactatacagcaaaataaaaattttgttcggactgtgatggcccaaccggacagagggttgacaacgtttcttttgtccatggagaaacttaccaaaaaaaaaaaaggaaaatcaatctgtttccatggcacttaccgcatacaaccaaaaaagagacctgtcagctaacaatcaaactcactcagccaaccaatgcctcctttccttgcacagcagcgcgtgatttaatcagccacgcgcccacacgatgtcattgaaaggcaagtttaatatgatcaaaattttgttaagtaagaagttaaattgttttgttggttgtagattgaaagataaaaatatattcctaatttttcttgcatttggagataattttatggttaaataatactataaatatcaaatattacatatgagtatagaaattatcaagacatcaagatcaaggtcagtatttggcagcctgtaatgttcgatcatcaattctcgaccatattctatctaagaattaattcacatttgcagggctaaaaaaataccacatttaatcaaaagaaaacaaacatattaccaagggacggcaaataaggcggcattcaacgacggcttgcaggaattttaaaaaaattataaaaaaatcctatcaatgatatggatattaccggtgtagtgagatgacaaagaagagaagcaatgggcaagtgagtgtgtgcaaacaaatgagataggaggcagttgccacaggaggacatgccaagggtggtaaagtaaataaaaaataattataagagttcaagtaggattacaatttataaatgaaagaaatatcacaatgagaaatatttatttttgaaaaaaatagtccatacagaacacaacaataacaaattataataaagatgagagaaacaatagacccataaaaaattagagtggtgtaggtagatgggacatgtaaaaactataaataaaaccttaaatagaatctgaatgataattaagaggagggacgacgagcaggtcgttaagcagcatgatctcgacgattggagggatttctagaaagtaaaaaaaacccctcaattattatcatgttcgattttcaaatctcaacgataataaaaatgggaggcagcaggcgggccatagagaagtatagtagcggcgtttggtgagacttctaaaaattataaaaatgaaacccaacaatacaatgaactctaaaaccacaaggtcaaatttgtagaggtttcagggaggatgaatgaaagcattggtagatcgagcaagtaaataaagcgatgacaaagaaataaggcgtagtgattagcatgactattaaaagcaccggggtgataaagtcggtttttcaatgttctaacataacgagatagttatttaacaaattttaagtaaaatcatatgtaaaacatagataattttatatgggtgttagccgcgcaattgcgcgggccacccagctagttattcttcatttaatatataatcgatcactctgtatttttaaattaaaaaatcactttgtttgggaaataatcagtatatatttatttatttgtatattccatcgtaatcaaaggcattggcgcgcaaacgactttgggtgggggcgacgaccaataaacaagacgaggtcgagttgagttgcgtcgcgtcttcctccccgccgccgccttccttgaacctgtctccattaactcctccatgtctccattgtctccctccacactaacatccactattatcggatcgcaagaatccacagcccggccatggccgccgccgcgccgcagctggaggaactcgtcgacctcgagcccttctctccgtcgctcttcctcgacctgcccccgacgccgcacagcgacgaccccaacgatgacgatctcatcctccccttcatctctcgcatgctcatggaggacgacatcgacgacaagttcttctaccagtttcccgaccaccctgctctcctccacgcccagcagccctacgcccaaatcctcgacgccccatccgacgacaccaccaccaactcctccgacgactccgcctccgccaccaccaacaacacaaccaactccgccgccgccgccaacgcctcctggccctacgaccccatcgagctctctcagctgctccaatccccgccccaccccgtctccgacaaccacgacgccgacgtcggcgacaccaggagcgcgccggaagacgacaaagacctgaaacttctgttctccgccgccgacaacatggagatgctcaacatggcgttcctcaagggcagggaggaggccaacaagttggtgcccaccaacaacaccctcttcgccggcttcgacggcgcctcgctgctcaagacggagccggcggtggatgagcccacgttaatgttcggacgaagcggcggcagcggcaggggccggaagaacaggcacggcgaggaggacgacctggaggcggagaccggcaggagcagcaagctgatggtgccaccgcaagaggccaccgcggccgccagcgagatgttcgacgaaataatgttcaactggtacgaggtgatcatgaaagggatggaggagctgcgcgtcgccatggacagcgaggccgagaagaaggcccggaacggcggcggggccggccggagggcggcgcgcgcaaaggcggcggtggtcgacctacacaccctgctcatccactgcgcgcaggcggtggcgacgagcgaccggcggagcgccaccgagctgctgaagcagatcaagcagaactcgtcggcgagaggggacgcgacgcagaggctggcgtgctgcttcgccgaggggctggaggcgcggctcgccggcacggggagccaggtgtacaagtcgctcgttgcgaagtgcacgtcgacggtggacttcctcaaggcgtacaagctgttcgcggcggcctgctgcatcaagaaggtgagcttcatcttctccaacaagaccatcctggacgccgtggcggggaagcgcaagctgcacatcgtggactacggcctcagctacggattccagtggccaggtctgttcaagtgtctgtcggagagggaaggcgggccgccggaggtgaggattacgggcatcgacttcccgcagccggggttccggccagccgaccagatcgaggagacaggccggcggctgagcaactgcgcgcgccaattcggcgtgccattcaggttccaagccattgctgcaaagtgggagacggtccgccgcgaggacctccacctcgaccgagaagaagaagaagaagaagaagaagaggtgctcgtggtgaactgcctccacttcttgaacgccctgcaggacgagagcgtggttgtggacagcccgagccccagagacatggtgctcaacaacatccgcgacatgaggcctcacgtgttcgtccagtgcgtcgtcaatggcgcgtacggcgcgcccttcttcctgacgcgcttcagggagacgctcttcttctactcgtcgcagttcgacatgctggacgccaccatcccgcgcgacaacgacgagcggctgctcatcgagcgggacatattggggcgctgggccctcaacgtcatcgcctgcgagggcgcagacagggtggatcgcccggagacgtacaagcagtggctggtgcgcaaccaccgggccggcctcacgcagctgccattgcagcctcaggtggttgagcttgtgagagacaaggtcaaaaaactctatcacaaagacttcgtcatcgacgtcgatcacaattggctgctgcagggatggaaggggcggatactgtacgccatgtccacatgggtagctgatcgtgatcacaaatccctcttttagttcaagatttaattatctgcttcaattacttacaaattgagaactagatatatactcctacatgatataatatcttcatttgcaatgtagagctagctacataagattttgatatatatatatatatatatatatatatatatatatatatatatatatatttccagcataaataaattgagaacttcatttttttttttgctactatagtttaggcctgtgtgctcttctgtttgctgacaatctactatagtgttttcactattgtcgtgtttgatgatatgttctctttgtcatgtttaattcacttccttttgtgtacgcaaattcttgatacttcccttctttcaaaaaaaatcttgatacttccatttccctggcaaaagtataacagttgcatgattgagcagtgcagtttgttcaccaattattcaaagtgtttgaggtgtgtatcgctgtcttactttctaatattaatggtttgtgggccagtacaactcttgtgtttgtatggattcactcataaagttgtgatatatgttccaaaaaaatcagtttcaaatctgacaacagttaaacagcgatactgattaacaaaaaaagggtgggcggtggggtattcaatgtatatatctgcatgctgtccgcaaaataaaagatgtcatacatttcccgatgtttcccacagtttcattttgacaggcagttcttgctggatatccttgtatttgagtcagacaagtacatcaaaaagaggttaccagattgaagacatgttaattttctgtaaatattgttgagagttgatcactgggacctgctctgtgatatactcctatttatgtgaaattgacattgatgattccaaaataaaaatggctgcttagtttgcaatataatagatagatcttttcttttgacaggatgttattaaatcttgatggttttttttttttgaactaggagagcatattaaatcttgatggtacctgagaaaaagtccactaaactagttacaaatattcaaatttgttgtatgatagtcaattgttggtcaatagcttcatctgttaggctgcgttcgttccttgggcacggttaattaagtattttaacataacctttgaggaacattgggccaaaggttccctgcaaatttctatacgtgtttccttacaaattctagtactttacatattcctgggttgtgttttctttgattactggcaggtttgaaatactgctagtttggtttatcatgcattccatgtgctgagatagtttgataattacagactgatgtagtaggtgcagttttatctgtcttttgcatttcagaagcatagaactgttttttttcttatatatactggggctaattttactaaacaggtatttggtctagtaatttcacgctgcaacactaaacaagcttgtatagctgtgtttcagatagaagtttgtgaaaagattagcaatttgttggagaagttaggtacaatatcaattttaagctagtagagttagggggtgtttagatcccacccaaaaattttacaccctgtcacatcgaatgtttgaacacctgcatgaagtattaaatatatataggctaaaaaaataactaattgcacagattgcgactaatttgcgagacgaatcttttaagcctaattactccatgatttgacaatgttgtgctacagtaaatatttgctaatgacggattaattgggcttaataaattcgtctcgcagtttactgacggattctgtaattagtttttttattagtgcccaaacaccccatgcgacatcctatataatatccgatgtgacacgccaaaactttacaccctggatctaaacaccccccctatattctgtaaaaagggatgtgcatttcattcatctttctgacatgttaggtaggagtaattcagtaacaagatagcagttagagaatctccaacaacctttctaaaatagactctccgaacatccatatagccagctagctatcctgtcgggtcccaaaactaacaacttggatccgactgagattaatgtatcaatccctggatcagtaaaaatcgatacatacaatataactggttcttcattgcatacgttaaagtcttacaatactaagggttttacaataataggtattcacccatctaattagtacacagcggaagtttctatacattctgactagtgaggtataacctttagggattttctaagttatcagggtctttgtagtaatagtcataagggtcctcctcttgacccagatatgaaaaaggaggttataagagcaaggatgagtattcacaatactcagcaagttatcacggaaatatgttatgcattgacatataatagggttctttgcaaaaagcagtattggacaatctggaaaagcagaatttataaaacatataacctttagatttccaaccagggtaccatatgagtcccggtactcaactccatgagtacgtgtcatgccccgaaccagtcccgaccggaactagcccgtgacgctccaaattaacctgttaatcgataccagtcccaggaaacagtgctggtatcacagggagacagaatatcacagcaacagaggtctctttattatagagtagaggtatagtcatgttgggctgtggacagatcccgagctcacaactgcattacataagggaaacggaagccaggacttggaccaaccaacacaggcgcgacttgggaactaggccgaaaccctaaaactcatcgtagccggcttgctcctggaagaactcctcatcagcaggatccgcttcatcttcttcagcaactgagggggggggatatttatatagagcaagggtgagtacgggaatactcagcaagccatgagaaataagtgtttaatgcaggcttcaaggaaaggctgttgtttttgcaattgtttttatttgaactcctttttgtaaacaactaagtgagtgcttctcaaacgacacggatgagacagtgcgtctcgtccagtcggagtatgtgcaatgtatcagtctttagaaatgacataagatcggcacccggccaatagcttttcaaacagccacccgggccaacaactttcaaacggccacccgggcctagctgatcccatcagctgcaaattttccaaacatcgatcccctttccacaacagcaatttcacaagcagtagtcaaacaaaactacgctaggaatcacctcacatctgcccatgaccgtgggcacgactgttcgaacagtttgttaacctctgcagagggggtacactttacccacacgacattacaaacccgggtcacccagcccgtggggatcaaccacgtcgggagacctccaagctttcatgacaaggcatttcgaaagccgacacaggtttaccatatgccgacgagaggggtcccagaccaacaacaggttaggtcccagaccatactgtgccaggaagcccaggggtcctccccgacaccaccccggcgaatccacatgtctctcggcatcaaggctcccctgataagctagttactccgccaggggtgtcccattccacccatgtggtcgtacttgacttatgtttggatgaaattccaaggaatcggtccttaagtgcgagagcgggaaaccgtactcccggtacgttccccggtccgcggttttggaaattcatttagttcgcaagcaccgacccaggtgtcgggttttccaagccttttgtaaacccaagttttacccaagttgtttttcagattttaagtttgaaggcgtccgtcgatactcgcacagggtgcacgaatatcgagacgcaactagatggttacaaggggacatgatataacaattaacaaagggaggatcaatgcaacaaattaggtaggtccgctgatctgcctagcagacgggacgacagattaagtgcgatcctatcaatgcataatatttttcaagcaacataattaaatttcaaatataggctcgagatgttcagaggtggcttgccttcctcgagatctggagcttgatcctcgaaatcctcgcactacgggtcttcgggctccgaaactacacgcgaaatgggacaactcaacaaacggcgaaaataaagctctattaatgacctctaagcgtgccattagatagatctcgagatttgaggaattttggaagttgaacgtagtcaaacggacttacggttgggaagatattgaatttctaagattattggatttttggtctaaaggaaaaggatttaattaaatcctttttggaaaagaaaaagaaaagaaaagaaaagagggagggattatagacttttcctcgggcggctagggcgtggcccaagggaaaaggagcggaccggccgagctaaatgggccggccggcccaaggcggcccaagtgcgcgcgcgcaggggggaggagaaagagggccggtggaccgggctcaccgtgcgcggtcccgggtgggacccgcttgtcagcggctcggctcaccgtgcggagggagcacgtggcgcacgcgcgcgggcgggggagggacgcggtgcacgcgcgcggtctgcggaggaacggatgcggcgggcccacgcgcagcctcacggctcgcggtggaacgcgcgcacgggaggggctgaccggggtcggcccgtcccgacctcggctgagctggcgccgacgtggcgcctacgtggctgccacgtgggccggcgggaggtagacgacgacgccggccggaacggacgggcggacaacagcggcgagcggcggagcgaaccacggcgatacaggcgaaagcgagcacaccgggtggttgcacgagacgaggggagacgagccaacggctcggattcgcctgaggaagcttgacggcggcaaatcgcggcggcggcaactggcggggagggaagagggaaacggcgacgaggtcacgaggggccgattcccggcggtgagagcatctacgcggctacgggaatccgatgctagcgtcggattgggcggagctacgccgagcgaggctggcgacgagcgggtgctacggagctcgagcggcgacggcggcgagcacacggcgagcgacggcaacggtcggggcggcgccggctagctacggggaggctactcgtgctaccaccgaaaactaaggggggggagatggagcggggaggaagaacggagagaggcactaccgtgcgggtcggggcgcagtgacgagaggccgacggcgcgggagtaaactctccggcctcgggccggggaagaggaaggagacgagcgcccggagtccccttccgcgtcctcgctcgtgccggctcctccgacgcgcgcaacgacgaacggcgacggcgaaacagaggggcgacaacaatggagtggaggcgatgggacaacgagaggagaagagagggagggcactcggggctttaagggcggcaatgtcggtttggaaaccgactttgggcggtcaaggcgcgagctggcgctcggcgctcgcgtccaaatcggcgacagggcggagggggg

SEQ ID NO: 66007 - DNA, 11074 bp, Oryza sativa
cccccgggggagatgggccgagagaaattcggcccatcgaccctgggggaggcaaaatagacttttgcggaggaatttgatttggaaggatttggattcggaaatgaactcgacgatagatcggggattgagatcttgagatggcacggacacaagacgacaagcgaagaaacaaatttcgcaattagggtttttaagagataattttcccgctaggcgccacgacggaacgggcgctacagtacagctattcgaatagtttcaaagatattctactgcagtagatgtacgctttacccgcagtccacgacttgctgataattatcggctttagtcatggcccagtattaagtcattgacaattatggcacctgttccatgaacttatatcctcatatgctctgaacgtaatgttaacagcagcaagaggagttctggcgttcccgaggtatttaaggggaactgatcatatgacaccacgtcatctcgatcagggtttagaaatataccatataatttatactcgagtatcataaaccatttacctgtacgtggtaatggttaaagttgcccttcgcggctatagttgcctcctgcgcgaggacttaaaaataagaaccactatacagaggcgccatattgccaattaacctaataactaggtctgtccccattctagaaactgcggtcgtactcgttcgttcgacataagtacctggtaaaacttatgtcgattgagacaatactagccacccggaaatcatccaaatcttacgtattgtcccaatctaagtatagggtgttttaaccagattgtaagcaaaataagcaatactaaattatctgggtttctatgattaatttatgcatagaaaatagaatattgaatagaatgctataaataaataatttataaaatataggcttaaatgatcaacaggtatatggtaacttgccttgctcgatgtcctgagattgattgatattatctaaagtgtcagaggaatccttaagacctagggttagacatataaaattcaaattcaaaaggaattcaaataaaatccaaaaatatgaaaaatagagaaaataaaataaaatgcaaaaatagcaaaaaggggcttaaaagatagagaatgattttagaagaatattggtccaagtttcactgggattggatctatattttaaaagatatgggcttctaaagtttgaaaatcaaataaatgtgaaatggcactgtgtgcgggtcccacctgtcagtctctctttctcttctcttcttctaccttcggccgttccccaaatcgggtcggcggtgctagggtttaggattgcggcggcgttagagggagaaagtggttgcggccgaggaggggagggagctagggatctccggcgacggcgagcggcggtggaggagttaatttgatgcgtggacggtctagcggctagggcggcgaaggcatggttaggccgagatggcgatcaaggtgataagagttagacatggctaggtgttgacagaaaacacgaggcctgggagatctgcttaactccagtgcaggtccaaagctcgccttcggatgtatgagcatgccagttgatttgatcttgcaattaacaagaaatagaacaaagaaaccacaattaatcctataaatgatagccgatcggctaggtgccgatgacatatcatttatttcaagccgatgtcgtgtgtacatcgatcggcaaatatcaataagcaaaccagaactaaatctactcgatcggctgtagatactaatgatatataatccttatatcgatatatacttaaataaaatgattgggatagatcggtcgccttgccgagacagtataaatcacttagatcgaaatatatattaatagtaggattatatacattcataacatagccgatcaggtagatctagcatgtatcggctaatactccgatactactctatactaagattttaaagcaagtagaatatactaaacataagcttaatatacttagatgcgacaagatcttaacataaagggtagatttaacatgtcaatcaaacatatagaataaaagtagttaaatcagataagatcggctgaaactccgatactaccctaatcagcaaccagaaagcaggctagagattgcaattctaagcgcgacttaatagatcaaactcaactgatgcagcattaagtatgaaaagaaaaacaatatctagacaatcaagccgctggaagtttcatagagtggtagatatatcacataatctaagttaacatcattgtctaacctaatcggctgccttccattaacagatgttagccgattataggttagatgaagatattatcaaagattatgtgagatatatgataactcgacgaattatatagacaagattagagtgtcataaagatggaagcactaatcttgagaacataagtcgtcatgacaaattttacctcttgttgaagatcgaaaccgatgcagctcaacccgagaacacgaactcgtcgaaataaaagtaaagcataaagggtggcgatgcgccgagattgtattggatgtgttcctttttttacatagggctcgggtctatttatacccgagaattacaagatacgcccataacggacactactattatctctaataaactctaagataccataagtctttacggcagacttttgcccaaacatatttctaaagaaattatatagaatatcctaattaatagatacaattgccttcccaggactctatccatgcgtggcaaatcatcttgaagcacatcaacttgaacccgatggcgtacaccgagtcatattatcggaatcggcaatatcggctaatcagctgtatcggctagcctcgtccgactcgaactctgtcgacctgaccttagccgatttggactacagccgattcttactttgtttccgcaacgatcttcatcttggattccacttcgatctgatcttcatctccgatgccaataatgatagaatttacgaaatttggtcgttaacactaggggaggggttctagagcatctacgaggtgtctagagggattccggcagcttgccaacctttggcaaggcgcggagcatagttgccgacgagcgcctccataggcagcggccgtgcacatgtcggcagctcagagggtggcaagatagtgcaaaccgattgcaaaaatggactctaggtagtatgtagatggttgaaacgaaaaaactcaccgagatcagttgaaacaacggattgtggccggaaaaacttcgcggcggggaagaacagagcaacgcgggggcggcggtttctgcttggtgcggcgaggtaaaactcgacgcagggctttggttagggcttattatgctagaacatggtaggatataggtgttctaagggttatttagggcggaagatggatggagaggggtggagtcgatcgcgcacaatgtgatcgaccgacgggcgagggtggttgatgagatggattggtgaagcagagcttcggggttgtggggctatggttgttgatgatcgatgatggacagggaagggattggggtcctatttatagggctaggaggagcggatgagctcgggcaccgtcatcgccatggatgagctcgggatttggatgaggtaaaggtggcagaggttgagagagggcgggtaagatcgatttgagtggcaggaggccacgttcgaatacttaccggcgaaggattttgacttgaccacggttggaatcggctggcgacgtgttggcgccaatccgggcatgacgcgcggcggcggcgagggtgaaaatggccggctcgggggtgaatggtttgaattgtgagaggggataccaccgtctatctccaatccaaccgtgcggcaagaattggcgcgattcaccccgggtagaagcgaaatcgcactcggcggcggcttggacgggagcgcacggcatcgagcggcgatttcgtgcggcggtcgtcgtcctggctttgtcgccgtcaagattggcgcggcggcggtgggctgagagcatcggacgggtgacggcgcgccaaggcagtcggccacgcgcgggcagcctcaaagccgacgcgcggcgacacgacgcacgacaaagtcggctgctagagagcgtgcgcaaaggggaggagaaggccaactaaaccacggtttttgagtgggatgtggtcccctaggagcaaatctaaactttgtgcaagattggaagggatcgggctgctctagttgggctaggcattctaccgaacaccttttgtgcaatgaacagtgaatttcataatttttgaatattttgctagaaaagatttgaattcaaactaggagtttgggagggtttcactagggtttagagtatagcaaaactccactaataatagagtaagctaaagaaataatctatggtttgaatttgagagaatttgctcaaattcactagggtttagaataaagggaataattagggtaaattagtaggactctaatacttgaacaagttttaaatcaaatagatttttaacccaaacaaatttaatcaaaagctagcatgatgcagtcaaatttttagttttaaaatttgaggatgttacagctatccatttgatttagcgagtcaaagtcgttgctcgcttcaacagcctctctatctaccctctccattacaattctatgacaaatgggacccatatgttatatctattaaccttcttcctccatttcctccctattttccccgctcatactactgcctcctcccccacaccctctcctttgatgcggcgacggcgggcgtgcgaggcgacgggctgcagcgagcggcggggcgatggactacaacaagcggcgaggcgggcggaggtggggcgacgggtggaggtgaggcggcagggcgatgggcggcatctcaatgggcggcgtgacgacggctacgacgagcggaggccggcaggctgcagcgagcggcggggtaggcggtggccgactgttgacaggaaacacgaggcctgggagatctgcttaactccagtgcaggttcaaaactcgccttcggatgtatgagcgtgccagttgatttgatcctgcaatcaacaagaaacaaagacaaagaaaccgtgatcaaatccataaatgatagccgatcagctaaataccgatgacacatcatttatctttgagccgatgtcatatgtaaatcgatcggcaagtgttaagtaaacaaatcaaaactaaatctattcgatcggctgtagatatcaataatatataatccttatatcgatatatacttgagtcaagtgattgggatagatcggtcaccttgccgagacagtataaatcacttagatcgaaatacatattaataatgagattatatatatattcatagcatagccgatcaagtagatctagcatgtatcggctaatactccgataccgcttcgtgttaagatattaaagcaaatagaatataccaaacataagcctaatatacttaaatgcaataagatcttaatataaagggcagatctaacatgtcaatcgatcatataggataaaagcagttagatcagataagatcggctgtaactccgatactaccctaatcggcaactagtaggcaggctagagattgaaattctaagcacgacttaatagatcaaactcaactgatacagcattaagtatgaaaagaagaacaatatctagacaatcaagccgctggatgtttcataaagtggtggatatctcatataatctaagccaacgtcgttatttaacctaatcggctgccttctagtaacagatgttagccgattgtaggttagatgacgatattgtcaagaattatgcaagatatatgataacttgacagattacataaacaagattagagtatcataaggatggaagcactaatcttgagaacacaaaccgccataacaagttttacctcttgttgaagatcgaaaccgatgcagctcaacccgaaagcaagaactcgtcgaaataaagcaaaaagggtggcgatgcgccgaaattgtattgaacatgtgtgtccttttttttacatagggctcggggtctatttatacccgagaattataagatatgtccatattggacacgactcttatccctaacaaactctaagataccataagtctttgcggcagacttttgcccacatttatctctaaggaatttacataaatatcctaattaatagatacaactgcctttccaggactctatccatgcatggcaatcatcttgaagcacatcaattcaaacccgatgtcgtacacaagtcatattatcggaatcggctgtatcacttaactcaacccgactcaaacctagccgatcccaatcgtagccgatccggactccagccgattcttactctgtttccgcaacaacccttatcttcgattccacttcgaccccatcttcatctccgatgctgatattaccaaatttggtcgttaacaccaacggctacagcgggctacggcgagcggcggggcgggcgccgtcttcacctcctgtagcaatgctcctccccatgtctcatcgcctagttgccatgctcgagctcgccgcctctcgtagcagtgtgccggcgtcgagattgggtgggaaagagacagatgcaagagagagagggggtggaggagattggtagtgtggggcccaccattggccagccaaatagactggccaaatttagctagcaaggaggaggatttggccagctaaatagcttgaccagtgagttggagaggctgttggaatatggtttttttagaataggtaaaatttaacttgaagagtcaattggagaggcagatggatatgctcttaatatactactactaaataggagcgagatgtagcggccatattgttttgctgccattgaccgtcaagttgaatgggtttacttttccctgcgacggttaattctcttctagtaacaaagaacaagttgatcgggttttcttttcgttgggatggtcagtggcagcaaaacaatttggcatatcttgggttggtgtacctggcctgatccatttggtctttggcttcaataaactaataggagcatttggcctagtgcttgcatacgacgcgtacatgccaacataaatcttctgaaatatttcaattaactagtcctaggtgcatgatggtggtccctggtcggtggtcaagctttagcttcatattgttgttttgatattgaaaaggaaagggactgtctactcctcatttgacagaaaactcctcctagtatcttgcaaatttcagaccattggattgatttaagatttgtgcgaagtccacaaaaccctaaccagtttttcttttttctctctgccgccgcacaacggcacaagtcactcgagcctcgagagctcccctcctctcagcaccgtacacctcctgcaccgccgccgtcgtcccacctggcctcgccggctggtcaaaaggtgttaacggcgctgacaagccccccaggctaaccccctccctctccctttccccctccctctcctctccagtggcggcgagctgtcccgtgccgccgtcttccccgttgccggtggtggggcgccaccaccggccgcctccacctaacactctttccgcttgcccccgccacttacaccggcccaccgcccgctcccgtccccgcagtttcagcggcggcgagctgtcccgtgccgccgtcttccccgttgccggcagcggggcgccaccaccggccgcctccacctaacactctttccgcttgcccccgccacttacaccggccccccgcccgctcccgaccccgcggtttcagcggcggcgagctgtgccgccgtcctccccgttgccggcggcggggcgccaccaccggccgcctcctcctaccactctttccgcttgcccccaccacttacaccggcccaccgcccgctcccgaccccacggtttcggcggcggcgccgccgcccaccgccggtctgccgcctcccacggccatcctctaaagcctgtgaactcccccctcttcctcccacccccaccccgggaccctaattcgtcgaccctctgccggattttgggttgtcgccggcgccgtaaaagaagaggtcgccggagttggagaagatgcaactggagcacgaatcgcgaagcatatccagtggtccaaaatatgcaagatttggggtcgtattttctatcgacagaagtatagccgattccgtttttacaagagtggagcacttattatggtcagcttgagtagcgagacataagcgagagagaaacagacatggattttctacacctaggtataatcacacctattatttgcatgtcgtctaaacatttataggaaaaaaaaaatatctggttagattgagtgtcgtgtaataatcgtacccacttgctgcttgatttgccccagaaccttcatatccttgatccttcccattaaagtgcagtgaagtacactgatagtgggcgtaagggcctatagcctaatggttataagagtctcaatagtaatttaggccctagattcgacttctcatggaaacgaatttttcagaaattaacgactttgtgctttcagtagtaggcgacgtacccatcgatagcgaaccactccaggatggatgtgtaattctcaaaaagtagactgatagtggaacggaaggaatttgtgggtgcgacgccgaaggccggagtccctccctccctcctatggccggcctgaccatgctggcgttccatgcatgatgacatggccctccccaacatctcccgccttctcattgaggatgacatccaaaatccacaccctgtaaccattcgacgatgaaccgcctagtgaagtcaggcattgtcaaacaccaccagagacatgggcaattctctaaaaatctatcgattgtgaaacttaaaatcttgaaataaacttaaaaagtgtacaagttggatgaatttcacgagacaagagctttagagatcgattatatattgtgtaaattaaagcaagagttgaggagctgcgtcttgatgctgtcgtcttcctggaacctgcctgcctgcctttcatgatccatccatccatccatgtctcatgtgattggtgtctccctcgtcccctccacgcaacacacagacacccatcatcgcctccactctcttcccctccatccaaagtacctggagagagtggaggcatcgggaggccatggctgccgcgccgaagccggaggaactcgtcgtcgccatcgagcagccattctccccgtcgctcttcctggacctgcccccgacgccgcaccacgatgacgaccccaacaatgtcaatgacgacctcctcctccccttcatctcacgcatcctcatggaggacgacatcgacgacaagttcttctaccagttccccgaccaccccgccctcctccaagcccagcagtcttacgcccaaatcctccatgcccctgccacatcttcttcctccgacgacaccaccatcaacaacaatacgaccaactccacctccgtccccgacacgctcgccatgcccgaccacgacgccgacacccagagcgcgccggacgacatggagatgctctacatggcgttcctcaagggcagggaggaggccaccaagttcctgcccacaaacaacaccctcttctctggcttcaaggcagagccggtgctggatattcaacccaccttcacgttcggaccaagcggcggcggcaggggccggaagaacaggcacgccgaggaggacgacctggagacggagaccagcaggagcagcaagctgatggcgccagaacatgacgacgccgccgccgccgacgagatattcgacgaaataattctcaatgggtaccagatgatcattaaggggatagatgagctgcgcgtcgccatgggcagccagagccaggccgacaagaacggccgaagagcgtcacgcgcgaagacggcggtggtcgacctacacaccctgctcatccactgcgcgcaggctgtggcgacgggagactggcggagcgccaccgagctgctgaagcagatcaagcagaactcgtcggcgagaggggacgcgacgcagaggatggcgtgctgcttcgctgaggggctagaggcgcgtctcgccggaacggggagccagatgtaccagtcgctcgtcgcgaagcgcacgtcgacggtggacttcctcaaggcgtacaagctgttcacggcggcctgctgcatcaagaaagtgagcgtcatcttctcgaacaagaccatctacaacgccgtcgccgggaggcgcaagctgcacatcgtcgactacggcctcagctacggattccagtggccagctttgttctttttgctgggagccagggaaggcggaccgccggaggtgaggatgaccggcatcgacgtcccgcagcctgggttccggccagccgaccagatcgaggagacaggccgccggctgagcatctgcgcgcgccagttcggcgtgccattcaagttccgcgccattgccgcaaagtgggagacggtccgccgcgaggacctccatctcgacccagaagaagaagaagaggaggtgctcgtcgtgaactgcctccatggattgaacaccctgcaagacgagagcgtggtcgtggacagcccgagccccagagacgtggtgctcgacaacatccgcgacatgaggcctcacgtgttcgtccagtgcgtcgtcaacggcgcgtacggtgcgcccttcttcgtgacgcgcttcagggaggctctcttcttctactcggcgcacttcgacatgtggacgccaccatcccgcgcgacaacgacgatcggctgctcatcgagcgggacatgttggggcgatgcgccctcaacgtcatcgcctgcgagggcgcagacagagttgatcggccggagacgtacaagcagtggcaggtgcgcaaccatcgcgccgggctgaggcagctgccat

SEQ ID NO: 66008 - DNA, 18969 bp, Oryza sativa
  unsure (1)..(18969): unsure at all n locations
ttcaaagtatatgtctgctgtccgcaaaataaaacatgtcatacattcccccctgtttcccacaggattcacttccgcaggcagttcttgctggatatccttgtatttcagtcagacaagtacatcaaaagggaggagggggggttgttcaccagattcaacgagtgttatttttctgccatttttgtggagagttgatgacagctgggacttgatctgtgacatactccctccatacttataaaggaagtcgtttaggacaatgtttaagtcaaaccttaggaatataaatcataaaagttgttgagtttgaaaatataaaaaactatatgaatagatttatcttgaaaaataccttcataaatatacatatatcacttttcaatcaatatttttatagaaaaagaagtcaaagttgtgttttggagaccgtgtcgctgtcctaaacgacttcctttacgagtacggagggagtaggagtattatgtgaaattgacattgatgattccaaataaaaaaaatggctccttaccttgcaacaataaattatatggaaggtgaacttcgacgaagttcaggatgttatataaatcttgatcatacctgagaaaggtccactagttagaaatcttcaaatctgttgtatgatagatagtcaactgttggtccatggcttcatctgttaggagtgcttagtattttaagatgaacattgagttttcaacgcacaccggcacacggcacactgaacattaggcttcaaagtttaccagctttccttacaaattcttgtagtactacatatttctcggtagtgttcctttgtttactggaatagcaggtctgaaatactgctagtttggttcatcattccatgtgctgatatggtttgataattacagactgatggagtttgatctgtcctttttcgttaggtgactaggagtatgtcttttgctatgtccttgaagcatctgcttgtatattttagccatgacttctggaggtttaggtagtaggaccgtaggagtaattcagtaataactagatagtagcagttaatatactagtcctaaataggagcaggatataatttgttgagttgcttatggagaagaagttgttttcaataagagggaacaagttgattaagtttcccgattgcttgggacggtcaatagcagcaaacgatttggcatactagtaccagtagtataatatatagaagtatattgggttggtgcaacttcgtccattttgtcattggcttcaataaaactagttgtagtacagtggttgcataaataagtatttcagtaaattagtcctaggtgcaccatgatagtggtgaatttaaaataaagcttcagattcatactggtattgtagttgcttttaatttggtcttgaaaagaaaaccaaaccaaacctgcgacacaggcaggcagctagagggtagctgctctgctcgatccattccattccatgccgccgccctccttcccatcatccttaatccttcaatttaattgcacttgattaatagctagtgatagtggaaggaactggtaggcaatggctaccacgccggaggcggcggagtccctccgattccgatggccggcagcggaggaggagttcgacaacgacatggtcctcccctacatctcccgcctcctcatggaggacgacgtccacgaccacttcttctaccagtaccccgaccaccccgccctcctccgcgcccagcagccattcgcccagatcctcgcctcctccccctcctccgccgccggcgcctcgtcgtcgtcctcctcctccgatgccccgcccagccgccccttcttcgatgacgaggcggccaccgccaagactttccccactgctgcggtccacagcgttgaccaccagtactccggcggcctcgacatggtcaacatggcgttcctcaagggcatggaggaagccaacaagttcctgcccaccaacaccctcctcctctcgaccgactcttctactaccttgcagttgcaggttcagggtgaggtagtcgtcgacggacatggaatgctcgggggggtcgggggagcagctgcagctcatgctcatggtgcaatcaacagcaagaaagtcaactgcagggacgacgacttggaagctggcactggcagggccaccaaactgatggcgcccgagccggagctggaggaggaaggtgcacgccagatgttcgacgaaatgatgctccaggagcacgagatttgcatgaagggggtgaagcagctgagcctcaagtccaagagcagcagcagcaagaaggcgcgggggagacgcactgtgatccacaccgagccggtggacctgcacaacctgctgctccactgcgcgcaggcggtggccacggacgaccgccggagcgcgcacgagctgctgaggcagatcaagcagcactcgtcggcgtggggagacgccggacagaggctggcgcactgcttcgcgcaagggctggaggcccggctcgccggcacggggagccaggtgtaccagtcgctcatgtcgcagcgcacctccgtggtcgacttcctcaaggcgtaccggctgtacatggaagcctgctgctgcaagaaggtggccttcgtcttctccaacaagaccatctacgacgccgtcgccgggaggcgcaagctgcatatcgtcgactacggcctcagctacgggttccagtggcctgggttgctgcgcgagctcgcggcacggagaggcggcccaccggaggtgaggatcaccggcattgacctacctcagccgggattccgccctgaccaacacatcgaggagaccgggcggcggctgagcaggtacgccgacgagctcggcgtgccgttcaagttccacggcatcgcggcgacgaagaaggagagcgtgaggcgggaggagctgggcgaggcggaggaagacgaggtggtggtggtgatcagcctgtgccatttcaggaacgtgatggacgagagcctgcaggaggacagcagcaggagccccagggacgaggtgctggggaacatccgcaggatgcgccccgacgtgttcatccatggcatcatgaacggagcctacggcgcgacctacttcctgacacgcttccgggaggctctctactactacgcggcgcagttcgacctgctggacgcgacggtggggcgggagagccacgagcggatgctggtggagcgggacatcttcgggcgggcggctctgaacgtgatcgcctgcgagggcgcggagcgggtggagcggccggagatgtacaagcagtggcaggcgaggaaccagcgcgcggggctgaggcagctgccgctgaatccgcaggttgtgaggctggtgctggacaaggtgagggacaagtaccacaaggacttcgtggtggacgaggatcaacgctggttgctgcacaggtggaagggccgcgtgctctacgccttgtccacttgggttgcccaacactagctcttagcctcttaccaattatttataccaattttcagatatgcacatcataagtacaaccatgtctatgatcgatgtggaccatggttgagtaaaccctattgtatgtttcttgtatcacatttttgctcctccttggtcatggtgaccactgaccactacctgatttactactccagttaatcctataaataaataaaatggccatagaggaggaggacctcaacatggagacagccttccctgatgaggtactcacggtcaatgaccttttcaatttcaggatcttaatggacgagagtgtacgttgtcacagacagcaggagtgccctgggaaatcgtcctcgacacaatactaacataggccatgtttagatcacaccaaacttcccccaaagtcccaactttccatcacatccaaaactttcctactcacataaacttctaactttttttccaaactaccaactttccccaaacttctctccaatttcagaaactaaacacagccatatggaagatatgcagctggacgtgtttgtccaaggcattgtaaatggctcccaaggcatcacctttcttgtcacgcacccgagagccaactgcggttggtgctggagcaggacatctttggatgggatgcccatgaacgcaattgcctgtgaaggagggaaggaccgggtgggcatacaagcagtggcaagtcaggaaccaacaggcaggctttaggcgaattaattttgaaaaatatattgtctattcttttttctcagaaatactcaggatacaatttttttggcacaaatataaagtcgatatcgctgaaccgttgtgcgaaaatgataaaaatgtgacaacacggatggtcttgaacagcgacggcgcaagactgctcgggctcacatggcgcgggtgtgagaccgagcggtctcgcacggcaaaacagcaacaacgttttggaaatagattaattatccgattagcgattaattaacaataataagtgattaataattaattaatcgctaatcaactaattaatcaattagaatgtcggtctcgctgtttggccatccatccgcgtgatacagagcagtcttgctccgtcgccacatgacaccatgcgagactgtccacgtcatcatgccctcgtcatttttgcgcgacgattcagtgatatcgacggtatatttgtgccaaaaaattattgcatctcagatatttttggggaaaaattaaatggaacagtatattttcaaatttaatttggcttgaggcagctgccctagaacagggaggaaattatgatggttaagaaacactaccacaaggattttgtcattgaggaggatcaatagtggcttcttcagggctggaagagccgcatcctctttgcccactcaacatgggttgcacatgactagtccagttctcgctgtcagcattccctctacaatggcggatatatccccttcaaaaaaaatacatataataactttgtattcccatgcaaaaaaaaaacatatatatttaactgtgtgttgatacggggtaacaagtatttttttttcatgttctaaaattaatgtttccaaggatagtcatgttgaacaggtaaagaaaaataaaaacgaaggacgtatattattaccttgtctgcattctcaaagcaaccttggagtaatctccatttccatgtcctatttgtactaggttattggaatcatcacacattaggttggagttatggacagggtatttgctcctgcctcatgatatgacgagcaagagcaaaggctaccaccattgaatgattatcagcatggccaacccagaggatttcttttgggaggccctcctcaaggagaacgaagcaccatccccatcacctgtcttctttgaactccccccaacacccctcgccaacagtgatggcagtacagatccctcgtcattgttggacaaccaacttctctcctacgtcactagtatgctcatggaggatgagatgggttcttctgctgctgtcaccaacttgcagtgtgtcaacaggggcagcacagaggaggccaacaatatgttgccgggcagtgaagtggttagggcgttcttgaagggcatggaagaggccagcaagttgctgcctagaaacaacagcttcagaatgctggagacggtggatcaagtatcaagtcatggtcattgtaggggaggaaagaagaaaaaccatgacagggatgagcagcagctggaggaggaactggggaggagcagtaaattagctgccatgacgaatgcagggacggaggaggctggtgctcgcgagttgctggacgaactgatgctgcactcgcacgagacatgcatcaaagacatggagaagctgcgcatcgacatggacaatgaggcagataagaccatcaaaaagaagggcaagaaaggcagtagtagcaaggtggtggacttacggatgctgctgatccagtgtgcacaggccatggcgacagacaaccagcaatctgcaggcgagctgctgaagaagatcaagcagcacgctttggcaacaggcgacgccatgcagcgagtggctcactacttcgccaaggggcttgaggcacggctagctggcagagggaagcatctgtatcagaatcagatgcgcatgtcgttggtggagtacctcaaggtgtacaagctctacatggcagcctgctgcttcacgaaggtggcactcatgtttgccgccatgacaatcatgcaagctgtgcaagggaagaagaggctgcacatagttgattacggcccgcgctgtgggctgcactggccagacctgctccgccggctgggaagcagggaagacgggccgccggaggtgaggatcaccatcgttgacatcccccagccggcgtttcgtccatttcagcgtattgaggaggcagggcattgcctgagcagctgtgccaatgagttccgcgtgccattcagattccaagctgttgtagcagcaaagtgggagacggttggtgccgaggacctgcacatcgagcctgatgaggtgcttgtggtgaatgacctctggagtttcagtgctctgatggacgagagtatcttctgcgatgggccaaaccccagggatgttgccctccgtaacatcagcaagatgcagccagacgtgttcatccaaggcatcatcaatggtggctatggtgcctccttcctgtcacgctttcgtggagcgctcttgtattactcggctctgtttgacatgctggacgccaccaccccaagggagagtgggctgcggctggcgctggagcagaacgttctggggccttatgccctcaacgccatcgcctgtgagggtgcagacctggtggagcgccctgagaagtacagacagtggcaggccaggaaccaccgtgcaggcatgcagcagctgaaactgagaccagatatcgttgatacaatcagggaagaggtgaacaagtaccaccataaggactttctgctgggagaggacgggcagtggctgctgcagggatggatggggcgagtcctctttgctcactccgcatgggtgccacaacaacaagacaattcctccggatgactgtttggttttttttttcttttcttctttttctgcataaaaaatgcaagttagtagacttatctttggacatgaaaagtgcatcgtgtgcacagaatgttacagcgatttgcattttagcagcctggcaagtttctttaattatgaacgtgctagtattgtcaacatgtagagcaaggacacctagagtaatacttaccagtactagaagtactttgattgctccagttgcaacatgacctgtttattttccttgtaacagccatcagccgtataatatgccaacaaggaggagaaggtgggtaatgaatccaagccaagcatggaaaacatcaaaccctgttctcagcaaaactaaaacaccaccatgctatcaatcaccaggaaaattgttgggtatgaatgggttgaaggaattgatgcctccatccttttccgtcctcttcggccttaccaagagcatcacaagaaaatgcaaattagaaaaatgaataatactggaatagtgctgctgcatattatggttgtattctgcacttgcctggattttgcctctacagactgcagtctacagacattatgtgttgagtcctttcaacttgaagaattgactgagaacagtaacatagttcagggtgaagttgttaagtttccttgcacctgccctttttacaatgatttgacatctgcacatatttatctgtcaaacagcttggattgaatttgcaaattgcctttgcattatgagaatatacaatacccaggtcacaggctacatcattcactatgttacatggtcctcagctacatcattcaatcagataagactggtgtagttttggctgcttccttgtatcaatgcaatagagtcctctgttctccatcaaattatatttaatgatcattgcttctttagataggacaagggaagaagtggctccaaaaccaagatttgcagattgttaaggatcaaagaaacattgaggaatggaagggccaagccatcagtaccacaaggtaccagtgctcctagcctatcagattaaaattctatactattattgtgctaatacaacaggattccagggtatacaattcctcagcggtactgataaaccagcacaattgttagtaaagacatggtttccaagttcatagtagaaagtcaattaccagttatcacaacaatcctcctggtagaaattctgaacatctgatcaccttctcaacatggcatgagtcgatactattgtaaacaaattaatcaatttgaatgtcggtctcgctgtttggccatccgcgtgacacaaagcggtcttgctccatcacctcatgacaccgtgcgagaccgtccacgtcgtcnnnnnnnnnnnnnnnnnnnnnnnnnnntcagtgatatcgacggtatatttgggccaaaaaaatattgcatctcggatatttttggggaaaaaataaatgaaacaatatattttcaaatttaattcgggttgaggcagctgcccttgaacagggagaaagttatgatggttaagaaccactaccacaaagattttgtcattgaggaggatcaatagtggcttcttcagggctggaagggccgcatcctctttgcccactcaacatgggtagcacatgactagtccagttctccctgtcagcattccctctacaatggcggatatatccccttcaaaaaaatatacatataataactttgtattcccatgcaaaaaaaacatatatatttaacagtgtgttgatacggagtaacaagtattttttttcatgttctaaaattaatgttttccaaggatagtcatgttgaacaggtaaagaaaaataaaaacaaaggacgtatattattaccttgtctgcattctcaaagcaatcttggagtcatcttcatttccatgtcctgtttgtactaggttattggaatcatcacacactaggttggagttatagacagggtatttgctgctgtctcatgatatggcgagcaagagcaaaggctaccaccattgaatgattatcagcatggccaacccagaggatttcttttgggaggccctcctcaaggagaacgaagcaccatccccaccacctgtcttctttgacctccccgcaacacccctctccaacagtgatggcacagatccctcatcattggacaaccaacttctctcctacgtctctcgtatgctcatggaggatgagatgggttcttctgctgctatcaccaacttgcagtgtgtcaacaggggcagcacagaggaggccaacaatatgttgccgggcagtgaagtggttagggtgttctcgaagggcatgggagaggccagcaagttgttgcccagaaacaacagcttcagaacgctggagacggtggatcaagtatcaagtgatggtcattgtaggggacgaaagaagaaaaaccatgacagggacgagcagcagctggaggaggaactggggaggaccagtaaattagctgccttgacgattgcagggacacaggaggctggtgctcgcgagttgctggacgaactgatgctgcacgcacacgagacatgcatcaaagacatggagaagctgcgtatcgacatggacaatgaggcagagaagaagatcaacaagaaggacaagaaaggcagtagtagcaaggtggtggacttacggttgctgctgatccagtgtgcacaggccatggcgacagacaaccagcaatctgcaggcgagctgctgaagaagatcaagcagcacgctttggcaacaggcgacgccatgcagcgagtggctcactacttcgccaaggggcttgaggcacggctagctggcagcgggaagcatctgtatcagaatcatgtgcgcatgtcgttggtggagtacctcaaggtgtacaagctctacatggcagcctgctgcttcaagaaggtggcgctcatgtttgctgccatgacaatcatgcaagctgtgcaagggaagaagaggctgcacatagttgattatggcatacgctgtgggctgcactggccagacctgttccgccggctggggagcagggaagacgggccgccagaggtgaggatcaccatcgttgacatcccccagcctgggtttcgtccatttcagcgtattgaggcggcagggcattgcctgagcagctgtgccaatgagttccgcgtgccattcagattccaagctgttgtagcagcaaagtgggagacggttggtgccgaggacctgcacatcgagcctgatgaggtgcttgtggtgaatgacctctggagtttcagtgctctgatggacgagagtatcttctgcgatgggccaaaccccagggatgttgccctccgtaacatcagcaagatgcagccagacgtgttcatccaaggcatcatcaatggtggctatggtgcctccttcctgtcacgctttcgtggagcgctcttgtattactcggctctgtttgacatgctggacgcgaccaccccaagggatagtgggctgcggctggcgctggagcagaacgttctggggccttacgccctcaacgccatcgcctgtgagggtgcagacctggtggagcgccctgagaagtacaaacagtggcaggccaggaaccaccgtgcaggcatgcagcagctgaaactgagaccagatatcgttgatacaatcagggacgaggtgaacaagtaccatcacaaggactttctgctgggagaggacgggcagtggctgctgcagggatggatgggacgaatcctctttgctcactccgcatgggtgcgccaatcacaagacacttcctccggatgactgtttggtttctttcttttcttctttttctgcataaaaaatgcaagttagtagacttatctttggacatgaaaagtgcatcactcttcttgtgtgcacagaatgctacagtgatttgcattttaacagccaggcaagtttctttaattataaacgtgttagtattgtcaacatgtagagcatggacacctagagtaatacttacgcgtacttctagtactttgattgctccagttgcaacatggcctgtttatttttccttgtaagagccatcagctgtataatatgccaaaaaggaggagaaggtgggtgatgtatccaagccaagcatggaaaacatcaaaccctgtactcagcaaaattaaaacaccaccatgctatcaatcaccaggaaaattgttgggtatgaatgggttgaaggaattgatgcctccatccttttccgtcttcttcggccttaccaagagcaccacaagaaaatgcaaattagaaaaatgaataatactggaatagtgttgctgcatattatggttctattctgcacttgcctggattttgcctctacaaactgcagtctacagacattatgtgttgagtcctttcaacttgaagaattgactgagtacagtaacatagttcagggtgaagttgttaagttgccttgcacctgccctttttacaaagatttgacatctgcacatatttatctgtcaaacagcatggattgaatttgcaaattgcctttgcattatgagcatatacaatacccaggtcacaggctgcatcattcactatgttacatggtcctcagctacatcattcaatcagataagactggtgtagttttggctgctgccttgtatcaatgcaatagagtcctctgttctcccatcaaattatatctaatgatcattgcttcttttgataggacgagggaagaagtggctccaaaaccaagatttgcagattgttaaggatcaaagaaacattgaggaatggaagagccaaggcatcagtaccacaaggcatcactgctcctagcctatcagatgaaaattctatactattcttgtgctaatacaacaggattcctgggaatacaattcctcagcggtactgataaaccagcacaattgttactaaggacgtggtttccaagttcatagtagaaagtcatttaccagttatcataacaatcctcctcatagaaattctgaacatctgatcaccttctcaacatggcatgagtcgatactactgtaaacaaataagttccccttgtcaggtgcagtagaactcctgaacacccttgcttgcgacagttgcatcggtaaacaatatgcaatggaatccttgcgaatatataatctaacacctgaaaattaaagaagaaacaaagaggaaggggataaagaaaaggtcaacatgtgacatcaattagtgtatgactatttcactggcaggttgtttacagggtttagaaagcaacaggccagttgggtgttgagtctagtgagtgttgatgctaatgtgcagaaaataggtagaaagcaaacaaatataaagccgctgacacgcaagttgaatagggatggaatttgatgattataaaaaaattctcttagaaaacatagtgtagatataacactgtggcagcatttttgtcatcttttctatgtggcatttgcttaaaagatcctggaactacactgtctcatatcacacagaattgtatgcaaaatgaccatagggcatgcatgcacgttctctagtaattaccaggccatcattgctttggtaactcttcctcaccaaaccaccttgggggatcataaccatgaccacctgtttgttggaaaagaaatttaatagatatgatatgatgcaggtgcagactgcgactgtcaaagaaatcaaaagaactatgaaccaacgaaaaacctacataccaagaggattacaatggcatagacgccaagctgtcaagattgtaccctttgcaacgccgtattttttgtatgcttgcatagagtactggctgcaagttggcacataacggcagcttgagggtagtaagggcgatatttctcctgttcacataaaggagagcaagctatagagatatagttgatatcaaaaggcaagggcgcaaggccaatgattgctgcacataaatacaagatgaaaacagtaagaatgaacttacttttgtaaaattttagcatggatagtgccacattgactcccaagtcattgacttcctcttcttaaaatcaaataaagcacaaaatgcactcatatcgatcagttctatagttttactcagaaaaaaaaacacaagtttgtcttccattaaaataaagcccaatctgcaatctcctaatcccacaatgaattgcttagacttagtcctttacttaagtacgagatacatggattgggaaatttgcgccataatattccatgtagcctatgtacattttgctaaactgagttctgtgatgactcattatgaacttctgcagcacattttgcaggcattatgcacagccattcgcagtgtgtgaaagctcaaaacttagacacactattgtaccttgaaagtaaatgtggtgtgcaatgtacagcctagaaaggacataaatacttctacttattaaaaaaaagaattgaaatagtagtccctcatgtaagatacatcaaaagtttataaccacctcaagatctgagcctgggtataagaaatttcactcaagaataaaaaaactgtaaaataaaacatttgaccgctcctacaatttgccaatctccagttaccattagactaaccttcatcagcagcgcagtagacccgcatcgttgggatccttctcttgttttggtagggaacaccgaaggaaactataaatgaaaaaccaagaaaaataaagaggtgggagaactccagtctgttgatgcaaggaatgcaggattacacaaacagagagggtagcggaggagaacaaaaaagatgaggcataatgatgaaagaacacacaaagttgtttaaacacagtgaaattatatggcactagatagatcatcaactacaatttcctacatatatataagcaggtcagcaacgtcccaattaatgtttacaggcatctattgcaactgacggattgtcagtgttgcttcacaaagtaataaaccaaattaatcagcaacgtgcatgtgtgtgcatactgctagacacaattggccaataaggtagcaaagacgagtatataggggtagtccggtagatataacaattagctcgctcactgaattcttctgttcttcccatgcatcatcttgtactacaagctaattccattgtcagttggttaaatatggagtagtggatagctaattagacaacatggatattactagatcaaagaccaagttatcatacatatgcatgcgttggctggctcgccggatggatggatctagtttgatctctagctacttgttcagaaatcagaagaaggcagctgctcccgcctatgccgcccgccaactccagtacccccgcgcctccctacagacccgccgcctccccgtgctgccccatatctccccggaccctacgcaacctcgactaccacaagccccagcccacgccggcgccacacccagtgatcgatgcattcctccccgagtcggctaggagcgagagggggagggagactcacgtgtggttccggcgagaggccgcacaggcgagagaagggcggaggcggccatgcccccgatgtccggtggtcggagatttttcacagatttcttcttctctctgatttttttttttcaaaagaggagtgactgaactggataagatcgaacgtccctagctatttgctactccctccgtttctaaatattcgacatatatttaaccgttcgtcttatttaaaaacttgtgaaatatataaaaccatatgtatagataaaagtatatttaacaataaattaaataatagaaaaagaattaataattacttaaattttttaataagacaaatggtcaaacatatttaaaaaagtgaacggcgtcgaatatttaaaaatagaaggagtaatatactatataatatattttccaactacccatatatttctatcaattttttgaagatctatatatttgcagtgattttaagcagatgtttgttcgatttaagtgtagctacccatatattcctctgcatagaaagaatcacatgagacatactccctccatttcaggttataagacgttttaacttcttttaagtttgactaagtttatagaaaaatatagtaatatttataatactaaattagtttcatcaaatcaataattgaatatattttcataataaatttgtcttgagttgaaaatgttagtacttttttctacaaatttggtcaaacttaaagcagtaccaaagtcaaaacgtcttataacctaaaacggatagagtatatagctaaaagaaagccaattgaccttatcttctcaccaaatagaaaaggaaagaaagatagaacccgccacactcgttgtttcaggtgtcgcggcagtggcggaggtgtggctgatgggcggcgcagggcaaaggagcgatgtggcgtgggtggatgggcgatgcggctcgggtggcctggcctgacgcgggcgaccatagctgcatacacaacgactacgacaatggtcgacaacttccggatgggcgttttggcgttcctctctcctggatggctattttcaccaggattgtttaggctcagtgtagcatttgttcgaaaaagtctcttaatataggccagatctgattcgtctccctcaatcgtaaaaccagctttattgactcctctaactattgatatcgtttaaaatgactcccttggctatttctagagcggttttcactgatgtgacatccacgtggcagccaggtcatcacatcaagtaaaaatatagagtggggcccacatgtcatcccctctctcttcccttcttcctctacccctctctccccgtatcaatcttctttggtcttcgcaacagcgggcggcatcaggggatgggggtgggggaggaactcgagggagctggatgacatcgaacgagccaaggtgtccctctctccggtagcatcgatattatattctcatattccccacactcacgagcggtcggccacttccctacacctagagacaagttctccattggattctccactactacggaaacgattttctatacgaggaccctaataggttgcagtcggattgtaattggtcgcgtctgcaataattgaccttcattttagcgtgcggttccttaagacgcccgcatgtaaaaatctatttttgcatgtgagcctcttaaggaaccgattgcaatgagcctattttcgtatgcgggcctcttaagtggtccgcatgcgaaaatatcccctctcctccaaagatttttttctcccctcctctttcttttccttcttagcaacttgaaatttttttccacctcctatcctctctctcttcctctcctctcctctcttgatactattttcacctcctccttccttctttctttctcttctctcctctcctctcctctcctctcctccgagcggccgggagcaggcggtggccagctcgacgacctcgggtggttgtcgacgacaacaaggaggcagccgggagcgctacggccaggagttgctgcagtgggcaaggggctcctcctccaccaccgggcaggaggcgtggcactgacgtatctggcaccccctctccctcccgcgtggatccggctgctgctccgcccctacacacgtggatccggcggtggcggggcggatctggcgcaggcgataacgagagtggcggcggtggcggtggctgacggcgggagtagcggcagtggctgcggcgacctcggcggcggcaggcaagggcaatggctacgaggattttggtggtggcggctgcgatgacctcggtggtggtggcctcagccttagacggttggcaagcgtggggccgccgctggcgaaggagtggggagtggcggggctaggttttttctttttgaaatatttttcacgattttttgttgtcgcatgaggtcggcttaagcacctgcatgtgcaaaatcgtatttttgcatgtggttgtgctggccgtatgcaaaagtccgattttcgcaaaatctttgggtgtaggtgggctgcccgtcaacatgcaaagttcgattttggctgcaaaccgaattctgtagtagtgcgcgattcagcggttcggtgatgccgccagtatggcggatgctctctgctcggctagaactagtgagcgtacgtactcctctcttcatgcgtcttcgaggattatgggtccgtgtccagtggcatctgcagcaagcagtccttgcctgtcatgtcggtcttcctcgtgctcataagcatcagtgatcatctctagcttgatgcatgcggatattggatcgcgtagatatatatgtacaggacggatggagtatgtcaatgtcaggagctcgatcgttcggcatagccaaagctcgccggagtatggccggtgatccatcgatcctggccttgtacaagcaagggtcaagggggctgatgctgaaccttgtcttcgccggcatgcattcgaactcgagcggccggcggcgatggaacatgcaagcagctagtcgcaggtcatggaccccgaggcatcttcctgatgctggtggccaacgtaaatactgaaaaagatcgatacgggagctagggagatggcagagaaagaatgagagaagaaaggggaaggaagaagaaaaatgtggcactgatatgtgggtctcacatgatgagtcagctagttagactgaatcaaagcgccgtcaacaaaacagctttctaaaactgcatagagagtcacgttatactgtttcaatagttgagagtttaagatatccggtactacgatttagggatatgaattagattgaaggtgagagtcaaagtggacttattccaaaaagatattcgaatttacaatgtgcttgataactatcttttttgtcgagtttctaagtgttaaggttttttccttgttattatttggtctgtcactaccatcaaaagtacctcaagtttgttaacattaataccgtattgttcatatcaaaaggttgttcattttattgctaaaattaacccaaccaagttttaactttaccgacgtttgggaacgtaacaatctaacattaccaattaccaaaacttgtttccactaccaaagtttggtaattttagaatctctctctcccaaaaacttaacaaaagtaacaaactaaacacaacttacacttctcaaccttatcaaatatgggaaatgccaaaatttggtaggctaggttaatttatttatgcatcaaagtcaataacccccaattttggtaagacagatttattgatgttacgaaattttgataattcagagaaccgctgagcagcgccatgctgaactattgataatatctttgcatttttataaacataaagtattcaattgttttcaccgagtctacatgagtagggtttcggaattttaaaatataaaatatgttaatactccttccgtccttaaatatttgacgccgttgactttttttaaacatgtatgaccgttcgtcttattaaaaaattaagtaattattaattcttttcctatcatttgattcattgttaaatatacttttatatatacatatagctttatatattttacaaaagtttttgaataagacaaacaatctaacatgtttaaaaaagtcaacggcgtcaaatatttagggacggaggaagtaatattctatatgtgtaatggtggttatgcatatgatgcaagcgttttggtgttgggaagtggacaagaaaacggttgatcacttttgtcacctcccttgcatgatcaaataaaatcacttctctgccaga

SEQ ID NO: 66009 - DNA, 9871 bp, Oryza sativa
ccatttgcgggagaagcagccgaggtggtggctgggcccgtgccggggaggggcggcggcagccgggcccgtgctgggcgggggcggcggcagcggccgcggccgggctgtgccgggcaggggcggccgcggccgagcccgtgccaaggaggggcggcggccgcggctaggccgtgccagggaggggcagcggcggccgggcccgtgccggagcgacggcggccgggcccgtgccggaacgacggcggccagctcgtgccggaacgacggcggcccagcgcggaaggccgcgcagcgacagctccatggattttttttcttttttccttttcgttgtgtgaataatttgaataattgtttgttgatttgatccgtgatttgagaatgatgtgtgaatgatctgtgatttgttgttgtggatgatttgggatgtttgagatattgggttgttgctgtggatgatttgggatgttgagatgtgtggatgattttgggatgtttgagaatattgggttattgctgtggatgatttgggatgttgagatgtgtgaacaatatgtgatgagtgacgtgtgaacacaaatatgtgatatttggcgctagaaaagaaaaaagaaaaaaataacttttgtaccggttggtaataccaaccgggactaaagatactatatctttagtcccggttggtattacgaaccgggactaaagatctatttttagtcccggttattttaaccgggactaaagatagacatttttagtcctggatttgtagtcctggttggaaaaccgggactctagggggttcccaaccagaactaaaaaatgattctccagcagtgtgtacctaacatgatcaaataaacgttgaactttgtatcatcaatgttctatcagcagaagtagtttaagcaagttttttttcctcgtaaacattcatggtgtcagaaccctgatttttgctatatatgctttagtttgcagtatctaagcgcctttttctgcatttgtccttatactattaacagatagtcacatggtcgtcacatcacccccaacaaaacccacatgctaatgcatgataacatgcatgcatgtggagagactaaacaatgcaatgtatagtcaaatgagtcatcaaattccttaatcatgtgttaattagcacaatacaacatgcggtgcgaaactttcggctctgtgtcattgaaaacatctgcatgctagctgattaacatcatgcagagtttgtaattaaacataaacatattaattatgtatacatatctgcctactttttttttgattatcaacatgtctctatcactgttaagcaaattttcacctgtctattactagctgttaattaattttttagatcccctatctgcttatacgtctcgattgggaggcaaaataatcccataaaattagacatgtaccaaacacttttgagattccgaataatatataagagttgccgctccgctcctaaaaattacactaaaaaagtggagtggcatttctgctactcctcacctccactccaccctagagtaggagctctataaaatataccctttactataaagacaacattacgatatggcacttatactaagaaattataccataaaatatgttggactaaggtataagatattgtctgttttaatttttttcttcacatggataaactgtagaaacaattctaattaattaccagtaccgtagtggagcaatataatttaaatcatacaaaactatgcaatgttaatggtgtctacaatatataaaacatttccattgtctaaatttaaaatcgtgtctatattcaagtaattcaaactaactatttaattggacaaatgagttgagttgatattggcttgttacgtttggtttggttttggttttggttttgatgaagacatgaaatgttccaagtcaaattttaattttttttgaacgttctatctttttgaataggagtatattcaggttatattcacaggaatcatatgagtatctaaatttgttttaaagatatagttttcgtaatatcataatttcatcaagacttagatataataataattcaaattttactctatcggtttctagatataagtatttcaaaggattcaaaaatcgtacacaaatataaacatagctagagtatttggtgtctcatcaacctccactcatttaaatttctttccatactagtacatgaataaccaaaatgacaaaacgaatgcagtgagatgcatgcatatatatgattccagttcaatgaaccttttggatccatggtactgctagctcctactccctaggttcatgtcagctagctcctagggtgtaccatttgatgcttctgactttttgatagctggattagtttaaatcacgattataaaattatgataaaataattaatttttagaggacaaggtagttaattaccgtggattaccttgaagaatagggaatcagaaagacacaaagccctacccctactcagccaggacactggacttcctcgccatcggcttgtgattcatccatctccttcccctcgcgactcgcggattcttgcaagcagcgagactcttacagcttccaaattcgcccaaattaagctagcttcgttggcgctaaaatttttcactattattgcaagaaagaaatagttttacaaggcaacagtagcacatccggcacaagcactgcttattgttgaaacccaataatcgtttctaattagccaaattgctcaagttccacccgcaataacgcaaagcagagggatgttccacttccgagcatctcctgggcaatgcagcatgcatatctagcagctcagtacaggcgttggacaccttatcccacaacaaggcatgcatctcttacacagcaccaaaaatatagaataattaattcgattgcttttctttttatagggatcagaagatgagcatccttggctggttgcctttgcttaatttggctttaatttttctgggctagaaccgaatacaattccttttttctccatatgaaaaaaaagagagatcttaattctgttacgaccggtgtagaaatccttaacactccatctttaaaatcagtcgtggattagatccattttgcaagtaacaatctttaacatatccaaaagatgcaagaatttctatagttaatgaagctgactttgttgatcaagactctaaacccgtgctatgcatatataggctatacaagattctaaactaatttaattttatgtagcataataacgtgctacagatcattaattgtatattctcgcagtatattatcttgaagtttgttatgtagtcgaactttaaggagctgcaggtcacttcaggatcaatggcacccaagtacccaaccaagaagtactacgatacaaaacttaaagcttgcagatattagttaatactacattcgtcccaaaatatagcaatttttaggtgttcagatttatagctaaaaattgctatatctgtgtgtttagatttatagctaaaaattgctatattttaaaacggaggtagcagttatttgttttacaagcgagagatatattaattatgatagcatgattaccaaagtttctagctattattttttaagaatacaacgttattatgatgttcgatccaacacgagagggatctaataagatcactttggacaagcagcatgatcgatgattcgtacgttggagtataaagaaagtcatcatcagttaattatctggctatataaagagagagagagagaggtcgatcaatcgaagcaagcaatcaagcatatgcatccgtggatctaacactactgtatcaattaagtagattctctatagcacttaactgcattgtagtactacactgggtagcaagatgctcggctaattactactccatccgtctcaaaatatcataataactttttcacctacattatcttctcaattaatcacaaccttacaccattcaaattcttacctactttcttttcttaatcaatcacaaccatccttcatttaatctcacatatttttttaatacctatacataagtctaaaacttcttatattttaggacatagtttgtgctagtttaatactacctccgtttaggttataagattttctagcattacacacatttatatagatgttaatgaatctaggcacacatatatgtatagatttattaatatatatatgaatgtggataatactagagtcttatatataatatgaaacggtgcaagtactaatatgttgagcaaatgaatgcaacaaaattaagggacccggcaccatgctgacccctattttggagacacacacgtacgcgtggcaagcaaattaaactggttaattactcctatcgcgatcctcatcatggccatgcatggggtaacgaattaattaagctgctggcttgggtatctcactataaatacccaaactggccatggtttaagcaaaaagctagctactcgattcattcgccgctagctagcttttgctttatcctccgaagagaagagggatcgatggaagaagttgagagtagttatcgatcggagatgatggatggcgaggggtggaagatgatgcagcctaatactaataagcagctggtgcagatcaagacgaggtcgtcgtcgatgcaggtggtgaaggaggagatcgaggaggaggaggtggcgggaggaagaggccggagaagaggagggctgaggcggtcggtatcggggagggtgagggagcagcgcgcgcgtctgtacatcatgcgccgctgcgtctccttgctcatctcctccaccttccacgactagctctacctctacctgcgccactattttttttttcttttccccttccttttctttagctgcttctgggctgggccttcaattatgtactgggcccggcccaactccatcttgtttcttttcttttctatatgtaactacgcttttttgctttgtttgcctgacttagctgggctgctctctgagagatgggccactgttgtttcgatctgcccatcctgatctgcatgccctgtctgtgtagacacatgtaccgtcctgctccttaatttggcagtcaaaataatttgctacaatttgaaagatatggaaagcacagcaaaatatgcatctaaacttttttttccaacaccgtatcgaaacatttcactctcacgcattaatcacctaattttaacggttaattagttaatatatataatcatgtgagatcttcttgttaatatataattgtaataaatacaacggtgtaatcggatcaaagttcagataagtaatttagaagaacatatttagtttaagtaatttatagaggaaaataatatttaaagcttcttaatggagtgttaatcaatttgatcctgcaacttacaaaatatataaattaaaagtcaaagagccgatcgactgacaagccgatgtagcaatgctaaccgatgtcggtaccagctgatgttgatagagttttgagcaatcagctatatatgtccaatgtagagactgatacttgagtaaataataatataaagacaatcagctaatgataatataatataacaataatataatttactagaaaccaatcggctaataatgatatgatagaataagcgttgatccgaaggttaaagcatacatcgctgtaggtccgatgtcattaaatccaaacgattagataaacagtgaaacttttgttccgatcggctaaatctaacttgtatataatccttataagccgatgcaacgtaggctagagagaaaccccgatgaaacccttgtatatcattataatccttgtagataactcatcggctgaaaccccgatgaaacccttatatgcaattaaaaagtaggctagagagtatggttctaagcacgacttagttcaaggcatattttattttctagttttttccaaatgagatgagaatatttgtagtctcgatgtgctaaattaaattgttgactgaaactcaataagtcatcttaatactcattgtttgtatgcatgcatatagtaccttggttttgttatatggtggatgagttaatccgtccttggtcttggtgacaaaataaatatgccttagacttttggatgaagggagcatctagtatgcatactcaactaaggccatatatacgatgagacccacctcatctgctagtttgaaccatcactaggatgccctaaggattataggtttaaatccaattaggttatatgctagagttctttgaaacaaatttctattattatgctgacgtacaaacatcctagaatgtaagaatctatgtgtctctattaacactagaaaataataggaagttgggagatttgtctcatcaccttatgtctatttttccccttttattcaacaaacctattggatttgtgccttatgacaaaagctggagatataaatcatttatattatctttaaaaatgaacttaagaaaatttttcaaaggaatgtttgtacctttgattcagtattggacacttagcaagaatatcatagagaggtaacacatggatcggatgtccacctaacattttctttttcttaatgaagaaccactagcatgcatattgttcgtggttccttctctagtagtttggttgatgtacatatttatactctctaaaaacaatccaatggtggtggcagtgaatctgtcgccccacctactccaatagcaatctttaaatattacccctttaacttcttaatattacacaacaactatatctaaatggatagccacatataaaattaatgtgggtagccacattttcctataggggaaatgtgggtcacatttttcctataggagaatgtgggtcacattttctctcctatagggaaaatgtgggtaacatatttcatggtaaatatgatttatttattttagaaaaatattttaatattttttttcattttatccgtagcaaacacaaacatttaactagtcaataatattcatgtattaatcgtattccttctttcagggttataattcaagtaatcagaaggtgattgcaaatgctaacacaaatagagataccaacaacttggcaatgcaaacacaagttcctactcatactagagagggaccaactttcacacaactactacttggagaggaagattttgaccttcctccgtatgttccggatgatgctaaagagagcaatcagttctatcaacaaacaacgaatgagttccttaacatgaaccaattggataacaatggtataggaactgctcagttggaatctcgggagcatatgatgacatatggcttaagttctggtataagttcacagcttttaggttctcaagcaatagacgtagttgatgttgtaggatgcctaacttcaccacggggtacccagctgcatgagggtcatcttgcacatctaatgtcatatatccgtgcatgtcgtgatctagagcaacatacccctcccaactttgtcatgcatcaatctattgggccagtgttgaaccactatgcccttagtgcagagatgtcatattccatgagatatccagaaaatgcagctactcgtggacctcaaaatattcttgggtttcctataaaaaatgcagacacacgcacagagagagacacacacaaacacatgtacacacacccaaacacagacacatgcatgtacacacacacataaacgcacgtatatatgtagatggtgaaccgcaacttcttcatgctcatccactacgtccatcgcaggcatgtcctagcccgcctccaaatcctactcgccgctcgcggtccttatatagtcttattaatttttacctagcttgcattgttcaatacatcatctactgatcgatcagctagcttgttttggacaaacatatatctgtataatttctcataagcaagtattgagttgattcattcaattcattgatcgattcaggtgtccaatcgctgctgcatgcacagaggaggcgcctgctggctcttctcaccccgtcgctctactacttgggttaattacaatcgacaaactactacctaagctagctagccgctggctttccttcattttactccctccgttccataatataaggcacaaccacttttattagatattccataatataagacatgcatgcaagcatgcaattaactatggcatcttctctattaaattattacttttttaaatcctccactctcatgttatctaatcctattggatgcatgtattatatttattaggatgattctaaaaaaaactacaagatgataataattatttattgatctttgggttaagggtggttgtgccttatattttggaatggagggagtaccatgcatgctgtaactgcgattcgtcagtccggtgatgttatacaatcacaataagtttatcacaactatagcacacaagcgttttaattttaggaacaattccaatttacccccttaaaactattgcgacagtataaattaccccctcaattaaaaaccagatattcttcaccttcaacttttcataccggatgaattacccaccgacggactcaggagcggtttttgttgtacgtgacgcacacgtggtagtccaatcagcataaaaaatataaaagggtagggcccacatatggtgactgagagaagaggtggaactgacaagtgggtcccataattttttatttttcttatattgattggattgccacatggacgccacgtaggatcaaaccgctccgaagtcaactagggggtaattcgtccggtatgaaaagttgagggtgaataatgtctggtttttttgaattgaggagggtaattcaaacctaagaagatgtcatagggaaaatatatacatattatatgtgctgatttttctaaaaaaccggcacttaagcagcaatgccataggtaccagttttactaaagaaccggtacatatatatacttacaattttgctatatatttatcgacaaatttttctcaaaaaaaatgacactgtaacttgcatgtaactacaatgtaacttatacgtaactaattttgaaccattagatttctttcaagattcgtgcaagtcatgaagaaggaaaaacgtcacggcgcgcgcacatgtgagaggatttgttcccacaacctccgtttcaccgaaatagcatgttatgtaatttttgaaagtcacatacaagttgttacatgcaacttacagtgtaattaaatcacgattgtcaaattgtctagtaggtgttggttctagaatttcgggcacttttagtgccatccttttttttgctgtgatactacgtacctggtactagcttggagtatatatctgctggtataccggccgggcagttgagagtaataaagatggagtaggtaggatttgcattgatatatagataggcataggtagtatgattaattgatggaagaagaagatacatccagaatacgagtacattagtgaatgagtagttaggatggttggggtgggcagaaggtgatgaggtagcgcttggcgtgacaacggttgaggctggtggcgtcgtcgtaggcgtagctgtacgcacgagggcagatggccttgaaaaggtgggagaagatggtggggcggcacgccgacggcgaggcgtagtcccccgtgcagcagtagcggtcgccgcccatggccctgcaggcgctccggcaacccgccaccctcccttccctgtcccgcacctccagcgccgactggcagcacacgtt

SEQ ID NO: 66010 - DNA, 3913 bp, Oryza sativa
aacccgtccaccaggctcacgtcgtagaagtgcatcgccgacgccgacgtccccagggtcatctccaccaccgtcgcgggagtcgcccccgccgcgccgttgcaccgcagcacgccgccgcagtcgcccgtcgcgcagctgccgcgcccgcgggagtcgaagctgcagccccgccgcggccacacgcgccccgaccaccccgccggcacctccaacgccgcctcctcgccggcgcccaggtggaagccgcccgactgcggcgtcgggtgccccgcggtgcccagcagccccggccacaccgactcgccgcagttgttcaccatgatcagctggatgccgccattccctcctcctcctccacctgcaacttcatccctcataattaattagctaccaattcaaacggatcatgcatttctgcttgtttaactgccatgtacgtacaagctgtgattgccatgatgaggatggcattgacgacgagcagcagaggagtggccatcaactcaattaactgccaatatatagctagcttagtcgcttgatgcaactgatgatcactagtctgtggggggaggccagccaacatatatataacctgtcaacactgactataaaaattatgcagagggagctagcctccctagctactgaagctaactgacttgttagcttacttcctttcctgtaactaacacctgggacatccatctgaagcgaataaacatactactccctccgtttctaaatgtttgacaccgttgactttttagcacatgtttgaccattcgtcttattcaaaaacttttgtgagatatgtaaaattatatgcctacataaaaatatatttaacaatgaatcaaatgataggaaaagaattaataattacttaaattttttgaataagacgaacggtcaaacatatgataaaaagtcaacggcgttaaacatttcgaaacggagggagtactatctatttcagtttcatgtgttccataagccacaacacgttgctgccataattctgtcgacttgttcgtactaccactagcaatgtctacatgctcaatcagcaatttaggcaccactataggctacctgatgactgtgctaggctgctgtaactcaacttcacacctggcttcagttaattagcttactgacctgacctgctcttcacatcttattgcacattaattttcagtttttcacctatgtgcagtgcaatcagctaatcggatgcctggcgaccaaatcagtgcgagcagagtagcgcagcaaactccaaaggctgcaaattactactaagtaccaactttaatttcactttcttccttttcctttggggattgcgatccatctctcagcaggtactacgtcaggatctattccttgctttgcgctgaggtttctcgctttgtacttgtgctgcgcaaatgcatcatcaaccgcatgctactagagtatttatatatctcctcgtcctcgatcgtcatttggataaggaaaagaatttgacaagtcgtagccgtagccccagttgcaatctccttctcttttgcttttgttctctgcttttttttcacgatctctatcctgtgaatgccgctggggtctatgatctttcatatgcatatgtaattcatcagaaagcaaagcatgcatgtatgctctgttcagttgctttccaaatcagaaaaggagtcctagtcgtctagctcgatcactgagtcactgatatgatttttctctacatattcacaccaaagcctgaagatacattttaaccagaccagtcacatatatcgcttcttcttgttgatatacattatgctcaacagtattacaattttatatttgaaatatgctgcacacagactgtttaaacttgaaataattgagcagcacgcacaacacaaatacatgggcgtgctttttagcgaggaccgatattacagaacgaatataaaatacacaaaatacgtacatcaatttgtctgattagctacagtaaacgaataatgttaatctccttatcccaagttaatgctttcagtggctagttcactttcattgtgacttgtgagatcatttcgtctcctgaatacatgtgcatactccactatccttatcttcctctgtattagtacgtatcatcgtcaaattgatctggcttttaatctgccgctgccaaatagacatcggcttattgctgatctcttaactgtaccgtcagtgtggaagggaattactactgaaatcgggctccagcacggatggtcactagacctgccaggatttttggacatatccaagtgaagtgctttcatcatgttgaagcattccttcacctcatggtcctgcagttagtttaattaacaccatcagttaactctatatgttttccagacgggtaattttaccatcattgaaaatgtacagaaagatatcacattttctagtataaaattaatttgttacctccagatattaaatatctcgagttaccaaaagttttagtttaaaatttagatacctcagggtactttttcaagggtcgtaaaatttcttttcctagacactagtactatgcccgtatattgtaacatgatctagagtaatagggtggaaggggtgtgttggtttggttttttatcggcgctgtgcgcggtatgggagggggatgggtggaccggttcggttttttacaggcgccacatgctatagggagggaggagaacaactgagtgtttaaagtagtagagaatagagatagagaagaaaaactttgttgtatatgtattggagagtttgtttagaatcattgtcccatgcaacatataaagcaaccttaccctagatttgcatcataaaaagagaatatgcaaataaacagagtagctagtgtcctgttcacaatattgtaacagagcattacggtcggatgtgaatatgtaaacagagtagtccagcatttgcagatggcgacttgggcagtgaatgatgaatcacgaacgcaaaaataatagtaacaaatgggtagaatattgttgaagtatatatagggtaagaaattaattaaggtacgtaccgtctgggagaaaggatgaatgaggcggttgaggaggagatgattggggtgttgtggtgtagtagaggataaagtaagagcagaggcagcaagcagcgaggcatcaaagcggagaaaggagggatccaagagggagcggaggaggagggccctagtagttgtagtagtagtagtaacggggaggaaggagaaaggggtgacgcaggcgaggcgccagcggagagccttgagcagcgtgagctccatgtcccggatggtggacgcccggaacgagtgccccatcgcctcctccatctgtcctccacacaacacatgcatccatccttcagttcacttcgtatcgatcgatgtatatgaatatatgatatgaatgcatagatatgatatgaatatgaatgcaccgaaaattaaatgaaatgaaaatatacgtatagtacctgaaggtcgtggagcgaggggatggtgacttcgtcgagcttgcaggcgagggacaggcaccccacgctcaccacttccaccatccactcctcccacttctgccaatattaattggcaatgcatactcagttactagctagaggagacgtaccactactactaactgagtactccgatttgatcgatagatttaccaaccaaatggcaattgatggagaggaagcgatccagatagttggctgcgttgaacgccgtcgcggcctccagtcccagccttcccattgcctgatcattcatcatcatatatcaatctttcgattacaaattaaaaatttacacaacacaagagctaacaacaataattatttattttgcacatcaata

SEQ ID NO: 66011 - DNA, 19040 bp, Oryza sativa
ccctataacccccctctatttcacaatataaggtgaggtgctttagttttatcctcaacttaacttctttttaggtttaactaagtttaatttataggaaaaacattataatattctaaaagccaaataaatatattcgatagtggatcttaatagaattgatttgatgttacgaatgttgttatatttttctatgtaattaatcgaacttaaaaaaagtgactttaagactaaattaaaacactttacattctcaaatgtagctggatatatatatatatacacacacacacacacacacacacacacacacacacacacacacacatatatgacactatatatatatatatatatatatatatatatatatatatatatatatatatatatatgagggttgaaaatatatattacgggcgatgaacagtactgtggactcttttctctgttaaatagagtatatattgtcatgttctacattaggacatacagttatatctgtccatccatactgtgaaagattgcaaagggagcaaacgcatgatcaatggatgtatgagccaacatgcatgcatctacacatttgtggctgggcggctatagcgcccatataatattcagtcggtcgcggccggttgatttgtagatgtgtgctgtgcatgcacggatgggtgccttaatcaatttggatgtgaatgcatgaatttaattaaatttctacctaacgaaagatgcaacatatatatactacgtactgttacatgtataaatatattagtagtagtatatacttgcatgcatgaggaggagttatgttggagtggtccatggcaacactgtgtgcattcaattcgatcattcgtactcatacgtatatgcgtatgtactaacgccccagacacatacagtacaaacatacatatacatagctagtactatctccgtttcctaatatataaaaacgttaattttttcacaaatatttaaacattcatcttattcaaaattcttgtgtcaatataaaaaaaaataagttatgcttaaatatcatttgatgataaactacatcacaataaaatataaataataaccacgccataataaaatataaatgataatcatataatttttttaataagataaatagtcaaatatattttaaaaagtcaacaacggtgtatatatatatatatatatatatatatatatagagagagagagagagagacacacacgtacagagtactgggtactatatccatccatggatgcatccatcacacggccggccagttgtaccccatgcacatgaccactgtaatgacacgatgacacttaattagatactctatttattaatttacttaaaaaagtacctttagctaattgtaaggcatcatcagtagtctctctaaacataccccaactagtggtatatatcgatatagtagtatatatactatcttggttttatatgacaccgttgttttttaatatgttaatttgattatctatcttatttaaaaaattaatataaatatattaaagtataaattattatttttcttaataataaaatatgttgtaacaaaataaataatatttatatatttttaataggatgaatgattaaacatcatgttagaatttaatgacgttatctatatctatatctatatctatactattataaaaattgaaaatatttttgtcggtattttgatatgtcatctatgtttgattggtttttaagtacgttcgtttttagaaatacatatccgtatttgagttggattttatgtttgtttgtttttaaaaatacaaaaggagtcgtataagaaatctctttaaaaaaacttgcgtgctaacttgagatgaaagtcaggctcctaattgcagctcaagattttctaaaataaaaatccaagtaaattcctacagtgaatttcatcctagctaaaccgtataacaatgataagattaaaatagcactcatccattgtaacgtacgagtattttttcaagtctattgaaaaggaagtaggagaactgacttgctcagttagttacgctaaattattttttcatcatcgtgcggattattggagattaattgaagaacgcgcggcattaattcgtagagtagtattcatagggtacgtacaacgccattgaataatctgacagtagcagagacaagttcagtctgtacagtgaagtgcaaagcttctcttagaccctgaattccaacctttttctttaaatttttaactttttcattacatcgaacttttttacgtacacaaacttctaatttttctattacatcgtttcaatctcttcaaacatttaattttagtgtggaactaaacacatccccttatagtagtagccgtatgttgattagagagacagcccaggccggctcctcatgattgaggaataagtctactttgtctctctcaaatttacgccatccaatctaatttgtatctctcaatcataataccatatatcttaagcactcaattattaaaaccgatgcaaaataactccctcgataattttgaggatggttttcgctgacgtagccggttgacctaggccaaccattgaggaagtaagtagggacccacatatcatactatttctccttcccttcctcatccctcctctctccccttctgttcctcctctccacaacgatggtggctggcggcaagttcccattgggacgaagcggaaaccgggggcagttgttggcagctagcacaacagagccaaggaggacggcggcttgacctcacggaggcttacagaaaggttgaggggaaggtggaggggcgatagcaaggtgatggcggcggaggagtgtagcgcccgttccgtcgtggcgcctagcgggaaaattatctcttaaaaaccctatctgcgaaatttgtttctttgattgttgtctagtgtccgtgccatctcaagatctcaatccccgatctatcgtcgagttcaaatccgaatccaaatccttccaaatcgattccctccgcaaagtttagtttgcctcccccggggttcgatgggccgaattccgctcggcccatctctctctctctctcccgggctctctttttctctctctcttcccccccccggcgcgctccttcccccctgctcagcctcgcccgcgcgctgctcgcgcgtgcgagagccgccccgagcgtctctctccctcgctgccgctccccgcgtgccgttgctcacgcgcgcccgcgctgccgcccggtcccgccagcccgcgcctgtcgcccgagccgcgccgttcaaaccaccgcgcctcccgctgttttcccacgcgcgcggccgaccgctcggtcgccgccgtcgtcagcgcctgcccgcgcctgtcgccaatgtcgccgctccgctccaaaccgccgtcgtcatcgccgtcgtcatcgcccggcccccgccactccgcgcgcaagccgccaagggacggaggcagcgccccccctccctctgccgcgtcgcccccgctcccctcctcctctttcccaaatcgacaaaggggcaagccccttttccccttttcctccccgccggcgtcatcctccctgtcgccaatttggccgctagccggagcgccagctcgcgccttgaccgcgcaagtcggttctcaaaccgacattgccgtcccctttaaacccccggcctccccttacccctcctcttccattcgtctccgcgccatagccgccgccccgtgctctgtctcacctccgccgtccttcgccgagcgccgggagagccggtgcattcgaggacgcggaaggggacttcggccgcgccctctccttccccttccccggcccgaggccggagagattactcacgcgtcgtcggcctctcgtcacagcgcccctcctcttctcggtgatgtctctctccgttccccctcctcgctccgtctcctccccctagctttcggtagtagctcgagtagaccccccgtagctagccggcgccgccccaaccgttgccttcgctcgccgtgtgctcgccgccgtcgccgcccgagctccgtagcacccgctcgtcgccggcctcgctcggcgtagttccgcccaatccgacgctagcgtcgagttcccgaagccgcgtagatgctctcaccgccgggaatcgacccctcgtggcctcgtcgccgtttccctcttcttccgccgccggttgccgcctccgcaatccgccgccgtcgagcgacctccggcgaatccgagccgttggctcgcctccccctgtcacgaacaactgcccggtgtgctcgcttttgcccgtatctccgtggttcgctccgccgctcgccgccgccgcccgccgtccattcgcggccgggtcgtcgtctacctcccgccgtcctgcgtggcagccacgtaggtgccacgtcggcgccagctcagcttagaccgggtcgagccgaccccggtcggtccctccccgtgcgcgcgttccaccgcaagccgtgaggctgcgcgtgggcccgtcgcatctgcgtccgccgcggaccgcgcgcatgcaccgcgttcctccccgcccgcgtctaaatttcctccctccttccttttctttctcttttccaaaaaggatttaattaaataatcttagaaattcaataatcttagaaattctatatcttcccaaccgtaaatccgtttgactccgttcaacttccaaaattcatcaaatctcgagatctatctagtggcacgctcagaggtcattaatagggctttattttcgctgtttgttgagttgccccgtttcgcgtgtagtttcggagcccgaagacccgcagtgcgaggatttcgaggatcaagctccagatctcgagcaaggcaagccacctttgaacaccttgagcctatatttgaaatttaattatgttgcttgcaaaatattatgcattgataggatcacacttaatctgttgtcccgtctgcgaagcagattggcggacttacctaatttgtcgcatttgatccttccattgttaattgctataccatgtccccttgtaaccacccagttgcgcctcgatactcgcgcactctgtgcgagtaccgacggtcgccttcaaacttaaaatctgagtaacaacttgggtaaaactggagttttacaaaagacttggaaaacccgacacttgggtcggtgcttgcgaactaaatgaatttccaaaaccgcggaccggggaacgtaccgggtgtacggtttcccgctctcgcacttaaggaccgattccttggaatttcatccaaacataagacaagtacgaccacatgggtggaatgggacacccctggctgagtaactagcttatcaggggagccttgatgccgagagacatgtggattcgccggggtggtgtcggggaggacccctgggcttcctggcacagtatggtctggggcctaacctgttgttggtctaggacccctctcgtcggcatatggtaaacctgcatcggctttcgaaatgccttgtcatgaaagcttggaggtctcccgacgtggctgatccccacgggctgggtgacccgggttagtaatgtcgtgtgggtaaagtgtaccccctctgcagaggtcattaaactgttcgaacagccgtgcccacggtcatgggcggatgtgaggtgattcctagcgtagttttgtttgacttctgcttgtgaaattgctgttgtgaaactgggttcgatgtttggaaaacctgcagctgatgggatcagctaggcccgggtggcagtttaaaagttgttggcccaggtggctgtttgaaaagagttggcccgggtggccgttcaaaaagcttttggccgggtgccaaccttgtttcaagatctaaagactgacacattgcacatactccgaccggacgagacgcactgtctcatccgtgtcgtttgagaagcactcacttagttgcttttagaaaagagttcaaataaaatcaattgcaaaaacaacagcctttccttgaagcctgcattaaatacttatttcccctggcttgctgagtactcccgtactcacccttgctctatataaatatttccccccctcagttgctgaagaagatgaagcagatcctgctgatgaggagttcttccaggagccagccggctacgatgagttttagggtttcggcctagttcccaagtcgcgcctgtgattgattggtccaagtcctggcttccgccttccttttgtaatgcagttgtgagctcgggatctgtccgcagcccaacatgactgtacttctactctataataaagagacttctgttgctgtgatattctgtctccctgtgataccagcactgtttcctgggactggtatcgattaacaggttaatttggagcgtcacgggttagttccggtcgggactaattcggggcgtgacaaggagctcgtgggggttgggacatgatggccctcacctagtccgcatatacacgggtagagagtggcatcgtgaaggaggacgcggttatattactccaagccgcagaccactgtcagtgggtcgagatggatgggccaataggctccttcatgacggccgcaaagtagaggccgacggctttgtcgaggctaccgtggcagaagttaaagtgattagcggcgacgtctcgaccgtccaagtcgtgggtcgctgcccccggttcagcttcgctttgctgggagctagccaccagccgatgctgctactatggagaaggggggtattttacttattgccacttttaagatgtggcgatgaaggatttgtcacttacaatctatgacgtgtggcccttgtatatttatgacatgtggatctagtggcaaatccttaattgccacttataagagtgacaaatagttaaatatcttggagagggggaatgtaatgggaaagagagagataatggagaaagagagaggaggaagaaggaaaggggagagagccagagagggagggggatgttatgtgggtctgcacatgttggctcaatgattggactaggctaacatgccacgtcagcgaaaatcaactcaaaactaccgagcgagttattttacacctgttttaatagttgagggtttaggatatctgatactgtaaccgagggatacgaattatattggacatatatatttaagggagtctaagtgtacatactctcacgtgattgaaacatgtggatgtgtgggccacgatcacagaaatatgggccacttaaatataggccaggggcctatgtgcatttacgttggccggcccagaaacgtggagctgggatagtgggcttaatggacctggcccagaatctatcggataccactccactacggagtcccctcctctcctcccctcacctcacgatatgatgatatccatccatcgctgcgattcgccgccgactccatccgatcctcctcaactccgatggcgatggccctgctgctgctgctgcttccgctcgccacccaccctcagccagcgtccaccgatctctttcgtgctgctgcttgcttcaccgatggtgatgcatgcttgatctgtgttcgtccaaatgcctcaaagggcgatcccatcttcaaccgcgattgcgatggcgattaggcgatggcgctgagccacctcctcctcctcctcctcctcctcctcctcctcctcctcagcgtcacctcttccaccgattcccctttctttctttcatgctggtgctgctaatgcttgctattccccttgtgtgttcgtcacaatgcttcacaaggaaggtgcgtcatcactcatcaaccctcgcacccctgccttcttcctacctgtttgattacattcatcggtactctctctctatctctcaattttgttccatgaatgtcacatgtgaattagcattccactctcccaagttttttttttgaaacgaaaagcggcaaaagacttgccgaataaattagaaggagtgcaaaccgtattgttcccattgcttaatttagcattttggctgacagtaaaccgtcttacagtattgttctaagaaaacactggatggacacagaaattgacaaatgatacccaaatgaaatatactcatgtatagtatagcccatatctttatattatattattattaacaaaaacttgtcatgcccagctatggcttgggcgcgatctgatacacagaacaaagagaaaacataaaaaggagaaataattaatagcaagcgtcaagccggcctgcttaaaaggtgtaaaggcagctgccgtcgtcgctcctcgccgttgggtcgaagttcttggcaacagggtcggtgcaaccttccggcacaggcaggttacctgcttgctgtgctccttgccctgatccaaattatcccaagtactaactttaatcagcaacctatcgatctatatagtacataacataggagtatagtattatatgtttgagaaaatgcagacaagatatagtagaatataatatatatatatatatatatatatatatatatatatatatatataaatatatatatatatatataaatatatatatatatatatataagggaaatatcctttgaaaacgagcttagtgttggaaactagtgaaaattatatctaaaaattttataaattcatgaaaaaattactagagaggtgtagatatgaaatacattgttaccaaatttaagtccaaacttaacttcatttgagagaaacaaaaattctcacaaataaagttgagtttgaacttgaaatttggtaagaatatatttcatatctgcactatatatctctagtagtattttcatgaatttacaaaacttttttgtatgattttcattggttcctaacacatagattgttttcaccggatatgtcttcatacatgcatgtatgctgaaggactgtatacaggaattacaaaatggaatagtgaagagttaaggggttaaatcacctcctcctcctatgcaggccgcctacgatgcatcgatgggatgcgaatagctagagatcttttattcagctggatggcgcagaacctatagacaggggcggaggtagaattttgtcatgcatagggctcaatcatttagtataacaaattgtaactagaaatttatgcttttccggccctaataattttcttgccacgtgtggagctcaagcctaattaagctgctcgacacgtggctccgcccctgcgctatagatagaataacatgtataacaaatcttaatttgtgcgttttagctggtcataattaatttagaggaagctatttttgtttctttcataatatatatatatatatatatacagtgatagagagagatgtatcatatatgatgatggtgtagagtagtgggagggtgttggatctaaccgtagaaggaaccagtcttcatggcgtcggagttagcgtcaccaagagcagcctcgctcaagtactgctcagccagctgcacacgcttgacgttctcctgctccttcacaagcatgtatccgtactccatgagcttttcgatcgtcatcttgggctgctcgaactccggtgggccctccctcgagttcaccagcctcttgccaatgttctccacacccgtgtccgacacccacttgcgcacctcgtcgtcgtaaacacgggcacgaagagcgccgaagaaatctgcatgcagcaattcgaccattcagtttcagtttcctttaattttaattaatttggtcattgatagcatttttggttgcagatggatgtaccgatggattggcctgggaagctgtcgacgatcttgacgatgtcctcgtcggggacgttgtcggtgcggaagatacccttgcagacgccgacacggtcgtcgcgggtgggagcccagtagaacttctccatacgcccgtcacggatgagcggcgcgtacagcgtggagaagtcgttgccggtgacgatgatggggacacgggggttgtcctccttgttgtacatcccggggagctgcacgttggttgggttgtcggcgatgttcatcagggtggcgttcaccatctggttgttcaccgtgtactgggtggtgcctcccatgcgacctgcacccgcgtccagatcgttgatgaagaggcagcacatcttccccttcttgatgatgtctgccgcctcacggtaccgctgcctgatcagcttcgccggctctccggcgttgccgctctccagctctccggcgctcatcatgatggggctgtaagtacgtacgtacgttgtaagtcaattagcaacaagcaagtacatacatactactaattaattcgaaagttcatactaacttgatccccatcttggcgaagacgagctcacactggaaggattttccctgacccttgcctccccagatacccaggatgagtgggaccttgatgttggggagggtcatgaagttcttggagatgtggacgacgagcttgtccatgaaagcaggggcgatgtagaagcctcccatggtgttgtcgaagtcgtacctggaggtatgtatgcatatatccagtcagtcaattcgattcaattcagcatatatatgaatatgatgaataaaatcgattggtgtggtgtacaaattagatttagtacgtacgttctgagaccctggctgaggtactcgtaggagctgaggacggcctcgtgggtgccatcacccgtgggagcctggaaaagggagtcgacgaaacccttccccctggtgatgtcctgctggtcatcggagatgtcgtaggcgagacccttccacctgtcctggtcggtctgcttgccctcgtccagctccttggccatcaccttgaacctgttgatgttggagctcttgccatggtagttcaccgccgatgtcacctgcttcttcagcttcttccccaggaagttggtcggagtggacgcctgcacatccattaatctcgcaagtaagtatcctcatttaatttgcagcaaaaacatgtacttatcaagctagctagctagctgcgtatgtatgtgtaccggagctccaacggtggaggagaaggcagcagccatcttaatttgctgaaagtcgatgattgtagaggatcactgatgatggccggccgctgctgctcaaagtgtagaggccgagctgcggtaggccttaaataatacaatagaattggacgtcgccatggaagttggaggctgtgagaggcacacactcgtccctgtggatcagcttccagatcctccacaggccacacgctgaagattgggttctgcacacgtggcgcaatctcggccggccgatccacagcatagcatgacttggacctggatcggagtctgtgagcgagttaggagtatattgtattagtgtaggtaggaaggatctcttggcttcagttccttgacctttcctcaccacagaattcacccatttctgatcaactctttctctctgttttttcttttctttccttgcctcacattcgtctcccggccggcagctagcgaccagttgcttcatcagctcagctactacataacctcttcattttgcatcaccacagaaaagccttttgctgcctctcgttgcccggcttcttggatgaggcatggcatgcaaattgtattctagttggactaccacaaatattttgctctgctacctgcacatattctgctttctcgataaccatcaggctaggactgtcatttggcaccacacaaacttctcttaacatacaacataagcattgtacgttttttcccctttgatggtttccgttaccacaaaaatacaaaaattctaattttgcactgctgttgatattgttttttggtgaagcatcaatcggaggcagctaaatctgcagcagtgccttaagatgaatttatttgtggttcatagctttcgttcctcctaagcctctatattgcttttcgtaacttttgaaaattaattgtttgctcatgtcatgtcagtagtaatcttttatgcaagtcatgtgaaatttctcctagctagcttgtccctactaagacgtttgagatggaggcaagtgattggtaacgacacttgtaaggtcgagtctccagtacattggaaaataacagtcatctcactaggcaagtactagcgcacatattggaattggataacattccccaacttgtgcatcattacagatttacagtgatacgctaattgttatcgtgcaacatgatgaatagcacaggaactttgatatagcatgcatctgtagtaacaaatgcaacccgcaagttgagaatacatccatatatagggaagtggatttggatccctcaaggaaatattccctcgttgattgcatgtcactcaagtggttatgaaaaaaattgagaagatatattaacatgtgatatatcactctacaaacatgcaaataaaaattcaacttcgacatctcgtaacgaaaaaaacaaatttaactctgaatatacattaactagctgttgtttaatttgtatttttcattacaatttgtagaagttgaacttgaacttgtatatttgtggagtgttatatcacatgttaatagaccttctcaatttttttcaaatttttttataatcatttgaatgacatgcaaataactaggggatatccccgtatatagtcagcatgtgtatatatcaatcagcgatatgatggcacatccacagtatccagagatcgtacgtatcgttgcatatgcatacagtactgctagtacactagtggataattaatgaactatgtgacaaacgattggattatgtgcaaaaatactaataatgtattagtatatgacaagtgtaatttcaccacatatcacatacttcgaggtattaaaatttgtagtgtaaaattttagtatgtactatactttaaaaattctcatacgattaatttaaataatactagttaatttgggtgcagtagtgacaaattaaacgttcctctttgttaagggtacaggctatatagggtgcgaagtacaaggaagcatatcgatggtgttcatatatatatatatatatatattcattaatcaagtgcaaaattaagaagctggtggtgaattggtgatggattgagttcagttgtagacgcagctgccgtcgtcgctcctggcggtagggtcgtagttggcggcgcgttggtcggtgcatcccgccggcacggggacgggcgactgctgctcggccttgccgtagaactcgccggagtcgtggttggcgtctccgagcgccgcctcgctgaggtacttatcggcgagccgcaccctcttgacgttctcctgctccctcaccagcatgtgccggcccgtactccatcagcttgtcgatcgtcatcttgggctgctccaactcgatccggcggagttcaccagcctcctgccgatgttctccaccccgatctccgccacccaccgccgcacctcgtcgccgtacacccgcgcccgcagcgccccgaagaagtcgatgggaacgcgtcggggaccttgtcgctgcggaagatgcccctgcacacgccaatgcggtcctcgcgggtgggagcccagtagaacttgtccatgcgcccgtcgcggatgagcgggagaagtcgttgccggtgacgatgatggggacgggggttgtacatccctgggagctgcacgttggtggggttgtccgcgatgttcatcagcgtcgcgttcaccatctggttgttcaccgtgtactgcgtcgtgccgccccgcgtccaggtcgttgatgaacagcacgcacatcttccccttgttgatcatgtccgccgcctcgcggtaccgctgccggatcagcttcgcgggctctccggcgctcatcatgatgaggctgcatgcatgcagttgtactactattacaacacacgcagcatgcaatgcagttgtacttcctactctcacttgatccccatcttggcgaagacgagatcacactggaacgacttgccctggatgttgggcagcttcatcaagttcttggagatgtgtccatggtgttgtccaggttgtacctgcagcaattaattaattaattaatcaaaatgtgcatgcaacgcagcattatatttcaagcattattgaatgtgcttaattacgtacgttctgagaccctggctgaggtactcgtgcctcgtgggtgccatcacccatgggagcctggaacagggagtcgacgaggcccttccccctggtgatgtcctgctggtcgtcggagatgtcgtacgcgagtcccttccaccgatcctgctctgtctgcttctcctcgtcaacctccttgctgctgccgcccgccatcgccatgatcttcctgcacctgcacctggacctgcctccatggtggctgtaccccgccgtcctcagccaattcttcaccaccaacccgcttccctgccaagccacaacatgtcagcttctgcatgcttttaaactttcaacaggacactcctctgtttcttactacagatctctcattgcaacgttaacgggtctcctctagtttttcctttctatctttaaatttcttgttgcttgcttcaaatcatgatatgcttttctatctttctgacaatacctaaaactttattatatgaatttaacaaaattgttattttctcaacaaatacaaatttttaaattgtaaagttggcgcgacaaaataaatggtaaaattggcgggagaattatataacttgcttaattgcaaaatattcagactcctacagaattatatagcagcaacaggtatctctcatccatttgccagcctcgttttcatttgccagtctcctacgagtactaatttatatcggccgattttgacaaatactactgtgcatacgtaggaaattaaccttgtcgtgtaggaatattattagaggctagctagctaacagcaggagacgagctagcgtacgtaccggggctccgacagtggaggagaaagcagaagccatcgtcgtcgatgtcgctgccatcgatcagctggtgggtatgtatgtatgtatgtatgcacaagatagtattttaattagcttcttgcagttgtactaactagctagctgcgttaccgatcttgcttgctagctaggtactaactgagtgagtgatcgacgaatgagctaggtgcaagaagaaattaaattgtgcaattaagctggctcagctcagctcagctcgatcagggacacccggttgatgagagctggcttgctgatggagcgagatttatagctactggcaatgcaaggcgaacgattgcagctttgctagtgtccaagcgatcgagtgtgtgcccgactcttccagaccgtgcctgcatattccctgcattgatttattacgagtactagttaaattgatcaccaattaggctgtgtttacttccaaccaaagtttagaatttggttgaaattggagacgatgtgactgaaaagtcgtgtgtaaatgaaaggtttgatgtgatggaaagttggaagtttgaaaaaaaactttggaactaaacacacccttagacacaaattctgtaagcccaagtagctatactatattcactaccagactttagagctatcctgtgggccgtgatattttctgtgcgttttgcagccaacccacagaacatcgctatagttctgtcggttgtgctaggactcatagaaaattaccactgacaggtgggcctaaatccatcgtatagaagtccagcagcccacacaagaaaacctagtttttcatccctcacgtcccaatccctcgagccgccgccgccacccctctcctccttctgcagtccccatcgccactcgcgagtagatccagcgccggcgccggtgctttgacgaatggagaccacgccgccgccttgtgccatcgatgagccatctcttccccggcggtgccagccaacccaagttcagggtcttcagatccatatgccccattctcaatggtcacggatccagccatcccgaggctgggtgttccagatccggtggctcccatctccggcggcgccaggtctagcctcgaggtgagtggatctgcggcagtttgtccccagcaagcctcctcgtctaacagctggtaggtttgctctccggattattttgcaaggatttgtagtatgtgattaccaagagtagatctggatatttgtcttgatttggagtaaatgatcaccgtatagttgatctggatatttgtcttgatctggatagtctagacaattagacttcaagaccgataattgacttgcaatatattattttgcttcgggtagcaaatcatctgtctactaatattgttgccaattactttacctttaggtgccaattacgaaatacagagatgttctgatgactttaggtgcccttttttgaattagttaatcaattaaaagtataagtagaatgatattttattcaccttactctttttttttcaaagccctgagacagccctgattcccggatattaagcaagaaaagttgattcccatattagtctacattatgtaacttagtccataatagaaacttaattttcttggattagtctagtgtataatgtccattttacatctaaataatttgtttcttgtttcaacttatatcaggaccatctaattttcctctctcaagccattttgtgaagacctaatacagtggcaccacaacaggtactcccacattagagtcccttgctactaaaaaaacttccctgttttatatttaaatgtcatgagacaaagcttcatcagttacagtaaagtgatctgcttgaatgtgttgctaaatataactaacaaatgtgcatgacctaaactgattctttgtatagctgatttgcatattcaatttgtccatcttgcagagtccattccaaaactacagaagaacgccaaatttcaacgaagtcttaggtacagattaagtgccacatcttagtgcatatcttgcaagttattatttttgttgcacatcattcaacacctgttgcctttttgcttgcagctgattgaaaggtgttgatcaatcagaattttcgtacaatgtttggtggataattttatcttgaaagataaaatatgaatctttataagtgtatctttataaattgtaacatagatggagacttgcagttcctttaccactgggtggctattttcttagtgtttgtaaacaggattgacacaaagttgaaactttgatatgtatatctcactgaagttgatgtatctgtgcacaattgtactatgaatatttgattgatgtaaataattatgtatggatctaatcatgagtgcaatatccaaatcaatttacttgtgtattaatctgaagtgcatgtgcatagcattctctcttctttttttttttccttggaaagccaatttttctgacggtgcactcgtcagaactatgttctctcaaacccggcgtctcagtttttttctgtgttccacccacaggaaaaggccgtcagaaattattattctgtcgggaaaccgacagaacaattgaatttttccatggtaatttttctgtcggcaatttctgacggggcacctacaggaatattttttctgacggtaaaaccaattttcctgacggtttttctcctacaggctagatgcaaagtctggtatgattggctgctagcttgccagctacatgcggccgattgggatggatcggatggatgaaccaattaagctgtccgtacgcacgtcgttggtgtggatgagattggaggtgcctcataaaccacacacactaaacacgctcaggaaataatccatccgattaataactatcgtcgttgcatatattttgtggcgcgtatgtatgtgtatatacgtggctactgctccacctcccgatggatgcgatccgacgatccacaaaaaagccggccaagggcccatatccatcaatccatggaagcttgcagctcctttacttttgtcgcgtgcccatgcataatttcatttgcaattttcttacatagtgctagattataataattggctgtaactcttttgaacaaaggccacgatgtaattttatttcattatctacaaaatatttgttgataaattttctcctaaaaatttaacatatgtaattacaatataatcatagtataattacactataacttaattgcatgcgtaattacactgtaacttgcatgtaagtacaatataacttgtatgtaactttcacataattttgaaccgctagatttgtttcaagatttgtgcaagtgaagaagatcaaaggatagctttcacataatcttgaattgaaaggtttctaagaacatcaaagaacaaaattatagaatcaaacatgcacatgttagcatccaagaacacaaatatggaaggacaacaatgaacacatccaccgccacttgccgtggtaaagtgcgtcgtcgatcgccttttctcgccaatgcgtcgatttgctgccattgtggccccctccccctaccccaccctaccatagatggatcttgccaccactgagacggtggtggccgaatctagccgatgccaaccttgtggtggcaggatctggaaggtagtgagctcccaaggaggaggcgaggcgactgatcgaagctaaccgccgaccgcacctttccccacgccagtgtgggccttataggctcgagccgcaactagatccgccaaacagagagaagagtcattggcggatgtggaagggcacaacggggattcggtggagaagcacgttggtggcattggtgcagatctggtggagaaagctcgttggtggcattggcgggatccgatggagaggggatagatggctgtgttggccaaaaagggttgatgtcttcgattccaattaatccttgtcgtttgagtaggggagagcagcaaagaggaggcggaagcagaggcgg

SEQ ID NO: 66012 - DNA, 12955 bp, Oryza sativa
aacgttaacgttggacacgaaaacttatggctacacttataatggtatggagggaggctgtgtttagttttcttcaaacctccaatttttccgtcacatcaaatgtttggacacatgcatggagccttaaatgtggataaaaaaccaattgcacagtttacatgtaaattgcgagacgaatcttttgagcctaattacaccatgaacatggtggtgctacagtaaacatttgctaatgatggattaactaggcttaatatattcgtctcacagtttataggcgaaatatgtaatttattttgttattagtctacatttaatacttcaaatgcgtgtccgtatacgtcaaaagtttttattttttgctaaaacaactaaatacggccggagtagcaatgtgcaggccaataaattagcagcagtcaggagtcttggagctagctagctagctgtagggcatgcatgcagtgccagttcatgggagatcgaataatccatgcattgaggcagcaggaggccctagcagggcgtcttgatttgaattattccaatggaggacagcacccatcgatccagcaaatgcaaaccatgtgtggattactaatgggacatatatatatcatatatatataagtagtacacatctatcctagctagtacgtactgctggccgtatattactatgcaaatcgagagaaacaccatatgcaaacgcatgcatcctctgaacttttggaattcatcgatcatcctctgtagctagagccaaatgcccaaattaagagcaatgccagcatgcaaggccagtttgttgttgttcctaccttacagttgccccctctcctcagttctctctctctctctctctgcagccatgcaggcaagcaaagacacacacacacacaagaaaatcatttgttgattacagaatttctaactaaaatgtgtatatttttcgtatgaaaatatgtacatatgtataatcttaatgtggtatggcaaggaaagatgatgatggtggctggaagaacggctcttataaagtcagtcctctttgcataacccatctaccacatgacggtcctgaagcttttgaaggggatcctgaacgctatagacaaaacaagacgcaaattaattcctgtgggcaggaggggatgatatcttgggagaaaaatgcaaagttaattggaaaaagtatgcaagccgaatgagctaggagggctaggagccctcagattgatatctgtggttcgaataagaccttgggctggcaccctagtgttaggtgatcatttggacagagagctgttcgcggtagcgtagcgaccaccataaccataggcgatgggaagacaacaggcttctagagcactcgcattgattgcgccggcaatctacacagcctccataagcaagaatagatctgtctgtgaggccctcctctccaacaagtgggtcagagagacatccagttgtaccatatcacgacgagagagcatctttgctgatacgtcgagctttggaccttgatatgcaatgctctcctgctagctagggcaacaacgcgacaacatcgtctggaaactcaccacaaatagggaatacaaggcaaaatcagcttaccagctcctattcctgggggcggcaaggtcaactttcaatgagacaatatggaaatgatgggcatcgccgaagtgcaagttcttcacatggctggtcatacaaagcagagtctggacagcaaacaggctaaaaaaagttggacaaatcagcaaatatgcccctctactacaccacacaggaaatggcattgcacctctttgcacgttatagactctcctgccgaatctgggtagtgattcagtggtggacaggcttgaatttgaactaacaatcttgggatgactatgcctcagtggaggagtggtataccacctcccgcatacacctcataacccggtgaagatgctcaagcctcttctgaccttcatcgctcgggaaatttggtgcgagtgcaatgtcagtatctttcaacatgtcgccaccccacatgtcacaatcatcgccaaaataaaagagtggcagctgcataggcaaaagtgggggttgtctaccttagggggttcgctgtttcgggaaaaattacctaagactctctttttgtgggttcctacctatttagaagccatgtacctatcttttgcccctgctctatcagtatacacacgaggcaaaacttttgccttcttttcaaaaaaaaaatcttaatccgtataatatactctatatacaagaggaatcagaatgtcatctgcaatatgcagtgccccaactttgaacgatgcatggatgcgcgcttttaattaggatcggaagtgcacgcaaaagacaaagaacagatatgatcacttcgtcagttcgtcgtcctcactagctagctaactagctatacgtactgtcgatcagcttctagctagtctttgttaagctatactaatatgtaagattaataaagatgcacacagttggacataactgattgtcctataacctttatatatatatataattattttaaggatctaatttagaatttcaactttcacggtgtaggaatagggctggatatgatcaatcatattgcttgaatctaggtaattgatactcctaattaatcatgtaaaatttctagtctagcctgaactgatagtaatcgacacattgagctaaggttcagaactgcagatcagcttttaagtatatatggagggaacgggaacagtataaataatactaggaagaaattaaaatgcatggtaaaaagagatcgatcaaatttgaccatagaagttgtatacaaacacatacaatacaatacaaaatcctaataccgatatgatcgaatcgactggatacaattcttcagaagagaatgtaatcaatacactaatatcaagcttaattcttctacaacactggcatacatatatttatatgcactgcacgcatttggaaggagggagagagagatgtaagcatgctgggccttgcaaactaattaagaaacgaattgatccaagagaagtcacaaggggaagaaaaactgagaaattaaatgaagaagccagctaacaagacctatatatatatatacggagagactagagtgatccacactggggtacttgtcaatcaatttcatgcagattaattaagcgtgcacaacagctttaggaggagtactagtcccaagcctaagctctagatctagtactgatcctgcttgttgatgctgctgatccccaaccacaagggcagaagcagaagcaattatagagctagggcttgcggcggctgttgttggtgtgatgatcagtacctgatgatgatgatctcctccttcacatgacgacggcagctgatccaccaaaccaagcctcctcctcttgtaccttctcccggccggttcgtcctcgtcctgatctgcaactacttgtacttgctgtctcggtaccctcttcttgatggtttcttgatctcttgctagcagtagtatgtcgttactgcaagtagtattatcggtggaggtggtgctaggtttagagaaagaggtatagtaagggccagcttgctgatcttggggtgcttcagcttcttcttcttggtggctgggggaggaggaggaggaggtctgcctctgtcggagacgagcccggtcgcggcggtgcacgttcatgtggccgccgagcgcctgcgccgaccggaactcgcgctggcagaagctgcacgtgtagaagcgcggcggccacacgcagccgccgaggttggcgttggccgccgcatcgcgcgcgaacgcctgctcctcccacgacgccgattgcctgatgattcgtcttctccctgccgatccccacatcacccactcctcctcgcctctttgctcctccattactgctgctctgctatgctagctagctgtggatcgatcgagttcattaaagcagccaaggtactacgtactagctaattaacctcctctcttgatgttctactgctgcagcagcagccagctgctagccgagtagtagcagagattgagtactccactagccggcttactaagtagcactagctagtaccgatcgacaataatcaagcggctctagctcgtctcaaaataaataaatctagtacatattgaatgtgacgattctaatactacaaatctaaacaggctaaaccaactaattagagcgagttgcggtgtgtaagaagcaatcagtcgaccgagcaatcaatcaagaggtgcatgcatctccgtgtgcagcgagagacacacttgacggtcgacgatgacagaagactacgcatatttgcaggaggaagaaattaggagaagactagtggaacgaagtctcgcaagctaagctaagctataggagaggccggccagccggagaagaattaagcaaggattggatcagatcagatcggtgtatatatgtctcatgtgtgtgtgcgcgtacagtgtatgattggatgacatgtcttctcctcgatcaggttttgttctttaggtatatattggttactgcactgtgcacatgtggcctgctagctcctctttaatttattcattcgtttccttcttgggtttattaatttcagaggaaaaaatatgtagcttaattcattatttaatttgctattatatatgtatagagggaagcaaattaatttctctcacaccagtggtgtaattaagatgtttttttattggacaaaatgtaaaatccaggagcatatatataattggagaatgcgttgtccggcaaaatcatgtttttaaattatatatttgttggtcgatcttaactaactggtcattgatgtgtctctgcaattcattcaaggcaatcctagctagctagctagtcatcctaatctatcgaggtggtagtgtgtctccatcgaatctggaattctaaattgattctcttgcatatgcatatatgtacatgttttcattgaaatgccggtaatagtttttcttctaaaatcttttcaggtaataattcagttcgaagaagagtccactgaaagagaataaacactgatagctagatgttgttgacagttcaataggcaaaggcatccgaggtgctcccacccgattatacagcatcatcgatgagctaatgagaggtacatgtcgccaaaaagaggattttaatcacttgagagaatgttttgtgtgtatcgttttctctaatataaatggttatgaaaaattttgataaaatttgacaattgtagagtatagtgtgacatctgtttccaccaaagttcaaattcaatctacacacagtgtcggtactgtttatacgttagatttgtcgtcttttttgtgtgtgtttctcaatgtaagttgagtttagagttaaatttttcagagtggtatatatgtatattgtatgaacgttgtcatttttttaagaaaaattaataacttttttggatggtatttttgaacaaatattgaagggacatctctcgaggacttaaaagagttctctatacaataccaatggatttaggtgcacgtcagctattcggtgagagaagttcaaaattattcgtgaaattttttttctcagttaaatacccaaacgacaacaggatgttttggccttttcatccatcgtttagatttactaatatccatatgaatttaaacaaatataaaacacatacatgggtccatacatgaaactatttaaaacttaaaacattttataatatgaataagagaaagttagtacttaataaaccctaagttcatgtaatacatataaatgtttttgtatgaatgtttctatgagtcttgttggagtttaattactcgaggggtaaatctgcctttaattaatttgagtgatggttcaagctactccctctgttctatttttaagtgcagatatgattttccatgcacgactttttgactatccgtcttatttgaaaatttttttaaaaaatttaaaaacataagtcacatataaagtactattcatgttttatcatctcatagcaataaaaatactaattataaaaaaaattaaataagacgaacgatcaaagttgggcacggaaacttatagttgcacttaaaatgggatggagggagtagctagctagcctgcgtggattaatttagctaattatttttcatgttgcagttgacctctcaatctacactactactcctatctatcaatctgaacatttacacatttaatccgtctagatatctagcaagtcatgccccagatgctagctagcaggtagcagcactatatattgttggctgcaggaagggacgccaaatcgattacacatcgcgacatgagttcttcatttgaacaaggcacctaaatagttaaattaaagcaagaagtggcgttcttgagatggacaagatcagaaccacacggaatcagaattgtagatcgatttggtagtgtgttaattagcatgacatctagctagcagctggtatgttttcttctcactgtcctacactctggcctccacctgattatacttaactccactatttagtcgactactagcgagtagtcgctagagccataaaaagttgatgcttgtgagatgcgtttgtcttgttgcttgcttagcctgattcattttgtcttgttttctcaccgcttttccacatccgcgttccgatatcttatttctttaatttactgagcatagctagataatctctagtgatcggttgattcacattgttggatttcttcggttgtacttaatggcagtgcacattatttgctttcattgtcacagataatataagttggtatttcataaattggcatagtctgtcatcgatctgatctgactgtataatagcgactcatcacagtattgcactgtaaatctgttttgctccatgcttgcaggcagcatggcagcactgatcaagaaaacgaaaaggacaggttaaattcacaaaaacaaaaggttaatttgtccagggagggccaaaggctagctgcaactgtagatacacatgcatgcatttcgaatatatagatagatgagatgaaagggttggctggcagtggcagcgcaactgttaactggccctcctgatagatactacagtatatgatcaatgatctgtgagatagtagtaggatctttaattttctctgtgcaatgtgcacagcacagggaaggaggggtcactgttggttgggtattagtgctggctgggcaggcacaggcaggcaggcaaagattcttgtgctcttgtctcatgttctcagtactctgactgaaagctgctgcacactaaaattaagattgttctcatgtgctttgctctggatcaaagcagctgcctgcctccacatacagcatctcacgcatcgggcagacgggtggacatttcatcttgcaccaccactgcactactccactactagtatgcagggttctcaaaccgttttgggtgagattaccttcatcccacggtttcaactgttaacgtagtaaccgtacggttaccataacaaccttgcgattaacacgaaaaaaatggagaaggttactatacgtgataaccgtgatagccgcatattttttataccctgctagtaagtagaagtaactacttaataaagcaacctaaaactaaagggggcatttcataggggcatttcatagtacaatgaatctggacagatttattgtgctttaaaaatactccatctggtactaagttgctatattatacgacgaaagaagtatattttaatatggtactaagttgctatattatacgacaaaagaagtatattttaatatggagggaggcgctagcccgtttgcacccctacctattcctagtggtggcaaggctcagagtgagcgtgaagggtggcggcagccgggcttggctcagagcaattgagggtgtgtttggttgggcttttcaatcagcttttacttttgcaaaagctaaccaaagagcccaaatgctacagctacttttgcccaaagccagtttttggtctactacaaatcaaaagcacctctacccccgctttcacctgcttttgggaaaaaaaaaattacccagctctgccattaccaaaaaacggttcgttctttttctccaatcgcgtcgctcctcgtcctcctcacttcgccgtcaccaaacagaccacgccaccgccggcgctcctcctccccgttgccgtcgccgccgcccctcctcgccgccgccgcctctcctcctcgccccgtcgccgccgccgctgcttctccagccaagctacccgcgcgtgcaaagtcgtcgtcgttcggtcgtcgttggcgggcatgggaggtgctcgcggcggatctcccttgcgggcagaggccgtggtcatcggcagcagcagcccggccttccactaggtggacccgccgatgctccgcctccgcttaggcgccacgagctccgctcccagctccaaatccctcgcggagccccaatgccaccctgctggacgactgcttccgccgcagcgcaaggctacggcgcggcggcgtgatctgcttggcgtgcgcgtccgggtcggtgaacttccgcatgagcttgtctgacgacgccttcgccacgtgctgcacggacaccgtcccccgccgccgccgcttctccagccgagctgcccacacgtgcgaagtcgtcgttgttcggtcgtcatcggcgggcatgggaggtggccatggtggagctccagcaatggcgagcacgcgtgcgcagtggcctcagccttgccgcccgcgactgcctccaccgccgcccgcgactgcctccgccgccgcccgcgtctgcctctacctcctcgccgagccgccaccgccactcctcctccagccgagctagcaggtcgcgcgtgcgaagtcgtcgtcgtcagccgccagcatgctcattttcaaagctaattttcaaaaaaatcctcacagctactttttcaaagctacttttcaaaaaaatcacagtcgacagctgcttttttaaaagccacagcccaaccaaacacacccattgctggccgaggcgggagttgttcggttcggatagaggcatggcatggccgtaagccggtcacagcgcccaattccttggtctgatcgacgcgccagggtaatgctaacactgtgtccaattgacacgtaaacttgactgctattaattaacccttcatcaggctacgcagtatacataaagccagcagttataaaatataaacaaacaaacaaacaaacaaacaaacttcgacttcgagatcgataagaacgagaaaaagatgataaaaccaacaaaagcaccaaagtaacacgcagcactttaaccagtaaacctcatctcaacgttaactcactaatctgacaactttctgattcgaatagttcacttctgtcatggcatgtacccccgtccaagcaaaccacaaaatagcacgcatcaaattaagcttatgacaaattacatcatggtggcctccagaaacacaaaggtctcatgatgatagtatagtgaatttggggaaagaaaatctaaactgtaggatcatctcaggagatagatacctgtggctaggacacctatttcctcccatgaacacaatgctatcaccactgcgagatgtcaaacccttgtttcgatgatttggacaaagagaaagagagtagcccccacaatttacaaatgcttcccgtctttctcctcgatagccttggcattgcggtaatccttgtccgtgccaaacagcctatcacaaacaggaaggctcctcatgtaaagagtcaggtaaacatgcatgattacacatagcaaagtcaatgatttctcaccagtccatgtaaacaaaagtagaggcgtagtttcctgatttggtgtagagcacacggtgatgatagtcatgaaagtcggagctggtcataggaaaagacggcattcaggacaccaatagagtccccataccattttatatcacacttacaatatctagattacttaccctccatacagtggcaagaaatttgatgggctccatgggaaatggtatccactgtgagcttcaactgtctccaataccctcaacaccatccacagccatagagtgaacaagtgcggaccagtgagggccggaccaacaattgtggcgaacccaaggaacaaaatttcagcagggtgggcatattctgaagtcaagccaaagggtgtagcatatctgcccaggaaattgttatttaaaagaactggaacaataacaaaatgtaaaagtatgaggccaagatgtagcattacgtactcatggtgaacgctgtgaacatgcttgtatagccatttggtgtgcagtgccctatgtccccaataaaatataaaatcctcgagtacaaagtaaaaaagaacttgagaaacaataaccgtcctgcatcaacataggtggaatgttaaacattgcaataaatgaagtgctaccctggtttaaagattgaaacttgaataccagtgtggcagaggaagagagctcctcaggcccatgaatttgaaggcagggtaggataaaaccattacaggcaagttcacacagacatggtacagaatgagacgcagcacacatctattctggtaagaaggggtattgctcttcttctgcaaagatccacacaatttttttttatgagaccagatatggcagcaagcaagtataaatctctgctgagtttcacagtgttcaacagtttaactgttgtcacagaaggcccccaaaaagaaaaggcacagaggggagcaatgagtgaaatagaaagtagggacagaacaagagcatactctctttttttttaattaaaaaaaaggcaatgcatgttagtttcatcaggagaaccataaatggacaggagagacttctcatattgttcttaatttgattttgggatcaacaaagtggcatggcaccaacagctcaaatcgtactgatatgacttgtaagtcgagcaccgtaaactgggaacaagagcaatcacaagcatgctttactttaaaactgatttgtggtgaaacaaagtacaacctagaagcatttagcgacagcgaacagatctgccttgaaacatgcacgcggaggttgagtatttcttgatgacttggtggtatctggaagcaacttgttttcacaatttttgacttcttgttcagagaatatataaaactaaggtgcagagtatacaagtcaacagcatatatcttcgagcaaggatatttatcgacaatgttctcggtaattactttccctgtgaatgagaattttcaagatttgtagtagcctagtaggtagggcatttatatggtacttaaaagtgcaagaagagtttcctataaatgatgggtgatagttcaagtaataatatggtacctagcctacacaacatagatctttttttgggggaatacgcataaggaacacaacaaagatctagttttgccagatagattcaatactgcatttcaaatatttcactatgttcgtttattaaaaaaaatatttcagaaaagtagtattccactctgatcagtgcaaacaaagtcatctgtttatcctgacaaagctgtagagcttaatcctcaaaacatttattgccgaagcatttcacatacgaggtttttggtagtttggaactagagtgaaattaagcaacagttaaaaccatcccatcccatagtcactgaagcgttcaaggggccttttgactttttttttggagatgctaagacacacacacacacacacacacaaaggtgatacttaatttcgttttctgcgcacagtgagtttgacttgttgcgaggcatattgatcagcgtggcgttggcatagcagaaaccagaaggctccctgaagtggaattaagacactcatacaactggaaaagaaatcataaattatttttggttccgtgatccacctttccatgttggttgggggtgattttgtaaaaaaaaaaaaaagagacaattccagtgggtttgatctggttggtaggtcctccataataataataataataataattgtgcaaaaagaaaaaaaaaaccgtaggtactggagatgctatgttggggtggggtgtagtaggagacgagataggaaagaatggatgggagaaaaaagggaaggggacctggatcttgtacttggcgaagaggccgaagcgctcgaagaggagggaggggaggccggagaggaagaagacggtctcgtggaggaggaaggtgacgacggtggcgagctggaactcggtgaagctgccggtgaggccctgcgcgcattgttgacaggatgagatgagagatctatctatccatgtatcatatcgtatataatctaatctatgatgagaagagcaaatcgaaaagtagaagaaagggttgggttgggttggggacttggggggtagcgtacctcccaggcggagtcgagggcggacgccgccattgggctcgccggcgaggggagcagaggggcgggggagggagggaggagagagaagggaatgaatgtgagtggtggagtcaggaacggaggaggagagaatgaatgaatgatccgtgcggtgcgtcgtgtcctcctcgccctcgctcctctcgtgctttgctttgcttgtcttgtcttgcgtggctgcacgtccacctggcctcaacttgagctgtttgtttgtgcatcaatcacacttgcccctctccctccctccctccctccgtccacatctgccttccttgtttatctttctcacactctgctagtgctctgctctccacgtagtagtagcactagtacaatatacaatcaaatgaacacaagac

SEQ ID NO: 66013 - DNA, 5149 bp, Oryza sativa
  unsure (1)..(5149): unsure at all n locations
cctgcagccctattattattattattattattattattattattattattattattattattattattattattattattattattattattattattattatatagtatattatagttgctgctacgctatactatctctttctcatatcaactaatcgctttattatcagctttgcttgctaggaatataaataaaaatctgcccctcacattcaacagtctgtattagtccccacgctctctccgtattactctaatctcctctgccactgcacgctgccgcctccaccatctcgcccaaccatagaaaaaaaaaacataccaagccggcccccaacttgaatgtccattcctgtaatgtaacaaacccgtttgtgcacacaaaaggcctttgccatccaaagtctcagggatacctccataagcacccacataatcatattacaacacaacacaacagttacaatcctctaatgtttacatcactcaaatggggatgcacaccaagggattgcttccttatcaacaacaaaaaaaacctgctaaaacacttccacctcatctcatcaggtgtccagatagtttgcagccatcatcagctccagagttatctccggttcaatttgaaactcagatgtctccttcccactatcaaccaaccaaacaaaacaacaaccgagtcacttcagttgacgttaaacatgagcgccttaaatttgaatgaagtaaaatattaaaacaacatttgttaccctgagtaaaatatacaagacacatctagactatcgatagagaaatatgacagaatcagagtaataaacgactggttaggttctctgttctaccctacaaaaaaaaaatgtaagactcattttggtagcataccaaacactcagatcgaaacctacaagacacctccatctccaccaaaatttggcaatgccaaaacataaatctaaaatctggactggagagtataagctagaaaacactcaagatcgcattctacttgatatgcatatgtgctatttgagttatttcagaagcatatatgagttaaggaaactgccccaagttttaatagttttggatcacaaaggcctccacaaaatacatgaaccacaaagtcgatcacaaaaccagttgacaaattgggtagtgcagggattgagagatacaccaaagctaaatccctaccatgaaaccataaaactacctaaagaagacaacaaccttttggtgcaccattatttgaaaggtgtataatgccttccacaattttaaaatgtttgataaccttatacactgtacacaggctaaaaataatgtactgtatgtaagttatttattgtattctgaagtaacatttgcatgtttcataaattccaaacaaccaaacatgagagtgcaatatgcttatatatcttatagtagttgaaggttcctggtccaaaatatcacaggcaactatctctaccaaggcttagttctagattttgaaatgagatgtatcattataaattttgaagggactaaagtattgatgcagctgctgatgctaaaggtttatgcttcccttttcaaagcaggatatcttaatgcatagtccgatgggtcttagaggaaggcaggattcgagcagttgaaaaacaagataactggatggattttttttgaaggtgctcccaagttattttacaacatttatcctacataatccaatggctaatatgactattagccgcataggaggttgtcatcacttagcactgaggggcaataaaaacttttgacagcatacctacaaggaagtaattagatgctaaattagcatcccattatagaattccgggggatcatacttttcaaaaggatataatttgatcatttacttttattcccttatatcaagtataaacattagttaagggaaagaatagcatgaaatttatcaacatttgaacctatagatgttgaaaaaaaattagtatcataaattaaatgtagtggaacatagattaggtgaaattcaaacaatatcaaatatattgaatcaataaacttatacttgaaactggagaaataaaagtggatgaaatgcagacttaatctttcaacatcctcgaaattcagtccaataaatctcgtgtatacagtaaatcaaattcaataggtgaatgtgtataattgttcgctgcatgaatggtaaccaatccgatcatttattgtgttgacttgtctgcctctaaccatggatattaatgagtatcaagcataaacaaggttttgttggcatagtactgcccatagacattggaagggtaggattaatccaaactagatccaactgcataagagttaggactagtatgggattaggggtggtgtgaggactgaatgaggatgtcatgtggaaaaggtggaaagatttacctggagtagtggagcgaccagtagaagtactggcagatcttctcgaggatgggggtgctgatctcggggaacctaacctcgccctcgcgcgtctcggagaagccgcctgtgttggatttggatttggtggataattcaaggcaatctagggtttgagaaagcaaagcgaatcggatcgatagatggggaaggagacgaaccgggggaggtgagcatgttgcggagcgtgttggagaccatggcggccttcttgtcgacgacgaactcgaagccctcggcgctgatgagcttgacgaagccggacggtgcgtcgtcgtcgtcgtcgccgtcgtccttgtgcaggtggggtggggtttggtgccccggcgcctctcccttccgcagcatcctagcttgcccccttcttcctccgattcttcttcttcttcttcttcttgtcccaggcgagacgcagccacgcaggaggaggaggaggagatcggagaagaagaagatgacggccaggcctggtcaggccttgtgtgttgggcctcatccaggcatatgggcccgtctccatgtataggcccaacggcccaagcgtagcggaggctcggcaccaaaactaaggggggaaatagtaaatttgacaaaagaaatacttttatcaaattattattggaaaattatagattcaagatttaacactaagtttattaagaaatgaggtttaaaacttaagtatcacaaaattatagatttaataataaagttatcactgattacatattatggggttataattatttaggctttgtgattaaattggtattaaacatgtaattttgtgataaatttatggctaatatatttgtagttttacaataatctgtattaaattttattaaaatatagcgaaatttactctaataaaagatgcgagcacccatcatttggttctagttaggcatacccatttggtactacttacttgttgctactagttaggcatttgatattaatagtagttaggtatcgcatcgtattcctaattgatattcctattgtacatcaagactagagcatcgtatcccttacgaaatgaaaatcaggctaacatgttatatatacactagtagagggaaggtatatgagtcgaatccgagtcatttgcattaccactagtctagtgatgtgcatccgagtcatggaacaaagcaaaaaaagatgtccaaactagcagaagataattaacctgctcatttttgtatgtgcagaaaaatcaaaacaccgaccaaaagcaaaaaaaccaataaataagggtgtagggagttgttgagttgggtccgcgaatcgtggtttcccactagcaagcgcaagcgcaggcgcaaacgcaaacgccgccgccggtatgccggagcacgggtcgaagcccgacatctccttcgccggccgcttcaccgcaagcgccatcgctgcatgcttcgctgaggtatccaatcaatccccttcgatttctccgatttctcctctcctcctcctagagagagcattattataggtagatcgagaaggaaccagctgacggatcgatgatttggttccgatccgcaggtgtgcacgatccccctggatacggccaaggtgaggcttcagctgcagaagaacgtggccgccgatgccgcccccaagtaccgcggcctcctcggcaccgccgccaccatcgcgcgcgaggaaggcgccgccgctctctggaagggcatcgtcccgggactccaccgccagtgcatctacggcggcctccgcatcggcctctacgagcccgtccgtaccgtactcccccctccttcccctcatttccttttcatcctgtcgctattattcaaccccacgctttcgcaatcgcaacgcaggtgaaatccttctacgttggcaaagaccatgtcggggatgtgcctctcaccaagaagatcgctgccggcttcaccactggtactctaccaactctgctttgcttcccattcccaactagtactcactccgttatatgctgcttcttctcatctcaggtgccattgcgatcagtatcgccaaccccactgaccttgtcaaggttaggcttcaggcggagggcaagctggcgcccggcgccccgcgccgatatgctggggccatggatgcctatgccaagattgttaggcaggttgaccttctgcttctttcttcgcatgcgcttgcctgttccataccaacacatcattgcttgcttcacatctttattatattatcctcaggaagggtttgctgctttgtggactggcattggacccaatgttgcgcgcaatgccatcatcaatgctgccgagttggccagctatgatcaagtcaagcaggttccgtccttgtttctcgcagtgactgtaccatcaatttcacagttcgcacgcgtcacaggaaagatgacactgttatcctcgccttgcagactattttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 66014 - DNA, 1880 bp, Oryza sativa
gtttcataagctcaatcaaccttgtgtgcaagagattagaaattatttttactgaaatatatatgaaaatgcatgattttgcagaggaatcggatgtacttgacttctgtatgctaggatgtacttcgtccatgtgcagcaacatgaacacttgtaagctagaatcgaaaacatgaaaccaaattaccatttttcaacatatagaaaagaatcttcggtttgctgtagctaatgtatataatcagtttttcccttgaagttgctgacaacgaagaagggaacgttgttgtggaacgttgcaacgaagcatgctaccacttctgcaacaagaaagctgatattgtcactgtcgtttcctaaacaactgcatcatgcaagcataagggactccgcactttgaatccccatgcaaggctagctatatatgctgccctggagtagtcataaataagttggatatcatgatatccaaactagtgtgccgtcgatctctcatgtgtgtttacgacactttgtatttctaataagccatgacatataatcgcattctaccatcttctattaaggatgcatgcatgtgaggatatgttgagtgatgatatcttggctaaaaaataaatataatcgagtttctagtttcatcacatatcatttctaacatttggtcatcaagaaaccagaaatataagtatatttatgcgcctttcatcctatgccctcatgcaacaactaatgtgttaaatattttcttccaaacgggaggcattttaacatgaacaaaaagaacttcagtattggagtcatgattttagatttgggtggtcctacttagatattttttaaatgatgtaaatataacaaggtaatagaattacatgttgatcaaagatataccataatatattaataagagacacagggagaattcccccctccccgggcaagcaaccgactgcggagttaaaacgtaaatcgcgacacacagggattgttttccactctgagtgccaactatccattgaagagttgaattttaactcatgacacacaggtagagttcccacgtactcccggtgaatatataccgatttaggagttaaaacttaacttgcatgcagttggtgcgtgggttacgaggccttatagattgagttaacattgatgatatgttgtcgctggttcctatgcagttggtgcgtgggttacgaggccttactgattgagttaacacattttttttgcgtgggattcgtttgaagatgtacttcagttaaaatttatcgatataaaaaattaacgaaaatcaactgtgtgagagttaaaacttatctggaagaaattgtggcgcaaacgaaccccgcagacatcatgtctactcgagaccgtatagtgaaagttaaagtttaactaatgtaaacaatggtgatgcgttttgatgtctcagtgctatgggtagcttaaaattggggtggtggatggttgtgaagctgatgtcatatagttaaaaaataactttgattaaccgttcggtgatgtaaactgtccgtatgtgaaagttaaagtttaactgatggaaagaatggtgatgcgtttcggtgtctcagtgctatgggtagcttaaaattcggggaggtggatgattgtgaagttgatgtcatatagttaaataataactttgataaaccgatcagtggtgaacactctcggtatgtaaaagctaaagtttaactgatgaaaagaatggtgatgcatttcgatgtcgcagataacgagtaaatattcgttctttgttccggtcatacgtcatagctatgattatcttaaaatccgggggtggtgggcggatgtgaagttgatgtcttttagttaagacataaaat

SEQ ID NO: 66015 - DNA, 7558 bp, Oryza sativa
gatctacgcggaggatttggggtacatgtctaccccatgcctttctccaccttcagatgtcaacgacctaaatccgcctgaagaccccaacaacataagtgttctgcacccagctttcatcgacgacggtgacattgatattatccaggaggacatttacaactttcgatatgaccagactcctccaagagatgctcagtcaccggcaacccggttcctgcgccataaacgtgactagttttttgtttagtttacttaatattcgccactaacaattttatgtgttagaccatgtgtttatctattcacattgcccgtactcatagacttgaagaattttatttgttggtgtgctgccttccgcttttttagtgaataaaaagaatgtttccttgacacctattttgtgccgtggaatagaattgcaacaccgaatagtggagttaaactataacttgtcagcttaggtgatgatttcctctggtttatgcaggtgttatagttaaagaataacttttgttttaggtgcctaatgtgcgcacacactgtatgtgtttttaacgttggattccagatccaaatcgcacaaaccaaacaacaatgaaaagaatgaaaaatgacttaattaatttcaaatgaaatactcaatggtgagtgtaaaacatcgtttaataatggtaaaaaacaagacgagcagcataaagacggtgttatataaatttatagtgattatactgtcttcatgcggactcgctttcataaccactggaagattcgtccgcatgtgcttgctcgtcgtctgtaaaaccagaacactctgctgcatcttcagcccactcgtcgtccaaacatcttcgtagcgaagggccctctctgttgtatctccttgttgtactagcgaccgcagtactagccgtgcttccagcatgcgtaccacggcctctacccttgcctgttccccgtggcctgcctctctttcccttaccccttcttgaaatttgtaggattcttcgggcaagtatccgcgtagtgcccatccctcagatggcaccacccacatttccttatgcacaactttttgccctttgctccaagttgaacttcttcctccgggccacgagtccttccttttttcctcgacttgggggggggggctccctgctaattttggcgatttcaactcgtccaacaacgccttcctgcatattggtgtcaaccgtcgcagtagtgtcgcgcggtatctcctctatttggctgcgcagtcccttcaaaatagccatagctttgtcaaatgctaccttcgatttgcatgccgccctaaccactccaaacgcttcaatcatcatcatgtttgtcctgtaattttcttgaacaccatcggtccagttgcctctcggtcatgcctgtcaaatggcacgtcgctcttcactttctttgtgtacctctttaggatgtaggcagcgggtatcttctcaagttgtacatgaacaaatgcccggagcatgtgtgtgcaaaacatgcctacaagacataaaaaaaaaaagaaatcaattggaccagcttatttgtgaagtgcgataaaggattgctggaatttttaatgcgtgcataaatcaagcttgaggttggtatgaaaaaaggacatgtatgctcccactgtttgcactcgcatgtaaacacccctgcgtcaacatctgcaattagcttgaattgcttctgacaccaatcgtgtttttcagaacgtttggtgtgtgatactatccacccgttgcggaaatcgtggtcttgtgaaatcctcaagtcggtgctgtcctgtagcgcctcctcaaacaatctgaaagccgccctggtgtacagtctcgacatctgtataacaaatggccacctcacagccaacattggctttccctgcacaaaagagaagtcattagttgtgtgtgagttaaagtttaggtgaattataaaagtgatgtaataccgaatcccctctgtacagaatatcactaaccgagcatgctcttgtttcagcagcctccttctccttcctatcagttataacctccaacattctcctagcaaaacggtggagcgtagtttgctagtcaacaaacttgtgcttcaccaacttgttcatgctctcactgcgctgcgtggacgtcatcctcccgcagtagtccttcctgaagaacgcaggcacccacttctccctgatatcatataaagctttcatgatgggacagccctccaaatcatacctctttaagaattgatcccaggatgtttcaaactcataaggtttgtaagtttgattgatgcacaacatcatgtctggttcaatttgttcgttccgttcaaaaattgtgttcagcgggtcagagtggcagttaaggatatgccatcgacacagccggtgtattatcccagggaagcaccttccaacagcgacagccattgcaggatcttgatctgtaaaaaaaaaagaaatggcgtaaaacatatcatacaggatgtgaagataaatgggagtaacgcaaatattttatggtggatgacagtaggaaggtttatttaaatagacttgcctgtcaggatgcagcgcggagcagggaaattcgccatgcacttgttgaaggtgttgaataaccactcaaatgactccgccttttcgtctctgagcaagacacatccaaacagtgtgctctgcatgtggtggtttgcaccaacaaacattgcaagtggcatttcgtaaatattagttttgtacgtggtgtcgaacgttaccgcatctccaaagtcggcaaattcagcttggctgctatcatgactccaaaaataagtttttaatgacaccattttcatcgagctgggcgtcccagtaaaactttgggttttgcaacgtgcactcgttgaaaaactccaacagcttgttgatgtcgtttgcattttccatccggacattggctgctttcctgcgtcgttaagttaaaaaagaactaattgaaatcaacatgtgtgactccatgcaagaaaacaccataaatacttcaggaaagcaacatcacaaaaaaggaaaaaggggttattttgaagattcacctgttctctacgtcgcgggtcgtgaatgggattttgtccaggcctccatgaagatcatatagaacgcccatgatacagctttgcggcacgtgactttcttgcattatgtccacaatcttcatagccgtgtcatcatgattcttatgtgcacgcatgggctttaccgccgaaggagatggcgttagagggtggttgtgctgtagctcgaccacatcatactgtaccgatgagagcacgccaccgtcatagttgtgcctcagcttcacataagccttgcaccccattttcttggatggtttcttccgttctctatcacaatctgcgacctttgacacatgcttgccctctctcgtacaacacacctcgtgaatcgatttgtgcgtgcggctcttcttgatgtcaaaaccagcgtgatatgcatatgtcttgtagaagttgtatggatcgtcgtatgtagggaaagccatacctttggtgggcaccatgtgcggtggcacgcaaggaccctgttgaataataaacgaaaaattcgtacttaaatggacgatgaatagttgaaacattacgaaagttttgagaccattcaaaatttattgtggctgctgaatatgacatgtggagtgccagttaaaaaatggcttgtggccatttgctagcgtattcctgatgtgtgataagccggtggtactgtcatgtgcaatgtgtaagttaaaaaattacttgcgtattcttgttactaattctttgaataaatgaaaatacctagcaagagtggtagattctcagttataaattaacctatatcatgaatatatcgttattagatgttcataaaacatagatggtcttggcatgggtattgagttacattttaactattgaaagcgataaaagatgcttctcggtaaagaatcaaacacgtggggtatggatcattgtgaaagtaaaaaaataacttgattcttcatgaagctaattatttaaagtaaatcgaaagtacatagcacgagtgctaggtttagagctataaattaacttatagtatgaggttatcactcttagatgtttgcacaatatagttggtcctgccttgggcgttgagtttttttggaactatcgaaagcgataagaaatgattctcggtaaagaatgtcacagtgaaggtatgtcatgaaaagtggtaaccatatagaaacatcacatcattctacgatttgtgggatacttagtttcgtcatacgaaaatagcaacaaaaagaaacattaaacgtggttggacaaagtgtgcgtttagtgcaaaactattgcaatgtagccgtcgtagatgataaccactaaaaaatgggtttgaaggaatggaacttacatggctatataccctattcggcgtgggggttgcaatgtcgttgtcatccaaacacggtggcatccctcgagagcaaatgtctcctgcttggtgcatgggggtgcattgttgatcgaggagtgactagcggagcagacgacgtggcgctggtgatctccggcgacgccatgagcagccaaggaagagccgccgctggaaggatgtgctccgagtgccaccactaactggcagctagcatggtttatgattttttttttattttgtgtagtgtttctctatggacggatgctttggcaataatgacggatctgcatgggttgcacgtccggttttgtggtgtttaattttgaaaagaaggaatcgtgagttaattgtacggtaacgatttgtccgataaatgctcaggccgtttctttttttttttcaccgaactaattattttgaaacaaacgctgtggtgataataaacggtactgtcagattacgagttgtaaatagactatagtgtagtgaaattgtcgcgaccgagaaaattgcattttcccgaacgctagtgtattaatccccgtcccaggaaaagccggggtacaccatacaaacatgatataaaatacacatctttattatatcgataatatttacattattacaaaggcacttaaggcctgacaatcaaaaataaacagcagcggactagcgggcctacggctccatcttcacaggcgctcaactggggtataagccaagactccacctaaggcttcttctccaaagcttctcttactgaagaggggagaaagatagagaaagaatgagtacaaccacagtactcagcaagtcacaccggcagatgcatgattaacgcaagggggtacaaggggtaatgatataggggttaagttttgcagaaaacagcatttaaagatatttagttgctcaaagctatttcgtaaacacgattctagaactatacaatattatttatcaaggccgtgaaccctcacgaacctgccttaacccaaggcctacgatgattcagaccgaactggcaacccgaccctgggtcccagctcgtcccaagccaacccaggccaaccattccacattttagttattgagcaaattttaagaattaaaacactaacttgggtacattgctcggcttgcccataaccgagggcgcggctattcgaataggttttactctgatcagaggtgtacatctttacccacaagacacatcttcctcacgtgcaccacgtgccacataccaccacggtatacagacggaagacgtgacatagtttccaacccatcctagccatagacaagagtaccgaccctaccccacctacggccggaacctccgggacaggtaggcaggattgagcccctagcagcaggacaccagccctgtgccataacatctcgactaccgggccgcagctcgtgtagccttcatttgtcctagagatgtccatcgacccccgacttcgtccatctccatccgtgtacttttgtttataaccagactgagccacaaactaagccttacccactagacatgtggaagtacggtagtactttgcaacagaggcccgaagaccggtccttatatggccgaggtgctactatcaaaaccatgcaccccgagcccagcctaaaaccattttggggattttgaatagagggggcggtgtgaatccaattccacaataaaccaacaattccaaagtgtccaggtgatatgaatattcccaaagtctagagttgaaaaaccacctaaagttacctaattaaaatagcgaagcatctacctaaaatcatactagtgataccatgagtagagtgtccactagttggggttttgtttattctagggtgaacaaggtaataataacaataacaataataataaggtcataacaaaggtaattaggcatggctaaataaaacagtgataacgcgggaatttaaataaagcgataatgcaataatttaaatcaaaataattttataaactgggactcaatatgttcaaggatgatgtgacttgccttgctcgcttcaacttctacgaagagcggatcttgacttgacttgacttgacttgccgtcggcttcaacttctacgaagagcggatcttccgaagctgcagcgtctacacgaccaacggaaaagaaaaggcttttactctaataaactccatataacagcagaaacaaagcacaaaaatgggttcttgacttcttaagaaaaaattagagacttgaacggtccaattccgagttcaaatggtcaagttatggccatttgaagtttatatgctctttaaatggatatttgcgaatttcttcatttaaattttaattaaaaaatcggatttattgcgtcagccgggagagagggcgcgcggaccgggtccacgggagtggggcccacgcggcagcctcacggtccacggtggaccgggtgcacgcggcttgcgccggccggcgccgtgggtcccacgcgtcagccgcacccgagggcgcgggcggctgacggccgggccccacctggcagccgcggggcgcgccggaagggggcctcgccggcacggccgacgggaggcggcgcgcccgcgcccctatggtcgccggcggcggccataggcacggcggagcggcggccgagagaggggagggaagggggaaacgaaatggcggtcctcggctcaccccgggtcgacggcgacgacgggaacggcgaccgaagcggagagaggcggcggcgcggctcaggtcgacgaggacggcggtgctccggcggtcggcgggcgaaacggaggagtggacgaggtcgacgagaacgcggcgaagccgaaggaggcgatgccgaagcgggaggaggtccggggcgacgacggcggcgaaccggagctcggcggcgacggcggagagagaggacgacggcgcgggctcgattccgacggggagagaaagcggcgagtggcggaaacggaggagggaggcatggggagcgtttaaatagggttgggagtgagagagggcggccggaggggaaggaaatcggcgcggcgatctcgggctcca

SEQ ID NO: 66016 - DNA, 1400 bp, Oryza sativa
aacaaagttgatcctctcatcaagatctacaacttttgtttcggtcatttgtaataaaacaaaattagccatattaatgactacacatatgaagtctttgcaataaaacaataaaacaaaatacttcattcattacaatagataagtacaaatgcatcggtcacaaggttatgccttccatatgatctgaacgagcatatgccacaggctcttggggatcatcgtcaaggtcgatgtgaggtcttacatgaagattacggttgtattcttcttcatcgacgatgttgtcaactcctacaattcggcgctttccatccctcacgatgtgcatcttcttgtttgaagggtcttttatgtagaatatctgctcgatctgtttagcaagaacaaatggttcatcggcgtatcccacctttgataggtctactaaagtcaaaccttccttgtcggctttgacaccagtgcgtatattcacccaacggcagtggaacaaaggaaccttgaacttgacgtagtatagctcccagatctcctcaatgcggccgtagtatgtgtttgacccaatttgatcctggaacgcatctatacggacgccgctgctttgcactctgcttttgtcatcttgtttgacggtgtaaaatgtgtatccatttatatcgtatccttgccatgtgtctacggtccaagtcggtcccatccccaacaactgtactgtctcatttgggatatccgtggacattgtcacacaattcttgaaccattcgttgaaccgagaattatgtaattgacaaccttccctcgtgacaagacggaggaactccgataggatcggcatcggacatgtaattgacacagaactcaatagcctcctcggtcgtgtaaccttcaatgatgctctcctcgggtttggctctgttacgaacgtacgacttcagaactcccatgtacctttcaaacggccacatttcccttagaaaagccaggccacatagttttgtttgcttcaccagatgaacagggagatgaaccattatatcaaagaaagacagtgggaaaaacatctccaggtgacagagggtattcacaatatcggtctgcaacccatctagatcttctggatctataaccttctgtccaattgcattgaagaaagcgcatagacgttggatcgtgtgatgcactttcggtggtagaaagcctctgatagcaactggcaagatttgtgtgattagcacgtggcaatcgtgagacttcattccaacaagttttagatcgtccaatttaacatacttacttatcctcgctgaatagcccgatggaactttaatatccttcaagcatgataacattgcgatcttctcatccttcgacaatgtgtggcaagctggagggaggtacac

SEQ ID NO: 66017 - DNA, 3579 bp, Oryza sativa
ctttttagagtttttctttttataaaatcattttaactttgtttatttcttaataattattatttgtgctctgaaaattccactaaaatttgagggctccttttagaccaaggagaatttaacaaaaattctccgggccacatttgaatttttcttgtacgtattttagtgtttgccaattcttttagaattttaattaattctattattccttttagaaaatgatttttatttcgggatgaatttatcaggacgtgacaaatccaccccccttacaagaatctcgtccccgagattcgaggaggctagcaagaagataggttgggtggtcttctcttcttatttgacttcttccgctccgtcttcacaaactttcagcaaaacttcaccactcggaactgcttggcttgacctcctgttgcggatggaatcttctcttcacctgacttgaaccagggtgcaccttttagctgactcagactaggttgcggtagtttaatgatgcttccgttccagaacttctcatgattcatatctttggagtcaacctcatacaagttaccacttcatgtcatgcgtcaacactagcttgtcattactaggataccatgtttgtcatcataagaatatcatgcttgtcatttacttctaacttgccaccaactgcctcatattagctttcctggtctccgggtgatagctacttctgctatttgatgcaagggtcgataactttgcctttgaattatgcttcccaagagaaccaacttatcccacttgacatactttgacgtcttcccaaatggctttactgctggatttgttattgtctaatcattatcctgccaaatctgaggcttcgttgttagatgtgattttaatctgacctctgtagattatcttcgaacatatcacttgattcataactgggaatagctctcacgaacaagcaactcggattcactttctttatgttcagtttactttccactattctcttcatgttgtcatcatttagcattcaacgtattcctttgcaccttcagccttgatgtgttctttctcgatggatcgattgctaggaaagtgcgttgaacgatactagtgcaagtgcttttattctagtagcatctgatacaaagcccaaggttgaaccgagctttagattccactgttcaggttttacttcttgacttcttggtcatgtcacaaaagtttccatccttgtccccatagaagtacttctacctgtggtcatctctcttactcgtgaattcacctactttaatgacagggcaactgttgtagggttgattgctatcgggagtcttcctcgagtgacacaaatcatggttctcgttatcctttatcaatcacctttcgacctacttcttttcccagtaaccaaacatcttttccgatctcttccattaatcacctttcgacctttctcaaccaggtactcttcgctccgggtgttgaggatgcttctggggcaatgaggtccttgggcgtgctgtctttcagagaaaccttgaagtagttcgtcaaaagctagactgacgattgttgcctttgatccgaagaagacacatctgaaactcttagtccaaacaaatgtctctttggttgatcacttgattttcttcgccatcaatcgctaggttatttgatgcataacagattatgagcttacggaaatgagaccctaggtctccctaatcaacaacaaaatgtacacaactcacagcacttgcaatcttaacatggatccttcataaacttatcaaactcattcattatctcatgtttctctgttattacatgattgacggggaacaactataaaacaaaagtatttgaacactgatataagagtattatggttgcttctgactagcgctaggcttaacaggtactgcatttgctccagtgaccacttggcgattggcatgtctgcttccttaacaggtactacagttgtaacagacaataactttcttacgctcgggttcttcatcttgtacttgatttttttggctgctgtgctggaacatccaaaggtataatgccgatactggcctctgtcttgtcaactgatggctggggctgaaattgagcattgacaccttgtggtaatgcactcgctggagttggagctgttgcaacgcgggctataggactgcttcgggatgcatggatgacaattcgctgaggagcaagcttctgattgcagggagttgcgtggactgacgtgctggcagctatgtttctcggttttgggcacttgtcggcgaaatgacccattccttgacaattgaagcaacagatatcttcccggactcggcattttcttttctcattttgattcctctgtcctggcactggagttaggctgaaactgtaatcttggcgagatttgtgttgccttgatgcttctctccgttggaactggcgggttggttggccatcttcttcgtcagcagaaaactgaattgacaatcttttggtacatgatcagttccttcacaaaagaaacaagtgatcctgctcgttggacacctgtcgggtggatggtcttcctcacaatgaacgcatgtagtggcacacgagctggcaacatgaccgattttctccacaacgagagcatgccttacgttccatttcatcttcatcatctgaggagacttgatctgaatcttcactatcagacactctacctccattagctaaaagatgctctgtcaactgtggtgcacctcggaaggtatgtcttctctgacgttttgtcattcctggtggaggccattctgtgctggtaatgatcatcttacggacttcatcttcggttcgcattggtgtttttcttttctgctgaggacactcccttgcatagtgcccttgctcatcacacataaaacaaatgatacttgcttcttttgagtcaacatgtggcacgtcaccatgggtccttcgggatgctggcggcatgctgacttgtggtgtgagtgcttggactgcctccaactgcacttgaggttgcatctgactcaggttcagaattggcgtctgatgctgctgtagtatctctataagcaattggttctggttaatcaggtgttggaccagtgtcacacaactggtgtctggtgcttcattcactcgggagcttgaggtaccaatgtcctgacttctgaccttattgcctttctcattgtcagccatctgttgcaaaggtttggagagggagagagggaaaacaaaggggagagacagattagaaactaaggatagtaccttaacagatctaagtcttttgctgttatgatgtatgttaggcttattctgcaagttgattaagcaaacaacctagcatggttacatcacaccccactgatgcaaaccacgcgctacacacacaagcaaggaaacacacgactaacgactctaccctagagggtggcttaggttctgtgacgggttctcaagatcttcactcctgcttcacagctggcttcactgattactccacttcgctagcgatcctgcagtcttgcggagcttcagcaaacaactgac

SEQ ID NO: 66018 - DNA, 1118 bp, Oryza sativa
tttccttcgatgtgctcttctcttttcgctttccaactttcctcttttttccaaactcgttggttattcccatcactaagttgtgcacctctgtccctgttagctctgtcgggggtccggctgtatctctgtgtccattgaaattctttctcatattcctatacggatgataccttgggagaaatctcctgtgacccatgtagaccgtcttgtgtgaatgcttcaaccatttgcttcttgtttcctccatacactccgaacacgcccatttccctttcacagtttggccagaaaggttgccaagggccggataatcgttgatggtacaaaacagcatggcatggaggttgaaatactcttgtgcatatgcgtcccatgttcgtgtgccctcattccatagcctttcgaagtcatcgattatcggttcaaggaacacatcgatatcgttgccaggttgtctcggtccttgaatgagcatggcaagcataatgtactttcttttgaaacacaaccagggaggaaggttatagttaacaagcagaactggtcatgtactgtgacgactgctcaaatcaccaaaaggattaatgccgtccgtacacattgcgaaacgcatgtttcttgggtcatttgagaattcctggtaaatcctatcgattgtcctccactgtactgaatctgctgggtgcctcagcatagtatcgactttccgttcttcggcatgccagcgcacaagcttagcttgttccttgtttgcaaacattctcttcatgcgctccgcaattgggagataccacaccacctttgctgggcctcccctctttgacttacttccttcaccttcactctttgctcgtttgtatcttgatgccccacagatagggcagacatccaagtcagcgtattccttgtaatacaaaatgcagtcgttcggacatgcatgaattcttctgacctccaggcccaacggacataatacttgcttcgcttcatatgtcgtctgaggtaaattgttcccctctggcaacagatcctttaacagctcaaggagttctgtaaaactcttgtccgaccagccattactagccttaagcttcatgagttccaacacgcatgac

SEQ ID NO: 66019 - DNA, 9888 bp, Oryza sativa
ttagataaaaaaagcccgtcaaaggtattgctcatacctttgacgggcttctattcaacggcccgtcactggtatccgctcacctgtgacgggctagaaatgaaagccgtcacaggtggcggcccatcacctctgacggcttctaatgtatcggcccgtcacaggtgaggggataccagtgacgggttggaagcaaaactcgtcactggtatacctctgacgggttttcctttcggcccgtcacaggtgaggggatacctgtgacggtccgcggccggatggctcaccggtgacgttatctcgtctgacccgtcagaggtaatggtcactagtgaccaaatcgtttgcccgtcacaggtatcccgtcagaggtgtgaggatctggcgtagtgaatggatatttagtatttatatgcgtaacaaaaagatgtatgaataattaatattcaccacaacagtccctttggactagaacattggatttagtttgggtgaataattattttcttaaataaaaaagtttggggtgattaatggactgctaaccttcttcgtagacaacgccacagaagcccgaacaacggggcccacccactagccacagtaccaaagggtctgtgtcagggtttctctctgattcaacgaagtagtagaagagctcagtgccagtcttctcctcaacaccaatgtacctattgtgtatacattacacatgtacgtgcatatgtacccaattctatgtgatgagtttatgctcgtatagtagtagtatgtagaagaaaatgggactctcggtgagtagtgcttacccagtctcgaggtagaatggcaggcggccatggaagcccgggaggtgagtgatcaccgccgacgacgccgagcacgggagcgtcagtggcgacgacagaagcagaagaagaagcagtaggagaaggcaggtgatgaggcgcggtggctgcacgaggctgcattgccctgcggtggggcgatgatgagaacccatcgtgaggagtggagatccaagaggagcgtggctggcaagtgcttcctctgttactctgctagtgctcttatagctttattgagctctcggcaagccaatgaatgcatggtgagaggccagcggtaaaagggaatgctaaaatactcctctgttttctaatatatataagatggtgttgagttttagcgtgactattcgttttattaaagaattataaattttatttatattgttcaaagtacaagcatgcgtaagatgactgaataaaatgtgtaatgattcactgtgtcaattagaattacacactgcttcctccctctctaaataaatacagtttgagttaaagatatgtaataagtgttgttttatagtggttcactgtatctctttaatactactccgtcattctgaaatataaggccaagcacaaccacttttttcgtgatgtttcataatgtaatgcacaccatatagttaacttagcatctccattttcctaaattagtttttaaaaatcttctaacttcaagatctctaatttcattaggtgcatacattacatttattaaagtgatccaaacgagaatatggtaataactatttcttgatgtttgcgttagtgatggttgtgccttataatttagagtggaggaagcatttcatcattttcttcttgattttagcaattcaaccaatagtaatctctcctcgttttctcccccataccattctcgccacataaatcaaacaaattgcctgctccactcctgattcccctatgtttactgattagattccccttaacattggcatctccagaagaaacttacagggagcccttgcccggtctcaaggtggaacggcaagcggctgtgaaagcccaggaggtggatgatcgcctatgacgccgagcacgagagcagcaacggcaacaagagaaatggacgcaggtggcgaggcgcagcggctgcaagacactacattgccttgtgaggtgagcacccattgtaagaagctccaaaaacactagatggagccttgtgttttaccgcgggatatatggatgcgttaaattaaatgaatatatgttaaatgccataaaatttatagataaatttggtttgggttgaaaaattatgaaaaaagtgtgagaaatgataatttatgcttttatgttgaggtttggaatgtaaggaatggtagatataattgttatgtatgaatgttaagttttacgtgtttagtgagttatgtgatatgcttgcatgttagattttaagatgtactaataattattatgttgaactttaaatgtttagtgggttgtaacttagtagaaggtaaagatttgttttgttttatcaatgcctggaaactcgattattctacaacaaaaccaagggcactgtttgaacaatcaataggcactactaactgattctccatcagacagtatgcgcattagtatgcgacaggggcgtgcggtctcttgtgggcatggtatggcacctgccatagctatgttacggcgtgaatgctctcattacttctttatcagaagtctcgttgaaaggaagcagccgagaatggctgcaccggtgacttgacaagagctctggctcactggctaacctactcgatcgggtgatggaatcagtcaataagacaatattcatcggaacagtagttagctcttagtgattatgtgattaattggttttttgagttgatagaaatttaacttggatgaaaggtgtagatatctaagcagcacgcagcgccaaaagcggcaacaaaaaaatatatgagcaagaatatatgacatttataaagtagggaaaagctcttagctaaaattacttcaattataaaatatgcacagaaaaatacggattataattgttgattgcatttagggtcatatattatatatataataagtacggctgtaatatagtgtatataaatttatttttttattaattataagcatatatcatttagtttctacgtgtcgactccgtcatacctaaactttagtgttgggtacatcattggtatgcgatacaaaaaattaacgtgtcaccatgtcgttgcctcgctatggccgcggcgcccccttgaacaatcaataggcacactactaactgattcccccatcacacagtatgcgatacaaaatattaatgtgtcgtcatgtcgtcgcctcactggggccgctgctccaagcagcgcccgctcgagcacgaggtctggtttggcgcccctgagatcctggaccctgagaggggtcagtgatcgatgttgggactgggaggcgatggtagcactcagggtggtaggccggtggagacggtgatgggaagggaaaggaggaggaggtggtcgtgcccgacatggaggagggaggggcgattctatactgagagatatataggaggagatcttggaggggagcgacagggcggcactgattgggagcaggagtgctggacagtggagttgacagttgtttcggacaaaagaattttgttgttgtttcctccaaattttgccgcaaaatccctcttaaccaaaaggaggtctttcaatttaaggtccttggatattttgattctcaacatgtggcatcttcattatgttgtatgtgcactaatctttccagtttgtgttctcgggactgaatgtggcagctaatcaaaagcagggcttttcaagtaaatttcacacctcgtcgcaatgctcagcgatacaccatcgatcatatgattttatctgacaataaatttcatatttcttttttctatatgattgctaaatatcgaaatatatgagacattttccgcaagtattgtgttcgaaatatcacatgagccattggtattgttatcgcaagaaccagatagaacggtacccacaagccacaagcaggggaaaaatagaaagaaagaaacacatagcttttttttagataatgaagaaacaaataggtagcagtgtgcaaacacaaaaactctggccttcctatggaggaaaggcaacttagttttctgagtagcagactccttcacggcagcgtgggccggtagagaggatgtggagtgtaggtgggacagggtgttgaggctgaaccaaaatcacttcaatgtgcaaactacaattcaccaaccggcaaatatatttcacacattaattgagctctcaacttgccataaactttgagaatagtttatactagcaaatcaggagaataaacacatgcacacaagacacgatgatttacgtggaaaaacctcctcggtgtgagtaaaaaatcacgggaccaacagtctgctccaatcaataatgcgtacaaatggagtcttctctaaaacatcttgaggcatatcacaatagcagctatatcattaagttacatatttgatatcatcaatatcaacaatcacaattaacaagaggtataataacaataaccagagaaatagtagctttttttccttcagtttttagctgagatctcccaaaccacagaaacaaattgcacgaaacttggcagaaatgatagtctatgagtcccttccaagatatccaaaaaaagcccaatcggacatcgtttgacccgtcaaactgatattctaccaaatgccgcacaagctgaaactacagttactcgagctgataaaccaccactcgaattcagtgctctactcaaccaatcctcacaaaactaactgattgaattgctccaagtgagaaatgaactcaccaagtttggtgccaatctatcatgtttgagcctccaatcgctgacttgatgaagatcgagtaagggccaccaagctgaacaaactgcaactcttcttctacactctcctctccctcttatgtgttttgttggttgcttttcttctctccaatggctgctggcatgctgctcactctctctcaatggagactagggttttccttcctatcacagagggatgaggcaatctccacccttgatcatgatatgaattaatggctcatatctgttggacttttaggctgtaatgtgctgagagcaaaggctccacgtggagagaatttagcccaacacagtggaccgactcaaccactagcagaagttgccgttgagcggacaagctgctggaagagggtggaaatttgaggaagggtgttcctgtttttacgcacccaccttagagtgtacttgtcaactataacagcaaaacgtaatggattttgcattttctgaactaaatagagtatcatctatcctgtgctatggaacaaagttgtgtttttttttttggtattttgtgatattggctgtccagctgtggcattaaccgaatgttcttggcattatccagccgtactatgttatccactaaagactaggttatccactaaaggttttgttcaatcctctttcttgaacgttaatgtatttaatcgtacgaatttggttaaatagatgctaatttttatataaacttgagtcaaacttgtctaactcagaagagttaaaatattttataatattcaacagagagaataataccaaataaattagccaaagttacaaaaaagaaacatgtttcacagtatcaaacaaaactcaaccattgataaacctaacatatatgaccgaagtcaccaaacaccacgcatgatctgacatcatctaccattcaggatacataaccttaacctaacatatgaccaacttttgtatgaatagtttaattcgcatgaatgcacacacgtcgaggggtgatggcgatttgctttcccccatcgtcaatatatatgaacagactgtgtctttcctgatgatgtgccgccaaataaaaacttgatttaattttcttttgcagattaccgctagcaatctccctatcagttcgacacccagcggtgtggaattcgtatatacaagtatggttcacacaacaagggtgcaaatatctttgacatgctcatgtttggccacttcagtctcatatctatggatcgaatcagtacggtattagttctcacattttgtgaattccaaacgaccaaaactagggttaaattcaaaccagaaggcattcgaacaattggccaaagctaaattcatgacctttcaacagtaaacaccttgtaatttaccgttatttttttgttgtttctgcagagtttcaggcttacattgctcaccgtgaacctctgtatcggatgtgcctttgattagtatttatttaaggatgactgaacatggcattcactattctctctgtctctttgtttactaaataatgtcccctgacaatgttatactagggactgttgggcagtttgtgcttatgcacgtaacacctgaattttaatatcactagaaaaaacgcgcggctttgcacgcgtggtacagtgagcctggcccattgggcctagtgaacaggtaacaaattaatacgcatatatggaatagccagattaatagtagagataactaaagcttatattagagcttataagttggctataagattgtctctatatttctttttcctctctctttatcttacttataagaatttaatgtgtttaccttgaagcatgtgtagagttagattttactcgaaagccaacactatatatatatattttaatctctatcatacacgtaagtttatagcccactattatttttgttctaagagcaaattttatgagcaagttttatagcagaggtgattgagaccaccaatttattcacatcatcaactaattaattaagatgtagcatatgtaataaattgtctctaacataccggctccaattttcatccaatccacaccattcttttcttggagtttgtgaagagattacccctttcatgaggggtggttacttctcacatactgtcttgtagctcgtgctgcaactaactaataatatgtagtctatttttcttcactctccttcgatgttctatagctagcttattgctttatattgtacttgttctaaggttgcattcgataaagggacaaacaaaggaaacgtccatcatttttcacccatatgtcggagtgtttttacataaaaatatctgtagaaaagttacttttttaaataatcatatttctatatttttcatgtttgaaacagtcctaaatcacctgatgaagcgataatggcacacctcttttacgtatctcattttttccctcttctctcaaatatagcctaaggtatgtttgtaacttaggaaaataaaatacatggaagaaaacatttggaatataaaacacataaatacaggtgtaaaacatagaaataaaaaaacatactccctccgagttgataatacttgtcgttttggacaatggtacggtcttaaaaaaacaactttgaccattattttttattataatatgtatataaatgttaacaaatatatgattttattgaagtactttttaagactaatctatacatatagtcaccatatttcaaagacaaatattttagaaattattcataaccaaacattttaaggtttagtctcacccttgtccaaaacgacaagtgttatcagctcagagggagtagaaagtttaaaaagattaatatttggaacgtaggattttttagtggatgatttaattacatccggctaatttattttaatccctaactaaagtaggtattattaattctttgatcctcaagatctggtggtgaaaggaagcaatagctgcctgcttgcctgggctttgccagccgtacggcggcaatgtgagaaatcagcgtcagcaacgtggtacagttcattgatcagcatacaccgggtgtttgcactacatgtatgcatagtaatggcgccggctcttctagaatcatcacacggcataattcgcatgggctaccgatcaatggcctattggggcctgattacggagaaatttctggaggcctgcacacacgcacgcaagagcgtttcgtcgatgcctgcacgagcggatgcgagatcgtttcgtcgagcctcttatgcgaaactggagttgccacgtggcacgtttctccttttgatggtttgcattgaattcgtattataagatatcaatcgcagtaatgtttagttactttgtcaaaattaaaatcaattataatttatttaacttgaatcgtaaaaccaaaaattttgcactccttaacaaacaaaaccatgcaaaattacgctccataagtgagacatatttattgatatgcgacatattgaaaaatcaaaatgaatataggaaattagaaacagattgttcagcatgtctgcttccaatgaagaaatcaattatctttaaaataaccgtaaactcaaattctgttagtagttttttcataataggacttgcttgtgtcaatgtcctgattaattttgaaatgttgaaacgactctggtagcactaatttacctccctgtccttccctgcattcctccaaccacatatacctgtgtttagttaagcgtaaagtttggattttggttaaaattggagatgatgtgactgaaaagttatgtgtgtatgacagattgatgtgatgaaaaatgactgaagtttggatccaaactttagatctaaacacaagcctaccgtcaactggaagaatagcttccagtgctagctagcagcagttttgatcgattctgcccccgaaagagaggtggatgcggatatgcacatgcaaatctgcaacgccatgggcttgcttgtgacgatgcgtacttgattgaactgacaaccattgcgtttgcgtcgaaagcagttttttcagactgccaaattgtattttcggaggtggtttctcgatccgaccgcccctatgggaatgactgttaaaatacatgaaaacaactacgtagtacgtacatgtaaaaatacatttccacgtgcatctccttaagatgagtgctatggatattttcgtaggctgatatctaaaacatccgactatatatggaaatgctctttccatggaaaggaggttaacatgcccgaccatacaatacttttcaatccaaggaaaacaattccaaattcacatccacaaattccccaaattcgtcctaaattccccaattgacaaattaatatgacagtctctatctatccatatgagtttgtctagaaagaaaaatctgacaactgcaaatggccacaatgacaaactctgttcccctgccaaataaaaaaaaatgacaaaaagataagttcacgaagatcactgctcttagttgaagtgccaaagattgagcagttcggcctccacgggctttacatccggagaggtcaggcctccagatctcctctgctatgctccttcttgagctctatagatagagaggacaattttgggaggacacttaattctcgaatgtgggggtgttgagctcgccgatgatgtttcctcactgatcccactaaagccaccagtagcctccacatcgagatccatatttaggactccatgccagatcgactcttctcgggctcccgggctcccgggctcccggccaggacaacatggaggagggtagcacggagtgttttcaatgcacaattgttttgatcgatgcaatttaaatgtcatgtattaagaccgttatgatctatcacgacaaaatgtttgattaagccacaacgttcaattgcggtgcataacaagagcagcactatgtttagcaaacatagattaaggatacactgtacgtgtaactaatcacataagaactgaactcactgaaatatagtcaaacgcaaacgtgggtttaaaacctactacttgatatacaaaagagcaaattaataaaattaagtagcattacatggca

SEQ ID NO: 66020 - DNA, 1693 bp, Oryza sativa
tattgagggtaagaaatatttccctatattcaggtttaataaataatagggtagcaatgaaatgctcatcactgccttcctcagcaccagcattaacaattaactccatgatctcagaaataccgcatcctacttcactgattctcacggatgtttctgaatttgtttgcttctcattctcaatgggatgaccaaaagctgaaaccacataatttttctgaggatcgatcaagttattcgggatatcattagaagatttttgtaattttgcctcctcatttcgcctattaacatccttatgaatgatcccagcatcatttgaagcaatggaacatttctcgataccaataatagcattgacaactttattagcttcagttcctggtaaaaccgaatccagcacgccgtcaaagattatatttagcaaatcaacattctcaagtggttcaaagtgaaaattttcacaatccgtcactgcctgaagaagagttgaaaggataacatgtcagagtaaaagtagaaaaaaatctagctatagatgaaaaggaagttatgcctagttgcatctaatagagcaagagagtggactatatttatccatagtcagctaccaacacaagaaaatatcactacaaaaataatactcacaagctccaacaccattagttttttttcatacagtagatatagctaaagtaattcggcgcagtccatataactttttacatttgttggagaaaataattatgaacctaaccatataccaaggagggtcagaactgaaatggtatatattaagagagtgcatgtcatggacattgagctaatcttgaaattatggaattaaggaagtactagaattgaaaactaaacacgagtaaaacttggtatttattatttccaatgtttaaaattattgaatcatagaagagctataataattgaatccaaaattaactctttacaatttcgtatttattaatcctagctaccatacttatttaatgaagaaaaacatgaaattattaattttaactctcagaactattaaatgataaaatacaaaggaacagaataaaagtataacatcagacattatatacagaatataatctataagatgtgcatttctttagttattactaatcataattttaaaatcattaataaattgaattgttttattttgtatgaacttaacattggtggttaatttgtagtctagagagaaattaaccagaactgcggaattctgatcaaacatacccagataaaatatttgttaaatctttagttcagatattttatttgttttcttttgatagcagctgctaatcgatgacataattgtgatacattttgtactctactgtcaccatgtcatcttataaactgctacataatagtattaaccacaaaaaaaaaattctagccatcattaacagcaaaacagtttggtgatggatggtcccagtgttaattgcatgattacctgagcaatgtgatgtactatcttatctgggaccattttttgcttgagcagatcacgaataagacgaatctttccaagtatttgatgtttcactagcctttctttatcccgtcgctccatctcttgctctcgtccagtcaatttgtagatgtcggctcgaacattgcgagcaatttcaaatgcttgttgacatttgtccga

SEQ ID NO: 66021 - DNA, 12815 bp, Oryza sativa
taaagtataataattagtgtaattttatacaatgagttaatctgtaaaatatattacaaccagtcaacaagaacttaattaatatacctcgcgcagtttgagaagttgatcccttgtgtaacggatttgctcagcaggctgaaaacatgaattcccacgctgcagcagatcactacaaaattaatcagcatggcaaaaggtacaaaccacataaaaagttggcaccccgcgtcttgccgcgggttttttagttttatcgttaaacaaaatcgtagttttaaatggttaggtgcaactctgtatatatacaaaatatataataatgtggctttatatatatcttatgttagtataatacaattcatgcttcatttttccaagcgtcattgtgtattgctataatatatgaatattattttcatgtgcaatatgggtattgttgtagttagacaatttgcatctctctgcttcattcaagttttttttatgaaaattgattcaggtaacgataactaataattatatgctatctaatcatgcatagtaaaataaaacacacatctttaacaataatttgagttatgcacaaaatatataacagtgctatgtgtgactatgaggtggagcaaagggaggtgattgtataactaataaatgattgaattggatgaataagtagcttcttgatcaaacggttgttatctttgtactaatgtgatctgatgtcttaaaattgttgatgatgtggcttcttgcatgtcttgctttatagaagtaaatgccctttactaggtatcaactatataagaagataatataacacgagttgcacacataaataatgatgcagtatcaagtattgtctcaagtctcaactcgttttcatgcttggctctcccattggatgagctattgcagctcttgctcctcaaaccactgctatccgaccttactcctgttcatgtctacccttgttatgcactacaagtatatcataggcattggctaatgcttcccactcaaaacatgtttgaattaagccaacaaattgtagtattcgactatcaaacttcaagacagttcagtttgcatggaaattgcctactaggagaaaggggctcttttgtttgagtatgtactgccaaatcgatctcttagtgccaaccgttaggtaagtaattaatggcattaccaatgttttggatgaatagggttataatagcaaccatatagacaatgcaaataattgcatattaacccaaacatttagcaggtctatatttaacatgtcaaatatttcatggtgcaagttcgggatcacaccatatatagaaattaaagcctacaatattttgaacaaaacttacctgaaaatcatctttagatggaacaggttgctcatttaattctccatggtcaaggaccgagtaaatgttcactcccgaggatatttgattggtttggagagagccatcccacttctcatgacctgagcctgaatttggatggtgaaacttgcaattactgccaaatttacagattccgcggttcatgtagtatgagcacaatccagtcccctgcggaattacatatatcatgttttcaccaatcaaattgtaatttatgaaatattgaaatggcagtattaaaggagccatgttgagatgaatgaagaagacaaagagaattaaagcttgctaaaaaaagatcggcttaacataactttgtggtgaaggaaataaccccacaagaaaagatgtacagaaaaacttacaggacgaagtggaagcccaagaaagttcagctttacatgctcagcttcactttttccttcactatggtggcagtggcaagctttccaaggaaaatactgaaaaacactttgtttaagaaaaataatacttccttctaatgacgtaatatttatgcatacattgatttctgaatgtagggatgggccatcgtgcaaaatataaaagaagatttttttacaaaaatgttttgagccgatgcttgtgatttgtaaagaactcgcatttcctccatccttccctttttgttctgactgaattcacagaattgcaaatttagtaactaaactatcgactacaatattatatagtcattttcaagttaccacaatgttagtggacgaaattatcagaaaactgtaactccactacgacctggattactttaaataagaaaattgtcaactgaaaatgtttgatatataccaagcttgtctctatcaaaaagtagtttgacaactttaaatgttcattttatccaaatagatcctagcactccaaacacatattcgggcacgtgaatatcttaatgaaaatgtcttgaaattagacgttataggtttttccgagctcttctaaaactgttatgcaaaccttgttttcatctgattttatatgaaaaatatatcaaacgttgactaatcttttttgaagggaatgttgtccaaacattagcataccggcatgtttacaaacattatatagcatacctgaatatactcccttcattaaaaatatttttcatagatgacgtcatcatgttatgacattatgtttaatcactcattctattcaataaatttataaaaatgttatttattttattttgttgcgacatgttttatcatttaataatgtttaagtaagacttatacttgagcatgtttgcactaattttttaaataagacgaattgaataatcaaacattattctaaaaatcaaccggataagctagagaatatgataaagctagcctatattcaccgagcaaagaaggccctaataacgaacgtaccacttgctgctgaggcaggcggtcgggagggtggttgaacctgcagttcatcccgtacttgcatctcccgaacctcaggtagtggaggcagtcgtgctccccgggccgttgcgggtgctccagcttgtcgcaaccgccggcatgcttcgcagggtggttgtacaggcagcgcatcccgaacttgcagctcccgaactccacgtagtagctgcagtccggcactccgggtcgccgtgggtactcctgcggctcaaccgccgccttcggttccgtctcgccggcgctgctgctggtgccagcaggccgccggtcatccaatgtcttcaccgtgctgctggcatgttgctgcgagggcgtcggcgaaatggcggcgggatcggaggcggaagaggaggtggtggtggccatcggagtggaggaagaacggtggtcgctgttgcaacactcgcagaggatttgcatcatagctcgatctctctgtactatgtctcttggttggaggagttaatttggtttgcttgctgcttgagagagagagaggtggtgatcgaggtagctagagagtggtgcgtgttatagtgagaagaaaagggggcgggaaaggagaaggtagcgtatgtctttcggccaaaatgatgtggcatatgtccttgttccttaacggtggaggactgaaggatgtgcatgcatatgcatgaccagttggtccacttaggcaagcaggtaaaagggaatgggagggaactaaattaagaagcgtatagatcgtaactaactgctgtaactcattaacactctctctgttaatttggcagatatagtttcatatctgtaatagtaattgcgttatggccaactgggactgtctagctctcaatgatcgacctgaaaatccatacaaatttcagtcacttttcaaccgtccaggttgctcgaatattcatgcgccagtacccttattttgatgtcttctcttcccctctgtctctctccccaacacgagcgcttcagatcgagcgtactcatcctcgagcgccaccgtctcgcccgttccagcatgccaccaccgggcttgctggctgtacgttaaaagtgcttacgagtaacgaggcccgcgaaaccggccggctcctcctccatctcttcttccctaagccggtggtggcaccattgccctgcatcgccctggtacagattggttatttggttaacgattgatactatagttcaggtagctccataaaaaaaatcgtaccatgattttatatttaattcaaaaataaaaatttgaataatccttttgctaaagcagagaaattttgaaatttttgagcagaatcagataatagaatatatgaaaactagtgaatctttaatataatatctagaaattttggtccaaaatattgaaacctacatcctaatgtaccaataaaagtgtgtagcaaccggcaatcctaagtactgggactatacaagtggaagcaacttgtgcgcaggccttcttctgcattaggaggcactagcaataatatagaacctacatgtcaatatagagtactgcagggatcctgttccagtgaaggttgcctctattcagagttgtcaaggggtggtggcaccctcgttgtggtgggggaggactggaggaggtagtttgtggtaaagaagcgtagggaggttttcacaatatggctgctttccaacagaactaaataaaacatcattttccttcacctccaagataaattgttctaggtaggatgggagagtggtctattctagtcactgatataatatactcgtgtgttgcaatgggccagacccatacaatttgggatgggctaggaaggtcaattgagatggatagggaaggcggattgaggataagcaccggagatggtggttacgaacatgaaggtgtgaaagatacaatgcacggcgatagtaagaagaggtgatggaaggcgaacgactccgcttttaattagtagagatatgcattgggcatcgtttacagtttcaatgacgaaccatcgaagtggttctaatggtccaaaccattataagttagggacaattacgttcttgacactacttttagatgtaattgtgatgttctcctaaaataggtttgtgaattttcctctgcttttttaaaatgaagttgccatataccccaactctggatgaccatttggtaggcctccaataagagattgtgaatattagataaaattaactgagaatatatgaaatgaccattataccttctcattgcactcatattggttgaaatgaccattataccttctcattgcactcatattggttcacctgatccccattcctaaatcaagcctaaccctagatatagtggtaactttggcggctgtgcacgaatgagccagagtgaaagtagaagacgaagtcccccaaaccgcactggtgattgttggcgtaggggatgtagtcatagtagtcgtgcggaagaagccgctagctttatcctaaagggttcaccggtgatcagcagcaggttagcggcgaccttccggttgccacctaccctgctctgggtcagccaaatgttctccctgtaacgcttaactgattggatagggtttagggttttcagggagaagatgatcctggagagatatgatcatcatctgtccacgacatcggtctcccctataaatatggcgctgagggagaccgggcgcaatccaaaatatggaaggttttggcgctaccgatcaacgtgcatcattaaagaaactaatagtgatttggaatgagtagattacgcgggcatggggtgaaaattaaccacgcgtgatctcctccggttttcttgtcgagagatcaaattttgccagcaatatatccatggcttgcttatggggagcacagtgaaaaattaagttattaaggaagaccaacgcaaactttggtagcaaaagggcccgtatacatgccccaccacaggagacaaagtgaaaacaaatggaaaaaagaaggcaacacacgaaaagtgcttttgaaccaaaccgatttccttttcactcttgtatttccttaacgcccaaggacaagctaacttcaggctttcttctttgcagatggctgagccaaagcacacggttgagcagtggaaatctctcctcattgtatttttttactactacctccatctcataatatttgtatttataggattcaaatttatcccaaaataattatcataatagagtactaattatcatattagtcacttctcgtttaagtttattgctattttgccctagtcattgttccactcttatctatacatcatttaaggaaaaatttgctacaggacactccaaaaatatgtaattagctgtaggacataaaaaaacatgaatttgcccgaaaacactccgaaagtatggtaatttgctgcagtataccgaacgcattaaaatataatattcacccaattgacgagagagaaaccatacaaaataacatatttgcccttcttcttccgacgctcacttgcagcgagctccattggcttgcccatggcggacaaccgctcagtgtagtcgacggcgcggtcgtgcggcatgccactgtcaccggcctcgtccttaccaccaagtccccacctgaccgcgagcgcgtcaccgagctcatctcccgcttccgtggcgccacaagctctggtggtctcctcgagacgttgcacgagctcagggacgtggccgctgtgagcgagcctaacaggaagctcctcacggccgtccccggcacggtggagtgctggagtgatcgattgacaatagcaaagattcacatatataggaactatccattttctgctgatggagtgatggctggttttgcttgacttgttgcttgctgagttgctgctgcacctgcaccgctatggcgccatgcgaccttggctggtttgccattgcctgctagcttgccaactaccatgccactgccgccgccaggaacccggcggcctcacccctcctagccttcgcctgccctcctgcatgccgcgccggctctaggctccacagcagccgccgttcatcgatggggtgacgaggatttgggtcgtgtcacgtcctgataaattcatcccgaaataaaaatcattttctaaaagaaataatagaattaattaaaattcgaaaagaaattagcaaacactaaaatacgtacaagaaaaattcgaatgtggcccggagaatttttgttaaattctccttggtctaaaatgagccctcaaattttacttgaattttcagagcaccggaaatatttattaagcaacaacaacaattatcaaagtttattaaaaagaaaaacctaaaaataatcctccttcctcctttgggccaagtcctccctctctctctccctcggcccgcggcccaagtgctctcttcctccctctctttctctccctctccttctctccctccttctcttgggcctccccttcctctcccggcccactcccttttcctcccctcccgcctgggccacctcctggcccaagccgccccacctagccgccccagcctcccgagccgcccccccccctcacgcgcgccgcacgcgcgctaaccgcgcgccccgcgtgggtcccacgcgccgggtcgtcgtcctcctcccgcccggcctccttcctctctctcccgtgaaccctagctcctttcctccctcaaatccgtgcgatttactcatgggattccaaaattaaatagggggaattaatccccattgattcctctttgattccccccaatttccccttgattcgtgtcctctaacgcccggaacggccgcgccattcccggccgccttccatggccgccggccgtgtttcccgtcgccgttccgccctctcccatgcccggctccctcccccatcctataaaatggaaccccctcactccgttctatcattttagccccctcccgcgctctcccgtggcctcaccacctctccccgccatcctcctctctctcccgtgccgccggccgcctccagccgcctctcccttctcgccggagcgccgtccggtcgcgccgtcgccaccagcagcctcgcagccgcctcctctcccccgggccgtcctccgtttagcgtggagagcaccggaggcgcgttcccgccggcgttcagtggcgtcgccgccactacaccgtctccggccggctcctgttcgtcgccggtacgccgatcgatgcctccgtctcctccttcgataccacggcatcgtctccttccccggccactcctcggtttcgccggaacaccgccgtgccgcgccggcctctccatccacctcgccggaatttccccggtcggcccttcctccacccgtgcaccgtcggccgcgccaccaccacctccggcatcgcagcggcgagccggtgacgtcgtcctcggcatcgcctcctctccatcctcgtcgttgccgacgtcccttcggtcggccgctcctcctcgccggctcctcgtctcgttgtgccgccaccgtcgtgggcatcgctgcggcgtgtcccacgccggcctcacctctgtgcagctgccgccggctgccatcgtcgtctcctcgccggccccggtcgtcatcgttgtcgtcctctcgtcgttcccggtcgtcgtggcgttcgtccctctgtcaagccgttctcgtccatcgtccgcgtccgtcaagtgtgccgctgcagccccgtcgtcttcttcgtcctcgcctccgcgtcatcaagccctgcgccggccgcgtctcgccttcgtccaaggatcgccgccgaagtcgttccctcgccgttcgcctccgtcgtccccgagccgtctccgccgcgctcgttcgtctttgtcgttcccacgcctcgtcgcgtggtggtaaggatctctccctcgtcgccctcgtcctcgtcctttcggtgtcgccccgtacccgttgtgcggctgtcgaccccggtacccgtgtaccggtgtcggtagtcgttcgcttgtgcgtgtggagaccgtgttagtgtgcccgctcggtagccacgtggtttccacgtgtgcagcccgcgtggtgtctggtggagtccgtttgtcggctactcgcctcagttgatacacggggtccgctttcgtcgacccgcggaccgtctctgtgtacccggtccaccgtggtcccttaggttgacatgtggagtctgcatgtcaacaagcgcagccttcctgtcttttccaggttagcgcttacacatgttttataattgcaaaacctaatcacaataatctgtaaatcttcatataacagcattaaacttcggatgatcatatcttggtcatgcgaactctgaatcgacccgttcaagtctcctaatgtttgttataaccttaagaaccctgtgctttctttttatgtatcgttattacttctttataggcttgtagctttgcttgtgtgcttcgcgtagcttctgtcgttccggaggttcctgaagcgtggtttgcggttgtcgccgaaggttcggaaggccgttctctctgagtaaggtaaatcacatcatcctttagcatattgaatcctagtttgtaaaattattttgatttaaattaatgcattatcgctttatttaaattcccgcgttatcactgttttatttagccatgcctatttacctttgttatgaccttattattattgctattgtttattattaccttgttcaccctaggaaaataaaaccccaactagtgggtactctattcatggttccactagtatgaatttaggtagatgctcgctgaataattaggcaacattaggtggttttataactttagactttagggatgctcatatcatttggacactgtggaatggttggcttgtgatggaattgaacacacacctccccctctattcaaaactcccaaaatggttttaggctgagctcgaggtgcagggttttgttagtagcacctcggccactataaggaccggtcttcgggcctctgttgcaaagcactaccgtactaaccacatgtctaatgggtaaggcttaactcggtgctcagtctagtcctgaacaaaaggacacggatagagatggatgaagtcgttgcgacgatggatatctctaaggcaaatgaaggctacgcgagctgcggctcggtaatcgagatgtctaggcaaatgaagactacacgggtcggtgcccgttagtcgagatgccatggcactggactagtacgcgggtggtctcacccctatgtgtgtggcgcacccggtctagatcttgttgctaggggctcaatcctagcctgcctgtcccgggataccggcagtaggcagggttgggtcggtacttttgttcacggctaggatgggtgaagggttatgtcacatgtttacgatgggttccaaggccatggaacgggagtaaagatgtgtcttgtgggtaaagatgtacacatctgatcagagtaaatctattcgaatagccgagccatcggatatgggcaagcctagcaatgtacccaagttagtggtttaattcttaaaatttgcttaacaactaaaatgtggaaaggttggcctgggttggcttgggacgagctgggacccaggtcgggttgccaattcggtctgaatcatcgtaggccttgggttaaggcaagttcgtgtaggttcacgtccttgattaataatattgtgtagctcttggatcgtgtttacaaaatagctttgggcaactaagtgacttttaaatgctgtttactgtaaaacctaacccctattattatccccttgtacccccttgcattaatcatgcatctgctggtgtggcttgctgagtacggtggttgtactcattcttgctcaatctttccccccttcagtcagagaagctttggagaagaagtcttagatggagtcctggcttataccccagttgagcgcctgtgaagatggagccgtaggcccgctagtccgctgctgtttatttttgtttgtcaggcctgaagtgcctttgtaataatgtaaatattatcgatataataaagatgtgtcttttatatcatgtttgtgtggtgtaccccggcttttcctgggacggggattaatacactagcgttcgggaaaatgaaaattttctcggtcgcgacaggtcggccggtcggggatggattggggaatcaatggaggattgggagaagaagaattgcaaaacggtcattttgtgtggtttctctctcatcaattgagcggatattatattttaatgcgtctagtgtactgcagcaaattaccatacttttggagagttctctggcaaattcatgttttttatgtccgatagctaattacgtattttttgagtgtcctgtacaatcatttaatgaggagcaccatagtatttcttctcaaaccttaatatatgctaaacaatctagaattactattattttagaatctagaattactattattttagaatggaggtagtaatacattatattgcaaattctcttaagtcataccatgaacaaattaaattttccttcacactaaagattaaattcataacaatgaacattatatattaaaaaaaattgattgagttgaaagttctcaaaaaattttagttgaaagttttaagatgagttgaaaaggagaaaagagaggagagggatgatatagaatgaccgggaaaaaagaaaaggagaaatagaaaacgtaacaaacaagagaaaaaaagacaccaataagaagagggagaggggcatgcgagacgaggcgatagaatggtgtgggtcgattgggttgggttgtgttcgaaacgcctaattggtgaacagtcgcgcgcctccctctccgcgcggcgaggccatgtggcgtgcgtggagagggggcggcggaacggcgcgggagggaggggtccaggtacgatttttttcattttttctgttttttttcttccgtacgtttcagttttcgttctttctttctttctgtttgtttctttccgtattttttttcagttctttttcgttttttaatacgttcttgaatacatactttgtatacatatattttttagtttgtatacatacgtatacaaatttatatacacgtattttttggtgctttcatacgtacgcacacaaactatatatacatgtgtatattttctatacattaaaatgtatacatataaaacaatatatatctatacatacgtatgtatatactgtatataagtacatataaactttgtatatacgtatacaaagtttatatgtatgtatatacatatacatatagcagtatagtagtaagagagactagaggggggcagctgattgcgcgcgcgactagtcgggggtcagcgccccctggttgtgttgggctgggaatagggtgtatagtagttattctaaagtcatacgagtgatatgaaaccaacttaaacacagatgacgtattaaaaattcggtaaaaatactatcactttttataatagttgagataaagatagtgataggttaatatgatgataaagatcctcatggaattgctaaaactaatttaaatctcagcgtttcactgatcaacctaatttaggtcgggccaatgtctatcaaccaatctaagctgtgttcgcatgagtgggatgggaacatattccctccgcacggaaaacggaacgatccattagcgcgttattaattaagtattagttattttttttagaaaatggattactttgatttttttaagcaacttccgtatagaaactttttgcaaaaaacacaccgtttagccgtttgaaaagcgtgcacgcgggaaacgatggagagggagttgggaacaagggcttgcaacacacagtttacgtacatctctgcatcccagtccaccacctccacttgaggctactggcgatgaattcatcctcatcc

SEQ ID NO: 66022 - DNA, 8949 bp, Oryza sativa
cttgggtattacgtttccttttatattatggagcggcctaaagtcctgatttgataatattgtaaaatagatttaggaaaccgatatcgtattggttaaggtttctatcttgtaatcctgccccccatcctatataaggtgggcaggaggccctctagggggcatgagacaacctgatcgtcagatttatactatactcggcggattcaaatccccaaacaggagtagggtattacctctcattgagagggcctgaacctgtctaaatcctttgtctctgcatccatccacttttaggtctcttgcgctacccccttttattattgccgaattcatgtttcgacagtcggcgcgctaggtaggggttgcgtcgaattacccatctataagtgtgatggaatcaacttcagaacaaatgctcagatcaatctgatcaagttcgatggcttgaatcttcaatcccggtttgtctgttctaatctgatttgttgttattagattgattaatcgcagattaaactctgggtatcttttgtgtttaccttatgcatgattgttgaaatcaaccgtcatcgccggctcaccttcatgtcgtgtccgcgtgatcttctattaatgagatccgccggcttcctccgatgacggcgttgtgctgatggaccattaagctagccatcggctacagggccagatactcagatttggtgatggttaatttttttttaattaatcaccgctggcaagccggccgacgccgacttcttctgcaaatcgatgaaaaagcagacagcatgcaccttaattatatccagatcattaattttctattgctaattggattgatttctgattacaaattaattaatgcttttttggctatttcgttggcatgtattcatgtactccgtatcaaacaaggaccatggtgggcagcttgttcggcttcatgacatcatctccgcccagcagatcagatggatccgcctgatgcgccccacggcagcctccacgctgcaactggtgctgctgcctcggcgtcctccctgcgattttcctggagtgaatacatgcatgagttgatccatcgatcaacgtgcactatttacttatataatcacgcgtatatttgcatggatttcttttgagctgaccgcatggcaaatatcgtcacggccacaactagaaccatcaattcatcgggttctttccttttaacttattattctatattattagattgatttttaatctcagattaatctcttgctattttttttgttgttgttcacatataaaattacgcggcactattgaggcgattgatgctggtcatggactcgaggcgtctcagctttccggtcaatcggccgcgagtccactccgccggattgtcctcgccaccgccattgctgatagcaacaacgacttcaccgccggcttgcctccgtcgccgccgactggtgtctccgcctacacggctggcctgttatgctgccgtcattgggcgtttacgacttcaccgccggctcgcctccgtcgccgccgactggtgtcaccgcctgcacggctggcctgttatgccgccgtcgttgggcgtctatgacttcaccgtcggcttgcctccgtcgccgccgactggtgtcaccgcttgcacggctggcctattgtgccgctgttgttgggcgtctacgacttcactgccggcctgtctccgtcatcgccgactggtgtcctcgcctatacggttggcggactccgcctccgttgatgggcctcgtcatctacactggcttgccttcatcgccgctgcctagtgttttcgttgctactgatggacgactttgtttccacattggccacctctatcgtcaccgagggaaatatcaaaaagctaagtcatcactaattttcttttttatatgatattttccttttcctctgcctcactacgtcaactggttcgtcgttgcctagtgagtcgggggctacagatgttatatcaatattttttcaacaattttcttaatatttatcttgattgctcgcgacataacctgagtacaaaagtgccaatcgagttatggagtttcatcttcctatgctttccgtttggtttgctaatggatagttgcctttgggctgattcctagcacccgggggctcgttggatggaccgaataacgcaaggtgctaagtattaatcggaataaatcaaaagcatatagataagataatttattttctgctctttacagttacaaaagtacccgagtagtaaattctgattcgtgaaactttgttccattaatgacgaactcatgtcactcatatgcatgtttgggaagtgcctaggccgactcccggtgcttgggggctatgactactcggacagagcgtttaaacgtaatgagtgatctgctcggggaaatcaaaattgacaggaggagaaatacatatttataaacattttaaaatacttttatttttctcgagtattatatttacatcagatactactcatcctatatgtttgttctgcaggatccagatccagatatgcacaaaagggattcatggctttaagcttatctcttacgctcctgtaagggatcagtcagaacatcaccaacggcttgccgtcatcgccgccgactgttgtcttcgcctatacggttgtttggtcacaccaccgttgttgggcgtctacgtcttcaccgaccggcttgccttcgccgccgccgactgttgtctccgcttgcacgactggcctattatgccgccgttgttgggcatctacgtcttcatcgaccggccgcctcgtccgccgccgactggtgtgtccgcctgcacggctggcctattatgccgtcgttgttgggcgtctacgtcttcaccaaccggcttgccttcgccgccgccgactggtgtctccgcctacacggctggcctattatgccgccgttgttgggcgtctacgtcttcaccgaccggccgcctcgtccaccgccgactagtgtttccgcctgcacagctggcctgttatgacgccaactgatgctatcttcttcacggctggctacgtcgccgtcaccgctaatagtttattcacttccatggctgcatgattctgccagtgttgattggccttatcttcatgaccgctggtcatctcgtctgctgttgactagtgccctcgcctctacatctgtttataccgctaccactactgatggacatcatcgtcttccgtcactgactggttatgccgtcgccgactggtgcttttatcttcacaactgcgcgtcttcactaccggtttgcttctgttgccgccgactcgtgttcacttcatcacggcaatgcaactttgtcatcatggtagagcgacttcatctttattatcttcggcaccggcaaactctattgccgatacttcgcaagttttgctacttcatcaaccacgacgtctttgtgaacctcgacatctcggcatgcgatgccgtgttattttactacaacaagtggctctccaatattcaggatttttacttggacatcttcaacacatatcttcaatcaagcaatgactactcgacgataagaagctataattctcgattctatgttcagttgtttcccaactaaacaaatagtcgggggctacacaaatatatggctcaaaattcgacaagctttatgtcaagatgaagcaatcaattaatcagccaacgagtcaactctgggagtcatcaattttgtcttcgcttcaaagcagttggttaaaattaaatttacatgtctgggagtttggagtcatcaactaatcaactcatatcagattcaatgagttgaacaacagcatatacttttctctaagtgaagcatctgcaacagctatagcaccaagttctactgccatctttataaatcaagaggtgttgcatcaatcttcatcacacacatgccaacattaagaaaatacttgagcttcgatatcttctcaacaatttaatggattattgtcactgacatcatcaccagcacctctgcttcatcggctctgacattccgccgttgctaatggatgactaagacttcgccaacttgctatttcgccttcacggttgacctactatgcaaacgctgatgagcgtcttcgtcattatcatcggctactacaccgctattgactggatcaccgacatcgtcatcttcatcaacatcctgtcaagcctcttcatcatagcttactctactgctattgatggggaacttcatcatcatatttgatcatctctgttgatgcttatcatcattactgtcggttacgtttgtcgtcgccgactattttcttcatcttcatgattggtggatttcgtcatcgcctttgatctgcctcgtctgtcaccgactgattatttcgctgccatggctacacaactttatcgctgggcaccttcatcttcattgatggctgacctgactgctgccgactggtttcttcgcctccacggctgtgcaacttcatcacttttgattggtatcactatcttcactaccactaatatttttgccacctctgctaggcaatattatctctatatcggtcgtcttatctctatgccaactgcgtcagctaccatcaatgaacaattgtgactacgtgctcaggggcttactagctcaaacacaagtattataccttcaatttggacttgctctggatacatgcaatatgaattcgtgatcatgggtctattttctatgctcaaagactggactatttattattccccataagggttacaaacgaatacttgcgccagtcgggattcaattattatatctattttggagtattccataagggataatcactcagatcagaagctattgatatgagctacacttggtctatatcacccggaagatttattactcgggagcatgttatatgcgtcatcctttaaagggtgtcgaaggcatattttttggcctaggcctaatatgtctgcagcccatattttcaggtgtggcctgtcacgttcttttagggacttaggcactttttgcttaggccaaagtgcgcgtgatcaagtgcccaataccttaaaatccttttatatcgcagttactcaactttttaggagttggtacaatgcatcttaaaaggtgtcaaacagtaaagctttatatagctgccccgctgacttttttatatagtcaaggcactatttgggtttatcaagcaattgattggatacaatatcgttgctttttgccacgtaagtgtgcatttttattgaccaatattatggcttaagctgattatacattgtggtcattttctaggcggttggtaaatcctttatgagtttatttacttggattttacaccacatatgccatatatttccaggtgtggtgaaaccatgtgtcttttagggactaaagcacgtctgttaaagcagtgtgcgcatggcgtatgcccaatactttggaaatttctttattcgcagcattcaagtttctttatagctgttttgctatgtgaattttctatgatgtagttaactttaggttgctcacatcaatttttacaaagcagtcggtatatcactcggttcatgttatttagggattcacaccgcatatgctacatattaatatcaagtcgcttggttgaccataattattgaaaccacttggttggttggataatttattccttgactatatgcttggtttgttcaattaaccacatagtcgggggctacacctatgaggtgcatctagtcgacgcacctgactttatttttcagccctccacagtcttcatatttggtaaaagtactcgggagatcatggcgaagatgattgaagcactcggctttggagtaatctagtttgagaaaagattatcttttcgactgtgaaggtctcaggggctactgtggagattatgggtaccccatacccacacggcatggttatccgactagtcataggggatagcttatatctatggaatatgtaacagatcatgacttgggtattacgtttccttttatattatggagcggcctaaagtcctgatttgataatattgtaaaatagatttaggaaaccgatatcgtattggttaaggtttctatcttataatcctgccccccatcctatataaggtggataggaggccctctagggggcatgagacaacctgatcgtcagatctatactatactcggcggattcaaatctccaaacaggagtacggtattacctctcattgagagggcctgaacctgtctaaatcctttgtctctgcatccatccacttttaggtctcgtgcgctacccccttttattattgccgaattcatgtttcgacactctcgctgtcgtcgtcgtcgtcgtcccagcgcggcttgtccacgcagtcccgcaacgctgtcaggaggtgcagcttgcacccgccggcctccatgtgcttgcaggttgcggcgacgtcggcgatgtaggagacggctagagcagcatcccacgagactgggccggagcttccctgtcccatggccgccttgattcacaggcttaatgcagacgggttagctagggtttgtcggcgttgtcgatctctatggagatctgaaatattttgttttgtcggcgtggagacgaatagtgtaatatatatatgtaggaccctgcagggaaattgtattgttgcaggaaacctttggtaattccctaccgtgcacggacgacatgacgtcaagctacctgtaaccgatctgcatatccatgtgctgattaattcggactctactacgaagctggcacacataaacattatgttatgtaaccactggaacggatatcctcatctcaatcgggcggtaagccccatctcaatcggacacagcgtccgtcacaggctagaagtcactgatgtgaagagttatctcaatcgggcaaacggccgtcacggatgaacatatctcaatcgggccctaagtaaagctcgtcaccgatagctttgacccagacgaccagtcaaactatagcccgtcacaaatgacctatcttaatcggaccacaattagcgcccgtcacagatgactactaacctttatcaggcctaaactagagcccgtcacagatgactgctgacctcaatcgggcctaaactagagcccgtcacagatgactactgacctcaattgggcctaaactagagcatttagttatggcccatcccagatgactataatccacaaaaaaaaaaaattttgttttttggctagtctcaggcctttgctagccatgcccgctgcagaaatgacagaaacaaacacagatatccaatatccccagctccccagcatcacccattcatatacatatgcattcacatacacagacatcaatatatttcacacaaccacacattcacagccatcacatatttcacatccattcacatatttcaaatccattcaaatatttatcatatttcacctgcaaaacggagttaattggatcaaatatttatttagcaagtcttaacataaacatatgaaatatatacataaatataagcatcacagttacatcatcacagttgcataataagtgttcacaattgcctaaacataaaagttcaacattattcattattttagtttaagcctaaacattcctttggggttaattatttcgcggaggatgaagctggctatctcctcgcgaacctcctcaaagctggtaggcagagacttggttattgtgccctacattgtcataatttcagattagttgatcgatcatatataaggactaaaatgtagttagtctatcacaagagaccaccgacctcaaactcagccaaagtcttcaacttttctctttacagaaggtgcatgttgtggcacacatggaatccgcactggtcacctatttgtggatgagggtgtcatgtcctgtcttctgaggcttcctctttacacgtattgggcccacgcttcatctatcgctagttgaattggggtccaatcatagtttaggtagtgatatgtactccacttaggtgttatgaccagaaggatccaatgggcactgcggcattaatatagtgaaagttaattaagtactgaaggaatgtgtcatgctattgtgtatatttagataacacacttactattgattataggcgcacataatgtacttcttgtctcggcgggaccacaaggtgtcgtagatgtagttgaccattccttgacggtcattctggagatttgtgacagtgaccacttgtggatcaaggaaggcaacttccggtgcattcttctgacaccattgccaacttaacctacacacaggataaacgatcttataagcgagttaatccgattgttattaccagattgagttgggcgacaatacttacaaggagtagcacttaaggaggcttgtgtccaccgctcggagactgtagaggtcgaatagatccttgaacgttagccaagcaatgtccttctctgcggccggcacgagcttgatgtcatcttgcataatactaaatttctgcctccctatgaccctgcagatagacctaaatcggctcaatattttctttggagatgtcggcaaccctacggcgtccgccgatgttatgcggaaccgttccttagggattttgttccctgtcctaggagtacgtgccctagaggacccactagttgtcgtcgacattggttcgccttgctgagacatcgtctactttttttcaaaacaacaaaaatacacaattcagtgctacaatctattacaatgaattgaatgtcacttataaataaatgaagcgtataaataaactaaattgcacatctcacagtaatagaatgaattgaatgtcacatataaataaattaaacagggctgcaggaa

SEQ ID NO: 66023 - DNA, 1926 bp, Oryza sativa
tgcaggtagcagagggcggcgcgatggaggactcgcctgaggtcggccgggggggctcggtggtggcggcgctgggctcggtggagggcgtcgccggtcggtggaggagacgccgggctcggtggcggcggcggcaggctcggcgaaggaggagtttgcggcggtggcgccgggctcggtggagggcgtcgccggtcagtgtagacgccggtcggggaggtcggcgtcgggcgggcagcgtcgggcgtcggtgaggagtaggcgacgacgatgaggaaggacgtcgccgggcttggtgggggcagctgttcgcgtcggggaagaggcaggcgacgacgacgaggaaggtcgacgccggtcgatatagaggctcggtggcggcagcggcgggctcggtcgaggcggcggcctcggcggcagcgacggcgggctcggtggcagcggtggctcgctcggtggcggtggcggcgagggaggacgacggcggcgaaggaggagttggcggcggcgctagggttctaaggaggcgggaaattgtagcgggacttagaaaaattttcgatccgatctgagaaaccctagttataggagagtaatgagtcatctcaatcgggctttgccatagggcccgtcacagatgactcatcggtgacgggctccatactaatgcccgattgagatgatattcaggcccgtcacagatgactcatctgtgacgggccctaagataatgcccgatagagatagattaatctctatcgggctttaactaaggcccgtcaccgatgactatttttccatttttccgaacaagtctttatatttgtgcgtacaaaatatatagctgttgtataataattcattttattagtcataatatattttaggatactaaatgatttcaaatcgaaatatggttaacaaccaagttgtagatcctttcaagatctacaacttttattttggtcatttgtctatataactttgttcccaacagcttgaaattgattttgataaaattttaaatctaaacagcatttgtaaatactaaatgatttcaaatggaaatatggtcaacaacaaagttggtcctctcatcaagatctacaacttttcttttggtcaattcttcatccgacaaagtgatagttatattattcacaaaaatcacatttctctcatctggtttgtaaacatcaacacatatatgtcaattatgtaaacattagtactatcactttatcggatgaagaagtgaccaaaataaaagttgtagatcttgataagttgtacaactttgttgtttatggcttttccatttgaaatcatttagtatttacaaatgctgtttagatttgtcatattgtcgaaatcaatttcaagctgctggaaacaaagttatatagacaaatgaccaaaataaaagttgtaaatcttgatgagaggatcaactttgttgctgaccatatttccatttgaaatcatttagtatttacaaatgctgtttagatttgaaattttatcaaaatcaatttcaagctattgggaacaaagttatatagacaagtgaccaaaataaaagctgtagatcttgataacctctacaactttgttgttgaccatatttcgatttgaaatcatttagtatccgaaaatgtattatgactaataaaataaattattatacagcagctatatattttgtacgcacaaatataaagacttgtttggaaaaatggaaaaatagtcatcggtgacgggccttgacttcagcagtggggcgactccactccacaggcattccttgacggcagcgacgaaaccaacttcaacgaggcaactccaactaggaagatcttcagctctagtgtgggggaaaagagagcaagactgtatactacccactgtactcagcaaatcatacca

SEQ ID NO: 66024 - DNA, 5491 bp, Oryza sativa
cacaccttctttccaaagaatctccagatcgtcgataacaggctccaggaatacatcgatatcattgccgggttgcctcagaccttggattaacaagcacaacataatatatttccgtttaaagcataaccatggtgggaggttatagttcgcaataagaactggccaagtgctgtgagtactactcatgttaccgaaaggattcatgccatccgtacacagacatatcctcatgtttctagggtcggcagcaaagtctttgtgttttcgatcgatattcctccattcaatcgaatctgctgggtgtctaagcataccgtcattccttctctccgtggtgtgccaatgtactaacttcgcttcgttcgggttggcaaagattctcttgaaacgatcaatgataggtagataccacacaacctttgccggaccacccctctttgacttatttccttcgtcagcacttttctttcgcttgtatcgagaagccttgcagacaggacaagcatccaagtccgcatattgcttgtggtacaatatgcagtcgtttggacaagcgtgaattctacggacctctaaccccagtggaccgagaacctgctttgcttcgtatgtcgtctcgggcaatgtgttctcaataggaagtatagccttcaaaattcctaaaagatctgtgaaactcttgtctgtccatccactacttgccttcagcttcattaggtccaaggtaactgacaacttagtgtgttttgctttgcatccagcgtacagaggcgtctcggaatcactgaccaacctgctgaacttcattccatctctctcattctgggctgggtccttaatgtcacataacatgtcttgcagcagatcgtgatccacatcaaccatttcaccgcccaatggagaaggtataaacatgtcatgctcatcttcatctttctgattatgcgcaccacttctgtctgctgctgctccacttcctgattcttgctctccatacttcacccaacatgtatagcccttcatgaatcctcgttgtatcagatgaccgtgtacgtcctctccgctatcaaacatattctcattcttgcaatatgcacatggacaacacatgtaatcattgtttcttctattccgatcctcctccgcgacgttcataaaatttattacgccctttctgtactccgtagaatgatgtttcaaattttttgcatacatccaacttcgatcaattgctacaaaataaaaaaaacaaattacatgcacatcttataagatcagtattgcaaaagtaagatatgatgaaattgctcaattaatgattaattgtacttaattgattgatccattttgatcacttttgggaattttctgttttccttggaaaaaagacaaaaaatcgccccctacagcctcccaccaaaatagttaacagtgggatacagttacactaggtggttgggggtatttatactgtgcaacaaatatctgtaacggttctaaaataatcaatcgtgacgggcatacaagtaatctctatcgggccttaataaaagcccgtaaaaaaagagtgccatctgtaacaggcattaaacttatctcaatcgggcctctagttggagcccgtcacagattaccctcttctgtgacgggcttcttttagggcccgattgagatatggaaccctcatctcaatcgggcctcaactatggcccgtcacatataagtgtcatccgtgacatgctttagttttatgccgatataccatggttgtgcgaccatatctcaatcgggctgaagtttcagcccgatcgagattacttccttgtgacggcccgcaaattccagtcttgttaagagtcgtcacagatggaaggatctgtactagtgaacagaggaaaaaatatatatcaaaggtgttgtacgtcacatttatcacatccaattcaatttttttagtattcaaaatttgttccagaaatcttgtcacgttagaatacactttgtcacatttatcacctcaatttctattgtttctcaatcctgcacctaattaactacagcctgataccctatatcatttattaattgggggcattgtgttcatttcttactgaacattagtctttgttaaataaataacagctataacgatagcaattgtgggactattagatgcttcattgattgtttgttaaaacttatttcacggtagtcaaaacactcaagaatcagtatttacgtacacgcagtcttgaaaaactccatccaatccctttccaagcctatgcatttgaagcgcacgggagaaaaaaaaaagatccaatgcattggctcgattctagtcgatgtaccaagttgctcctagttgccccaaatccaaatcaaaatccccaaatcacaactcacatctcacaatcctcattagacaaaaagttcatccaaatccaaatctccaattctccaaatcacactcacatgagacggacgtcaagggcgccgcggcggacgatgacgagcggcacctctgctggtggatctccaaccataagtccacatgccagtcctgtgtgcgcaagcagtggtgcctcgacgagctctgcgcgtgccaagtgcttattagtggttttgtggcataatttgtcttataatagttatgggtgtacctattaggggttttatagtattgtgggtaacatatgaggcctagtgttggtatttctgatgccctcacaaactacacccttaagcacacaaaattcaagcaggtgcaatttgcaaatgtttttacatgtgaatgtgcttcacgtcaaatattcttgttgtttttcatatatatgaacaagcggaatcttcgtagagggtaatctcaccacctatatagcatatggtgagtgtatgcttaggcaaaaaaattagccaaacactgcctaaccctcatgtccactcaggcatgttcttaattagggcatcaaccaaacaccaccctgaatttgtgtcatgactgcacagagaaattttgtaagcaagattaagcaaccctcaggcatggaaaatactccagcaggtttctcgggatagcaaccaaacataccctattgatatctttgacaaaaagctaagtgacggcatcattgaaaaaaaaacaatatttacagatatcatctccaaaaaaaaattggtttgtaattgagtatgtatatcatgctattcgctgttattgtaaaatcaaagtgtgttttaattataattctctgatgaacaattggcatctaagattattggttttgatatctggagatttttggcgaagtggttttggagatgattggatttgcaggtgttaaacaggtgctgttgatttgtcgggttcggtcagatcgggcaggtgctgctagtcagaccggccagcccgcggtctgaccggccgactctgtgttggttttggtttcgggttgtttgtttggatatccgtgattgttttgtgtttatgacttctagatggaaactatgcatatgtaatactgttgtttgctactaatgagtcaagttggaggtagcttcgtctcgaaatatagtttctttgtttgcttcatgtgtatgtgacttgatgcctcgggagagtattgccagtgattgatcgggagtcagcatggggataaggcgatgtccgtgacggtcagatatcatgcgagatacttaggctagttcaatgcacgtggttggtgaagatttcatatggcatacgatggaggtattgtgtgcgtatgggatgcagagtcgaatttggaaggagtccaaatttggtatgattggagtttgtaaagtttgtttcttgtacgggaaggtttcctagatagattagaacttctagtacgggtttggttcgtagctttaggctttcctttatcgcttttgagagcattgagttgatagtttagttagtgtttcgagtttagtcgagatattcgtgaggagtgttcttgttgcactttgtaacacagagagaagtaataaagtggtcatctactttgagagttcttcgatttgcgttttctcgagtttggcggtctaaccggtgaaacaccggcggtcagaccggtggcattgcggcggtcagaccggcggagtacctgcggtcagaccagcgacggcgtcaggcaacttcaggcacagctgctgatcttggcggttcgaccgtacgttctacttcggtcagaccgacgatattcgagcggttcgaccggttcgactacttcggtcggactgcgatcagtcaaatttgagggtaatctttaattccgcaaagagtttgggtttttgggtataccaacaattaacccctctctggttggattagttcttatatttcgatcctacaagtggtatcagatccttgttttcttctttggattttaaccgatctagagtttttgccatggctaataagtttacaactaagccccatattttcgatggaacggattttccttattggtgtaataagatgcaatcttacattatggctgaggatcttgatatttggagaaaagtttataatccttatgtgattcttgatcaaattaatattgttgctttaaaaactgaatttgaaaataattgcaaagctcgcaatattcttttgagtgggatttctcgtttggattttgatcgtgtttcacatcttgaaactgctaatgagatttggaacgatttgaaaaactttcatcaaggaacttcaaacattaaagaacttcatcgggatctttttaaaaaggaatacataaaatttgagatgaaacctggaggctttggatgactatcttactaggtttaacaaaattttaagtgatctttgatctgttgcttcttcttatgatataaattacacacaatctgaggtttctagttactttttgaatggtcttgtcatgtttatttgggagatgaaaattatatcaattcaggagtctgttgatatatctacttttactttgaattcgctttacacaaaactcaaaacacatgagatgaatattctttctcgtaaaattgactctaagtctagtgccttgatttcttcctcaacttttttgaatattggtgcttcttcatcgaattctactattcttgctttaattaataccatatccgatgagcaactcgaacagttcgaggaggaggacttggctttggttactaataagttttctcgagctatgaataatgttagatactggaaaagagatggtcagatatcatgcgggatacgtaggctagagttcaatgcacgtcggtggtgaagattccatatggcatacgatggaggtattgtgtgagtatgggatgcggagtcgaatttaaaaggagcccaaatttggtataattggagtttgtaaagtttgtttcttgaacgggaaggtttcctaggtggattaggacttctagtatgagtttggtttgtggctttaggctgcctacctcatgtata

SEQ ID NO: 66025 - DNA, 3657 bp, Oryza sativa
cgcttttgagagcattgagttgacagtttagttagggtttcgagtttagtcgagatttttgtgaggagtgttgttgttgcactttgtaaacacagagagaagtaataaagttgtcatctactttgagagttcttcgatttgtgttttctcgacttcggcagtctaacccgcgaaacaccagcggcattgcggcggtcagaccggcggagtacctgcggtcataccggcgacggtgtaaggcgacttcaggcatagctgctgatctcggcggttcgaccggacgttgtacttcggtcagaccgacaatattcatacggtcagaccggttcgactacttcggtcagactgcgatcaatcgaatttgagggtaatctttaattccacaaaagtttgggtttttgggtataccaaccactcacccccctggttggcttagttcctgtgttttgatcctacaattattactagtacaatgtcgacactttgttccacaatataaagtgcacaaaattatgataaaagttgaaatgaatgaatcagtgaatcaccatcagcactgtatggtgggttacataagtgttcactttgtctcgtgggttctcgactatagtttcttatctattttgtgataaaatttgtcataaatatttctccagaatatttcaggttttttcatgaatcgtgtgcacatccattagtatgctccctgctaactaatgaaataaatgcaaataggtaagttaacttataaaataaaatataaataactctagtatttgtataagcaaaagataaagtacttggcaggtgacagagtgttatgctagtattaaaatgtctaggattttacaaaatttgcggagaaaaaaatattcagcaagtttcatttattgtcatcgcactgttggtagaattggatttacgaccatattcatgataaatagtgggtgcgttctcttctccatgtcatagttctttatttctagaagggccaaatggacgattatggaaatgacaagtttcatagtctgtatggtgagaaatgcaataggacatggaggcactaggaatttctattgtagtagctgtgacagaccttgatcatactaacagttgctggagacaggaaaatagattgacagcaaagcttctgaatgcatttgcacggcattgtttgcaagtttctccatcgcatggtacttcaactccttgctacgcctccaatcgtagcaacgtggcatccggtggctctcagctaaccaaagaaaccaaggactctggtactcacaggatccatacgggatcgaggcacatgcttattgctagtggccaagagttgctgaagtcaccgctgagttcaagagttgctcgatgaagtacctactagaatataactgttctgcagattcggctgtacacgatcagaaggtattgctagcattgctagctgcttgattcttagcatatgccaaacttcagctgtatcaaagtcaagccagcaagatggccactcgcaggcagggtttacgattccgatatgcctttccttttcgggcactggcggaattcgaaatttcacgaaatccggtgggaaaccggtaaattctgaacaaatttcataaactaaaatttgaatacaaattccttgagtttgctgacaagttctcgaaaaccgatcggttttagcgaaattccgatcgatatcatcgaaatttcgatcagtaatttataatagaggtaatttgctgaaattcttttctttcctcatgtaagtttcagtaaatatacacaatatatttttttttcgaaaatttatatcccaatagattccatgaatatcatagtatttataagattttatttgattttttttctttttttatcaattcaaatttgaatttggatgaaacttctcgaaatctcagacggtttctactttcgagcctcatcgaaacgtcgaaatttcgcgaaatccaaccggatttcgtcggaatcgtaaaccctgctcgcaggagcaggatcgtctccactctccactcaacacggaagaaactcctctaacgtactctcttcgttccaaaaaaaaattaattctagatttaaatttgagcatagtgtatgtccatattcaaactcagcattattattattattttttttacggagggaatagtgtctactggcagagctacaggggatggcgagcagcggccaggccacctccaatgaaaaaaatcctctcattaaaactaattaatcacaaaggagttggttaattggcctcatttaattaatactccagcaggcagccgtttgggcctttttaattttgattgctgccgtgcagtcatgatggtcttggcttaggcaaatggtgctacctgctgactttaggatacactacatgtatataaatccaattttattgctttaaatataaaatcgctagttgcttgcttgcaaatcgtcaatcacccgaattattaatctcatttggttacttcatattattagtgattactacttaagaatattacagctcataaacaaattggtactccattttgcaaacattattttttatgctttttagtttatgtggactttagattctcttacaatcttgaggaggaaataacatccttccaacatatagtgcattttcatacgttacccaggaaagcataacctatccatacaacgagggaaattagtactaataacttatggcgataattaacccttagcaaaaaaacattagtttagttagggcaagtaaaattgccacgtaggattagataatgaggtgaaggacagaagttaggagagagaatgaaccacctctcatgcatggggtaaccttcacacaattttcaagaaaagtgaaaaatgatgtgagtaaactagtgttggggtttgtgtattagatgtgatatgttgtatttgttgcctcttaattaattagaagatgacatgttttaaattagatgtggcattcacctctatcataatacttgtccttacacgatcacgtccatatatacgctgtagttgcagctatttcgtttctttgactaagtgcgatggtaaaggagatccagtaccatttgtgccaaaattgtttgtgacggataagatggctgtgttttcaaataatcgatacaattaattcattcacgcagacagtagttgtgttctatatcccttttcccagcgcgtattcccttatttttcgtacgcacctttccctaactgctaaacaatatttttctaaaaaaaatctataggaaaattattttacaaaatcatataaatttatgtttttaagttttattagctaaaacttaatttattctgcgctgatccaccattctgtttcgcgctttgtgttctggcttaggggttctctggtgctcactataagaagaaaaactgagtgaccacttggagaatttgtcacaaccttcgactctgcagcatatatacaaaacagtttcttcaatatcttagataatgaaatattacaaatgtttgctgtatttgttcacttatgttgtggctgatctgatcatataacgtatcaattcttcgagtactcattcataaagtagtactccctccatttcaaaatgtttgacaccgttgactttttagcac

SEQ ID NO: 66026 - DNA, 888 bp, Oryza sativa
aaaaaatttaataagacgaacagtcaaacatatgctaaaaagtcaacggtgtcaaacattttgaaacgaagggagtataatgcagagtgacaaaacagcaaaactcatgtctcgcatgagaaatgtaagacaattagaatccaagtagttgtaattggaggaaggtcatttcagtcattcagtaggaatgggaagcactgggatagataacctcttcggcagattgagagtactgtctccgaatttctgttacttcaatgatcctgacgcacagcaactatctcgaacacatgatgagctgaggcgcattggttgtcagtcagacatcaagtgatttattcttctgactacgcctacaaatcgcaagaaatgagattgcgaaagtacagcctgaattgttgcatgcaaattttgtttattatgaaatgagaaaacgaaacagccgccatgtgtaattcttgttacgacactaattgtgcgctaagaaaagagcgacgactagcagttagggtgcgtttgagccgtgtggctttatttgtttttttttaaaaaaaaaaaaaactgagctgcgttactatgttcttgagttcatggttacgccttgggaggtacttggctctatgaattcatggcactattcaaattgctctattcatgatcatgccagctgttcttttgtcctccattatttacaaaatggaatagtttgagctgttctaaacccattaagtagtactgtatcagggtctcatcgtttggcttttttcgtaataagccaaaacggcttattagagaacaaaaattaatttgtaggtaaaacttttatatatgtgttctcggtgacttaaaagccaaatactgaaaaagaaactacgttaaaaatatctc

SEQ ID NO: 66027 - DNA, 1395 bp, Oryza sativa
tttgggatctgtgtgacttgccttgctggccttgaaactcttcaaaatcttcccctgtaaaatcggactctccgggaacgtcggaatctaaagagaaaagaacaaaatcaccaaaacaacacttaaacaagcatgaacagtacatgtggatatttttaacatgtagatctcaattttagaaaaatttagagacttgaaccaacaaaatccgagctaagataaattagttatgaattttcaaagattaaatcggattaaatcatttatatggattttaattgaattatgacgcaataatgaattatttttgaaaaggaaaaagagattattgcgtcagcggctagggttcacggcggcggctcacggaaacgaacggccgggatcgatctatccaaatcagacggccgagatctaaacggtctacgaccggtctacggcggatggcgtcgatgatgtcagcggtgacgtcatcaccggcgacggctcggacggcgcatgctcgccggcgaacgacggcgcggcggcgcgaacggacggcacctacgggttgcgggcgacacggcgaactcaccggtgaccaaagtagcggcggaagatcaacggacggcgacggcgtcgaggaagaagcggcggcgtccttcggcttgacgacgacggcggtgcttcggcgacctacagagacgacggaggggtggacgaggtcggcgacgacttgacgatcacgatggcggccttcccgagcgacgacgacgaccggagcggcgacggcgcaaggctggacgaactgcggcaacggcggcgctaggctacacggcgctagagctctaccggcggcgagagacgaaggcgagggtggcggcgggtagaggagacaccgggggtccttttataggggctagggggccgcggcgaaggcccacggcggccggcggcggtgatggaaaggttagggttcggagagagagaggaatccgattcgagatcgaatccaccgatttccaaacgatttagccgacgattccaaaagtgaaaagatagaggagatctcggggatcatttcccctctattaatttcaccggaaaaggaaagggatgaacgaatttggaacgagacggcggcgcggctcggttagggttcgggcgtggcagctgcgcgaggaagacgaagactgacaggtgggccccacctgtcagcgagcgggacgcgcgcgcgcgggcggcgctcggctgcgggctgacctgggccggggaggagagagagaggtttgggccgactttcggcccaaagccaaaagagagatttttaaaactttttcatttaaattattcatgaagtgcaattccatttattaaaaatacttccttagctcaaataaatcccagaaaaatctagga

SEQ ID NO: 66028 - DNA, 729 bp, Oryza sativa
gcccaggagaaattgtagtcgctgttaaacatccattattatcatttgatatttatgaaatgactgttattctcgaagtatttatatatttcgttgcatgagtgtttgagttatctatatgcatgaatgtgtatgtggcatctttccacatcattcaaatgcctaactataaatatgtgcagactgttgatgtacctaaggacatcatgaaacttattcaagatattaatgtagaactccgtgctgaagatgaaagtcgggctccaaatgaaacaaattatgtgagagctcttcccttttcattccagatgcatgcatggcatatcactgatctaattaatgttcctgagtgttaagctgtcatgtcctgtctatcataatcataatagactcccttgtttcagcttaaacactgtattatttttgtgaatgattttttcctcgcttccaaaaaataatactacttgccaaaaaaatattgttctatgttattgtttaaacttgttcgaaacgacttgttaataagttttatctcaatgttgtatcatatatgttaggtaccaactctgtcatataaacgctttcaggagactgacagccatgactggcattcacggtctttacaaactccagtggttgccgaggaagagaaatctcaggacgatactcgtgaagcaaaagaaccctatgctttaggttggaagcaaaaggagtttaacaagcaagacc

SEQ ID NO: 66029 - DNA, 754 bp, Oryza sativa
attcctgcagccccgcctcactcactctctcgaccgccgccgtcctctccaccgccatctccaccgtcgccgcctcaacctctcctccgccctctccgccgccatctccgctgccctctctgccgccatctccgccgtcctctccaccgccatctccaccgtcgccgcctcaacctctcctccgccctctccgccgccatctccgctgccctctctgccgccatctccgccgtcctctccaccgccatcttcaccgtcgccgcctcaacctctcctcctccctctccgccgccatctccgctgccctctctgccgccatctccgccctctccgccgccgcctccaccgccgccctcgccgccgatcgtcctctccgccgtccgtccatcgacttccccgacctcctcgaccctgacctccccgacgccgggatccccgaccaccgccgaccgcctcgacctcttcgccactgcctctccgccgccgccaccaggatccaggacgactacggcctgcgccgccgtctccaagtacgccgcttctccaagtatgccgccaccctcccccattcctccttttttcgatggatgaattgcattgtttagatgaatgaaatgtgatttgttgtttcgattattggtgctgctgtatagatgaattaaatgtgatttgttgtctgtggatgttttggatgaatgtaggggctagattttatatacatgaatcttagcatcaatagaggatcttagcatga

SEQ ID NO: 66030 - DNA, 14210 bp, Oryza sativa
  unsure (1)..(14210): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcggtggatgagttgttcttgctccgaagtgagctccatgtcatcatgaggtatatcaatacctgtacaaacatcattccaaatacttggatgcaaagagattagatgcaacttcatcttgtgcttccaagcagcataatatgtctgatcaaattgaggagcacgccctgaaggcacggagacgaagttgtgagagggaatggtaagtttgctgtaatcaaaaggtatagtagctcccttgggtggtggagttcccttgctactcgcttcatcttcatttcattttccccgttctttccccctaagtccgacatcgtggatcactcaaaggtgtgaagcttgaatcaagagcaccaggctctgataccaattgaacgtgcagagatgtagcctagaggggggggggtgaaaaggctttcctgaaattttctcaacaattgcagcggttaaattgacagggcccggaacctcctggtgatgaacaccggaacttccgggcaggatgagtagcccagaacttccggggttcttgagtaaggaacttccgggcagcagagataaattaaactgagatgaaaaacaggtcctagcaagagaagtttaggcacacatcggaacaagatgaagatcgcagaatatcagcagattcacacaaagatcatgcacaagagagacaaagacaattttttcccgaagttcggatcacacgaatcctactctccgttgaggtgctccaaagagccgggtctcgattaaccccttggctcacttatgcaaagatcccagaagaggtccacagccttcaactcaacacttctaggttattttctagaattgagagaccaccaagatccaactcaaaatttcttctagaaaagaccacaagtgcaagttgctctacctaggacaacctctgaaaactcagcacaagaatctttactcacttacctcgtttccttgcggaggtgaggaaaaacttcacaaactttcctacgacatccacaagatctttggaagctcacgggagacacctaaccatctaggagaagatctccaagagtaataagcccaagtgacagcccacaaggtatccaaagtgctcaatcaaacctaatcttcaagccatctccaaaacactcctacactctcatctaatctctcaatctcacaagataggctctagatttgagtggagaaagcaaaggaagcttgggagtggctagaaaaccctcgaacatgaaagaactgaagtggaatggccaaagggtgacctggggatgaaatccatatttataacggctaggtgatgtcatctagccgttactcacatgtttgaactggaaacctgccatgaggttccgggcaagtgctaggaacttctgggcagcacttaggaaaatttttgcaattaaacggcgcccggaagttccggccagaaccttcgggtagccctctctgtcctggggagaaaatcatttttcaaaaatgattccaaaaatcttttgactcatggatatgactaagagcactttgtataccatagaaccacacttgaaacccctcttaatagtacggtttttcctaaactcaatttcgaaagtgaaaaacctagtctaatcacctacagcgattttcgcacttaggaacattcgaattggggggtctccttgcattcttagtcatcacaacttgctttgggactaaactcctgtgaataaacttgataaacacgttagtcccctttaaccacattgtcattaatcaccaaaacccactagggggtttaagtgcatcttcacccaaaatgtggtggctctggtatagatgatacatatattgattttgatctggaggatatgttgtggcacgttgaaccagaggttctagctagtacaagatgagggtttgacaattgggaagcgttggaaagaagggatacgagtgtacgacgagtactgtagggagcattttactctacgtgccattatattcattaccatcaacgacctgccggttaacttttggctcccaggatagcttaagaggaagttcggatgtcttatatgtatcgacaacacgtcatacaggtacctcacctcctcaaggaagacagtgtacatgcgtcaccgtcggttcttaccacagaggcacaagtggcgtaagatggccaacttatttgacaagtccgtagagaacgatcttcctcctgaagcatgaactggtgcacaagtcttcgacatggccaagaagattaaggtcgtgttcgggaaggtatagaagaaggcaatcaagaggaagaaagcaaaggatcaaagataaagttagctcaatcaaatatttcatctttgtagagaacacgactattacagaaaacatggcgggttcgtaaaggatcaaaagaggacaagacttctcgtaaagggacgctggccggtatgtaatcaaatatatatattcgttaagtatatgatgcaattgtttgttcttattactgacgtgtctactgttcttacgcagtgttacaagcaacccaacagtaccaacctatggggatattaagtgtgcgagatgctcagggtccgtgggagatacataactgagtttacagatataagtcatcatgctccttacatataggaaatagtcatttaagtcgcttttaacacatatcatttttcttctattttccatagcttccgagcatcccatatacagcaaactggttcgaccagaaaacgcttctgaacatctgcgcggacttatgccggttcattcgttgcaacatccgcaaccatccaagggagttctatgacccttacagcgaacttgctatggacccccaattcaaaaacctaagggagtgggagagagaacatgcaatagaataaaaaacatctatttttaatattatgaacactagacatgtacatatgctatgtaatatatatatatatatatcgatgtttctaattgtgcttgtataatttatatgtaactttacgattcaaaaatacacaaaaaataatgagtacgtacattttcccaaacggttagcaattgctagggtgactgcacgaatctattatcccgtgcggtcggcctagcacatgctagccgactaggataatagattatcctgtacggtcgacataactgaactgcacgggataatctactatcctgtacggtccacttaacataacgcatgggataatctattatcccaagaggtcctcttaactcgatcgcacgggataatcgattatcccgtgcagtccacgtaacccggccgcacgggataatagagtatcctgtgcggttgggctgcccgcacgcgataatgttgatttttgcaaacacctaggtgcagatgggcgctacctccgcatggaaaaatcggttttgactacatggaaaaatcgaatctgtagtagtgtgacaacactctatttgctgcccgctttagaatctccgggtgcataatcggcagtgaaactgctactagcacctaatgttacagtactacaagaaaaatgttttgtaagagacatttttctagtataatagaggcacttttcaaatgcctttacaacaatatagaggcattttaaaacatgtctaataataagtgtcttatggtgaattctctctataaacgaagagagattttataaaatgtctataagattgtagaggcattttctagagacattaaattgtaccacaaccatataaaaccagtccaaaaaagagaatataataatatccttgcttttgtcaagccttgatctcttggttaaatcattttaatcttcaatgcactaaccaactcacctccatgtcattacttgtatgtttgtttctttagttacacattatcattctaaaaagtatctctacatagtttaaaatgtctcaacaaaatgcctttacatattaaacgcattttatagtgccgaaagaatgcctctataagataagatctaacaaactgagctaaaattgtctctagagtaaaagttttctagataatttttgaagtgtctctacactataaaacttatgatcttagaagcaatttgcaaaactcctctacaaaagtgcctctatacgaggtttttgttgtagtgttaataccacttaagctgtgttcgtacatgtgagtttccatgcgcacgtttcccaaactactaaaaggtgtatatttttgaaaaaaaaaatcttgaaaagttgcttaaaatcatagtttttaaaaaatccattttagctgatacttagctaaacatgtgcaaatgagttgctccgttaaatgtgcgtgggggaaaagttcccaaagtgagctccctgaacgcagcaaatgataatttgctttccacaaacattaatacacattggcatatgtgaaatcaaagtgtgttttgattattatttcatgataaacaattggcacgagagataattgatactgatatttagagatatatggtgaaatggttttggtgccagtcacaccgggtgtcacgcccggaatttctatccaaaattccaaacgcttacatgtgtgtgaaccctcgtccaggaatcagccgaggcacacaataacaaattgataatagagtacaattattactctaattaataagcgtataaaatgtcattacagaggtagatagttcctctcaaacaataaagatctaagcagcggaaaataaaataaacggcgcagacggctccactccacaggcagcttgaccaaggctactcctaatcctccactccatcagcctcattgtagaactcttcctctgatgaatgattgcaaggtgagtatatgacatactcagcaagccacgtagcaaatatgcaagtgcacaggataacaaaggatggcataatagggtttcatttgcaaaagcagcatttagcaaacatttcagaatttaacaaaacagttaattaatttaacaatattaatccaacgctatacaacataccctgttgtataggcccaaccattctgaacaaccatcccggctgcacagttctatctccaaaccaggaatgtaccattccaaaccaggagctaatcaaattattaccaattatagcatcatttactatggtgagaagtgtgaaactaatcacgaaagacattgttagacccgcccataaccgcgggcacggctattcgaatagttttactctgatcagaggtgtaccactgtacccacaagacacaaccccacatcatgtcaccatgtgcctcaataccaccacggtacctcggaaaagagttgtgacaatacccctcgcataacacaatccactgcagcgcaccttcctggatcataatcacccccttataaacaaggcatggactccccagcgacccccgtgggcttatctccgccacttctcagtctggtgctccgcaatgaaccatgctatacaaaagataaagccgttgtccatgctggcttgtggttggcacggttaatgtttcacaaccgaaactcgtgaaccggtccttaattatcatgagcacgaccatcaaaaccatgtgctcacaacccaccattatcaggttttagttggcacattaattaattaaccaatcacaatcgaccatcatgaactatcattaagccatcatgaaataacagtgagtcattaattatcccaatagtgtgctaatgtttctaagcagggctaagcaattatatctagtatctagttgaaccaatataaataaagctcaactagtcaaattataataacccaaggtatcaaggaataaagtaatcaagaacaaaagggctataacaaagaataggttgattccacccaatgacattcgaaaataaatgcaatagttgaaaagaaacaatagctttaaataggatcaacatgctcaaaggattgtttgggatctgtgtgacttgccttgctggccttggaactcttcaaactcttctccggcgaaaacggactctccggaaacgacggaatctaagcagaaaagagcaaaatcaccaaaacagcacataaacaagcatgaacagtacatgtggatatttttaacatgtagatctcaattttagaaaaatttagagacttgaaccaactaaatcggagctaagatgaattagttatgaatttttaaagattaaaccggattaaaacacttaaatcggttaaaattgaattatgacgcaataatgaattatttttgaaaaggaaaagagggtttattgcgtcagcggctagggttttggtggaccgggcgcacgggcggcggttcacgcgaacggacggccgagatcgatccaatccaaaacggacggccgagatcgaacggtccaagaccggctcacggcggacgaccccgatgacgtcagcggtgacatcaccgacagcggtggcggctcggcggaacggacggctcgggcggcgcacgctcgccggcgaacggcggcgcgaggacgcaaacggagggcaccagcacgtagaggacgacgcggcgaacacaccggtgaccaaaacggcggcggaagaacaacggacgacgacggcgacgaggaggaaacggcggaaaccttcgggttgacgacggcgacgaagctccggcgatctccggcgacggcgaaggggcggacgaggacggcgacgacttggcgaccacgacgacggtcttcccgagcgacggcgacggctggagcgacggcggcgcacggctggagcagcggcggcgacggcaaagctagggcacacggcgctagggcttttccgacgacgagaggcgaaggcgaaagtggcgacgggtagaggagacaccgggggtccttttaaaggggctcggaggcggcggcgaaggcccacggcgacggcaacggcgaaggaaagctcgggaagaacaaatccgagacgaactcgaatccaactctttccaaagcgatttagccaaagattccaaaggagaaaaggtagaggagatcccggagaatgtttcccctctattgattcggccggagaaggaaaggaacggccggatttggaagggaaacggcggcggcgcgaaactagggtttcgggcggcggcggccgaaggtagacgacgactgacaggtgggccccacctgtcagcgacagcgagggcgcgcgcggctgcggcggactgggccggctgggccgaggagagagaagagagattttgggccgactttcagcccaaagccaaaagaggactttttaaaacttttttcaattaaaattatttcttaaatgcaattccatttattaaaaatactttcttagctcaaataaatcccagaaaaatctaggaattatagaattaagcaaagtatttaatgaaattttatctgggcccattttatattggaatttattaattaaaattagattttcttttcaagactttttaaaattatttctaaaaattccatttaaacaacaatttataaattttgaattttcagggtgtgacaaacctaccccccttaaacagaatctcgtcctcgagattcggaagaactggcgaacaattgcggatgagctgacttcaattcatcttctcgttctcaagttgattcttcttccgagtgattactccattggactttataaaaacggataactcgattcctggttcttctctcacttgtttccaagatacggattggtttctcaacataggtcagatcctcttggactcctatctgttcaagattagcttcttcggtaggtacccttaaacacttcttcaattgcgaaacatggaacacattatggactcctgccaaagattgaggtaactccaactgataagcgacttctcctcttctactgacaatcttatagggtcccacaaaacgcggtgccaattttcctttggtacgaaaacgatgaactcctcgaaaaggcgtgacacgaagatacacataatctccttcttcaaaactcaaatccctacggcgattgtcggcataactcttatgacgagattgagccactcgcaatctttcctgaatgattttcaccttttcttctgcttcccttaggatatccgtcccgaaaacctgacgttctcccgtttgatcccacaaaagcggagtgcgacacttccgaccatacagtgcttcgtaaggagccatctgtagactagcttgataactgttgttgtacgaaaattctgcatagggtagattcttatcccaacttccaccgaagtctaaagcacaagctctcaacatgtcttccaaaatctgatttaccctttcggtttgtccgtctgtctgcggatgataagcagtactaaaattcagcttagaacccatctcttcctgaagtttcttccaaaaatttgaagtaaactgactgcctcgatcagacactatcttcttagggacgccatgcaaacacacaatccttgccatatacaattccgccaatcgacttccagaataggttgtctttaccggaatgaaatgagccactttggtaagtctgtcgactattacccaaatagagtcatggcctgatgacgttctaggtaaaccagtaataaaatccataccaatttcttcccatttccattcaggaatcttcaaaggctgcaacaaaccggcgggtttctgatgttccgccttgactcgctgacaaacatcacatactggtacgtactctgcgatttcacgcttcatacttgcccaccaaaatctttccttgagatcctggtacatcttagtactaccagggtgcatggagtataaagtatcatgagcttctttcagaattgcatctttcaaatctttgttatcggggacacagattctttcacccaaccatacagttccttgctcatcctccaagaaaccgatagcttttcctcttctcatattcttcttgatttcttgaatatcaggatcattaatttgggcttctctaacttgatcaattagagtgggcttcgcttctaaggctgcaacgaaacctctattgacaattcccaaatttaatctttcaaattccttgcataactccaatggcaactgtcgtccttctgtagcattgcaataacctttcctgctaagagcatctgctacaacattagcctttcctgggtgataatgaattcccatgtcataatccttaattaattccaaccatctccgttgtctcatgttcagatccggctgagtaaaaatatactttaaactcttgtgatcggtgtacatctccgtacgagtaccgaaaagataatgacgccaaatcttcaacgcatgaactactgcggctaactcaatatcatgagtagggtagttcttctcatgcggacgtaactgacgagatgcataggcaaccaccttgccatcttgcatcaaaacacaacctaacccaagtttggatgcatcgcaatacacttggaaacccttctttggatcaggtaaaatcaaaataggagctgatattaagcgacttttcaactcttgaaaactctgctcacattcttccgaccacttgtacttcacatctttctgaagcagtcgtgtcatgggcttagcaatcttggaaaaattctctataaacctccggtaatatcctgcgaggcctaggaaactgcgaatctctgaaactgtctttggttgtttccagttggttacggattccacattactaggatcaacggcaactcctccggctgagatgacgtgaccaaggaacttcacttcagacaaccaaaattcacacttgctaaacttagcatacagttgatgctctcgtagcttctccaatgcaaggcaaagatgttcttcatgctcttctttggttcgagagtagataagaatgtcatctataaagaccactacgaacttgtctaggtattccataaacaccttattcatcaagttcatgaagaaagcaggggcattggtaagtccaaaagacataacagtacattcgaacaacccatacctagtggtaaaagctgtcttaggtatatcttcctctttgattctcaactggtgatatcctgatcgaagatctatcttggagaaaacagtggcacctttaagctgatcaaacaaatcatcaattctgggcagcggatacttattcttgatagtcacatcatttagtgcacgataatccacacacattctctgggtatggtctttcttttccacaaaaataaccggagctccccatggtgatgaactcggtctgatgtatcctttctgttgcaaatcgtccacttgcctcttgacttctgccaactcattggctgccattcgataaggtctcttatggattggagttgttcctggtaccagatctattctgaactctatatcccttttgggcggcattccaggtaaatcatctgggaacacatcggaatactcccgaactataggaatctcttccaaagttatttggttcagtcttgaccttaaagactcagatgacaatgcatgaacagttacaactcgaccatcattgctggtgagagttacttttctgttagcacagtctatcacacctttatgtctggctaaccagtccatccctaggatgacatcaaggtctttggattctaacaagataagattggccagaaatggtactcccttaatttctattctgaccgaggggctacgttgcaaagagagtgcttgatcacttggggtactaaccatcaaaggacgtctaagatcttctacttccatcccattatttcccgcaaaactcatagataagaatgaatgtgtagcgccagaatcgaaaagtactgttgcaggaactgagttaacagggaacgtacccaaaatcacatcgggagcatcttgagcttctgcagcagcgacatgattgacacgggcctttgatgctggtacagcagagttattctgagcagggacaaccttcacgcgacggggcttcggacacttgtcagcataatgtcctgggtctccacagttgaaacataccacgggcttgctgccttgctccctcttggcaggttgttgctgtgttggagctgcaacaggacgtggagcttgattgcggatgttgttgccagcattgttgttgaagaactgacgctgcggacgaacaacagatgaagaacctccctgtggcatagactggggtcctaaagtaaggcgcggcttctgattactcccctgttgtgccttgaagtgagcaatccgacgtttcctctgctccatgcaattgtacttgtcctcctaacgtatagccttatccactaatttctggaaatcaggataatctccaaccatgagtgggtaagaaagctcatcattaagtcctcccaaaaacttctcctgacgctcttcatcattacgcacatcttccggagcataacgagcaagacgattgaactcgtgcagatactccgtaacagagcgagatccctgagtaagcgacctgaactccttcttcttgagagacactactcctgatggtatatgcgtcttccggaaagcagcagtgaattcaagccaagtgataggttcagcagtagtcctattcaggcggaagtgatcccaccattcagaggcagagccatgcaactgatgtgatgcaaaagataccttctcctgatcagtgcactgaagtaaatccaacttcttctctatggcatgcagccaatcaccagcttcaacaggattagtggtactagagaaaataggcggcctcacacgaagaaattctgctaacttattctgaggaggtgcatagttatttccttggttctgctgattctgaaattgctgcatcatcatgttcatgagttgtgtctgttgagcaagaacttgggccagagttgggttctctccattgttattgttattggggttgttggggccattcccattgctgcgagtgttcaccatctggcaggaacagggcacaagaagagaaaccggggaactacttaggatagagaattactttaacttttattgatcttaactgagtttcattattacaaactgaagactctcacaccactaaactcaccaacttcctaacactcaaaagcaaacaaacacatgcaattacatcccaccactgatgtaaatcacatgcgagccacacacaagcaaacttaaagcaaacaaactaacacaacgatctaagacaacgacttaacaagtcactctagttcttccaagcattggaggtcgattgaaggctcgttcggctcgtcttcatcatcttgggttgctacccactcaatcttggaatggttgcgcttggattcttcttcttcatcacttatgatgatgaccggaggatccgcttgggatggggcaacttctttctccaccacacggacctttggcgccaattgatagcgagggacaaataaagctctcttccttgcggtaagacgaatcctggccttctgcggcggtgcttctccctttaacgcggctaattccttttccaaacgatccaccttgtcttctaacttgcaaatcttaccacgattccggtcttcacgatcttgagccgctaacacagtctccgcacgaccttcatccatagcccacagcatctcaaccaaatgccttgtggtagcatcattctcaattccttcagtctcaaggtagctgccacggtcacttccctggggttgacgaggatggtagcgatactcagtgtcggccaactgatcactatagcgatcacggagctctcctatggcaatccttgccacttcctgacatgcatggatgtagtttcttcctccagcttcgaacatcactgaggggatctcttcactattgctgttcaaggtgactttgactcggcacttctcttcatgacgatcatgaggaatctgggcataaaaaggggcagtcccaaatccaatggcaaaggacatcgtacgcaactcctggacaaaaccctcaacaccaaacaggtactcaagcttgtagcgcggcatctaaagacaagtgaaaggagggagttaagacctttatccaattaatagcacaagtttttggattaatttgaataaagtttagaaattcaaagtaaaaggtaagtgaataaagtaaaccaaacttgcaagataatttgaaatagttgaaaacaaggttacaaattttgtactttttaacaacaggtttcaaaagaaagttataaaatcaacatgctaaatttattttattgcagcaagattaaataaaacaacattgtaaaacttttgctgataaatgagccattagtacagtaatggatgtacagtactaataacactggaataaattttgaatgagaaccattaaaagagattatgaagtgcatgtgccattagtttggtttaattaaaagagaaagggaggagaacagttctacttttccaatatttttagagggcttctatgggtaaccatttggcataacctagggtcaagggggctctgataccaacttgtcacgcccggaatttctatccaaaattccaaacgcttacatgtgtgtgaaccctcgtccaggaatcagccgaggcacacaataacaaattgataatagagtacaattattactctaattaataagcgtataaaatgtcattacagaggtagatagttcctctcaaacaataaagatctaagcagcggaaaataaaataaacggcgcagacggctccactccacaggcagcttgaccaaggctactcctaatcctccactccatcagcctcattgtagaactcttcctctgatgaatgattgcaaggtgagtatatgacatactcagcaagccacgtagcaaatatgcaagtgcacaggataacaaaggatggcataatagggtttcatttgcaaaagcagcatttagcaaacatttcagaatttaacaaaacagttaattaatttaacaatattaatccaacgctatacaacataccctgttgtataggcccaaccattctgaacaaccatcccggctgcacagttctatctc

SEQ ID NO: 66031 - DNA, 4067 bp, Oryza sativa
gtagacgacgactgacaggtgggccccacctgtcagcgacagcgagggcgcgcgcggctgcggcggactgggccggctgggccgaggagagagaagagagattttgggcggactttgggcccaaagccaaaagaggactttttaaaacctttttcaattaaaattatttcttaaatgcaattccatttattaaaaatactttcttagctcaaataaatcccagaaaaatctaggaattatagaattaagcaaagtatttaatgaaattttatctgggcccattttatattggaatttattaattaaaattagattttcttttcaagactttttaaaattatttctaaaaattccatttaaacaacaatttataaattttgaattttcaggtgtgacaccgggcaaatattgtgaacgctgatctgaacgcagccttagatgcatttttagcctaaacaaagcaaatgataatttgctttccacaaacataaatacacattggcatatgtgaaataaaagtgtgttttgattattatttcatgatgaacaattggcacgagagataattggttatgatatttagaaatatatggtgatgaagtggttttggggctgggcagactgggcaaatattgtgaacagatatctgacgatgaacaagtttttctgctggagtggaccggtcagacaggacccttgctaagcgagcgtagctcaactggttaggtttcttttagtggaaccaatccacccgagttcaaatcctagatttgatacgagtggttgcatttatgctaattattctttgtttctcaaaagaaaaaaaaattacaaaggcaccctgtaaacaaacctcaaaataatagtatgactaacctcaatattccgagtaaacaagagtaaagcaagtacattgcatctcaactattagttgatggagacgttggtcagttcaacatcatcttctctattaccacatgtatatatcaaacactaatttcttggtgcacaaaaaagtacactattttgctccgacataatgaaaataatttcctgttgcagtgtgggtgaactgcaatgggacatcaattgtgcagacatatatacacaatgcatgaaaatgtaaaataagtttcggttactgttgtaatgttactttaatcagaacatgtcatccaactttcaaaagaaaacatgatttctaaatgatttggatttttcccatccccaaggcttagtccgaaatagctgctcagaaaatccataactcatgtttatagatcacattagagactacctatatatgtatttttatatatgtatttgttgacaaattttcactactatgaaaaccgtttttgtaaacgggcaaaacgtatttccacagacgatggcatggaagaaaaggtctgcaaaaaacacaattttcgcatgtggacacttgagccggccgcatgcgaaaaggataaatcacgaaaaaaataaaaattccaaaaattgaaaaatatacccaccgccggtccgccgtcgtcctcctgtcctcatcctccagctatcgctgtcgttctcaagccgccgctgacgccggtggatctgggcagggagggcggcggccggcggatccaggcgggggagggtcgccgccggtagatcggggcgggggagggcagccgccggcagatctgggctggggagggccaccgccgtggccttcgcccagcgccgctgccggaatctgcgtcgcagggtggcatcgctaactcctggccgcccgcactgcagcggagcccactcccagcacttcctcatcggccgcgctgcccgccgctcctggccgtgaatgcagcggcggcgcccgctcccggtgccttcttgtcggcctcgccacccgtgatagaagtgagagaggagaggaagagaaaggccttcgttagttgctagacaaaaacttttcaccacgtcacgtcgaatatttggacacatgcatggagtattacatatagacaaaaaaaactaattacacagattacgtgtaaattgcgagacgaatcttttaagcctaattgcgcaatgatttgacattgcggtgctacagtaaacatttgctaatgatcgattaattaggcttcataaatttgtctcgcagtttacgagcagaatgtgtaatttgttttgttattagacaacgtttaatacttcaaacgtgtgtccatatatccgatgtgatacgcaaaaacttttcacccctgaacgaaacagggccaaagagagggagagaagagaatgaaagagagatagaggtgaaggaagagagggtggaaaatatcagaggggagagagaggagaggatgaaaggtgaaaaattttgaagcggtgaggaggaaaatttttttgctagcggacccttaaaagatctgcatgcaaaaataaattttcgtatgcggacctttaagaggcccgcacgcgataataggctcatttttatttgcagccccttaagaggctcgtctaagaaaatagatttttgcatgcgggtctattaagtagccgtatgtgaaaatggaggtcatttttgcagacgccgccaagggtcctcgtacagaaagtttgttgttgtagttgtgaatttctttcaaaaatttgacagatataaattatagtataattgtggtgtaattttattttaacttacatgcaattatatttgcacatgtaactacaatatatcatgtgcaaccggtaaatattttactcatggatatacccaatatataaatacacatgtactacaggtaaatgcagcatattaattaattgaacacggtgtgtgttataatattcatatagaccggcaactaatacttttattttacatcatgaagtgatgaaacacgcggatgggatttagaagtagatgggggtttcagaagtggggtaggatagacagattttagtattgtctataacaaacacacatagatttagtgatcaatggatatgatagtataacatatccagctaataattggctagatatttttattaacttggaagcatctagtaaatatcatgttagtataggtacatatatgtaaacatatcagtagcattagagcccactcgagcacaacagtagcgatccatgagaacatcaggattgggtatttgcaagctaatgcaggtttctgaccaacgtacaacttcttgtcatcaacaaactttataactggacgcggccgaatccttgaaatgtgccacgcactactagaaaaaatatttttcatggcggtactctatttgttttactggcggttatataagaaatctgcttgtgaaattgtaactaagagatggagagtttaggaccgccagtgaaaatgaattgtcgctagcgtttgcttaaagtccgcttgaaaaaatacctatgtttttacaagcgatctcttaaaagacagccagtcaaaatactgattttcgctggcggttactaggcagcatcgtccttaaaaaaaatccccgcacattaaaaaaaatcaccgtgcgcgtttcccttaaaaaaaattgccgcccacctccttatccatccactcgcttctcctcctcctcctttttttctggttcctctccatccaaatccatccactactctcctctcctcctcccaccccaccggcagcggcggctcacgtaggcagcggcggcggccccgacggcagcactcggcggcacggggcggcgggggagggggtggctcggctgcggcacggggtggcggtgctcggctgcagcggtgcaggggagggggtggctcagcagcggcgcggtgacaggcggccggcaaactgcgatggcccacgcctcctctccctccccccccccccccggtctcccaccggccttccttcgctgctggccgccacgacaacgggggaggctggatccaccgccgtgacgatgggggtggccagatccaccaccgcggcgacggggagaccggatcagccgccgcagtgaccgtggacgccgaatcagccgccgcgacaatgggggaggccggcggggagggc

SEQ ID NO: 66032 - DNA, 2100 bp, Oryza sativa
ataacttatgcttcactattatttaatgatggcttaatgatagctcatgatggttaatcatgattggttaagtaattaatttgccaactaaaacctgataatggtgggttgtgagcatatggttttgatggttgtgctcatgacaattaaggaccggttcacgattttcggttgtgaaacatttaccgtgccatccacaaaccagcgtgggcaacggctttactttctgtatagtatggttcatagtagagcaccagactgtgaagtggcggagataagcccaccggggtcgctggggagtccataccttgtttataagggggtgattatgatccgggaacggtgcactgctttgaattgtgttatgcaggaggtattgtcacaatctctattcgggtacttgttaagtatcgcgacgcatggttgacatgatgttgaggttgtgtcttgtgggtacagtggtacacctctggctagagtttaaactattcgaatagccgtacccgcggttatgggcgggtctaacaatgtctttcgtgattagtttcacacctctcaccgtaataaataatgttgtaattggtaataacttgtttagctcctggtttggaatggtatattcctggtttggagatagaactgtgcagccgggattggttgttcagaatggttgggcctatgcaacacgggtgtgttgtatagtgttgatttaatattgtttaattactcaactgttttactattttctcaattgcttattaaatgctgtttatgcaaatgagactatactatgccatcctttgttatcctgtgcacttgcatatttgctgcgtggcttgctgagtatgtcatatactcaccttgcaatcattcatcagaggaggagttctacagtgatgctaatggtgtggatgattaggtgtagccctggtcaagctacctgtgaagaggagtcgcctgcgctgtttcttttattttccgctgctcagaactttattgattgagaggaactatctacctctgtaatgacattttattcgcttattaattagagtaataattgtactctattatcaatttgttattgtgtgcctcggctgattcctggacgagggtttacatacatgtaagcgtttagaattttggatagaaattccgggcgtgacaactcactggcagcacctctggccagctggccgccagcgaaaactattttttgtagtagtcacaacagttcagattggttcactagctcaggatagctcatctgtaataggcgggaagccttatctgtgtcggcgaggggtactgtcacgaaccaaaggttattaatgtgaaaagtcatatgtgtcgggtcagccaccatcacggacgaccgtcatccttatcgggcctaaataaaagacccaaactcatctatgacgggtcatagttaagacccgtcacggataagagttatccgtgatgtttcaagctcctacttccaagaactgacttttttgtccccaagagtgatgtctggcttgccgccgatctcgaccgggtcgctgccattgacttgtctacggctatgttccgagctttgagtgacaacatcaggtgttggcgtcagaacccgacatcgtcaatagcctcgtgcgtcgtcttaccggtggtaagccctttttctcatttatactttgtttggcccaaattcttactcgcaaaatgacgctttattgcctgctgccggtttactggatatgatgcaatgctcactaacattctaccttcctgcacagttattatatcttgacaacatactcccaccaacagacgttggtctcgatctagtgttcacccctcgtatacacgtgtatactaaggagattgtcgatcggctggttagtgcggatcaggaagctggaggggatggcacgcccccgttttgcaacctccctgtaagtgtttcacattccttcttccccattttcctttccattaataaaaattcatgtgctcacatacactggggccggcgtacgcgggtatttttaatgatcactaaatttgtacactaaaacccaatcataaagttatcatgagggctcctgaacaatg

SEQ ID NO: 66033 - DNA, 1905 bp, Oryza sativa
ccacgcgatgtaaggagaattagttacccattatatcgttatacatacatcagcaaagtgatatccttgtagtacatttcattacttcgcagcctcgcaatttctttccgtcacgccgtcaccgtcatttgttctaccgccggacacggacatgatcgacacacaagtgaacgagaaaatcaaggagatttgcaggctcgagggggctcctacattctccgtggttgtattctcaaacatcccattcgtcgagttcacttgtgcttcattgcatcaaatcatattctcgtagtttgggtttcctctggacacatttttttttgtcatcaacttgagcatgagcacttagggattgtctgcttggtcaaacagtacgcaccaaaagtttaattctgaggcaatatgtgaggtgttttctccagttgcaaactgcagtaagatagtcatttattaacttcactgatcaaggaaccactaagctagtggttcaaataaacaacctcactggaaatggatgagaaatcaagaaaatatcattatgagtaaaatttgaactaaactctttagttcattatttttgttaggatcatcacaaacttttatctgctatagcacaatctaccaaaaattaaaggaaaaaattaactaataccaggaaaactctgtactatacttatcacaatgacacagctggtagttatcttttaactgcaaaccttttcttacccaagtttacaactatctgtccttttgctacatatcaaaggagcagtcaactcttatattgtgctgtgctttgatggttcatacagcgatacacaggtagatggcagttaaaattatactttgtccgatcgtcctctactttcggttaacattttttccccttacacaattattgtgtttttttggcagcttttgcccgagaccatgcctgacaccaacgacgtaaattcaacgccatggtctctgccaaagcggttcatacaagagccggcaatatttgtttcgccggtggttgttggccccggtatgccgtcatcggacgtgtcgcttagcatccagctcaggcacttcttactgaccaatggtggtcgtatggacaggttggtgttcatcatcaccttgatgatgtgcatatggtgcatcatattttttcgcggaccaccttttttttccttgcttagattacgggtttacatgttaatatttctggtatgcttgcagcgtgaaactgctagagatcgacagctctgttgcgtatggaaacaatgtgctggaatcgttctccgacgggagcctgacagaggagcttttcatagacgtgttcagctcgattctattcaaggatgacatgaagtacaggctagataattatggaaaaaggattttcattccgacttccatatcagtaacgtgaataacgccaatttctactgtattcctttttttcgtacggtgcagcaacatgattgtttttctgttcttttttttcgcgagatgtgactcttttggttcacaccaacacatggccacacttttttttttttgcagtttctcctgaacattgattttatcaaacaaaatggaaagatacaaattttccactgatgctttggccggaaacttgcgcgactacatccagcattggttagttattaatttttgcataaagactaatgccatgtctacttttttcccctgcatcgagcatcttttaaacccagcaatgctattgtaagtttcgtttctttacttccaaacactgaatggacagataatggttcctgtgctccaccactatcactggtctctagatgcaatcaacattgcacacaggctggttgacataatggatacaaacaactacactttgctcggaacactggtaagcgaccaccatgg

SEQ ID NO: 66034 - DNA, 801 bp, Oryza sativa
agttactttttaactgaacatgtataccccagtatgtatgaggaaaaagaatccgtgtttccactgtgagtaaagttaaaaaaataactcctttttcatcccgcctaatgttttcaaacacttcaaaggttattacgtgaagagtcaagcaattgcccaacaaacggacgtagcttgcttcactggaagaacagaatattagttaaaaaaattactctcaaaagcacaaatcaatcttgcaggcacgaacccgatgatgagtaaaaaaaaactagtttcgcgtatagggggcaacctgtacataatccatccaagtttacgaagcattaagttaaagaattactcgccattcccatcctgaccatcgatctgctgagattaaataaaaggattcaagaaaatctatgtatacttactcgtacgtgtgcccgtaataatagttaaaaataactattagtagcaaacacactaaaattctccgtggtgtatccaaaagctttaactatcggctagaagtaaaactttaactattattgccacaggtaatatcagttaaaatttaactggcattcaaatctacaccacgactgtaacatacccaagcctataaacctgagaactaaatttaatttaaatgcatcatgtggttgtggagtgattttaattgtttttggatcttaatagtaatatgtccgtactaacgttacggtgtcataacattttttcttaataagttattaaaattcgactgcaatgaaaataattttcctagaatctgtccatttaagctttcagtccaag

SEQ ID NO: 66035 - DNA, 3906 bp, Oryza sativa
gcacactccccacatcgcgttccaagtccaagaaaacacaccccacgcacagaatgcctagagctcggccatcctccccggctccggcgacttagccgtcgtcgccgtgcatccccggtgagtccctctctcttcccatctatggaacgtgacctacgcttcacgccgagctcacccgtacccattttgccctaggaccaacctgtcgagcacgtggtgggcgtcaccgtccttgccgccggccacccgaaccgccgacgccgctccggccgccgttcctcaccaccgaagcaacaccaagctccggtgagtttccgctggatttctcgcgcatgcaccctctgtggctcatccctaacacccccgtactctaaaagttacagttcgcgccttgagtcgacccggcgacgtcgacgccggagttttgccgccgttggccatcaaccaccgtctccgccgctccctggaccttgctgcctccgtttctctgcttggtgagcaccctggtaccatatgagagcacatgcactaacccttttgcactaaccaagcctctgcatgcacatatatgggcataccgagacacaccaccgctgtagctcatgttctatgggctacagaccaccatttccctcaccaccaccactcatggatgcgcaagaacgttctatatattttctcttttgtgctcaaaccgattcgatccaccgatcaccgccggtgagccgtagaccgagctcagccatggctgctcctgatgtgagctagctggggacttcatttcttgaatttgatctagggtccaatctgaaaactgccatgactcatattactatagcaggatcttgatggaaataaacaaaagaatagggactcttaataaagtttgctgtccaggtggcagaaggagtgcgggatgattcccccaacttctgagggcctctctacaaatctcctttcactgacctgtcgacccggctggaattcaatttcgaaaattgatttctattttggtttaaagcagagaataagcagaacttctaaaatttgtagaacattcattttaacttcaaaaattgtgaaaccagttttgttagatccataaagctgtgaaatattttacgaaaatataaaactgggtactttctctacaaacttttcctttatttttgttttgccataaatgttgcctagaacttgttaaatccataacaaatttaatatagctctaaaaattgtgaaatcacttcttttaactttctaaaatcattctctgtaactttgtaaaaggaattttgttcacttctgtacaaaaatgctgcttaataaaacatagccctttttaaacctttttaattgtaaaatgcatatctctgtaaataaaaagtgataaaataaaaattccttcaccagagaccacctgagaccagcacacactcactgcataaatttcatgcattttcttgcattttggtttttatgcatttttgtatttatcgtatacgcgtattttgtatagaggaagaatacgtcgaagaagaagagggtgagtttgttgacgaccaggttcaggagtttgcagacgaaggcaagtttgcccctcctttgatcacattgatcctatgctttattgggctaaataattctattgcaaacatgcatacgttagctagtattaattttggtaaaaaaaattatataaatgtgggaatggtagatatgacctaattgctgcataattcaccttgaaatattgaatccttgctggttgtaaccataaagtgcttttgaatacaattattgtgttctttgggattatactatgcttatattgccgctatatgcttatattcggttaccgccttgcaaattactcgttttgataaatgttatatgtgaaaatggttattttgatgttgctggacagaaatttaaatgtgtgagtattgtgaactgaaaatggagataacttgtttttaaacttgggcggcgagtggtgtacatatggtggtagttgtacaccgatagggagagcgttcgcccgggtcgattaaggaccccactctatgtcaccaactaatgaaaacagtacaaaccacatgtgctaagtatgggctggtctcgacctattaagttgtttagagtttagccttgcatcttggtagtccaaagggtatgggttaccgggttttggtaacttatcggaacttcctatggtttgtgatatgatgaaattgattaatgacatgtggtatgtgatgatttgagcgggtagtctgtccaatacaacggtgtcgtgcctcgtgagggattccgggctgggatccttacggcgctaggttaaagcgtgggccccctacctagtggcgctagcttgctagtagcgtgggtaaaacacacatcgtgctggtgcaaggctagacaataaacaatgtaaccgtttcgttatgacctctacatcacactcaatgtgtagagtgtggtgataccgaccggtatcggacaaactagagcgattcatatcatgtgggcttaaaagttgtacaaactttgcagagtctaaaactaatcgattagccgtgctcacggtcatgagcggcatggtgaagtgtcatgagtatagtcggtgattttgataaactcttgtgaacttggaaaatggttggaatgttttgctgtgaacttgggtaaagttcggtgaatggtgatgagatgacggtgagtggtgatgatctaccttgaggggtagatgtgtgttatttattcattgacattacaagttttacttactctatactattgttataaaattccgttgcggaaaatgttgtgaactaaaattggcatttatgcaaattaacctatacactgcttatccttgaatatggccaacatgtagtatgctaggattgtttccgaatgccagtacattaatttgattaatgtactgatttcttgccttcttttacttgtttttgctcagaccccgctgcaggtaatgactgtttggatgaggagtttgatgcagcttgtgatgttgcagattttcaggatggttctaactagggatttaccctagtcggtttgcccatgggcttttgggtagcacgcttaccgcatgaaccaatatttatggcttgtcgccaagtactacttagaaccttattaagactatttatgcttattgcttagaaccacttattatttggatatcatgcttgagatgatttatgtgagactatgttgcattcctgggcaactagtcccacatgaggatgggtttgaaatggttgagataaccggggaatatgcctttgttgagatcgagtctctggagtacgcttttggtcgccaacatcgagtggttgacgggcgtatgacgtagatggctggtgtggctattccaacggttgtgtcttctatttcatatccgatggcttagagcctatgtagtgcactcttcaagacatgtcggggtctgcaatgaggttggatggttaccgtatttatttgggctttatttgagaccccatccatccagatatttcgcgccgacatgccttggagcgttgcaccacctaggctttgggacgtcctgacaacgacgagctcatatttaaggatttctgtcacgtcctgataaattcatcccgaattaaaaatcattcgctaaaaggaataatagaattaattaaaattcgaaaagaaattggcaaacactaaaatacgaacaagaaaaattcaaatgtgacccggagaatttttgttaaattctccttggtctaaaaggagccctcaaattttagtggaattttcagagcacaaataataattattaagaaataaacaaagttaaaatgattttataaaaagaaaaaccctaaaaagtctttttttccccccccc

SEQ ID NO: 66036 - DNA, 9576 bp, Oryza sativa
caataataaaccttttgtttagataaaagttaaattaaactatgaaatgttatctaccatatgccaccatatatacatgtgttcatgtaagaaagcaatattactagagtgtactagtagtaacgaaagatattataggagttttactgcacattcactagccacgcgtagtagtacggttgttgggagagattatcgccgagtttagttccaaactatttcttcaaactttaaacttttccatcacatcaaaacttttctacacacacaaacttccaacttttccgtcacatcgttccaatttcaaccaaacttcaaattttgacgtgaactaaacacgtcctatatttgtcacctaacgtgactaaggcatgtaccagcagtatgcagcaactgtacttgcacagtttcaattatgagttggacttgagggtgagcttatgacgagatcagctgacgcgagactaattaaaacttcacgtcgtcaccggatcggctggccggctcacaattttcaacttaactagaaagaaatacgcgctacgctgcgccgtttgaagatgatgtacatgccacaactatgctacaatgtcatgaactgaagtgtataaaatagcacctggtgccaacatacatatgagtatagctttattgagaaaacatattgttttatattgaaaaaaaagtatcactacaatacgtcagcagaacaaaggacatgcatatctgatacaccacctacgcagaagatcataaagattatgcaatgtttgttgtatagtttgtaaagctgataaaccattggagtatgtcaaaggagtaacttacatatgtaccgatgattttaatgacaaaataagagaagtaatatcgtatatagagaggttctcccatgtacagtctcttttatgtaacataaatcatgaccaacagagtaaaaatgtcccaattaccaaaacggcacaaaatacacaccatgatatagtctaaatataggttttgggatacaaatatcaccaaaaaaaagtagaaatagatgtctttttcaacagcagcaatgctggctcggcttttgaaaggtgattttctgatctttttggcagtaactaaggtggtatcgctcttgtatgagtttatctgttgtcacgtcctgataaattcatcccgaaataaaaatcattttctaaaaggaataatagaattaattaaaattcgaaaagaaatggcaaacactaaaatacgtacaagaaaaattcaaatgtggcccggagaatttttgttaaattctccttggtctaaaaggagccctcaaattttagtggaattttcagagcacaaataataattattaagaaataaacaaagttaaaatgattttataaaaagaaaaactctaaaaagtcctttttccctctctctcccccttgggccggctcagcccatctccctccccctccctctcctctccccgcggcccactcggcctctccccgcgcgcgcgccgctgacgggcgggcccgcccgccaccctcgctgacgggtggggcccacccgtcatccccttcctcccgccgctcccgccgcctcgcccgcgccgtagcgccgccgccgccgcgaatcccgccgcccccgtccgccccgcgtgcaatcaataggggggaaatattccccgtgatcccctccccctttccccccatttttccctctctctctccctcggattcgtttggaaactttccccctaacctcgccggcgccatcaatggcggccggatcttccgcgcccgtttccccctcgtccggccgccctctctctctcccaaccctatataaaccttccccgtgcctccctccaccgtttccgccactcgccgctctctctctccaccggaatcgagctcgcgccgtcgctctctctctccgccgtcgccgccgagctccggtccgccgccgtcgtcgccccggaccatctcccgcctcggcgccgcctccttcggcttcgccgcatcctcgctgacctcgtccacccctccgtttcgctcgccgaccgccggagcaccgtcgaccccgtccacccgagccgcgccgccgccttcctccgctccggtcgccgtttccgtcgtcgccgtcgacccaaggtgagccgtggaccgccgattcgtttcccccttccctcccctctctcggccgccgctccgccatacctatggccgccgccggcgaccataggggcgcgggcgcgccgcctcccgccggccgcgccgccgtggccgtcttcgggcgcgccccgcggctgccgcgtggggcccggctgtcagccgctcgcgcccttaggtgcggctgacgcgtgggacccacggcgccggccggtgcgagcccgggtgcgcccggtccaccgtggaccgtggggctgccgcgtgggccccacccccgtggacccggtccgcgcgcccctcccctcggctgacgcaataaatccattttaaattaaaatttaaatgaagaaattcgcaaatattcatttaaagagcatataaacttcaaatggccataacttggccatttgaactcggaattggaccgtttaagtctctaatttttccttaagaagtcaagaacccatttttgtgctttgttcctgcttgttatatggagtttattagagtaaaagccttttcttttccgttggtcgtgtagacgctgcagcttcggaggatccgctcttcgtggaagttgaagccggcgtttgggaaagcgagcaaggcaagtcacatcatccttgaacatattgaatcccagtttataaaattatgttgctttaaattattgcattatcgctttatttaaattgccgcgttatcactgttttatctagccatgcctatctacctttgttatgaccttattattattgttattgttattattaccttgttcaccctagattaaacaaaaccccaactagtggacactctactcatggtaccactagtatgattttaggtagatgcttcgcttttttaattaggtaacattaggtggtttttcaactctagactttgggatattcatatcacctggacactttggaattgttggtttattgtggaattggattcacaccgccccctctattcaaaatccccaaaatggttttaggctgggctcggggtgcatggttttgatagtagcacctcggccatataaggaccggtcttcgggcctctgttgcaaagtactaccgtacttccacatgtctagtgggtaaggcttagtttgtggctcagtctggttataaacaaaagtacacggatggagatggacgaagtcgggggtcgatggacatctctaggacaaatgaaggctacacgagctgcggcccggtagtcgagatgttatggcacagggctggtgtcctgctgctaggggctcaatcctgcctacctgtcccggaggttccggccgtaggtggggttgggtcggtactcttgtctatggctaggatgggttggaaactatgtcacgtcttccgtctgtataccgtggtggtatgtggcacgtggttcacgtgaggaagatgtgtcttgtgggtaaagatgtacacctctgatcagagtataacctattcgaatagccgcgccctcggttatgggcaagccgagcaatgtacccaagttagtgttttaattcttaaaatttgctcaacaactaaaatgtggaatggttggactgggttggcttgggacgagctgggacctagggtcgggttgccagttcggtctgaatcatcgtaggccttgggttaaggcaggttcgtgcgggttcacgaccttgattaataatactgtgtagctctaggatcgtctttttaaaatggctttgggcaactaagtgacttttaaatgctgttttctgcaaaacttaacccctatatcattaccccttgtacccccttgcattaatggtgcatccgccggtgtggcttggtgagtactgtggttgtactcattcttgctctatctttctccccccttcagtaagagaagctttggagaagaagtcttaggtggagtcttggcttataccccagttgagcgcctgtgaagatggagccgtaggcccgctagtccgctgctgtttatttttgattgtcaggccttaagtgcctttgtaataatgtaaatattatcgatataataaagatgtgtcttttatatcatgtttgtatggtgtaccccggcttttcctgggacggggattaatacactagcattcgggaaaatgcaattttctcggtcgcgacatctgttcacctaaaacacattatacgcatcagaaaggaatctcctgaaaaaaaaggagaatagccaaaactgatttgcaaaagatgatgcaatgttattgcaaaaattaatgagaaaaaatgtgggaataatatacacacagcaataagttactgggatttgtacttccagcactagaggctaatttatacaaagagaagaaaagagaaatagggcatctatcaacacatgatggccatggattaagaagtggcacaaatagtaagtataagagaagtattctatcatgaacctaagatagaatcttataattgctggtgaccggcaacatggagaatttatatgcatagaacattcctggtgctgctagcatattctagaggcccgaccaaactattggatcatggcagagacagtggtgcaaagacaaatagttgcctgcagtcttcatcatttgcacattacattataaaaataagagccgctcttttaaaagttttttgtttggcagaatataagtttgtaggatagcatttcataattacctgcttcaatatcctatttatcgaatatggggtaacagagtcatctaaaacaccgccaagcaatgataaagcaatcataggctttatttcctccatgatcttatcaactttctttattgaactcgaccaacacaacaaaccccataaattaatctaacaacgcatcaataatagcatgtacatcatctataatatctgcattctacgcatcattgtcatttctggtagaaagcttggcaatcctaataaaaagtatatccttacagtgcatatcctgttggcagaatgctttcatataagctttctgttgatagccttgtagtgatgcctagcatgattttttttccatcgatgtcattctatcaagctaggtaaagtggcaccaccatatcatataatatataatgtagcagtacaaccaataaacatggaatttctggcaactgaattcatattaaataatctgaagtaaagaaaattctcttaatagaagtgaggcataattgcatatgatcattagaatataattaggcttttgttaaccgtgccgtggtaaagaagatgaatggtgtcctgcaagatgaatctccctgctgaaactgtgagtacccctttcaggatagaggtaggaacaacatgaaacagttagtgtttcctaaaattaaacaatgatgcacatgaacaatatggaaataaataaaaaacaatgcacctgcatattgtttgtgttcttcaaacttgaatccataaaactgcgcatgaatcatgaatatgatcatgccataaaccaaaagaggcaaacattaatttaaggaatatgatatcctttttaatcctagttcaacctagacagcgaacaacctagttgagagagagaaccaacctacataatcataagagaattgtattaacttgtgatagaatgatttcttgccttactgcatgaaagaattaatattattccccacactacatggaagcaattaaaataaaaaaggaatcactgggttgtagttaaaaacaaaaaaagaaaaggaaattgttacggtctagttgcttaatagagaggacagctcgatgggtccctcagcaagatggcacgatagagtggtagcacacaagacatcttctctctatctgtgaacaacacctcaccctaatccatcagtcactcgacggaacctaagggtaagatggtggatcaagtaaaaaaacacagtaaatgcatggaagatgctaaactgaatcaaataattgccttacattgctgtttttgtgtgcaacagcacaaagcagaatgggaagtagaggaccatgatgtgatgggatggctgatggcgtcaatctttggcggctgaaggagtggggaactcggggtggatgggggacgcacaaccaggaactcgaacgccggtggatagagaccacgcaagcagcgtcacggattcagttgccgctgcttcaccagatcaactcccgccggaagcttgtgccattgaatagtgatccaccataagctcgtttcgtggatcaagcacatctaccccctcaccgacaccactggcaaggcacgggatcctcctcaccggcgccactagtgaggcgccggatcaagaaaggggcaacccgagaagcccgaatacctccggttggttgcggcaggggagggccggtggaatcacagagctagagagagggaagggaatacccggatcccaggtaattagcaaaacatgcatatttatttgcaaatggtaaaacatttataaattgggatcaacatgctcaaggggaatgtgtgacttgccttgcttcttcaaaacaatcttccgaactcttttcctcgcgaccgcggacttccgaaacgacggaaactacacgctggcacgcaaaacgaggaaaaactctaataaaaaccaatgaaaaagtacataaaaagtaaacaaacatgtagagctcaattttagatgaattttgcaagttgaacggctcaattcggagttcaaatgaattagatatgaattttagaagttttgagccatttaaatgaatttctagaattattaacgaattattgcgcaattactaattattttccaaaggaaaagatcatcgttgatgtcagcaaggggcggccggcgccaacatgcggcccccacatgtcagcaagcaaggggacaggcgcacggtggacacggtccaccgcggcctcgggcgcgcgtccaccatgtggatggcccaaatggggccgggccgatccgatggaccagaccggccacggcggggaccaaggggaggcggccagccggcggcggagcgggcgcggcgcgcggcagcggcgacctggccggacagccaccggcggcagcggcgcgacgcggcgctggcacgggaggtgggcggcgaaggctaggagggagagggagggagcgctcaccgagcagcacggcaacggagggaggcaagatggcggcggcatcccacgggcgaggacgacgacgaggattgtgcggcgtccggcacaggaggaagggtggccgagggtcgacgatacctggggaagcgatttgaggaattaggaggggaagaggggactcccgacgacgtgaatcgccggccggaggcaagaaaagcgacgggtgctcaccggtgtgcgatggaggtggagttccggcaggattcgggcgacggggagcggtggccgaggaccttctcgtccttgcggagccgagggaggcgacggcaaagcgggggacggacgggagtggcggcgattggcggccggaggcggcaatggcgacggtggctcgggttcaccgtggagagggtagcttgagggtggaatgggggagcggcgtggtgactaggcttgtccgcggggcagcgaagccgactgcggtggtggcagggcgcgggagcggctcaggcggcgacgacaagcggctggaggcggattaaggtggtggcggctcgggtgcacggtggaaggggagtttcggcagaggtttgtgcaaatggagcggtggccggtgtgcagcgaggcatggcgaagccggcggtgcaagcggctcggcgcggcggtggctacggcgacggcggcgtgtagccggagctcaccggaaagcggcggagcgcgggctcgagcggggagcacgggagacggcatgaggagctcggggaggagggggaaacggaagaggagagcacgagggtgctttttataggctcggggaggagaaatcgtggccggacgtggcggatttgaagcggcaacggccggcgacatgggcgacatcgtgggtgaagtgggggctcgatttggcgccaaaaattggggagaagtgggggatttggtggaggaggtggaggggaaccgattttatgcggtttgggggcgagggcgcgagcgggagggcgccagatttggcgggacgtgggcggcaaccgccggccatggcggcttcggcctgggaagccgaaggtaggaggagggcctgacgggtggggtcgccgggtccacctgtcggggagggagagagggaggagaacccagggggttagttagactttgcgcgaggggaaggggaaacgggccgacggcccaagagaggagaggggaggctggccgaggaagggagagaggggcgtgggccgcgggagggaaagggggattgggccgggagcggcccaaaagggagagaggaggtttttaattcatttttcattttatttaattgattcaatgaactttatgtcattaaaattacttcttgagctccgaaaattcacggaaaaatccggaaagtgttttagggcacaaagaatattacaaaatattctcggccaatgatttttaagggaaagttttagttctcccaataattcacttgattaaattgattaacttttatttaatttctagaaaacgcattatttaatgatttttaatcccgaatgaaaatcggggcgttacaggtgatctcgtagttcttggtctgtgaagatgcgttattaggtggtccattttcccattgaggacgaacctcaacctgtgctcgagcgatagctctccatacactgataagggatgtctggattctcgagaagagaggagccgtagtgccccccctccccggaccgcccggatcccacgagtgaatagaaagttagatctacatgtgatctcacctaaatcgcccatctatcctcctgaggagaagtttgtttggtttcaactccgattcaaacgggaggagtacgccatgctaatgtgccttggatgatccacatcttcgggtcaggcgctgatgagcacattgaactatccatgtggctgagagccctcacagcccaggcacaacgacgcaattatcaggggcacgctctaccactgagctaatagcccatcgcgtgggcctccctttgggaggcctgctacgccaaaagcgagaaaaacttcatccctttccttttgacatccccatggcgccacaccacaccgagggggggggaggggggccatggggatgtcaaaaaggggatcctatcactatcaacttatctgttccgacctaggataataagctcatgagcttggtcttacttcaccctaaacgaaagaagacttccatatccaagtttagctcagacgtagctgccttgtttttgggcgtgaagcagtgtcaaaccaaaatacccaataagcataagcattagctctccctgaa

SEQ ID NO: 66037 - DNA, 16237 bp, Oryza sativa
agccttcattatttaactttgacactgttgattctattaaaaaaagaaaatggtatttttccggaaaattgcgatgatttcataaaacctaaaagttttgcatatgattacttagaaattgtaatgatagaaaaagtatatactctaagaaaatctttgtgcggattacaaaatttgattcaattttttgtactctaggacaagattttgactaataattactttattgatatattatctaggtgatagaaaagcataattatgagtatacgtcattatgaatatacatgtagcagcagtaccatatagtaaataacaaatgacacttacttccctttctcacttaggtcaacaatagaaccacctaaatcttttctaaaatgactgccatcctcaatcacaccaaaatttaaactacatttaaatgttctgtctgcctcaaaacatcctcacaagaaagaggggaaggtgctggtctaaattctgttgtgccatcaaatgattttgtatctgatctaaatctatgatcagcatctaaaaacctgcgatgtgccatgtaagaactcttgctgccctttgatagccttgtataaccggtttctatgtggcaatcagtgcaagcaacttcacctgaagttgtgcatccatgaaaatatcataagccgggatagtctgatatggtggttaatactgcagcacgcagttggaaaaattcacccttagaagcatcataagtcctaatgccttcacgccaaagagattccaaatcatctattaatggttccatgtagacatccatatcattaccaggggcagttggaccaggaattaatagtgataggatgaaattaggttgtttcatacacatccagggtggcacattgtatggaattgcaataacaggccaagtactatgggtagaattcaaggatctgaagggattgaagccatcagtagctaacgctaatcttatattacgactttcattaccaaaggtaggatggactgtgtccaagtgtttccaagctggagaatctgctggatgtctaagcaatccatcttttgtacgtccttcgtcatgccacctcatatttttggccatctctgggttaatgtatagtctttgaagtctttccttaattgggaaatacctaagaacttttctaggaactttgtggaaacgttttccatcaagactctttctttccatcttccatcgagaagtattacattttgggcaggaagtataattttcatactgtttccaaaataatatgcaatcattttcacaagcatgaatgttaatgtagccaagacctagagatttaaccgtcttctttgcttcataaaaatttttaggtagtgctgcaccttcaggaaatgcctctctaagtaagtccagtagcatgtcaaagcttttatcactccatcctcctagaaattttgtatgcagcaaacggactaagaaatttagtttagagaaggtcttgcaaccagggtacagctcctgacttgcatcatctactaatctataaaaatcatcggcatcattattggcatcccctgaactgccatcagcagcacccccctcccccatttgatctaaaccatatgccatatctctaagcatttcaggaatttcatcacgatcagctgccctctgttctacttgaacttgttcatgtgtagtgcaatgtgcagaagatgatgcttccccatgaaaaatccacagccggtacccatgcttaaatccatcacatatcaggtgttcaattacaatgtttgcttccaaccatgaacaattaacacacttcttgcaaggacacagtattttatttccttttgctgaatgagtaaaagcaaattctatgaagttattgacaccacgtctgtactcagttgtgctcctgaaatactatattattagagtttggacaaatgaagatagtgaggctaaacaattccatgctagtaattgtgtgtttgtacctaggcagatccatccatcccttatccatgcttgcctcttataatgaaatactaaatgtctgaatataaaatgcaaatattcgttatgatactgcaaaaacacaaatggttaacatagctctcaagctcaacaagcattccagtcatacaatcaaaaggcaaaacatcgtgtaaaaaaaaactaaagtatgtaaaagtagttagtaaatcacatagaagtaagaaaaactgatgtcaaagagcaagggaaacacatatgtaccttttagttgtgcgtttgcttgttaatttgttctggtttgctgccaaccttgttggtgtctccgattactcagcaagaccttctacatttttggataataaatacaaaattttaaatgcaacctctgcgatatattttgctcttgtgcaatgcaaattgaaaaattaaataatctgagtgacaatcctcaggttcagaaaagagcatctgtatttctttttacttaagccactgaacatttgtattttcagatgaaataccataaacaaaatcaagtagtcaccctgtttatatgcagtacaatgggttagttagataccatatcacttaaggtaaattttgttaattgttagcacaaataaaaaggcagctatacacctaaatccagacaaagaatggatgctcgcatttgatggtctgctgctttacttacataattagaggagccccctagtcataaactaataaacagagaaggagttccacttccatacctagctaaatatgtcagggaggtcaagtagacaagaattaagcaaattccaccataactactgaagatagatctgcaatggaaaaggtagaaaattggttatgccagggtgaaataagcacacatgagtagtaacatctcagaagggatgggacaacaaccaattggaaaaatattccttttacaaagacagtaagaaccatcatctatcatttctatcccagtagtcaaattaaaaatcttagcacatgactgaacataaaacagaacaaacaacaatgaactctgctccatcaccacatctgcctggggaataaagttaagataagggggaagagaacataggagggaaggggaagaggaagcagggaatggggggacaagcttgaccttgtgttgttgattgcagtggacaaagaaacgtcgtcttgagcttcaagaagggacgacggtgcccagaacctcaggtgaagcagatctggtgagcacagatgcaggtggctccctaggagcgatgaggtcgtgctcttggtgatgaatcgcagccaaatgcgacctccctgcaggaaccaccttgggggcgtggagatggtggattcatgtgggatgggccacatggatgaaccaccgggggcaatacatcgtggatgatgtgggggagatggaggaggggacaggaggaggtggtggcgctgctggttggagaggaagcggcggcggcgctgctggttgggggaggagatgaggcggaggcggaggcggtgctgctacctgctaggtcttggagtggggattttttcaggtttctgagagagagcgtgtgagagagaagagaggtctgtttgtttggagttttggtgctgaaaattttgttccgcgccattccttttttgtttagcgctcgtttctcccgccgatacatttgggccgcgccttttttttcgcctgggcatctacagatatagcgacagacaattggacgggacagttcaattagtggcagacaacttgccactaatctttaccgacagacagtgcgttaaaaaaattatttttaccaacagactgtgtgacaggatattttccgacagacaaagtgacatctaaatttttttctaccgacagacgactgtcttctttttagtgttgtggtgtagtgaatatggatattatgacatcaatttgtgtcacaacaattatatccgcatagaatagttattgaatatcaaagctttatcccaacaaagaaaattaaatatttgttgtattttttgttggtgggagtacatttagttttctctaactaatattttattatagtaatatacgatatcaatgtggctaggatatttgtttcgatcatagtatatagtatattgaatttgtctgacgatttatgaagatacttttcttcttgcttattttttccttttctccttttattcgtggcccaaacgcctgtaattgggctgtacagcccagcttcgtggcaaacaagagcatctgcaccaaaggtctattttcctttctttctttttctttttgtttttcttttttgcgtgctgttcagaactccggattggtcgagacgccaaaccaggcacgacgattaatgcatgagagccgtgctaaattgatcgtaaacttcgccacgtgtaccactcaatttaaggcggttccgccggctttagaagataagatatgtatgtaaaaatatttttttgagaagagaaaatttctcttattaatctattatggtatatctttgatcaacatgtaattctattaccttgttatatttacatcattcaaaaaaatatataaataggacaatcaaatctaaaatcctagatgtgcaactgactccaagactgaagttctttttgttcatgttaaaatgcctctcgtttggaagaaaatatttaacacgttagttgttgcatgcgggcttaggacgaaatgctcgtaaatatgcttatatttttggtttcttgatgagcgaatgttagaaatgatatgtgatgcaactagaaactcgattatatttatttattagcaaaggtgtcatcactctgcatatcctcacatgcatccttaatagaagatggtagaatgcgattatatatcatggcttataagcttattagaaatacaaagtgtcgtaaacaaacatgagagatggccggcacactggtttggatatcatgatatccaacttatttatgactactccagggcagcatatatagccttgcaggggattcaaagtgcgaattcaagtcccttatgcttgcatgatgcagttgtttaggaaacgatagtgacaatatcagcttccttgttgcagaagtggtagcatgcttcgttgcaacgttccacagcaccgttcccttcttcgttgccagcaactgcaacggaaaaaatgattgtatacattagctacagcaaaccgatgattcttgtcctatatgttgaaaaatggtaatttggtttcatgttctagtttctagcttacaagtgtttatgttgctgcacacggatgaagtacatcccagcatacagaagtcaagtacatccaattcctctgcaaaatcatgcattttcatatatatttcagtaaagtactaatttctaatctcttgcacacaaggttgattgagctgcatatatgaattatgaaaccaacagccaacaaataaagagaaaaggaagttaatatgttttaatttaccagactcagggtgaagggtgtggtgaatgtaaggtggcttgcatttcccatcaacaattttacagccagagagtttagaacatctttcccttgtgccatgcgcaaaacggcatgcattatagatgtttcttgccgtggtggttgggcagcagctctttgctcccaccttgatcgtctcttgctgcaggactaagcctagcaccagcacacacataatcaaactcttcacacctttcatgttttctagcttcttttcatcgagatttagtcgaggagattagcaaagcaagaggctaagagacggtactactttcttccactcgtctatgcagatgttgggagagtgaggtgcctatttataggcgcaaccaggatcacgtcccagctgcatctgcatgatatactgtgattatttatcttcattagattattattgttaatatttcttatgtgtgtattgtttgtttactgggacaaggacaaatgattcatccatgtggattaattgcatggtacttaataagctactagtgtaccatcttatcttcactattgtaactcccggccatttcatgcaatgatgcaaagccttagctacccatgtgctgaatattaaacgttttgtactggcttctagtagtactgggccgtagcttggtgactgtcaaaaagttttacacaagtagtaaattaatcaccatacaaataccacctgttcacaaacctgttgttgcttttaaaactagggcacgttttgtaacatacctgaattctaggattaaggaatttccatcaaaactagttgaaagggaagttcttcaattttgtaaaccaaaaatttccattttaaacctaggtggagttgatccaactcttgcatgataaaattttagaacaaattaaaaacctttgcatctctaacctaggacaaaaatataaatttatgtgtaagcatgcatactctcatagacatgtttgacttgagtccttcatatgcatttggattcggattgcatttggattttcgatttgcatttcataataggtctcatgaatattaactaagatctagataaacaactaaaccattagggcctagtgctagctagaggaagttaaaatagaaaccatacaccttaaaatatatcaacaaggccaatgtcaagccccacaaaactatttcggtcatccatctgaagactagtcatgaacatggaagtgaccaaataaattatatcatatagggtatattctatcttaatcatctctataagcattctcttaatttaatactaatgtaaacttatgcataataggtaaggagcttatgacctgtgtaatgtaaattgtaattctaacatatcaacatcacctcaggttaatgagagtccaaatataacttttataaacatttacatgcatttaggaaagggaagcatttataagatataagtcttgcgaattatctaaaataattcgtgcaagataaaatcatgggaaaattcatgtaggctctaatcaacacatgcaactcactgtaattttggtatgatttaataactaaatttggtacctcaaataaatcagtcaaactaataaaaactagattaactgtagttcttactcggctaaaaccatactttgtctaaaagtgcatttaactgcataaaagtgtataagtaaaataatttattcaaatactaggtcatttataatgaataaaaataatttttccagaatttatcttctctttttatgtctcctaaaaattcgaactattttccaaagaacccatattcctctaatttctgtgagtaatctatccataatttttgagtgcaaccaaagaaaatggaatctaggtatcttcatctaccttcagaaaaatccacactaaattattctacccacaaattaaataattgaaatactaaagtgggagagagaaataatccttaaaatcattaaaatcattcaaaccttttgttcacccacgtttctgcccaaccctctcaccctagcttagtttgccatgacctggacccacttggcagccactctggctcgtcctcaccctgtgcaaatcttccagccgaccagacacagccgagagagagagattggcgccggctgtgtacgacgcgtggcctcgacgtggcagcgccgaaccgaggcttcacctccacccagctgcgtcgccattcttcaccaccatcccagtgccgatccaaccgagggaggaagctccagctctccctctccacctctctttcgtcgccggccgccaagaagagggacatcgccaaccgtcgtcgagccctcttcatctctaactcatactcgttccattctcatctcaccatgacgaacaactttggttttgatcccattccatttcatcttctacagcagcgggaacgccgccatgtcatggtcgctctagagcgcgctctgtgcaccgccgcagcgacatcatcgccgttcccgcttatctggaccaagccgggccaagctgtcgcgccagcgtcttcgcctcgacctcctctccatttcccctcaataatctcgaaggatggtgctacgagtgtggagatcgtccaccgtcttctccacctccggtcaccgtcgccgttgccgaatccaccccctccggtgagtaccaacccaattccatgcatcagtaccatctctggggcctctctaacctcatggacacacatgcatgatagttcttggagctgattgagccatcgccgttcacccggaggttcttgccgccgccgagccgttacacgagccaccgtcataaacctagctaccccagccatgtctaccatctcggtgagcacccttcagcctatagaacatacatgcatgcacccaattaaccaatacatgattgtagaagcacatgcatcaccacccgaaaacatcctcctttcggactcgccgccggcgttactccgatgtccactgaccgagaaaagtagaggaatggaatcgcaatagcatgatcttcattttgtcttttggtcgcaccctcaaacgagccatcgtttgtcgccggtgagctcgagattgagctcagccatggctgttctgcctctctgcgtgagaaaagaagtcagggaccttgtttcgagaatttaaacaactataaggtttaatgtgcaacttttcaactcactgacatatgagcctaggtctgcgggttgattcttagaaacctcagggatctttttgtatattgatctttcactgacagtggaccccttggaaacaaaaatctgaaattataaaaggaaagtacctaaaacttgtaaaatccatataaaattaaatatagctcattttaagatgattcaaatttctgtgaactcaccaaattgggagctttgatgttatggaataaaaacttccactcacagtacaaatttagcctctaaaatttatccaagttaaatcacacataaagcacgcacaaaatttataaaatgcatacagaattcatttcaactcattttggagcaaactcagtttctacagatccaccaacttatgttctcctataaagcaaaatgaaatagcatacatactatacatcaaatgcctctaaaactattacctttaaatgactagttttagataagctgaattttagaagttcatataaaattcatcttagatctttttttagtaaacccaagttctgtagaatcaccaaaacatatacttccaaattataaaataaaattatatacttactgtatgataaaagcctctaaatacttatgtaagtaataaccatcatagagcaaccttaaattgtaaaatttgtagaaaattcatctttagtctaaatgaagtgaaccaaatatctatagaaccagcaaacagtgggcttcaacatagtaaaataaaatatggaaccttctgtacaggttatagctctaaactttaaatttataggataggtgctaatcacatagtatcgattgagcaatatgtatatatataaatgtatatagaaatacactctagctataatgaaactcaaataaaacttgttagaccagtgaatgcatagttccattcccatccaccaaaacttaaggcacttagctcatataataatttctaggttgatataataaattgctaacatggactagagctcccctagtttataaaatatgaaccatgataataaagaccataagcctatgaactaaggttagattagctaactaaaatactcattttatacatcactagctagatgaggcaagttctagacctaaacctctaaagccatgaacctatagaacactatacacctataacacgttataacttgtaaaatacataaagaattcatattaactctaaaaattatgaaaccaaatgtgttagtgttagaaaacacatatcttcaccccagcaaacataaacttaataagaattaccttacaacagcatttcacaacagtaactaagtaaatcctacactataccgacgaaacttctaaaattcataactcccaaataaaatgagataaaatagaaattctttcacctaaattaattttagaccagtacctattcactgtgcacaaatcatccattttagagcattttggatttttcgcatatttcggtgtttaattgcataacgtgtactttgtatagatgattgcttaaacggtgaagaagtgatttaggtgctgacattttcctgattcaaggcaagtcccacctccctctctttgatcactttgaacctatgttttggaggttattgaaaatgtttgcaaatcctgcatgtcgattgtgcattaacaaattaaaattgtgttaaacttgttagacaaactcctattatttgcattatcaccttaaccccacatatatccatatccctcattcctaaccttaggaacaatatgactacaccactttatatatgaattttggagtcactaggttactataatgcttagccatgcttagaatggtcttccttgtcattatgggctcattacaaatatgaaaaattgattttgaaataatctggacagaactttaatacttgtgattttgataaataaaatgatggaaaacatggattttaggtttgggcctcaagtggtgcacatatggtgattagttgtgtaccgatagggggagagtgtgcccaaaccgacctaaggacttcactcaatgtcagttcatttcgtatacagtgcaaccacatgtgctagtatgggatagcccaagcttagtaaattatttatggtttagccttacattctggtaggccggtgtgtatgagttcgtataattcagaggagtttcctatttaccccgaagtggtagtttaggtgactaagcgtgtccaatacaacggtattgtgccacgtggtgggttcccgttgtgtccgccaccacggcgttaagtttaaggcgtgggcccgccacttaacggttctaggtcatataacgtgtatggcttaggatggagtaacacgtatcgtgctggtgtaaggctaaatcatgaattttggaaaagctttgttgcgggtaatcgactgcttcttctaggacttgaacttaatggggtaaacccctagtcggtgtgcttgtggattgggtagacaagcttccactgttctatatatttatttggccaattggccaatgtaactaaagtagatgtagtttataatcgctttcatcttatttgtgtttgctatgtataatcatgcttgagatgaaagtgtgaatctagtgcacatcctgggaactagattcacatgagtatgagttaagaatatttgagatgttgtagatctttagccatttttgtcaagtctcctgaatgtgtaacacatctggtcaccgccttcgagtggtttgacgggcacatctcaggctgaagttgactggcaggctaaaggcccggcaatgtctccaatattcctctctcgaggcgtcggatatttcattatacttgtttgatgacttgaattatacatttcatctctcaattataatggaaggtccggagagcctacgacacgtttaacgaccgattgtgataaataccactgtaggttccttaatacaaataccacctatccacaaaccagttgttgcttttcaaactaaggcacattcaacgaccgatcgagataattactactgtgctagttccttaaagagtaaatttcataatcattcagctactttaattgatcaaattattttaaaaatatagatttaaagtgatgtttaccaaaattacatatttaacaccaaatttactatgcaactacgaatttaaggtgggtaagccaaagctacatatgtaataatagagttatatataacaaaactacaggttttagagtttaaatctctagtgctactattatgtcagagtcataaacgttgtagatttgtgattaaatgggtacataaacagtagttccatgataaatttaatgctaaatctgtagctttgtgatacaccatcttaaatctgttgttttgtattagtttggtgaaaatatccgttgttctgtgaaatttacatagaataaaaaatatagatgatttgcatttcacaaacttgaatacacacttgcatactgatttggggaatgactgcagtaagaaaaaaaaattcacacataagcaagttgatgtttaagaaaatttgatggcaagaacacatcgaggataaatcaatagaaaacaacacaaaaaatcttaaaaacaatatcatacgcatctcggctcaaatccaacccaactgtgctagcatgcctcgccattgccttaaactccagacccatcattgttgtcatgactcgcctcctcagtctccccctgtcacaaccttaagctagatgtggcccgtggaggagttgcccgggtttaggaagatgagaagccactattgccaatgtgagggcctgatccagttgtcctggctttcttgcctgtgtttttgttgtcatacctggttctctgttatcgaaagaggagtatggattgtgtcagacaaggagtagacggtgctggagcaagagtggatggcatcgcttggagccggctttaatttacgtgatgtcttgaggtgatctccacaacagccgagagggctgtaaggtaccatcatcatcagggaattcgtcaggaaagcagtaaacatttctagcgatgaaaatggcaacatcgtcatgaagcgggttatgggtggcgtcttcaggtaccatcatgaaataaatgatctgcctcataccgtcattgggggagatcgatcttggaggtcattgtgggaagccatatatgagtggggatgaaagagagagggggaatggagagatatcgagagaatcgggtgttagtgcaggacttaaccagatcaacggatgtgaggccaacacttaatgtggttctaaaactatgaccgccatctcgcaatttttgccattagttcaccttaagaaccggtattgaatattactgccagttattttaattcgcagtgatttttgtactgccggttccatttggaccaagattgataggccggttggtgtttcggtactctgtatcagttattatgtgttgcgtctaagtttgaaaatttgtaatcctacgtctgtgtaagaatatataccccgctttacactacaaagtttgtagcttgtagcacctctcaaatacactaaagcactaaacaaaatatcatcctagttaggctccactactgcaaaacatctgttaggtgccagttgcaaacccggcatacatgctgaatttacagccggcacatatcatctggcagcaataccctagacttattggtgccagtggtaggaaaaaagaaacgccagctcgatgctttgatcagtttgaacctgtttcccaacattggatcaagaatccacatcaacagatcaagaacatacaggatcaacaatcccccaaatcaacatatcaagatcaaccccacactaattaatcccctgatctgtaacttagaaactaaaaaaaatgaaaagtctggactcctataagtcggtagctacgagggttttgtagtagtgctcaaataccatgacaaaaaaggtttggcaaatatccaagggtgccatgtcgtagttatgttcttcggtgtatgagattcatctctagtgaaaaaaaataggtcatctctcatatggtagcgatcggacaataataaaccttttgtttagataaaagttaaattaaactatgaaatgttatctaccagatgccaccatatatacatgtgttcatgtaagaaagcaatattactagagtgtactagtagtaacgaaagatgttataggagttttactgcacattcgctagccacgcgtagcagtacggttgttgggagagattatatttgtcacctaacgtgactaaggcatgtacctgcagtatactctctccgtctaaaaaaacaaaccctggtttccgtgtccaacgtttgaccggccgttttatttgaaaaaattatgaaaaaaattaaaaagataagtcacgcataaagtattaatcatattttatcatttaacaacaatgaaaatactatttataaaaaaatttataagacggatagtcaaacgttggcacggaaatccagtatttgatttttttaaggacggagggagtatgtacgcagcaactgtacttgcacaatttcaattatgagttggacttgagggtgggcttatgacgagatcagctgacgcgaggctaattaaagcttcacgtcgtcaccggatcggctggccggctcgcaattttcaaattagggtgtgtttaattcacactaaaattaaaagtttggttaaaattaaaacgatgtgacggaaaagttgaaaatttacgtgtataagaaagttttgattgatggaaaagttaaaagttgaagaaaaattttgaaactaaaccagaccttaatacgtgttgtccttgaattattgccactactagtatttattctgaacggcattgatacccgtacgttctagttcaactggaaatagtacacgagttggtactactactaaaccatttgtatagttctcagacattttagactgtgtttagttccatattaaaattagaaatttgaaaaaaatgaaacgaagtgacggaaaagttgaaagtttatgtgtgtagaaaagttcgatgtgacagaaaagttgaaaatttgaagaaaaaaattggaatctaaacatgatcttaattattatatataggcagataagagatataccgatttgccaccaaagtccaaagagtctgtagcccaagagattgtagcatcgtatagaacctctcaaatacataaaaaacgattgggattataacacctctcaacaagaaaagccatttgtctggggacattgtttctagtactccacaagatcgcggctgtgcaagagcaatcacgcgcgccaccgtgcacgatgtaacgagcacatgtatgacagtatgagatgcctttgagcagtttcaattcatgtatcagcccaattaattatatgtttgtcagaactcgatcagaaactaaggtttcccagaaatacaccctccgttaaaaaaaagacaacttctaaagataaatctggataaatgtttgtccagattcatctctagaatttggttttttataagacggatgaatagtttggcagggtatataaaaagacctttataccaagagagtacatgctggattgatcctttctaacccccaaaattatatatataattatatatgtatctggaatgtgtgtgtatatacatacacttcgcggatgctgacaaacattgatatttcgaccacatcaacatgtattaattacctcattccaaaataaatatatatatatatttttaggcgttagcacttaaatgaggatggagagaaaaaaaatactccttactaaaagaaagtagctttggattactgttaatggcactactggataccacacgctttcctgcgggatatgtaaacgaatacatgttatacattacagaaataatataggtatagtatatatttaaataatgtaaaaatgatgcgaaaataatgatttgacattgatttcatattgagttctaaaaatataacaaaattataaatggtatatcatgtttgcatgatatttaaaatattatactacctccgtcccaaaataattgtatttctagaattcaaaatttgtccaaaataattacaattctagagtactaattgccccatcaatcatctctcattcaattttttcctatttttcccttaaccatcttcccgctctcacataaacactatttaatgagggacactatagtctttcctctcaaaccttaatacatgctagaattacaattattttggaacggaggtagtagataataattgctagtgagtgatgatgtatcacacttgcatatggagttttaggagttactgtacataaactgtagatagtatagatttattggatggagaatacgagggaacatatctaatgcactttaattaggacaaatattagcggataggaatgaattcattttgggatatatatggaggaagcatataactagctcctatctcgtttaattttgatggacaattaatataattattcatacaatataaataaaacatcaggctcatatcgataaaaaaaaatactatcgg

SEQ ID NO: 66038 - DNA, 17292 bp, Oryza sativa
ctgcagcctgcttggaacctgtagactctctatatctaccgcagcccggagttatatatggatggtacagttaataatgcttgatggtgattgctgaaaacgtggcaaaattgggcagaccattgataactttgctagctacgtgccagacagcaaccagatccaaaacagtgttaaaatctgtactactgtagcatcatgcatgtttcacgccctttgctctcagcctatgcgtgccagctagcctcttttgccttcgattccacagtgccactgaactgccacacctgcacacaccaccacgtaggcacccaatacttttacatctgtgagtatgtcccttaatttgctatttgttcaacacaggtgattaaatgttaattaattcggtacacctactaaattcatagggatgccgcatatgtaaattatgaacaccataatttaaaccatgttctggagagtactatcttcagttttgtttggcacagctttagctcctggagctgaagctcatccaaacagtttcagctatacctaaaataggagcagagctgggtggagctctctcacaagataaactagagttgtggagctaggtctaggtagctccacatcaggaccggtcctagggttttggggccatagggcaaaaacttatatggaggcccctatgtatacatgtaaactagtatatatatttatatagtcttataaagaggaaaaaagatagagaaatttaccaaataagatgaattggacttgaaggagtgtaggatcttgaaatcagatgaatgaatgaattggaggagtgtagtgcaggcagcgggcgacaggggcagcgagtagtagcgagcagagaaggcgaccggtggacgatcaagacacacgagcatggctactggcgagccgcgatttgctgacttgccgtatccgtttgcgagatgccgagaagtcaccgagagcgcaggagcagcgagcggcgtgatgtgatcgagatggtgcaacgcgagtggcgtgtgtgatgtgatcgagacgaagcgacgggagtcagaggaagatcgcttcgtcttcgctgaaacaagcctggcgatggactaaaattcattttctatattgggctattcagctgtctaacttatataggcccatggcccatggactaaaattatataatacgtagtatatatactatatgtgtataggggcccctagattttggggggctcgggtggcggcacggcctgaccccccccaggaccggccagtccacatctccactccagacccaactcatgtaactaaatttagacgttggagctctaccaaacaggccacccttacacctatattgtttcatgaatctcatcatagaaaacccaatccaaatcaaatgtgacaccccaagtattattcgacatttctggcatccaatatctctccatttgacctaagaaggccatggtagctggtggcacgtggtatagacttcggcaaaacatagtaagtgctccgcgaccaattcattatggaatacacaaaaagtagatggacgcactcctttttctttcacctgtgttcataaccactctctacttagaagccattatcgatcgaaaatacataaaattcaccgctgacccgtgaaacatgaggatatgttttgtgtacagatgacatgaatcttttcggggatatgagcagttctcacagtatttgtaaactataacctacctccatggttgtgcttaaagtggaaatacgttatgttgcgattgttaatccacggaccgaaacaacccgtctcaatgataatgatgtattgttagagccggttatcgatgatctagaaatactctggtaagaactttaatctccgcgtcctattgttttgcaccattaatgactattccatccttggtaatctttcgagacaaactgtgaaaggaaaaaaaggtttgctcaggctgaaaaaatcgcaaaatatattttacatgggtcataggagttagttggctccggttacgtcactcgtacagaaaaaagaagaaactttttcaacggtaagaaagagcttcaacatgctccagtggatttaaccatagatgaggtgcatgacatgattaatatataagtaatgagtttaggaagaaaatgaaatgtcctaaggaaaatgagaagggtttgtggaagaaaatccctatatattggcaactaccttattggaaagatatcgacgtccgtcattacattgatctcatgtatacttcttctatgtattatcttgtagtactatcaaaaaatcaatgttttgaatacacaattatctagtacaatatttttggagaaactatacatactacaatatacaaaggaaagttgttggtatgagctatagcccacctcatctagcaccctcttgcctagctaagcaagctggattaagaaaccaaactcagatcttcagttttttaacaactgggatcctcagaatcctccatttttcgtgtcgtaattaacataaagccgacacatgttgatttgttctctctcactatgcaaatatatatacatagaggtgcatcattctacttacactacttatcagagggaatgctggggtggattgttggatcagaagtcattacacaaattaatcaatcgagcaaccatttgtaggctgtagaatgaaagattgtggtgaattggcctacaggtcatagagattttaatcctattgacaacccactctctcaaacagtagtaacaactagtgttgaattggtgtcatgttacgcatgttggacataatttgcataaaagttattgaagggttgtgtttgatgaagacatggaagccattggtgaccatgtttgcatcaaaaggttacagttctggtagtaaaacaccagtacagatggtcataaggcttgaggcccgatagttgggccgtgcctgggccgatgccttggcacggtgggctggcccgacacggcacaatcaaagaaaaagttgaggaatccaaaatagacttaactcagccatacaagacatggcccatagagaagaaggatacacgatagacttattccaaccatataaaacatagcccaaagagatgagggaggaaaatagacttattctacgaagaagcacaatgtgttgtcatgccttcaggcagcctagcacggcttgagtcttaatgggccgtgcctgggccgtggatgcagcctgtgggtaggcacggcccagcccagcgtgtagatcgggccgtgccggcccaactgaactcatcacaagcccggtcatgcccggaccgggtgacccatttgaccatctataaaaaccagtggtaggtggtgcgatgagggtggcgttggccctccggtctccacttgtacttccctgccacggatgtcacccttcgaactccctcaagcacctctatcagcactggcttaacctttattgggaactaggaaacatctatgtttgtcacctcacacacgagctaggttcctttagtttaatggcgctagtgagtcgggggcatgtcggttgaggtcaactatgtgcactctgatcaatgcacatatatgtctaattaaaaaatacgtaaggtttccgtgactatttttgtccgtcgtcgtcatcatccgtgtacgtgatggaaaactctagtgaaacggactctgagatgagaaactctagggttttgcttatttaggatagggctcgattccgtgcacgatacgatgcagttttgctccgattcatgggaaaacggagagaggatgagataagaatcgaaactcctcaatcaattttgtactatctccaaggatgctaccggatttcacggagaagacgatttcagacagcgtctgcaagctgcgggagtctagccggaggtagatgacgaccgtgcgtgtagcgcgggtacccacgcgacagtgagaggagtaactgagggagcactattagacttgtggatgcctgatgggcttgatgcgcttgcaggccggaggcgaaggggaggagaaggggagaaaatgggtcggctcggctgcgtgttgagggaagaaatgggctgaaaatggcctagggagaaaggagggtttttatttagaattttatttaaataattgctgaatgatgtttgtattatcaaaattagcagtatagctctgaaaattccgaaaaattttaagatagtttaattaattaagaagaatttaatataaattaaatccagccatagtttaattgggaattttttttcccacatttacttcaccggaaaattaattgaactttagtataaattctagaaataatttattaaatgatttataaatcccttaaacaaaaatcatggtggaaaatccatcaagttgtcaatttggattaggacgatacatacatatgtcctatcacccacaaaaatcatgcatcattcaaatttatgttgtcactgcacatcaaaatagaggtctacgagatcaattaaatgaaaatgacttgatgaaaacgcattcccgagatctgtgaactcaatgatgccatcttctttttagagggaatgtgctactaagacgcaacattacatgcaacatgaacgttcatccgtgcgttgccgattcggcacccgtctgtttaccgcgtgctttctgtgttcccatccatggtggtctcacgacagaacgaaccggtcccaacgtcccaaccacgactgttttatcaagccactccaaaactagatagtacagtgatgttatgttaacgttagacctaccatatcaccagacctaacatctttcttttcttcaacatcgtatatatgtgtaattgcaattttcatatgtagcggggatgaaattgcaactacaacagagatacacacatggtttctttatataaagaagataaaattagtattttaattaattacataatgtaaatctttcttaactttttcttaatttttttgaattttcttcctattgcaatcgtacgggcacgttgtcaagtggttagagacgtgtataagtcctggagactcgtcttggtcgggcatgggctcggccggggtggtacgtgtctgttttgcgtcttcctatggcacagttgccatgatatcaaccaacataattatcctatatgaaggcacatggattgcctattatttaattgtaatgacaaactattaacacactatctaaactcatcgattttccaacactattatttttattgccctaattaactagtagttataatactgggagtctgagtctctgagagatactattttttaatgtaaaatttggaacctctaaataattcatgttcctaccaaaatttacactagtaaatttggtatatctcagtgcatctcgaggattgtaaattttccctaattatgaggacgtgatacgtactgacagaaagtgagcagttatgtgctatcagtagcatgattcgaaaaataaatttgcagagtatatttgatgcgcacaaaatacttataaatatatgagtaattttagtaaaagccgatgttttgtagacaaacttcttgtaaaaacccatgtattatggacatgtcataggttttatggattgttgacgattgtcttcgcagtgtccctgtgatattgatcctgataattggttcaggccctctcaatgagaggtaacaccctactcctgtttggggatttgaatccgccgggtgtagtatagatctgatgatcatatgtgctcatgccccctagagagcctcctgcccaccttatataggatggggggcaggattacaagatagaaaccttaaccaatacggtatcggttttctaaatatactttacaatcttatcaaaccaggactttaggccgttccataatatacagggaaacgtaatacccaaatcatgatctgttacatatttcatagatataagttatcccctataactagacggataaccacgccgtgtgggtatggggtacccataatctctacagtagcccctgagactttcacagtcgaaaagataatcttctctcgaactagattactccaaagccgagtgcttcaatcatctttgccatggtctcccgtgtacttttaccaaatctgaagaccgtggagggctgaaaaataattgaatttagacttaggtgcactgactagatgcacctaataggtgtagcccctgactatgtgcttagttgaacaaactaaacatatagtcaaggagtaaataatccaaccaaccgagtggttttgataattgtagtcaaccaagtgacttaatattaagatgtagcatatgcggtgtgaatccccgagtaatcatgatataccgactgctttgtaaaaattgatgcgagcaacctaaagttgagtacatcattgaaaattcacatagtaaaacagctataaagaagcttgaatgctgcgaataaagaaatttccaaagtattgggcatacgccatgcgcacactgctttaacagatgtgcttaagtctctaaaagacacatggtttcaccacacttggaaatatatggcatatgtggtgtaaaatccgagtaaataaactcataaaggatttaccaaccgcctagaaaatgaccacaacgtataatcagcctaagccataatattggtcaacaaaaatgcacacttacgtggcaaaaagcaacgatattgtatccaatcaattgcttgataaacccaaacagtgccttgactatataaaaaagtcagcggggcagctatataaagctttactgtttgacaccttttaagatgcattgtaccaactcctaaaaagttgagtaactgcggtataaaagattttaaggtattgagcatttgatcacgcgcactttggcctaagcaaaaagtgcctaagtcactaaaagaacgtgacaggccacacctgaaaatatgggctgcagacatattaggcctaggccaaaaaatatgcattcgacaccctttaaaggatgatgcatgtaacatgctcccgagtaataaatcttccgagtgatatagaccaagtgtagctcatatgaatagcttctgatctgagtgattatcccttatgggatactccaaaatagatataaaaattgaatcccgactggtgcaagtattagttgataacccttacggggaataatgattggtctggtcttcgagcacagaaaataatctcaggactacaagtacatgttgtctgtatctagaacaaaatccaacttgaaggtatgatctttgtgtttgagttgataagcccctgagcatatatagcttgtccttttatcatagtcaaaattgtccattggcaatagctgatgcagttgatatgaaagcaagatgactaacatggagatgatatcacccatcaaagctgacgacgatgttggtggtggtaaagacaatgacgccaatcaaaggtgatgaagtcgcatagccgtagaggcgaagaaaccagtcggcagcagacaagtcagccaacagtgaagatgaaggcgtccagcaacatcgacaaaattgtgcagccatggtggcgaaataatcaatcggtgacagacgaggtagccggtgaagaagatgaagatgcccattagtggcgacataataagccatccgtgaaggcgaggataccagtcggtggtgacgaaagcaagccgacggtgaagatgtagacacgcatcaaaggcaacaacgaaatccaccaatcatgaagatgaagaaaatagtcggcgacgacaaacgcaactgacatgataaagatgacgatgtcggtgatctagtgaatagcagtgtcgcaacaaatgataatgacgaagacgctcatcagcatttgcatagtaggtcaaccgtgaaggtgaaataataagtcggtgaagacataatcatccattagcaacagcggagatgttagggtcgatgaagcagatgtgctggtgatgatgtcagtgacaataatccatcaaactgttgagaagatattgaagctcaagtattttcttaatgttggcatgtgtgtgacgaagattgatgcaacgcctcttgatttataaagatggcagtagaacttggtgctatagctgttgcagatgcttcacttagaggaaagtatatgctgttgttcaactcattgaatctgatacgagttgattggttgatgactccaaactcccagacatgtaaatttaatcttgacctactgctctgaagcgaagacaaaattgatgactcccagagttgactcgttggctgattaattgattaattcatcttgacataaagcttgtcgaattttgagccatgtatttgtgtagcccccgactatttggttagttgggaaacaactgaacatagagtcgagaattatagcttcttgtcgtcgagtagtcattgcttgattgaagatatgtgttgaagatgtccaagtagaaatcctgaatattggagagccactttttgtagtaaaataacacggcatcgcatgccgagatgtcgaggttcacaaagacgtcgtggttggtgaagtagcaaaacttgcgaagtagcagcaatagagtttgccggtgccgaagataataaagatgaagtcgctccaccatgatgacaaagttgcattgccgtaatggagtgaacacgagtcggcggcaacagaagcaaatcggtagtgaagacgcgcagttgtgaagataaaagcatcagtcggcgacggcataactagtcggcgatggaagacgatgatgtccatcagtagtggtagcggtataaaccagacgtagagacgatggcactagtaagcagcagacgagacgaccggcgatgacgacgataaggccaatcaacactggcagaatcatgcagccatggaagtgaataaactagtcggcagcagacgtagacagcttgcgttgaagatgatgacgtctattagcggtgacggcgacgtagccagctgtgaagaagatagcatcagttggcgtcataacaggccagctgtgcaggcggaaacaccagtcggcgggggacgaggtggccggtcggtgaagacgtagacgcctaacatcggcggcataataggccagccgtgcaggcggaaacaccagtcggcggcggacgaggtggccggtcggtgaagacgtagacgcccaacaacggcggcataataggccagccgtgcaggcgaaaacacgagtcggcggcgacgaaggcaagccggtcggtgaaaacgtagacgcccaacaacggcggcataataggccagccctgcaggcggagacaccagtcggcggcggcgaaggcaagccggtcggtgaagacgtagacgcccaacaatggtggtgtgaccaaacaaccgtataggcgaagacaccagtcggcggcgatgacgacaagccggtggtgatgttctgactgatccattcctggagcgtaagagataagcttaaagccatgaatcccttttgtgcatatctggatctggatcctgcagaacaaacatataggatgagtagtatctgatgtaaatataatcctcgagaaaatttcaagtattttaaaatgtttataaatatgtatttatcctcttgtcaattttgatttccccgagcagatgacttattacgtttaaacgctctgtccgactagtcatagcccccaagcaccgggagtcagcctaggcacttcccaaacatgcatatgagtgacatgagttcgtcattcatggaacaaagtttcacgaatcagaatttactactcgggtacttttgcaattgtgaagagcagaaaataaatttatcttatctctatgcttttgatttattccgaataatacttagcaccttgcgttactcggtccatccaacgagcccccggtgctagcaattggcccaaaggcaactatccattggcgaaccaaacggaaagcataggaagatggaactccataactcgataggtacttttgtactcagattatgtcgcaagcaatcaagataaatattatgaaaaatatgatataacatctgtagcccctgactcactactcaatggaggaccaattggtgtagtgaggcagaggaaaaggaaaatatcatataaagaaaaaaattaatgatgacttagctttttaatattcccttggtgatggcagaagtagccgatgtggaaacaaagccgtccatcaatggcaatgaaaacaccagccatagaagcagcttgaggtgactgacgatgaaagtgaagatgcccatcaacggcggcatgataggccagccgtctaagcagaaacaccagtcggcgacggcgaaggcaggccggcggtgaggtcgtagatgctcgacaacggcggcataataggccagccgtgcaggcggagacaccagtcggcggcggcgaaggccagccgatcggtgaagacgtggacgcccatgaacggtggtgtgaccaaccaaccgtataggcgaggacaccagtcggcggcgacggaggtaggccggcggtgaggacgtagacgcccaacagcggcggcataataggccagccgtgcaggcggaaacaccagtcggcgacagcgaaggccagccggtcggtgaagacgtggatgcccataaacggtggtgtgaccaaccaaccgtataggcgagaacaccaattaacggcgacgaagacagttgacagtgaagatgacgatgcccatcagcaacggccaatggagaggcgcagcccggtcagcgtgagccgtacagggacgatagtcgggctcggcagcgtggaagcagccaatcgcgaacttgttgagacggtcgacagtgtcagcggatgtagccaaccatgcaggcgaagatgcccggcaatagtgagtgcggctaacgcgcggacatatcaagtcgatactctgcggcacggcgacggcctgaccaccacggcatctcagtagcacatgcaaccaaacaaataattaaattgatcagcagcagcaaggaattaattaaagataaatgcacaaatatcacgtgagatgtgattggttgctggcttgatgggcatgcatgttgccgatgcatggtcctgtgcatgctggtgatcacgtgtcatcgtatcatttgtcggccatgttgccattcacagccttgttgaatttggttgttgatgatgtcgccggtggcgaagacgatgcaacccgcccgactagttgacgatgacggcgcggccgcgcgggcacaggcccgtgcacaagtctggcagcagccggtcagtcctcgccgactttgaagcggcggaggaacagatccgcggctccggaaggacggcggggagggaggcgacgtagtcgtcggagcggaggaggcggaggtcgcagcagcgcgcaggcggcgtagctgcgtgcgcggtaccggcgtcgtcggtgtccatcagctgcagccatctcctatgcatgccgattagatcggttttgtcatgccttgtgattgtagatccatcttgcagcatcatggcatcttcgttggggtagattgattggttcattaggcttggtggtggacgaccatctgattcgtcggatcgtcgttgccatcgtgccgatacgaacaggatcaggcggagaacagcaacggcgaccggtcttagggtttggccatgatgctccttagttagattgaatctctcccgactggtttgaatccaagtcagagaacgagagcttgttaaaactgtcggtgataaggaagcaaaactcctgaagcgaagtgaagacgaagccgacgactcatgaagttgattccatcgcactagtcaataggaaactcggcgtcacccctacctggcgcgccaactgtcgaaacatgaattcggcaataataaaagggggtagcgcacgagacctaaaagtggatggatgcggagacaaagatttagacaggttcaggccctctcaatgagaggtaataccctactcctgtttggggatttgaatccgccaggtgtagtatagatctgtcgatcatatgtgctcatgcccccgagagggcctcctgcccaccttatataggatggggggcaggattacaagatagaaaccttaaccaatacggtatcggttttctaaatctactttacaatcctatcaaaccaggactttaggccgttccataatatacagggaaacgtaatacccaaatcacgatacgttacatatttcatagatataagttatcccctataactagtcggataaccacaccgtgtgggtatggggtacccataatctctacaatatgtgatgatgagatgtgtcatgactcgcagattcacaatttttgcagaacatttgctctttttctcttaattaacaatttgctgaacaatctgctattttgcagctgctccaactagtccattatggcagaaagtggagagaaaattttgaaggcccgatgaacatgagtagagcaacacaaataagttcaatgaattcatagtactaactacaccccaaggcctgatgaacatagagcaccccatatgctagtcctctccactcatctgttatcctttttttatgtcctaacagatatagataattacaattatgcgatgctcttttcacaaagagggcagctaccgcacgggattccgttgcaacgtagctgccacgggataagatctccactaccttatctccttcctttcccctccacaaactctctctctctcacaggagaagaaaacgagaggcggagatgaagctggccaggaggaaggggtcgtcgtcgtctccggcggccgtggacgacgacggcacggcgtcggcgaggtcggggcggcgtcgagggtgatctcgccgcacctccacgacgtcgtcctccgcccgctgcggtgccgcctccacgcgctgtggcgctgcttcttccactggcgctctcgttgctgccggcaccggggcctctcccctcctccctcgcgctcctcgccaaggtcgccgtcgtccttgcccgctgctcccgccgcctccttgccagtgagcgcaggtggcaactcctccgccgccacagaagcagaggaagccggtggtctcctcctctccatcctgatacttggtaccttgggtatcaggtacctggtacctctggtaccgtctgatacatttggtacctggtaccaggctagtacctaaaatctagtaatgtgatacctggtacctggtacctggtaccctggtgcctggtacctggtacccgtgatatctggtatttgatacccgtaatacctggtacctagtatcctggtacctggtacccgtgatacatggtacctgatacccgtgatacctggtaccagtagcctggagcaggaggagagagaggaggaggcatccgcgtggtggagcaggagaacgaggcggtgcgcgaatccggtgatcggcgaggcgaagcgtggaggaggcagtggcgaatccggtggtcggcgaggcggggcagccgatgagaagaccgacaagggcggggagccagagcggcgcggcaagggaggcgagcttgagggcgacccttgccgaggccgcgccgtcgtcgtcctcctcggcggccggggtcctgagccagcggcggcttccccggcgccggcagcggcctccacgcccccgctcccgctctccctcttgttcaccgcacctgtcgccattctcctcgtcgtcgccgcctcccccgcagcggtggccgccggctccgacgagcggtggggcgacggcgacagggacgacggcggccaccggctccgacgagcgatggggcgacagcgacggggacggggacgacggtggctgttggctccaatgatttaggggagaagagtgaggtaggaggaggggatcgatccggattactatcccgtctccacgggatgccgtggaatagattttctatttcgcaaaaccaatttttacgtgcgaatattcatgatgtagattgagttacgccctcctcggagatggaataaatgttccggatcaagtgaggaaagcagtgggcgtgaagaccccttggtcgagacttgcaggtgtgacaagatcaacaaaccgctcaaggcaatgaaggcatgaatagcaagcaacaatgtgcctctgctctgtctagggatgcaagccgcgtgggcaagcggtttttttttcccacttattccacttctagttcattttttcttctaaattttgtactaccatgcgggaaatagactagcaagctggtttttatgcgggtagcggaactatccacttgcatccctagctctgtcccctctacatgacggtgtctggatcttgaggtcactaaaattgcagagtcctggaaccacatgaaggacaccttggtcatcctgacttcaacggacataacccatttcagtggttatacaagagcagcaactctcaatctgccatctgtgattccaataggaccaagaaacactcaagaaaacattaagcagcttctcgcaggtacacggagccagagtttagcaatcccggtgcctcctcctctactgaacctccatgctgccatgcatgtacagctgagattgcatttgacagcagagatcgatcctcaatgtgccatttgacagcagagatcgatcctcaatgtgctcaaattatcgtgatgtgatttggtcaaagcaagacacatgagatttgttgttggatcacagtacagatatatagagaggcgcattatactctacagtactacttatcaaggagagattgtagtgctgttttgttggatcattaagtcacaacacaagttaactgatccaagcaaccgtttctagactgaagaataggaggttgggatgattttgcctactgtttctagtcctatttgagagagttaatgtaacaagcacggtggtatcaatttcaataggtgtagttgcatagatattccatataaataggcatatgaaactacaccacaatatgaacttactaagtctaacactgacatttttacttttctgatgagtcatgttgtttacaatatgtatatttttactacttaacttttagagctcactactagaaaaatgatctttgctgggtcgacccaaaaccacaatagtcccggttccaaaaagaaccgggactaaaaaagatctttagccccggttgaaaaccgcacagccattatatgatctttaatcccggttgttgttaccaaccgggactaaagatggtctttagtcccggttttcattccgtgtaagaggcatgtcagggggcgataccaaccgggagtaaagatcgccacattgtatataatccctatcccttatcctctcctccacaatcgcaaccactcagatcctcccctcccctcccctcctcctctcccctggagacggacgccctcctcccctcccctctcctccccttcctcctccctcccctggagacggaggccctccttcctcctccgtttccaggcctccccttcctcctcccctcccctccccttcctcctccctcccctgaagacggaggccgcgcgccgcgcggacgcgtggtggatggacgggcacgtgacgtgcggttgcacggcacgcgcggtagtagtggcgccgtgattggagcttgttttttctcttttttttatatattttgtgattcactaatatgtataattttgtgattgattgtatgggtctgagatgtataatctgtgatgtatttgatttgtgtgtaatttttttaggatttgtgatgtatttgatttgtgtatattagtaactttaagatttgtgatgtggattgggatgttactttgatttggggatttggggtttgatttgggatgtgcatgctacccgattcgggagaaaataaaaaagaaaaaaataagaaaagggaccatctagattgccgctatcccctctttagtcccggttggtgttaccaaccgggactaaagatctttctctttaatcccggtttttgctaccaaccgggactaaagatccatctttagtcccggttacttcaactggaactaaagatgggcatctttagtcccggattcctactcccggttggaaacccgagactaaagggggttatcaaccgggagtaaaaaaggtttctccaccagtggctcttttcccatccttgataaggtaccatgaggtaccaggtactatgaggtacaaatcaaatctagccattgatttggcaggggtacgatcggaataaatttgttaagagattgtatgtgctaattgggccttcaggtaggggtgggcgttcggtctgaccgaaaaattcggtctcggtcttcggtctttcggtcagttcggtctttgaaaacttaggaccgaatttcatccaaataaactctggaccggtaaattcggtctcggttttttcggtctcggtctcggtctaaccgaattcgctggagacttggattgcgcaggtgggcagcgagagctggtggcgactggcgaggccgcggctacggctgccgcaacggcgaaggccacgccgccgctcgccaggcgcaccgcggacggcggcgctcatcggggccgcggcggaggcggcgccgaggcggacggcggcgctcgtcgtggccgcggcggaggctggaggcggacggcgacgctcgtcgtggccacggcggaggctggaggcggacggcaacgctcgtcggggatgcggcagaggcgagaggcggcgccgaggtggacggtggcgctcgtcgggaccgcggcgaaggggggaggcggcgctcgtcggggctgtggcggaggctggaggcggcgccgaggcgggcggcggcgctcgtcgggactcgggacggcggcgggggcgtgaggcggcgctggtagtggttaggtgctgaggtagtgggactgttggagtgggagtggggaattctagggttttgcaatttgttgggcttattgggcctcctaagcttattgggcctcaattcggttttctcggttaattcggttaaccgagcccaataaccgaaatgaccgaaataaattcggtcttttgatggctgggaccgaactactaaccgaatttctcgatttcggtcttttcggtttcggtctcggttttttcggttcggttcttcggttcggtcttattttgcccacccctaccttcaggtcggcaccgcgcaagcaccaatagctagacagattggaaaagagctcgatcggcgcaatctcttccccgcgactcatca

SEQ ID NO: 66039 - DNA, 1434 bp, Oryza sativa
caagaatccagtgactgccataaaaatagatagttcatgcatgaacagcataatggttttaacgggcatccattgacagatagttcatccacataatcaggtcttaactagcacataataagttctaactggtaagaacaagcacataataaggtcttaactagcattacatcatacgaatttggatggcactacaaatattgccagacaaaatggtgatgttcatccatcacactacttgagaacatggatcttcagatcaagaacgtcgtcatcgttgttgaaatggaaaatacaaacatcaccctcattgaatacttcgacatcaatcagttgattccatccggtggtggtcagtaatgccctatcgttctgggacttcttcaacctcatctgatataactgtgttattccagcctcgtcctgttccaagcactgcacgccgggggagcgcgccgtcgccgtcccccagctctaccgcctgcagccgcgcaacgggctgcagcgccgtgtcagcagggggcggctcggagcgcgccgttccaccgctgcccaccgccgaccatcgccgcccgccgccgccgaccaccgttgcctgccgccgccgaccaccgccgcccaacgcctatcgcctcgaaggggaccacgagcggatggagggatgtatggatctgagcgccatccctccatcccctgcgctagttcagccgcccacggcatggctactccctattgtgtgcgccaaagcttcggagagatcggggagaaggaaacagaaccgagagaaggaacaaagagaccccttctccctcgctacgcgaaattacaattttaccccctccccaccagcggtactgcatcaagcagggtgtgcggtaccatccaatctcagccatccgatgagggcatatcaacggtcaggatttggtaccgcccaccctcaaggacagtaaaaaatctctaacttttatgaatagcagaacaattaagaccattcaccctagcacatctagctactgtttagcaaggtaatcaggactacttacagctagtttgttgctcacaagaatgtgagttccctatgcctccctttcctaataggcatcctgtgcgcaattaccttctaagttacctatagtagtcttcaaggtgagaggtgaggaccgaatatttgatcttccagcaatttaacttggtggtgtaaaaagaataggatgattggggtttgttttgtgcgttgctcgacaacgaggacatgaaggtttcgattatatatccatcttgaaacggatcttctgacttgggctgtgtttagttgaggagaaagtttggattttggttgaaattaaagatgatgtgactgaaaagttgtgtgtgtatgacaagttgatgtgatggaaaatgactgaagtttggatccaaattttggatcta

SEQ ID NO: 66040 - DNA, 701 bp, Oryza sativa
ggcaatcatacgccgttcgatgaataccctcaaataaccgaagcggtgtgggaggaattctgctctttcaagaccacccaagagtttagggaatcaagcgaggcacatcgtgtactgcaacagcggaatgagcacccgcatcggctgggcaccgcagggtacatcggcaaggaggcaatatgggcccaagaagatgcagccgctgcagcagcgaatgtccctgccccgttttcagacatccctgaacaaagagctcgcaactgggcgcgggcaaggggtaaggtcaacccggacggctctgtcacatttgagaacaaaagtgatgccgtcgtctatcaggaactggtgagttcgctacttaacctaactaatttccgttcgtataaagtacaagttcgtataaacgactatcttcttttctagttgggcttggttgctgaacaagcttcacaaagcgaggttgagtccgcgccgaagaggcgcgaagatgacatcctcacaaaggcgctcggaaccaaagaacatcctggccgaactcggggaattggtagcgatgtgccctggaagcatggactccctcagtacagctcccaatacaggaaacggaaagtctccaaggaagagaaggacgctcgtttgaaggccgaacttaaggttgaggccattcaagaactagaagctagcatgaatgcaagggtgga

SEQ ID NO: 66041 - DNA, 920 bp, Oryza sativa
cagcattcatgacgcagatgtatccttgcgaaaggtacctggggatccttaagggttatgtacggaaccgttcacaccccgaggggagtatcatcgagagttacaccaccgaagaggccatcgaattttgtgtggactacatgtcagaaacatcttcaattggattaccacgatctcatcacgaagggaggcttgacggtgttggtactgttggaagaaagactattaggttggatcggaaggtgtacgataaagctcatttcacggtactacagcatatgactgaggtggtgccgtacgttgacgaacaccttgcagttatccgacaagagaacccaggccgatcagagagttgggtcaggaataagcacatgtcttctttcaacgagtggctgaagaaccgaattgccaggttgcagaacttgtctagtgaaacacttcagtggttgtcacagggtcctgaatggagtgccaccacctggcaaggatatgacataaatggatacacctttcacacggtaaagcaagacagcaaatgcacagtgcagaacagtgggttacgcatcgagactgctagtgacggtggtcgtcgtgatcaatactatggtaaagttgagcaaatattggagctagattacttgaagttcaaagtcccgttgtttcgttgtcgatgggtcgatcttcgcaatgtaaaagttgacaatgaaggtttcgccactgtcaacttagctaacaacgcgtacaaggatgaaccgttcgttctcgccaaacaagttgttcaagtgttttacatagttgacccgtgtaacaagaaactacatgttgttcgtgaagggaaaaggagaattgttggattggacaacattgcagacgaggatgattacaaccagcacgtccacggcataggtcaagaaatacct

SEQ ID NO: 66042 - DNA, 2082 bp, Oryza sativa
caatgcattttgttttctataattctttgaaaattaaggacctttattaggtgtagggtttgaaatctagttacaagggaagaattgatagattgggcgcagatttaatgtagttcggaggttatcaaaccatcacagaatacaaaatgcatggggaattttggtggataggccagtgtagtccatgcacggaaccgacctagacaccaaaattctccatgcattttgttttctgtcataatttgatgattaaggaaatttgcagattatctaaacttgttgatttatataccctttttgtctatgagtaggtcaattgtatgaattgttgtttatatacatgatttatatacccttgctgctgctgccacaatgattgtgggctgttttattatctagacttgcttgaattgaatggatgaattgctgtttacatgaagttagtagtactgtctccttttttatctatacccctgctactgctgttattgtgggctacttgttaatacacctgttccttgttttatgttgttgctgcccctctccaagtatctttgcccctgcttctgctgcccaatgtgttccttgttaaatggccagtgatgaattgctcaataagaacagattatctacacttgttcatttttttatctattcttctttttgcccctattgtggctcaataagtgatgaattgctcaataagtgaatcttgaatgtggatttaagtgcaactgctgctgtctatgtttgcccttgctgtctatgtttgcccatgctgctgcctatggttgcaactgttagttaagaacagattttctgcacttgctcttttcttctggattgataagaggagtatatctagacatgttgttttagttaatttgcccctgctgttgctacccctgtggcatatatactcctcctgctgctgttttatgtcaatcatgcaaattctgtacccttgctgctgctgttttttaaatttgcatgattgattcagtggttatatatctctacacttgttctttttttatgcataagaacagattttgtgcacttgctctttttttatgcataagaacagattttctgcacttgttcatttttttatctacaataatatatgcatgatttatataccactgctgttgttgcccctgtacttcttgttaaatggccaaggatgaattgcttaataaaattctatctatacctgttcttttctttatggataagaacagattatctacacttgttgatttatatacccttgctgtctatgtgaatttccctctgctgttgctgtttatgtgaatttccaccctgctgttgctgtttatgtgaatctccccctgctgttgctgcccctgtggcatatatacccctactgctgttatatggccctgctactgctcttattgctgctattatatggccatgctattgctactgctctaatttcctgcacttgctattttctttatggataagaacagatgaactacacttgttctattttatggataagaacagatgaactacacttgttctattttctttgggttgctttttcctcctagtagctgatttcctctttttatcccttcatgcaaatgattgtaattgatgcatatttctcagcaaaactgaggccatatctttcatagtgtaccccgtattacattggatctaatgctatttagtctaatggtaggaaatttataatctttttcgcgaaagttaaaccatgtcaacgcccggcgcaaacccgccctccccaacacctgcgaggatccaggaagaagcaaacccagccacagaggcagttgccgaaggtcatcccacgacaacggtggtccaacaacccgaaattcatggtaatttataggataaattttcaccacatgaccacataaattttagctagcaccccttagcaaatattgccttctgtttgtgctgcagaattgccgcaggaacaacatacgtcgatgtcgggcgggacaagtgcaagtaggtctagtagaaatccgcggtcacaaaatatatggccgaccacagtgcaagttataagagagg

SEQ ID NO: 66043 - DNA, 2983 bp, Oryza sativa
agcataggagtagttgtgcatccacagaggtgccggcccctggtctcccgatcgcaccactagctgcagtggaccacatcgaggtaattgttgttatccgatccatatctaataaaagacatgtacacattccaatattaaattcaaactttcaccttatgcagggcgcagcacagtgtgtcctactagcgagagtccacccaactttcgctcctgaagtcgctgagggcatggctttcaagccctcggttacagacaaggtccacggcgcagacctgctagctgggtatgccaaggtgtccatcgatacagtaaaggacacctggtcaggctatccgctgcccgtgcccccaaatgatgaaatcatgactttgggcgatgcgcgcaagacgttcatacaatggcccaaagaagacatagttgtgaagatgactcctcgtccaagtcgaccgacggagcttacacctcccaagtctaagctatcaattgaggctccccgtggaccggcattgtcagtacctcattctcccggtggagctgatatggacttggcagatatagctcaaagcttggctccaataaagaccacaagaaaggccgatagctccccaccacttgtcaagggccagaagcgtgaacgcggcaaggggaaggtcggggagttggcgccggagccaaaaaggggcaaggctgcgacgtcgatgccggtgagcaaatcggggaaggtcgtgagggcgccagcccaatttgagctaggcatgccattggtggaggacaatgtgttagctgtgatgggtattgcttgccgagagctacataagcaatacatggagctaagcaatgccaagcggaaaatgagggagtcatccatagtaggacatcacgaccaccagccgttcctatcgtcgcctgcctatataactataggttttgatgacctcttcgaccttttcaggatccggaagttggacactggtcttctaaaatgctactccttgtaagtgcataccttctatacttgtgatatgactggactatatctcctaattaaattagttctaatacgtaaatattttaaggttgtgttggatcgagagtcgtcgccatggtaatcaggttgggttccttgatccatccatggtgaatgaggttaatttacgacagagcttcactgaggtggttgactatgtcaaccggtgtttatgggcccatcaagacaaggagtacatcatgtgcgcacacaaccaagagtaagaggacaatacccttcgtgtctattgtttttgaagttaaggttcttagtactaacgctacataaccactgcgcaggcgacattggattctcctagtcatcgtacctaagtggagtagggttacctaccttaactccaataagtccaaagattatgatttcagtgaaatcaccaaggccttaaatatggcttggggcccatatgtggaaaagggtggtaggcacaaggagggcaagaacgaactttatcatgacaccaagtttgcatgcgcacaacagatcggagaccaatgtggtttccacgtgtgccacaacatgtcaacacttctaagagaggtgaaagatttcgaccctgaggttgttgctaatggcgaataagctcatttcaatatctacattactattcaaaacgtgctaattaacctcttatttattaaacagaaaggtagagctggcttcaagatctcacccatcaacccccccactatcagaggcgaagtgtgcgcctttattcttgcagaaataatgaacaagaaaggacgttttcatgccaaatagactcatgaacttggctagataatttattgtgatgtaaaaaagatgtttttataatttctggcgatgtaaaaaattatgtttttatagagtgcaatgtaatttactttcatatgtgcaatatttatggtactttactaaattgtcatcacatttgatcaactacgatttatgttgtactattcatctgtttttgtcacgaccgggaaaattgccttttcccgaacgccagtgtattaatccccgtcccaggaaaagccggggtacaccacacaaacatgatataaaagacacatctttattatatcgataatatttacattattacaaaggcacttcaggcctgacaaacaaaaataaacagcagcggactagcgggcctacggctccatcttcataggcgctcaactggggtataagccaggactccacctaagacttcttctccaaagcttctcttactgaaggggggaaaagattgagcaagaatgagtacaaccacagtactcagcaagccacaccggagatgcataattaatgtaagggggtacaaggggtgataatataagggttaggttttgcagaaaacagcattcaaaagtcacttagttgcccaaagccatttcataaagacgatcctagagctacacagtattattaaacaaggccgtgaaccctcacgaacctgccttaacccaaggcctacgatgattcagaccgaactggcaacccgaccctgggtcccagctcgtcccaagccaacccaggccaaccattccacatttttgttgttgagcaaattttaagaattaaaacactgacttgggtacattgctcggcttgcccataaccgagggcgcggctattcgaatagattatactctgatcagaggtgtacatctttacccacaagacacgtcttcctcacgtgtaaccacgtgccacataccaccacggtatacggacggaagacgtgacatagttcccaacccatcctagccataaacaagagtaccgacccaatcccacctacggccggaacctccgggacaggcaggcaggactgagcccctagcagcagggcaccaaccctctgccatgacatctcgactaccgggccgcagctcgtgtagccttcatttgccctggagaatgtccatcgacccccgacttcat

SEQ ID NO: 66044 - DNA, 1665 bp, Oryza sativa
ttcctgcagccctgcaacaacattagtcaatgccaattgccttcaatgaactgagtgttagtaaaattttgagaatcaatcataccattgaactaaagaaaaatcataccttctagtgacaagcccaggactcatattgctggaatcattgattgcaaccttttgtcttttgggtgtgctagaacccgctgcatcactagttgaacctagtggtcttccttgtttggcacgatttttcctaaaaaatgtaaaacaagttaaatgatctataaagattaatgtacaatatgctagaagtaaatgtatgtggctacctttttttcttggtaccatttaaaggacattttgaggatgtttgcctatggcccatgttaagacacctcttacattgaatctgccaccttcctttggtcctaggtttgcttcctttctcaaggcacccaactatcctattctttctttgcctccctacgtccctcatagtgagaggtggcagcaacttgaaaccaatatttacttttggccattgggacttatctggaagtggatgaataactcctgcatatgccagcttatacttttccactgaataacaaggatccaggtaatcagccattcttgggtttctagctgatattatgagagctaatgcatgtgggcatgatttgccagaaacttgccactctctacaagtgcatgtatgttctgtaagattgacagcatgcctactaatatcatgttcaggagtaatctccgccatttctgcttggtccctattaccttgcactaccttcaagtgacccaaatctctagtcattgcattcagttgacgaactacaatagggagcatcacaccatctagtttctcacctatcttcctccgtctcgcaaatagatccattgtctttgctctgatgccttctgcaagatctgcaataggacgatccttcatatccttgacccatttgttccatgactctgctagattgttggtgatgaagtcacattttatcttttctgagatcttgtcctccacattaacaaacaaaatcaactttctatcactcttcctaacaaacaatgcatgggctacatccatattatccttaaacagtgtttcctcaccagtgctcatgtcgtagccacttatcacaacatgttggctgctgccccattttacccttgctgcaagatccttttccaagctctccaatgtgcactgatgataatccacaacctattcaagccatttacgcgccacttcaacacaagtaccatcatcaagtttagctataaactgaccgaactgaacacacacgctaaactccacatcatggttggtcctatcacatacgaacaagaaaaacgagagtaaaaaatcattagttcacctgctaaccaaatatgtcctagttttgctccttagcccgttagtgcaaataatggagatgtggagagttatagcattacctagaagggagttcacttggaatcgaggagcttgccgcttgcgccatgatctcttgaaccgtgacccccttccccctctctatcttcaaaccctagggtccggaggctggccggcggcggggcaaggaggctagctggcggtggcgggtggcagggtgatggggaggctggtggcggcgcccggcgaggaggcgg

SEQ ID NO: 66045 - DNA, 2442 bp, Oryza sativa
ggaggacggcgatggaggtgggagccgggcgtgaggacggcggccgccggctgtgcccaccggtggttgtgggaggctggtgatggcggcagtaagaggctggcaccggtggcagcgggaggaaggtgcagccggcagggtgaggccggcgcgggtggcgccgacagctgcgggaggtcgactcggtcgaggcgagctattcatgggcaacttggtcgaggcaacgacgacaacattgccataaggggggtgttgaagccttcggcaagattcattccaggcgattgttctcttgcggcggcggcttgccgccgtaggatggtcacgttttaattaggtttttttttcatgtccaagggtttttttttttttcgggctttcctttttttgtcgatttggtttgttcgttgccttttttttttaccgatctcagttcgatccaatgtgctgcacacgcacaatgcccctccggccactaccctagccaaatcctagcgccaccgcgatatcgatctacctccctatgcttttttccttcaactagaaaaatgtccgtgcgttacaacgggtgaatgttatattaatcttatcattattattattattatacggtttacttaaagtgaaattcactgtgagaattagcttgtatatatatatttccagaaaatcatgagctataattaggagtccgattaattatctcaagttagcatccgagttttcttaaagggatttcttatacgactcctttgtttccaaaagcaaacaaatttaaaacccgactcaaatacaaatctgtattttcaaaaacgaacaaacttaaaaaccgactcatacacgagactcatacacgagtaatatatcaaagtaccgataaaaaatcttcaattttataacgtatcaaagtaccagtaaaaatatcttcaatttttataataagtagagacagatagaaagatacatagatagctagctagatggatagaagaaaaaggaactcgtgaaaatcccgtgggccgatcgtacgcacacagtttttgtttaccttttttacatgtcttgcttatactacgtacgtatacatgggttattagcgcctgcttatactacgtacgtacatgggttattagcgcctgtaggcaggcgtttttctcttttttccaatatatctcttgcatacgtgcgcgtactgagagagaagatattagccggttttagcatggagtaattagttaatagatccgattaacggttgataataaagggtccaccaatttaaatggaaatcgatggttggatatttttcttttttcttagaatttctatgattttgtctaatttattagagtgccatgttgcagcgtaggagcgtttgtagagtaccacgtgactgtttgagagtgtttttaagaagtttaatggacttttagtatagaataaataggtagattgattgcaaaaaattgttccgcacttcttcctcattattctctccatgatttcccctttcaattccattttaattcttcggatttgatctccattaaagatggccgatcggcgagcttccctgaactttttatcttgagttttgctaattttctctgattttggagaaacggaaagaggagattgagtagataaaaaattctcaactaattataggacatcgagaaagattcggccggatttgatagggagtgtcggctccggcatcatatgggcatggccgcacgggactatgttctggaggttgaagattgtagtcagccatgcgagctgagcctgtgactccacttatacttgtgggttgggtcgaacagagatagaccgagcggagggaacatttatacttgtggctgggtcgaacagagatagaccgagcggagtgaaggaaagaatggcctttcagccaaaaacatacgaaggattttcattatttttttcaattactagaaaaaatgcccgtgcgttgcaacggttgaaggctattttaattttattattgctatacggtttaattaaggtaaattcattttgagaattcgcttggacatatattttttctagaaaatcatgagctgcaattaggagccatatcatcttaagttagcatgtatgttaaatttttaaagagatttcttatacgactgctcatgtatttccaaaagcgaacgaatttagaacccgactcaaatacatatctgtatataaaaaagcgaacaaacttaaaaaccgactcatacacggatgacgtactaaagtaccagcaaaaacatattcaatctttataatagtttcactgtgagaattcgcttagatatatatttttctagaaaatcatgagctgcaattagaagtctaatcatctcaagttagcaacttagcatgcagattttttaaagagatctcttataagacccctccggtattttcaaa

SEQ ID NO: 66046 - DNA, 3637 bp, Oryza sativa
aactgatatggggaaggagctatttgtgagggattcggacgcgaaaattggtcgctagatttgggagggagcgatctgagtggggatcggatagaaaatttggagcgttctggggatggagtcggacaaaaaaaaatcgctacggatgtgatctgaaagaaaaaaaaggcgtgcgctattacggatgcgatatgagaaaggaaaaaaccatgtgctaggtagaactaattaattatgaacgattacttagtccaactaattaaaaaaaaggcgatgggaaaaaactggacccacaaaaaaatccacaaaataaaacctcgtgcacgaaccggtgacggaaagaaactcggacccaaaaaaatgcgaagaaaacactggacaaaaaaaccgcatgcgtgaaccggtgatggaaaaaaccggacctactcgaaaatagccgcgtcaagaaaacgcgctattggccagtcggacaaaaaaaaccaagcgctattccaattgtgggcgatatccaaaatttgtggggagtaaaaaaaaccagtcgctaaaaaaacccggcgttaggtgacgtacgaaattttttaggcaaaaacatcttcaacttttataataggtaaagataaagattatgtatagtgattccaatgtttcactttatcgcttggactctaatagctattatatcactgaaaaaacatctttatctgttgcaacgtacatgcatctatatatctatctatcttctattatatactaaaagtccattaaactttttacaaatgctcctaagctgccatgtggcatcctataaacactctcgagtcgccacatatcactctaataaaatagaaaaatctgaccatcgattttcatttaaattggtggacccattaattttgattgttagatttatctttccaataaaataaaatcttcctccatccacgtaacgtacgactatccatctgtagagcaacgtgcgtacatccatccgtttcctttttttccttttttatctcgataataataataataattagaattaaaaaatatgggcctgaaaagcccatcaacctactagctagcatctcctaataagtttattaaacatcatataaatatttctaaacatctatatcgcattcctaaattagagaaaatctagaaatactaaaacatttgaccatcgatttacattattttagattattagatatatctttttcttatggaaaaacatctcaaacttccttgcgctcccatgcggcgttaaaacccattcaccacccttataaatatttctaaaccactatataacacttctaaattagataaaatcataaaccattagtttcaacttaaattgatagacataccatttaggttgttattagatttttgcttaaaaaaaactagcaaacctcctttcctccctcccgcccctataatgttaaagacttaaattacattaaacattctataaatatttctaagccactatggatctctttaagtttaaagaatcatacagaattatgaaaaaaaaacatctgaccgtcgatttcgacttgaacatctaatacattattttaggtcattatatcaatcatttttttaagaaaaaacatcctgcctctctgtcctcatgtggtgtgtgtcgttcatccttttctcttatttttatccttatgataattgaaattaaaattatttttatgaggagaaaaccacaaatggacctccacatatcaggtctagccagctcttctacagttccttttcttctctttctcttcttactagcacttatagaaacaatataaataaaataattataatattttaaatcatatattcagcttatgatctgtttgagctatttttttagtgaaaacaatactttaatatccatattgactatatttaaatgctaacataaaatttacattccggacccacatcaatcttgaggcctccactaaataaaaaaacctaaattcgtcattataaatcaaaatatcccatttttatatacaacattttaaaaattaaaacgtgctcggttgaacatcaaactgatcgtaccaaacatgtaagattgcaccgagaaatcttagcagtgaaacaaccatgaggtctctttttggtaaaacttgctatgctacattgtaaattcctaaaatttagcatataataatctagaaatgtatatttattatataacctctatttttcatatttcttactcacaattgagagataatttagaatagatgactttaccccatgttaggttataggttcaacccgcatatatttttagcccaaattgtagagatcaaatcatttcaaagatgcttgatagagtggatttctccaaaaaaaaatttaaaaaaatggatgtgaaaagagttcaaaatttttgtaaatgtttttaaaaaattgttgggattaaaacccattctatatagaaatattcaaatattttagcacgataaacagaatgaaaatatctaaaattttgaatagaatcttaaaaaaatggactttttatcaaatgtttgggggtgagaaatccccgtggggattcaaaatacccaaaattttctcatagaaactacatctattgttttgacataatattatttcataaattgaaaactgtacggtttcgagtagttttagtttagaatttatgtgctacatgggtaattagaagaaaattataaccaacattcaaagcgcaataaataagttaaattataatttagatatagtaaaataatattttaatacaaaatcacctatatatggacattcgtaataaaatttgacacatattaaattaggtgcacgcgcatgtgcgcgggctacatttctagtttttttatagtacaaacttacaacgaccacggaccatcgagatatctttagaaaaatccatagtatccggtctctctgattaagttgaattagaaatttctgaactttgcatccacatggtgttgtagttcttttcttttcgaagtttttgacattgtcaattaatttgacaatcaactacttctgaattaactaagagagaaaatggacgtatttttcatttactaaggaaggaggacgatcgcatttaaggtggtagagatattttcctcttcgtgagctgtgagcaccaacttacaaggctatgttgtttcttctattttgatacaaacttgcaacgaccacggaccatcgagaaaaagcacaagctttagtcgaataattcagtggagccatcgttgtgtccatagcatatatatccggccactctgattatgttgaactagatatttctgaacttcgcatctacatggtgttttagttcttttcttttcgccactctgattatgttgaactagatatttctgaactttgcatgtacatggcgttttagttcttttcttttcgaagtttttgacattgtcaattaagttgacaatcaactacttctgaattaacaaagagagaaattggacctttttttttcattaattaacgagctttctgaactttgcatctacatggcgttttagttcttttcttttcgaagtttttgacattgtcaattaagttgacaatcaactacttctgaattaac

SEQ ID NO: 66047 - DNA, 16480 bp, Oryza sativa
tatgaggatcttcgaatacggccagcaaatcatctttgagattgacgaagtcaccacaggcgcctggctatcgacgggcacgtcgtctaccactgaaagcacaatgcgttatcgacgggcacatcgtctaccactaaaagcataatgccgttaaatcctggaaaattcactcccgtagggagtcgaacccaggaccaaaggtgctactaaagctcttgtaaacactagactaccggccctttcgcggtgggagtcgattttgatactataccgtagcggagctgtagccgtaaatataatattattaccgttaatattgtggatgtccatattagcgtccaatttggtattggggatgtggaggtccatacattaaaccaagattaaaggtacagatgcatatattttataagtttgtggacctatatccaagtttaaagaccgactgtctatttttattcagattttttcggcatataagcacatgcaaccttttaattacaaatgtaagcacacgagatttgaatttttatttctaaacgacatgcccatatgcctgccttgttactatcagtaacatgcggaaatcagcagcctcggtaactctcttctttgcggctatcgtgttggtctcttacttagctatattcagatttactggaaaaaaatatatgcatgctacgatgatttgtaaaagctgataagtaaaactgctctgcaaaacaaataaagattattagcacaaattatgattttgatgatcctcgtggatgaattagattgaaatatagaaaaatgttacacctactatgttattccaatttctaaatcaaatgctaacaaccggctaagaggaggtggactgttggtctatacgtacacgtacttactcaatttagcatccaattagattgtatccggttgaatagaatcaccgttgcatcttgcctataaataaaaatgtgggtttggcgtgctcagatttggaaatactgtgttgcatgtgcttggataaaaaaatacggatttttattttggcaaatacggaaataccaaatggccatgtaccaaacaggccatgcattttattcaatcctaaatgcacttaggccccctccgaatcataggaataaaaaaaatagaggaatagaaaaaacgtaggattctattaggaatacaagtgtaaaatagatgattgcaaaacgtatgaaaaacacagaaatgaccgtttgattgaactgcaggaaaaacgtaggaatccgatgagagagatggactcaaaggaaagtttcaagagattggagcgcttgctaaattttctccaaaatctctataggatttgtccattccatagaaatttcaaatgataggatatgattcaatcctttgtttcaaatggctttataggaaatttttctatagaattggaatcctccgaaattcctatggtttttccttcaaatcaaaagagcccttaagctgtgttctttccccacctttcccaactcacaccctcatctttcacgcgcacgcttttcaaactgataaacggtgtatttttttcaaaatatttatatacaagagttgctttaaaaaatcatattaatccagttttttaaaaaataataaatacttaattagtcataagaaaatacatcgctccatcttatacgtcgctccgttttacgtgtgcgggaggtgagttcccgactcacccaaatcataagcaccaaacttgagtttctgctctccatagatgatatcatcctagactcatgcatgcactttgacagtgcgtgttactagttgggttggttaaaataaaagagaaaattccaccttttaaaattaatagaaaagatacccgtgcattacaatagaataaactaaaattttgataaacattagatccgtactttgaccttttccgaaaattcctcaaagtcaataaatttcaaagtggattcaattttttcctatcaaattacttttttaaaaaagcaatcttccctcatttaaaatttgttcagattcttatatatcaaaatccaccgcaagatgaaaaaaaatccttatgatcccgcatagggactgatgatggatgaaaaaaaaaaagagaacgataaaagaaagaacgagactaccgatcaggcgcccgattcaggcgtggaaaaatcgaacgctgacatcagcatgcttgtatacgtgcaaaaccactttatgctatttttttctcttaaattatttattcaaatcatgattcgattgcaccattaaattcgttgcaattaaatatttaaaacaagatcacacatggatatattccgataaatttttttagcttattattgaattatttttaaatgttgcacgttgttccaccaaatatatcggaattgtttcactaagtagatcgaaaatgtttaaatgatttaaatcggacgctgtttcgccttatataaaaacaatgtttcagcaaatagtgaaagaatgttacaattcactgcaacattagatctatacatagtgaaacattgtgagtatactaggtgaaacattttttttggaacaaaaataaaacgaattcccttaatagagggtttccaaaatatgtgggtgatttgttacaaaagaatgttttaattcattgcaacattagatctatacatagtgaaacatcgtgagtacactaggtgaaatatttttggtggaacaaaaaataaaacgaattcccttaatagtgggtttccaaaatatgtgggtgatttgttgcaaaagaatgtttcaattcattgcaacataagatctatacatagtgaaacattgtgattatactaggtgaaatatttttggtggaacaaaaaaaataaaacgaattcccttaatagagggtttctaaaaatatatgggtgatttgttgcaacagaatatgtggtagaggcacgtggcaggaggggatagggacacgtggtgggtccaggggatcacgtgcgcgtggggggtgcccgatcctgctccacccccgccggtggcgtccgggtttgagcattttataaaagaaaacactaagaattttatataggtaggtaggtagcgaagatattcctcaactactttttttataaatcgatataactctaaccattattaatatctattttttcaattaaaattttaattatacaattaatcctactttgatatccttgctgatcaaacacaaacatatatatacatgaaacaaagcgtaaaaccttaatatatatagattagcacaacactaatatctcatctatgcacataagcagcccatccaagttcatgatgaacacaactatcgcatacttctggttagcatcgaagctttgaacgaagcatgttttaatttgtcaggcatgtcggacgaaacggattgagtacaaaatcaactctcgcggatgcacgtgctttggaaacaacggctgtggatgcacacgttttctgtaacgatcacgagcgacgatgtagcataccgaagcggagggaaaacagatcacacaggacaccacgatgacgtgtacagacaggaatcagtcccggatacaaacgatgtactgaaattccgacaaaaatacctttaatttttataatatagtaaagataaattgaaaattctagagttcataccacaatattcaacgcataccctgtttgtttcccctactatgagaggatgaaattttagattatcgtggcacgcttttcaaactactaaacgatgtgttccatgcgaaaactttctatatgaaagttattctaaaatatcagattaatcaatttttgaagtttgtaataattaaaactttaattaatcacatatttttaccacctcgttttatgtgaaacacttaatctttatcttcatcttcaggagattcaaacactagaatggaagacgcataatagttcaattcgccgttttggtggtgggatagggatgttgggtatagaagtatagaaaatcagctggtcctggacaaggtttattatggacttttggtttagaccttaaatatgaatttatcgtactcttttttaaaaaaaaaattcttcaccatctgccactacaatttaagaactacatctatgattttttttagaaattttaaatttggttaaaattcctcaaaccctaaccgccgataaccgatctcagctcgtatcccacggtaataagagccccgtaaccacgtgatttcgcaaaccctggtcccggcatgcagaacggctaatgattaatgaactgacgcgtagtagaaataaacaatctgtgtcagcgttcgctacaaactacggagtactacatttgtaatttggattattgcacactcactggcaccttgcgctgactgggcataacctgagaatagagaagagggtttttgcacctgggagcagttaacggattgctgggttaggtttagactttagatctggactaacctctcacacgccgctgaagcccacgttgctcacagttccgaccttagcgtatgacgccggcgaggcggcgactgttcatcgatgtcgtagatgcagagatccccgtcgttttccctgaaattcttcatgaactagacgcggttccgtttcaggttgcacgcgcaggcgtagcacgaggtcgcggcgatcccatcggacaagaggaaaacttactccgatgtcgggcacgcgcgccaagcccggcagctcgtcggagaggtcatcctgtacacggagactgcgctgatcttcctgtcagcgaagtccaggaaaccgagaaggacctggaacagctcaccgtcagactgcagcagccagacgttgccggtgtccactgtccacgccttgccggtgtactggcgtcgaacttggcgaccggatcggagaggacggtcgggaggagaggtcaagtcaaagtggacggtgcacatctcatccgcgttccattcgcataagatgaatcgcagcgtccctcccacggcggcgatggccgggatcgtgttcttggtgaggggtgtggaagtaatgcggaactcctccaggcgtcgccgttgacgaggcataagcacatctcggggtcgtgggtgtcgacgagtatgacatctgcattggcattggctggactgcccgggcacggacgccggcgacctgacgggatccgcgactcgtagctggactccgtcttaccggcacggggcggactcgtgcaagtctaacgcccaatggagaagttgacggtggcgtggccacgtggggaggttggtcatggttgatggtcccacacggaaaattcggcctaactacctggaaggccaccactgcaagtggcccacaaagaccaacggagattggatagctacaaataaataagtccactttgacaccctcgtaccatctgattcgtatgcctcaaccattagatattttgtggttttcactgacgtggcacgttgacatagtccaccctaccgagacatcatgtgggacccatgtatcagtgtccagcttcctctatctctttcttttcttatcactctcttataacaggtcatcctttatatgaagtgtgatgaagtcatccttttataataggtctatgacggttgtaggtcagtggttaagttggtaaatccatgtaatagttattggggaccaataaggaagcgccatgtggaagctagcggttagaggtgccgaggttggtttggccgaaccacctctggccaccgactttctttagtctctgacaagtgggtcctatggtggttgaggatgctttggccccactttagatcgcttttgactgtcatgtgggccttccaatccttgtactcgcacttgattggccggaggttcattttgtctcatggcgggtgaattctcttcttaaatgatctgtaaacatatttctaccaaatctagtgaaaatagttaataataaacccgccacattctgcccctatggcaaaattggttatatagcatcaaaagttcacatttttggttttatagcaccgaaagataccggttcactttaatagcattcaaagttcatgtaaaagtagaatgcatggcaatgaggggatagaaacgtcatatcgtgtgtgtggctgggtaaatagcgatcaacgcggacggaaaacgatcgagaattgacggaagtgttaaaaataggagtggggtgaactttgggtgttactaaagtgaacctgtatctttggatgctataaaactaaaaacgtgaactctcaatgctatataaccaattttgccaaatggggccagattctgttacggcggcagcgtcgagccgccgaggtgttatcgtgtccgcgtccaagcgacggcgctccgctgcgtctgcgtctcgccgcccacggcagcgacaaccataatgcggtcgctggctgctgatgattcatgcgtgatcgatcaactcagagagagtcagttaattccttctggaataagtccattttgcctccctcatctcttgcgcttggttgaatcgcatccctcaaccgcaaaaccgggtataacatatcccccaactcccaaaaccgttgtaaattgactccccggacggtttcgaaggcggttttgtcccacgtggcatctttgaccccgttgaatggctgagtcatcaggtgggacccacatgtcagccagccggctgctggtactgcgtgccgacagggtggccttttcctcctcgtcatcgtcgttctcgcccgacgacgaactcgagctggcggcggcgggctggcggccacgttccgcatcccgccgcagctagagtgcacgcaacaggctgggagggggctagcggcggcgttctgcatctagtcctcttcgtcgctgtcctttcccgcctccccaatcaacgccacctggtccgcacggtggcgagcaacgatgacggcaggaaccccatgggtgtcaacacgaggtcctcgatggtctagcgatcgtcgtggaggcagtgtgcggaggcgatgatgtacgtgccggagatggagaactgtgccaccttgacgctgagcggcctggcgacgtcgacggtccacggcgtggggaagtcgaagagcgcaacatccaggaggatcctttcccttctcccctctctctcctaggatgcgggcggcaggcagtgagcatcggctgccggcgggagaaggcggcaccgatggcgacaccaccaccacctcgcggcgagcgggacggcatcggctgtcggcgggagaaggcggcaccggcggcgacaccaccaccacctcgcgacgagcgggacggcatcggctgccggcgggagaaggcggcaccgccaccacctcgcggcgaacaagacagcggcggcgttcggagagtacaagatctcccaggtccagccgaccgcgaccaccctgtgcgctcctcccaccgcccggccaaccgtggccacccggcgagctcctccccggtgcccagccggctgaggcatcccagcgagctccatccgcgcgtccaggcggccgtggcctcccggcgagctctatccacgcgtccgagcggccacgacctcccggcgagctcctcccctgcgctcggctggccgcgactacccagcaagctcttcccccgcgtccagccggccgcaacatcccggcgagcttctcccctacgcccagccgtcgcggcctcccagcgaggtcctcccccacgcccggcaagccggggcctccccgcgagctcctcccccgccgtgccgctcgagccaatggaaggcggctgtgagagatgagaagatgaaagagagaggggaggggtgataggtgggtcccacctaattttttacagtgaatgccacctagatgccacgtggatgccacataagctaaaactggactcaatactgccttggaagtcgatttgcaccggtttttggagatgagggagtcgttatacctggttgtggttgagggatgttattcgacaaagggtaagagatgagggaggtaaaatggacttattccattccttcttccaccgccataagtgggccacaaaagaccaatggctcataggcagacaattttcgtctccgagtaaatcatgggctttatatgcggccgaatttcaaaccaccggtcaatgggggtatctagcctgctacatcaattgaacgtaggtcaaaactgaacgtgtccacaagaaactgaattccgcttccattttagtatagctggacaaattccagtatttttctcagctaagatgaatcagataaacatttaggagtactaagtactgcgagtcacacattacaacatacaaaagaaagctggtaataaacgagggttacagtcctccaaagaacagattctaggaatacaacagtagcaatatctatagcaatatagaaaatgcacagatttgaaattgtataataacaacagtgttgatacaccttatcaagcaacaatgaccacaggctccaagcgttcggctctgcagcttgctttgcggccgcacatatcgccgcatcaaaagcctgctgctgcctcaatggcacatcagatacagggagaacatccataccagcccaagttgctgaaagcctgaagctgaaagcaacttcattcatcttcacgttttgttcgcagcgtccattaaaagtttaaaaccatcatttgtttccagctaactgtttatcactcgtctagtaagattaaggccttcagttctgggtcgtctgctgcggaggagggacttgagcctggtgcagcgttgctggtgcaggttgttgtgatgagctagcttgcgactgtgctggtgttgccaacatcggctgataaggcggatactgcggtggcggtgggtatggcatgcgaggtgggggcatgtaaccgccatacggtgggtagtagggtgggtactgaccatggtaatattgtggtggcatagggtaactctgtcctgagctgcttgatgcctgagcttgggctgcctgctgtggaccgggtttgccatcaccctcctgtgacttgaccaaggcacccatcctctggggatccattgaagggtacagtgtccgctctgctcctggcggtgctggaatgttgaagtagtatgatcccgatggtgcttgctgttgtccctccattccaggtggttgaggctggtcaccactctgctgctgagatataacagccctggggagcattcctccatgtgcaacatgcccttgccttccagcttcatcgtcttctggctttggtgcttgaggcttaccccacatgagcttcaggcgtatacccttgatgactaacttgttggcaagctcctctgcagctttctcagcaccttctcttgtagtgtacgtcacaaatgcacaggcacgttgcagaaccatccttatggactcaatttcaccatgtgcgtaaaattgatccctcaaatcctgctcggtgattcgattattaaggccaccaatgtaaagtgtccttatactctcatcgtctggaggtgtcagggatggcatctcaccggccttacccaaaagtttcaaagcaactggatcattaactctgtaatgagcaagaagagaatgcgtcagagaatgtgaagtaatatataaatagaactaagtgcaatatgaaccaaaagagtacagtgaagaaaaaaaacaagtcggttcatctcacggacatgattaaaccatcagtaggtgtgcatcaacaagatctcaggtgtgctaccacaccatattgtactaaacaatgtaaagtccaatttgattgaaatataccaagatttcttttacttcatcattcatccatccatagacactgatgatggaattcatatccagagttacaagtactatgcatgcagatgctggtttgcatcctgagacactacacatggatttagttttgatgatagtcttaatattaaaattagttagaaatagcaggtctaacagatataaaaaaggatcaataggcatctttggagtataatgatcattaattgttgcctcttaatgagaaataaaaatatgctaatatccatagagaaccaaaacaagcacacagttcaaaaaattgtatgcacaatcagcacaaacatacccatagtaacgatctttaatgttctgctgagataactctccagtttcaggcatctcatgtcgataagggcattcagcacctcttgtacattcaccacgcacatagaaactgcagacatgagctcgattcctcttgtaatatggtgccgtcctctgaagcttcagaatggtgtcattgggacgtgccttcccatgggaagaatcataatctattccagccctggcctacattttgataaagaaagcctaccataagaacaaataatccatacatttagaggcaggaagaataattagatcatgattaacataggcagaaagcatgtgcaggcactctgccggaccaaactacttaaaaaagggtacatcgtttgttatttgagatcaacacacttaaagtgcattcattttatattccttacaacattaggtttctggtctaagaaaacccattaatttccttaatgtgttatgctactagaatagactagacaataaaaatggaaggaacactgtggacatactagttgcagggaagaaaaatgaaaatagcagtgatatggacataaaccattttagatgagtattgtgaaagttgatacaaataataagttgtgaaaaaggagacataccttgcgatcatgctcttctgcaaagtactcacggttcacatcactccttgggattgcatcatttgaattaatagcgagtgctgtatccctaacctggaccggtagaccatattcaagatctagcaggcagacctggcagacatttttcagtttgcaacatgtctggcagatctctgtcttcttgtatcttgcatcccggccaggtcgccaacggaagacagtaaacggacgtgcacatattttgcactctttatcatattctgctctcaactgccaagacaaacaagaaagacagtaaatcttgtgtccatatcaagatcataagcaaactaaatgtgccgacaatgataaatttgattagtaataaatgtttggatgtggagacaatctcatccacatctaattgcttagtattggacccctacacaatgcctggtcttctgcttgacaatttgttctcgttttcttggctaggttatcctccacaaataaaattctataatcatactactgcaatttgcgaaacaaacaccatttcggtacatgaaaccaacaaaatccaccctagagcagcaatcttttcggcctaactcgtcgctaaatcagaacaactacaacaacacacgtaccgcaatacatcccacagaaaccgacgcctaacttttgacccccgatctaccccaataacaacagcaatcgcaaaccaggcaggctgaaatcaccgcgcccgcagccaccacatgaaccaccaagagcgcgaatcaatcagatgcggttagggtttgtgggggggcaagagacacggtaccatgcggacgtaggggttgtcgccgaggcaggactcgcagatgatggggaagtcggaccgctcccacccgtccgcctgcgcgtctcgcagcagccggtgagccatctccgccgccgccgcctccgcctccgccgccgccgagaaagacgagaggaaagagagagagagacgaccgagacgaggcgagctatctgatttggctttcctccctctttaaatgggccttattgggccgtactaccttgcgtgagcaaaacgtgggctgggctggtatgggccgggtcagtgggccggaccagatcagcacagtggatactacagaaattttgttgcagcttgtggttgtcggtggttagctggttctctttcgtgcagaggaaacagttagaaacttaaaattattctgcaactttgtttttaagaaatttgcttaatttcgtattccctccgtccctaaatatttagcgccgttgatttttttaaacatgtttaaccgttcgtcttatttaaaaaaattaagtaattattaattattttcctatcatttgattcattgttaaatatacttttacgtatacatatagttttacatatttcataaaagttttttaaataagacaaacgattaaacatgtttaaaaaagtcaacgacaaatatatagggagggtgggagtacatcttgttgagtagaattgtcctgtatgtttgacactgaatatcctcttgaagtggcggttgtatattttttttctttcgccgggatggcgaagaatgctgaccgatgtatattaaggaaaaggggaaaattgtacaaatgcagtgcgttagagcaccgcctttacaacaaaaagcaaattacaaagtctgtaatctctctaaagctggcactgcagcaacattcaacgaggtaactagccctgctgatttccaagtaacccattcatcacacatggtcgcacacagctgcatgaccgatgaggccgttccctcgaaaacccgtgcgttgcgctctttccaaatcaaccatataatgaggatgaccccggcgtcgaacgtcttgcgatcgatcttcgcaacagtttgccgggtagcgagccaccaactggcaaagtccgaggacggcggcgagcaggagaggctcaaacgagcctgaacctgcacccaaacttgctgcgagaaggtacaggcttggaagatgtggcggctgtatatttgacgctatgcgttactggctctggtactcttgattgttacttgcatatttacattaatttttttttgttgctttgagtaagattggtgatcacaattgaaattcaactgggtcgtcaaatgtttataacgggaggatttacaattggtgatcagatcacaatcacagaagataactgaatttttttaatcacttgctatatttggacagctcctcctccccgttttcccgcccacgcgaacgaatcaacgaaccatcacccgggtgcagcatctcaccaccgcacctctcgctgcacaacgcgcagtacccgccgccgccgccgccgtcgccgtccgcgagcgcggtgcagctctcgacgaagggcgtggtcgccgaggtagtggtagcgcagctcggcgatcgaagaaccggcgcggcggcccaggaagttgacatggaaccaggcctcgcccctgtacgccgcggcggcggccaggagcggctcgacggagtcgacgtcgatctcgtcgccttctcctcccgcgctgcatgccggagtcttagttgcggacggcgtggtggaaggtgagcgccaccttggcgaagggcagcgcgagatgcatgagaagggtgaaagactgaagggaggagaaggacgacgacgacgaagaacgagagcacaccgacacctagacgagcgccaatactgaccccatcagtgcctaattgctctgcaaatgccggggtacatgtttttttttaattacagtatataatttaatgtttcgcttgttactcaaccgtcaatatttagacggtgttcttttagagggttggaactctcctctccattgtaatatttagacggtgttcttttggagggttgtaaccctcctcttcgcatgaaaaacggagcgatagattaatacacgattaattaagtgttaactataaaaaaaatgtaaaatagatcaatatgatttttaaagcaactttcctatataaactttttacaagatatgtaccgttttagcggtttgaaaagcgtacacacggaaaattaaaaatcagtttgaaaagtacacacgaaaaattaaaaatcagtcgatttgttgaccgcatgatttactttgagatacgtgcatctgccgttgagtgaaaaaatattcgctagaacaaggaatcgaacccatcagggatgccacaacatgcgccgtaccaactgagcaagcagcagacgacagctttcattctatacttaacttttttaaaactttcactgcagttacattacactcacacgattaaaacgtaagtgtatagatggccataaggcccggggcccgacggcccggcccaaggcacgacaaattggcccggcccaggcacggcacggcccgactggggtcgtgcccgtgccggcccggcccaacagccgggccgtgcttgggccgctccctcggcacggtgggccggcacggcccggcacgaaagaggtcggcacggtgggccggcacggcccggcacggtccaacggcaggcacggcccgaccgaggcctgttatgccgggtgggtataaataccccaaaccgcatcaaaccgacaaaccctaaccctagccacatcagtctggagtctcgaccgatccgccgctcgcccgctccgcctccacctccaggctccgacccctcagccctccacgcctccatccctcttcgtcggcgtctccgatggatgcctcgccggatctagcaccgagggtcagcgggctcccgctggaggcttgagggtcgtctcttctctatccttttctttcatctctttggctgatctgtgaccgtgagctcttcgtctccgcctctccggtcaccggatcgacggtcgcattgtcgatttcctctccattctgtacttttttttgcaaccctcatcgtttctctttgtaagaaactcagatccacctcatccaccccgccaaatctagtctctcctcttgtcttctcggagatctggggatttctatcatcaacggcaactccggtgctccgaatgcgcaggtccaagcttttttttaagtttattttctctattcgatcagatccgtaactactctcggctctggtcgttgtttcatttgttcttgcaggtcgctgagcggcaggcggcagccaccgttgaggaaccggagtgcctgcgatggatggtgatccaacctcatgcaactacgaggcgagggtgatggggacgcagggtgatgacgaagatgacttggaggaggaacgcatcgaggtgtttggcaacactgcttcacctctgagagatctgtcgcagccggagccacacgatgatggtaccggtgccgatggcaacggtgctccgtctggctcaagtgctagcaacaagaggtccaggtctgaggtatgggacgactttgaagaactctttgaagagcgcaatggcgctcaggttcgcgtttctgctaaatgcaattactgtcataaaacattgtctgctcgttcaactggtggtactggacatttgcttaggcatattaaatcgtgcaaacctagaaatgttggtgctttgtctcagtccatgcttaggtttaatgctgatggttctgttagtcaatgggaatataaaccggatgtggctagaactgagttggttaggttgattgctagagaggatcttccacttacttttggtcaatctgctgcttttgaggagtatattcagaatgctcacaaccctagatttagtgttgtctctaggcaaactatcagtagggacgtttttaaggtcttcgacaagagacgtgctatgcttattgatactttgaagtctgttagctctgttgctttgacatctgatatatggtctggtaatgctaaggaggattatttgagtgttgttgcccattttgttaattctaattgtcaattagagaagaggattttgggactggtgctaattgatgtgtcacacaatgctgaaaatatttctgaacgtgtgctttctgttgttcaagaatatggtttgactaataagatcttctctattaccctggacaatgcctctgctaattctaaagcaatggatagtcttaaacctgctctgtctggttatattggtgatttatatttgcatcagcgttgtgcatgtcatatcatcaatttaattgttaaggctggtctagaaatcttcaaacccatgcttcaagattttagaactgctatttcatttataaatgcatctaatcagcgcattgctttatacaaaaacttctgcattgctaaaggtattcgtcctcgtaaatttggtttggacatggatgttagatggaatgcaacttatctaatgcttaagcatctcttgccacatagggtcattttttcagtgtttattgcatctcaccatccaatggctgatggtcagccattactgactgatttacactggacaattgctgaaactgttcttttattccttgaacaattttatgattcaactgttattttgtctggtgtttattatccaacatctccattaattatgcatcacattcttgagattgctggacatctaaatacttatgagaatgattggaaccttagaaatgttgttgttcccatgaaaaataagttcttgtcatactggtctgagattccatttctgtattcatttgcttttatcttggatcctagggcc

SEQ ID NO: 66048 - DNA, 4589 bp, Oryza sativa
tggacttggtgctggtaatgctggtgctagtgccagtccaggttctggacttggtgatgctggtgccagtgcaggatctggacttggtgctggtgcattttctaggagaacttctgctaccgctttgattcaggctgtttcttctactgctaacatgaatgcatctgagttgtttgcctatcttgacagtgacactgtcaaccaatacgatgatgacttcaatatccttaactggtggcatgagcacaaccacacctatcctattctttccatattagctagggatgttttgactgttcctgtttctactatatcatcggaatctgcttttagcttaactggcaggatcatcgaggagcgacgacggcgtctagctcctgacatggtgcaagctttggcactaatcaaagattgggagcaagcagatgcaaagatgcaacataccatggagaatttagagcttataaactcttttgacaatttgtttcttgatgaagtaaccactgccactgggactggatgattgtattggacttggactttattatgaacatttgattaatgctgtgggctgcactcttttttcctttctagggttttctcacgaggtgtgagtttttacctagaaaggtttttaacgaggcagccattgcactacacagctactttattcattgaaatacttgtgtcaagtttttgggtgaaagtttatgattttgggtaatttttgacttagtgaaacttttgaatcttagaactgtgatttctgtgaattgtccatgtcatctgtgatctaagtcaagttttttgggtgaaagtttgggtgaaaatttgtgattttgggtaatttgacttggtgaaatttttgaatctacaactgtgagtctgtgatttttgaaactcttctgtgaattgtccatgtcatctgtgatctaagtcaagttttttgggtgaaagtttgggtgaaaatttgtgattttgggtaatttgacttggtgaaatttttgaatctacaactgtgagtctgtgatttttgaaactcttctgtgaattgtccatgtcatctgtgatctaagtcaagttttttgggtgaaagtttgggtgaaaatttgtgattttgggtaatttgacttggtgaaatttttgaatctacaactgtgagtctgtgatttttgaaactcttctgtgaattgtccatgtgatatgtgatcttagtcaagtgatctatgaatttttgtcaatgtgatctgtgaatctttgatctgtgatctgtgaatttttgtaaaggtgatatgtgaatctagaactgtgaattcaactaaggcatgttcaaatttgaatttgtcaactaagttgtgtaagttgtgttatttgaatttgttaaccaaggcatgttcaaatttatatttgtcaactaagttgtgtaatttaaatttgttaactaaggcatgttcaaatttgaatttgtcaagtaagttgtgaaatttgaatttgttaactaaggcatgtttaaatttaaattttgcatgttcaatccattgatccattgaatttgtcaatccactgaattactggtccactgatccactggtcctaagccgtgcctgggctagcccaggcccaatgggctgatcgtgccttcgtgtcggcccggcacggcacggcccagtagcaatcgggccgtgcctgggcctgacgtgcggcccatgggcaggcacggcacggcacgaaattccaatcgggccgtgccggcccgatcgctctcgggccgtgcctatccgtgcctgggccgggccgtgccgggcgggccttatggccatctatacgtaagtgcactacagctacaatgtaaattttagtatacgcgggtgcaatttttgttttacatgtacggaatttttttactcatcgtttatgaaatgaaactatattcgagctcagtctaatttattaatttgcttggatggataccaagctctcactgtactgaatggcatagtgcatccaatccccatcacagcggtccagcttgcgccttgacctgtcgaagtaggtcatctcctcgagcatgtccaccactcgttccacaactctgcgttcgacgtcgtaccggtaaatcatggcgtaatccacgtagaaaaatatgcctccttggtaatcgtaggtaaactggaagaaggtgtcaaaggagtgcggtagcacgacggtgcattgcagcgaccaccgtggcctgctgccccctccgtcggcggcggaagctgtccagagctcaactctatcgtcggcgggagcatgcacatagcacagcttgccacccagctccgtcaggtccccacaagcgacgtcagacatcttctgccgctccatgaacggtgggcacgggaaactggcgaactcctcgctgcacacgtcgaagcgtacaatccctggggtggtgcagctgccggtggacggcgacggtagggcggcgatccagtagatgccgccgaggatgcacggcgacgttttggtcttgatgaggtagggtgggtcggcgaccggcctccacgccggcgagccgagggacaaaacctcgcatccgacgctgtagtccgtgtaggtcttgtcgcagtggcggatgaagcagtggaccaccttcgtcttgcccgtagattggtcggcgtagaagcttaccgcttgcaccccgaagtagtccagcgcacagtccggtagctcggcaagctccttggtcgccgggttgcaaactaacatctgagtggagtacttcatcgtcgagcgcagcaacacgagcccgttgcagtgcagatgcatgccccagccgatggcgccaacgtcgtcgtcccagtcgtcgtcgtcgtcccagtccgcggcggcgtccccgtcgtcgacggcgtcgtccaagttgtcggcggcggccccgtcatccgcggcatcggccccgtcgtcgacggcgtcccagtcggcggcagcgtacccgtctgcggcggcggcgacggtcgacttcgagttcgaggaccatgttatcctatgcgcgaagtccgcggcgacgccatggcccggatagctaaagaagtcgatcgttcccctccattgctctggcacacaccagtctgccaggacgagcatggacggtgggtgatggcgcgccgccgtggtggagtggtgcagctggaggcgaacgaagtgcggctcggcgaccatggagcgccacgacttgcacacggacctgaaccgcaggatggacttgacggggagacggaggaggatttgctcgatgacgtcttccgggatgccagccgccgcggcgccggtgggttcgacgcaccgccgccgcttggccacgggcagatcaccaccatgtcccggctgattcatcatatcacgttttcccgcgctcgcacaagccatcgatagcaagcgaattccctgtaactaaaacaagaaagacttttataggaagaggatgcttgcattgtccgaatcgtttttactttttgttttttgattcggaatctgcatcagttctgcaatcaaatcggattctcgcctggctctcggagtcggagccgtacgtccgttaatcttgcgtgtcgagtataaattgcgcccaaatgaaggcttcgctgagagaggcccaagccagcattggcacttcggcatcagatcacttgggcataatggcccataggccatagctaggggtgaaaacggtacggaaatcatctttatcgttttcgttttggaatcggaaactccggatacgaaaacggaatcgaatattatcaaaaccgaaaacggagcgaaaacgaaccggcgtgaatacagtaacgaaaatttatcggaataaaaaaaccctcaaactgataaatccgattctcaagtctcaacggtcaacaattcatcataaacacaatcatataagtccaattgttaagtatcaatactacatcacaaaacacaatctatggaataaattagtaatgctgttgataaatcccaatgtagaaaaaaatattcttatataattttagatttgcataacaattttttttaaaaaaataaccgctaaacaccatggtattcactattcagtgcttaaaaaagtaatccagggtattttgtgatttctggaaattctgagaaaaattctaaaaattcctagaaaatttccggaaagtttccgaccgattccgagttccgacgaaaactgcccttatcattttcgattccgtttccgaggaaatatttctgaatccgtttccgtttccgaaaaatttcgaaaaaattccgaccgacagattccgttttcgaaaataggttcggaatgtttccgtactgttttcacccctagccatagctaattaacaacccggaaaccaaaatgtttttgatagtttccctttctgaacctgaatcaaccaaaaaaaatgaagacatccagttctctgtcattcgatctgaatcagcgaataactctgaagagattaatgaagaagtgattgtcagaggttctgctcctgtagttctgccttcctctaggcggcatgaacattggggtacctcaaccagagagcagctgaatttcgcaa

SEQ ID NO: 66049 - DNA, 6828 bp, Oryza sativa
tcctgcacccccgatcccacgacgcgcgtgcggcaactggcggatatctctcctgctatataaggaggccgctagtccgatcaaaacgattcgcttgctttctctcactggtgttcttcctcctccgctcgcctgtgctgcctctgtttcgcttcctcgcttctgatcgcttgcgcgcacgagagatcggatcggaaggagcagggcctccggaaccacaatttcgcccgctagtccgatcagaacgattcgcttgctttctctcgctggtgttcttcctcctccgcgcgcctgtgctgcctctgtttcgcttcctcgcttctgatcgcttgcgcgcacgagagatcggaaggagcagggcctccggaaccacaccttcgcctgagatctgcaccgggtaggcgggtgatcaggtttttggggagtgctttgtcacgcccagaaatttaacccaaatttccagactattttgcgtagtaaatccctgtccaggaccagccagggtacacaaaacgacaagtaatatacagttccaaacgtaaataaagcgtaaaatacttacggaagaggcacttagtcctcacaccgaaacagaacgacagcagcggaaaaaggcgatcctagcggggcttcagctccactccacaggcaaaactcaactggggtgtgagccttggtcctctaactccatcttcagctcagaagcactacacttctgaaaagggagaataaaagcaaggctgagtacaaccaccgtactcagcaagccacaccaacgacgcagacgtgcaaagggatacaaggatggtttgtggctatttgcataaaggcggttgtaaaacattttattgagcaaaatagtaaaactgttgagtaattaaagtaacattaaatctccactgatcaacgctacaccacgttgaacaggcccaaccaacccacctaaactacagtgtattgggttgatttattaagtgtgagactaatcacggtgaatctggtcgaccgcccataaccgcgggcacggctattcgaatagttttactctgatcagaggtgtacaactgtacccacaagacacagccccacaacacgtttccgtgcgccgacatgccaccacgacataccggaaagaggccgtgacaggacccttcgcataaccccctctaaccaagcacaccacacctcaggtttcacccccgtccccagcgggcaacgggcagtcccctctcgtgcctaggtgaatccggaagcgacagaggccgtcgcagggcccgccccgctccatcacgcccacccttgcctggatgcgtcgactagaggaaagctacactacaagcccagccgttgcccacgctggcttgtggtaagtacgataagttcttccagggcatcccgcgaaccggtccttaactgccatgggtgcgaccagcaaaaccatgcacccacagcccaccattcagtcgcattttagttggataattacgaccatgaagcatggccagatgtctcgagcacgtagctcactctgatactaaaaaggtctaatactgcaattatcccatcaactgagctagtggtaattaagcatggctaagcatatagttctagctaggtcacataagtaacatgagctagtcgattcattacccaaagttgacaaagaacagatatcaagtaaacatggcacaagcgagcagataggtaataccctgaccccatgtaattagcaaaatatgcatatttatttgcaaatagtaaaacatttgtaaattgggatcaacatgctcaaggggaatgtgtgacttgcctcgcttcttcactttgatcttccgaactcttttcctcgcgaccgcggacttccgaaacgacggaaactacacgctggcacgcaaaacgaggaaaaactctaataaaaaccaaggaaacagtacataaaaagtaaacaaacatgtagagctcaattttagatgcattttgcaagttgaatggctcaattcggagttcgaatgaattagatatgaattttagaagttttgagccatttatatgaatttctagaattaaactcgatttattgcgcaattattatttatttttacaaaggaaaagacggttgctgacgtcatcaaaggggaggggcggcgccggcaagcgggccccaccggtcagcggcacaagggcgccggtccaccgtggaccgggaccaccgaggcggtccaccgccggtccacgggaaccgacggcccggatcggcccaaagccgatcggacggccacgaggcggcgcggctggggcacgggcacggcatgaaaccggctcggccgagccatggcgcggcggcggcatgcggccaccggcggcagcagccggcgacgtggaacggcggcgggcggccgtaggacagcggcgcgcactgggacggcgacgcaccccaagaggcggaggtcggcaagaaaggggaacgggaaaaaaaggaagggagaagaggtcctcaccggaagcggcggccggcgcggaggaagatgacggcgacgacgattgcccgatggcggcttgcgaggacggagggcggatggggtcgcccttgaccttcagaaggagaagagggagttagggaggggaggaccgatgcggggtgaccggtaacgacggccgaccgcgacaatgtgagaaggatctcaccgacgaccgaggaaggaggagctccggcggatttccggcgaagaggggcggcggccgaggtcctcctcgtcccagcggagctgagggaggcaacggtgcgggtcggcgtcgaccgaagcggcggcgcgacgcggctggagtcggtggcggcgacggagagaggtggttcgcgtggctacggcgctacggaggtggagaggggaaatggagcggtggccgagcttgcctgtccggcggcaaagctggcggtggcggcggagcggtgcggcggcgaccctagcgacgggaaacggcggccggagttcgccgaagtgtggcggcgcgcgggagcggcgtagggagagcgagggagagagtgccgggctcgggaaacaaggggaaatggacgaggggagcacgggggtgctttttatgggctcgggaaggcgggatcgggaccggacgtggcggaatcggccggcgaagtggggcgccgacgtggggtggtggaggggttaaccggcgccgattttcgcggggagagtgggggaaagggcgcagacgtgggcggcgaggtcccacggacaagcgcgcgcgcgcggggtggaggaggtgggcggaaacggcggcgtcgtggggcggctcgggcggccatggcggcagttggggatggagctggaggtaggagatgacatgtggggtccacggatcccacctgtcggagagagagggagggagagttggaagggggacgtaaaacagacttcgcgagggagaggggaaacgggccgacggcccaagagaggggagggaggccggccgggagagggagagagagggaacgggccgcgggagggaaagggaattgggccggggcggcccaaagagagaaaggaggattttatttgttttctttttattttaattgattaaatgaactttgtgctattaaaactatttctcgagctccgaaaattcacggaaaattccggagagtacattagggcacaaagaatattacaaaatattcccggccaataatttttaaaggaaatttttaatttcctctataatttcacttgattaaattgatttaacttttaatataatttcttgaaatgcattattaattgatttttaatctcaaacgaaaatcggggcgttacatgcttcccgcacgactgctctgttcatcgttgtctcgtcgtccaccatgtctgcacctggaaccgatggcgtgcctggagccggagccgccgctgccgccgtctctggagatggcgctccgggagccggagccgttgcgaacgtcaacatcgacggaggcagttctgcctcacaatccagcggagggccattctcggggtatgtctctctcctactgtcgttcatacctctgtttgttctgttagtcgcattgcgttcttggtatgttcatgatgcttatgatactgtaagcatacttctggttatgctaaatgttgtcacttgatcaccccacattgttcatgccatgattattgtcttaaaattttggattaaaatatgccgatatatgaccatatttccaacaaaaaatagccctgattcttcttcttcctcactccaaccagaagagctcaccggcatccaccgccgtgccattggtgccaccttgccggcggtgatgctggcacggccctccccatcgtcctcgccttccatcctgcccaccgcgctggtgtgaggagaccgcagctgacgtcgacagagccggggagtcaaccggggagtgggtcgacggagacgaactcaccggcgacaagggcggcgcgtcgaggcgggcggacgaactcgccgacggtgggggcggcacgtcgacggtggccagccgaggcgacgccagcgaggcagcgacaggccgagacgacgcacgcggcggcgaccgaccgacacgacacgggcggcgagtcgggacggggcggcggcgcgacggaggccggccgagacgacgcgggcgacggcggccggcgagtcgggacggggcggcaacgcgacggaggccggtcgagtggcggggcggcggcgcgacggcgcgcggccgagacgacgcgagctggcgcgtcctcgtctcacctgccgctgccgtgtcgaaggtggaagatgaagaagcggggcattttcctctgtgatggtattttgacaaacacacctagttaagaggggtattctagcgaaacactttttagtgatgatattccagcgaatccaaacttatgcgatggtagatatgcaattttctccgtggtaacgtgagtggctgctggaactgaagcttcccggcggcggcaatgtggagatctctcgatggtggtggcacttggtggcactagtggctgttgaatcggagctacacgaggttggcggagacaatggagttggtggtggcgaagggcagcgatggtaccgtgtctctgatggcgagggctggcaacggacagcgatggtggctagccctcccccgtgacggcgagccagttcatcccgtgaccgtggtggatgattggttcgatgacggcagatgaagttggcggtggtggaggctctcgttggcaacgtcctagttgtggcggcaactaggcgagctccagcaccagatctgactgtagccaagccagatagtagaacggtggtcgtcggtgacatagatggttgatggtgtcgtcaactttgaagacaacggctgcggaagctattagcagcgatgccctagtggtgacggctagcaagtgacgtcggcaccaagatctgactgcggataggtgtggtcggcggtggaacatcttcgacgagctcatggcagtaaaatgcgaagtggcattgcagcttcacggcgcactaggggcgttcggaatgcggcggtggcgtaaggggatttggatgacgacaacggatagaaggcacgacaaatggcagcagatgttggttgtgatatgcggaggcggagatggtgtagtgtaacatcctgaaaattcccaacaataaaaaaaaatcactaaaattttgaactttttaaaacttttgcatcatgctggttgttatgattgctattgcttgccaaaccgtaaataattacaaagaaagcaaacccaaacaaagggaaggttaattactaatttaatttatagttcaaatattaaatattcggaccatgttgatagcttgatgccatgattagctaaaagaaacagtaaaatcaaatccaattcatttgaatccaatcccacatgaaatataggaacacatgaaatgatgatcaccactataatgatcgtgtttataaataagtaattcaccggaatatatagattgatacttacaacatttcaccgaattcctcgtgacatgaaaatcactcatataaaataatggtcatataaataaattaagctttatatataaataagaatatgtgagtgtttaattagacaattagattaatattgtaccgagtctcaatttatatttatcgaattactagatccacgtaaaatacattattatacaaataagttcattcaatgtgctattgtaatagtaatggccacattaggatattttaattaattttggaaccctcaaagcctccaaaatttttctaggttaattttagaattagacctcatttaaataatataatagaaaaatatatataaaaataaaatatgagtaatattaatctagggtgaattcattagttaagataacacaaatattgagtaaaatgcatatatgcaaaattaggaattgtggaatcaaatttatatggaaaatacactaaaatcggactaattagaaaacggcactgttcattagccccctaggtgttcgatttggttcctagccatccgccctcttcctccccactgctgcgccgccctagccggccttgagccccgagccgccatcgccgtctcgtcgtgccatcgccattccatcaccctcacccgtcgccatcgtgccgcgccgcgcgccgtctcgtcgacgatgccgcgccgcgtgccgtcgccatcgcgtcccgtccctgctgccgccgtgccgctggcgcctgccgcgccgcgcgccgctcggccgtcgccgtcgcgcctcgcgcctcgtaccaccgcgcgccatcgccgttgctgc

SEQ ID NO: 66050 - DNA, 2052 bp, Oryza sativa
ccattaagccgccgccctttcccctatccttctcccccttttccctataaataccccaccccctttccactttcccccactccatttccctcctcctcccctcttccctttccaccgcgccgccgctctcgtgccactgcgccgccgccctcgtgccgcctcgctgccgccctcgaagccgccacaccgcgccgtgtgccgtgccgagcgtcgcctcgccttgcgccgccgtcgccgccgccgtcgtcggtaagccgccgccccttccctcgttccgccgccgtcgccgccccgggtagcctgagccgagagagagagagagaggaagggagaaagaagccgggagggaggaaagaaagagaagaaagggaaaaagaaagagaggaagagagaaaaaagaaagagagaggaaggggagaaaagaaagaaaagaaaagaaaagaggaaaagaaaagaaaggagaggaaaaaggaaagaaaagaaaagagaagaaaagaaaagagagagagagggaaaagaaaagggaaaaatttagggggaaatttaaaatatttacaaatattagaatttaattataggattaatgaaaatataattagatgaaatcttactaattaaatacctaaaatactagcatttaaatataggattaatgaaaatataattggatgaattcctatagattatagatataatgctcgggtagattaaattaaaaacttatactaacaaaatatttatacccgcaaaatagtttaggatgtataaatcgaaaatggatattgtacagtggcataattatctttaacatgtcttgtcactgtagcaactaaataaattagttataatcaatccttccaatttatgggtgtataggaaaatattagtgccatttactagtctatgtccaaatataactaaatccatgacttataaattgtttacataaagtttagcctcatattttgtaactaaaatataaacacacatagatgaatctttaacttgtttaggagagtaatcacagagctagttgtatttggaccacttaaaaatttgtcgatacaatgtcatgtgaagtagaacatatgtatataatcgattgatatccattagttaaccaaacagagccatcttaaaatcaacatgtattgtatagcttacagtaaaaatcaactactcaaatatatgatccaataataagatattgttgcttacgcatatactatacatcccattatagtagtacggtatagtattaatttgcgtgttgcatatattaaattaagagggagtgtatgacaaaaatgtatattggataaatactagttataaatcttgaccccatataattataattatagttcaactgtaaattaggattattcattgtaaaattatgtgatgggataatctgtaaccataatatgattaacctaaacaactctaacatagaaagcatggatgattattaaccttttgtaatttattgcgacaagtgaaatatgttcataattaaagtaaagcctccatcaattaaataataatacaaatgattcattatttgattgatcctaaatccatccgacaacagaacctctagtatacgaccattttatttaggtagatgcatgtgtagccataatccttccatagccattagctagactacaccacatattagccagatacgtatctcatttatactacattgattagctcctgaatagaccaccaagacaacagaaagattaagtagcccttagcatgttggaatccattagcaaacgcgaataatatgagcaaccttaggttcgacctcaacaaatatattttgtttgtacatatttgattgttatttgaatattggtttttctcgcgtattatagaatttgtatatcggttagtcgtgaggcaacgtatgcagcttccaggaggtgaaggttgatcaagaattatatcaagaataaggactatcctgagcaaggcaagtcatcactattccttgaacatgctgatcccaattgcgaaattgttttgtttacaaataaa

SEQ ID NO: 66051 - DNA, 3960 bp, Oryza sativa
gccacattgccatgatgttgatgacatgatttgtgaaaggagaaataaaattaaacaactgttttcgactggggcggacggaggatttgggtggtatctggaaaaggctagtaccgttcccggtcaattaaggaccgagccatggagttaagcgtgaaacgacccccgtacaaccgtacttctcgaatgggtatagacctagcggattagatagccgagcggaggcagtatccctgcatagatggttcacccctgagtgaggcaggtgcgctacaatgggacagccgttgaggtagggccgagaggcgtgccctacatcggtgtcaccattggtaggactgccatgagtgtgtgagagagagaacttaacttgaaccataatttaatatgcgtgtgagacttctctttcccgggagcgccagaactcctctcactgctagaaacatggacgcctagagtgcatgaggatttaagttcatggagcgggtactgccaatgcgaggttatcgaaaagctttgccgtgacgcgtctcatgtgttgggacgaggctcatgtgttgggcagtcgcggagtgcgggtaaagtgtacatccactgcagtgtgagtaaaccaaatctattcgaatagccgtgctcgcggttattgagcaccgggacatgtattgcacttggctagactccaaattcttaacttgtgggggatgggatattgcatgatgaattttatgctgatggagccacatcccgagaggagggaaggtggacatcctcagaaaaccatgacgattcaatggcgggaagctatccttgggatcacaatggatggtggacagaaccgtcgttgtttaaagtgaacactggtactaaaatttgatcagtctatgctaggtcttaggcttatgaaaagaattgaaaaattagctttatgcaaaagaacctgaagcctttccttgaaataccttctatcatacgcattgttgttgtggtggcttgctgagtacggttggtactcacccttgctatttatatatcttttaggagagtgttgaagagaagcccttgtcggtacgcttgcgtatcccacaagatgattggagtgcggtcttgttctaggtctcgttccccagtcgactgcctgtggcatgttaaccgggcccttatattattttgtcttccgctgttgttctctgatagttgttggcctacctggccctaatgtaagtgtttaactcttttagcctaaattcattcgtgatatgttgtgatccaactatgtatgtgtgtaccaactactgatccagggattggtacagataaacacagaagatttccgatttccaaaatcgggggtcgacatgtagcgacgggctatggggtctagttccagttctccctttcctcttgtgctataacaaaaagagtatgtcatgtttgaagtttgaagctaagtcttctagtagcttttctttcttgtgttttatgttttcctctatagggggtttagagtctaagaacccatgtatgttttagctatgtatatccttcatggatatagaggccggattaatgaaaatccattatctaaaaaaatatggggcatttgcaaatttgctaccggttttttcaatattgcaaggatgccattcgaatgacagttctagtggtatttttgcaattttctagtggcagttttgcaataacgattcaaagtagtggtaaatttgcaattgccccaaaaaatatagctttgacattgtcctactagagctacttactggtaagatggccttcaaccttgaagggcctgaaaatgagaggagcctttccttgagcttcttgtgtgccatggaggagggaagactcatggacattataggtcatcacattcaaactgatgagaatgctggggtgctcgaggaggttgccaaccttgcaagccggtgcctggagatgatcggcaataaccgcccgtcgatgagagatgtcgctgacaaatttggccggctgaggaaggtcatgcagcacccatgggcgcagcatgacccggaggagatggtgcaacattcaaaatagagaaattgcaacatccaaaattcattgtctgcaacatataataagacatggtttgcaacatcttcactagctcttcaccagcctcactttcatcagtgccggctccaacctctccacctcctcaaacagtggtgagcaacactgagatggagacggtgactgcaggaatccccaacctaaagcaatctcccaatatcccttcccctctctagtctccatggcagccctcccgcagatccaatgctctaaagttgtgggtggctagatctgcccagaggagatcccgtgaagattaaggaggagaagaagttaggagaggagagggagcgggtagagaggagaacaatgggggaaacgtcctagatgacggtgacgaggatagagtagagagaaatgagcgagaggggagaagcgggcaagatgggtggggtctacgagcgtccgttgtccgagggattctctcgcatcggatggtcaatcaaaagcatttcccccctttcagtgatgtctctacaaagaaatcttcttttacacatattttaccgcatttgtggctttgtgtgtgtggttttcccttatgttgttgatgatatccgtggatttgacacaagggttcacccacaataagatccaaccatagtgtttcctgtacgtcgaagcaacttattgtactagcaactcagcttctcaaaatttaggtacattaaaaataggcttgcgcacatttaagcacaatacatcacagaagtcttttattcatatataatcatatataaaccacgtacgtatatagcgaatgtaatacaacacaaataaatgtatacgacactgacagaggtataacggggcactagtgtggtaaacccttggacctagtccaagcacatacacatgcacactatatatgtatagttatatagtgattgaaagaaatatcacccttaggtcttgttcggttcattcccaagagagagattagagagaattgaggggattaattccacacctcaataaatgtgaaattattctcctacaaatctcacttatcttcttgttgagggattaaacgaatagacctaggggtgaatttatcatgagcactgatccaaccatatatccaaggatatattcatatctacataatatatatcatatgtggacataaactccgatagagtccacaagtgctcccgcgcgttcgaagaaaccaaccacactgccgctctgcagcgggaggctaaaagcagttccaccaccttgtccaaaattataagtggtgacattgttgacaattttaaggtttgtcacgacgttggtaaaagttccggagattcccttcacgaattcctgagatccaagtgtaatctgtatgcaaggacgtgcggaaatatcatcattaattgatttccaccagtgaatgaacttgaataacactcccttattttctttatatatgatgcttattagttttaacactaagcaatgtcatatatataagaaaaaaaaaagagagaaaggaacatgtattaacgggcagcaatcattatattcaggaagaatattaatgggcagcaatcataatattcaattttaactgtgctaactagctaactactggcactacgtgttgtttaaggtcaatacatatgacatgcatctacacatatactttctccagttttataattcttaatattttgaacaaagttcaatccaacttttataacttttattatcaataactttaaaaatatttaaaaatatttagtttaatttgaagtcgcttaaccaacatatatagaaactagtcctaaaaattactataaacaaaagtaaatatttatttattatgtataatataacagaaaattatagttaaaaacattt

SEQ ID NO: 66052 - DNA, 11883 bp, Oryza sativa
  unsure (1)..(11883): unsure at all n locations
tcctgcagcccgaatagtgttttgtttttaattcgcagacacatttgtgcgagataatttagaaacagttccaaatcgttttgcatagactgcccttttagggagaggactatgacacgaacgcccaattttattcaaatcattgaacggcaaataaatgtttcacatgtttgagcaatcgatgaaaaatgtttcaataaaaactgtttcctgtcttcctgatgtttcattactcagtcaataaatgttttatcacttaatccaaagatgttccaatcatatatacaacatccgaaaatgctgactgcaatagacaaaatctataagtgcaacatccgaagaaaaccgactgcaatataaaaaacaaatggtgcaacattcaaaagagagaaattgcaacatccaattcattgtctacattcatggtttgcaacatctttgctagctcttcaccagcctcactttcacctgtgctggctcctacctatccaccacctcaaacagcagtgagcaacaccaagaaggagacggtgactgcaggaaaccctaacctgaagcaatctcccaatcttcgtccccctctccagtctccatggcggccctcccctagatccgatactctaaagttgtgggtggctagatctgctcggaggagatcccgtgaagattagggagaagaggtacgagaggagagggaacgattagagaggagaacaatgagggaaatgccctagatggcggtgacagggatagaataaagagaactgagcgagaggggaaggaagcgggcaagatgggtgcggctacaagcataagatggattctgtcacatcggatggtcgatctgaagccccccccccaacacacaccccccccccggcccctagtggtgtctgtacaaagaaatcttcttttacacatatttatcacatttgtggctttgtgggtgtggtcttcccttgtgctgttgatggtatctatagatttgaaatgaggtttcgcccacaataagatccaatcatagtgtttcatgtacatcgaagcaacttatttgtagtagtaagtagtaactcatgtgcatagcttctcaaaatttaggatcattaaaaataggctttcgtgcatttaagcacaatacatcacagtagtcttttatttatatataatcatatataaaccacatacatatgtagcgaatgtagcacaacacataaatgtatacagcatgagagaaacataacggggcactagtgaggtaaacttttgggcctaggccacatacacatgcacactatatatgtataggtatatagagtgattgaaagaaatgtcacccttaggacttaggtcttgtgcgattcatccccaaaagagagattggaggggaggtgtagaattaatctcctacaaatctccttcaacctcttgtgtgagggattatacaaacaagactttaggggtgaatttatcatgagcactgatccaacatatatccaattggatatattcatatgtagatgacatatatcatatgtggacataaactccgatagagtccacaagtgcgcccgagcgaccaaagaaaccaaccacactgccgctctgcagcgggaggctaaaagcagttccaccaccttgtccaaaattataagtggtgacattggtgacaanntttgaagggttttttttgggttttcccaccgaaaccgttttttttggnggnttaaaanaaattggtttttttccggagattcccttcacgaattcctgagatccaagtgtaatctatatgcaaggatgtgcgaaatatcatcattaattgatttaattccaccagtgaatgaacttgaataatactcctttattttctttatatatgatgctagttagttttaacactaagcaatgtcatatataaaaagaaagataggaacatgtaataacggcagcaatcataatattcacgaagaatattaatgggcagcaatcataatattcagttttacctgtgctagctagctaactactggcactacgtgttgtttaaggtcaatatatatgacatgcatctacacgtatactccctccaattttataattcttaatattttgaacaaagttgagtcaaacttttataactttaattatcaatgacattaaaaatatttagtttaatttgaagtcgcttgaacaacatatatagaaactagtcctaaaaattactataaacaaaagtaaataatttatttattatatatattataacagaaaattatagttaaaaatattttttggagaccatatcgttgtttaaaacgtcaagaattatataactaggagagtagctagctacggggtttacatttttttctcaacaatgtaaattaactgctaccttcgtccctgaaagactatttttaagtataaatccaaattcacgattgaaaacagagccttttgtgaaactaaaaacacaatattttatatgtaccgtagttggatttccaccaccaccaccccaaggacctgcaagatgttcattcccgtccgtgccaacgtatgtaaaggcaatagcatcaatggctgctccactacggatcgtcacgttcttcaggctatttgggggtacagatatgtctacagaacctcctccatttccaccccatggaccaatcttaacaagctttgtgctctgcaaacaaacacatcacatatcaaacataaaattaattgaattatatcatatatataatactacagcgaacatttttgcaggcaaatcataacggatgcaattaaaacatgggcatgcgtttcggaaaaaaaaagtgtattgaagcaaacgagatgaggactacttaataattaactaaccattttaatttgtagccttaatttctgccctatatatctgtgattacttgtagggagctatagttctttgcgtggataggccagccagggaatgccgatcctatttatagtgctggatttgtttaacaaagcaaaatttgtttatcaacttggtttgtaaattctactataagcaacgttttcttttataagcaacttgctttgtttgcttcatgatgggtgaggaaatgttcatcctaagaaaatgttgctttataagattaaattctttcttagaagcaaaatttgctcacccgttattagaagcaaacatttgtctcgcccacgacttttttagtgttgtgatacaatataatgtgaccttacttgtcgtcctctgtggctagcttaatttgttcataaaagctgcaacacgtccatatattatacaaagattctgctacattttggactaatgtctgctcttgaatatgtttgatgagattattcacaagagcgtgtcacactctatcaagttgtcttttttatataggtatgaaattgtcatttgtgaaatatcccattggtcctcccaccaacaattgtaaaattgaaaaaaaaaactaaatgtactctcatccactatgcgtacctaaacaatagaaaaacaaaattagagttcatgtaaaatgccaaagttttcctgataattaacaagtttccaaccctcatttattttcgaataaatttaactttgggtcaccttttattgccggtgtttcattttggaccactattcaactaatgtttcactttggactagataattttaccttatgatactttggaccaacctcaacttttttatccatctacatccaatttatcataagtcaaaaaaaaggtctacttatagctgagtaagtttactgacgaataggagccatcatactcgaggttgttcatatgcttgatgagtgagttgggggtggtccaaagtgaaacaaaggcaaaattaccagcccaaagtaaaaaaaaaaataagaggtgaactaaagtgaaacattaataataaaagatggtcaaaaatgaaatttactcatagtttttccttggataaaagcatctccaaccgaatgatcaaattaaactctccaaatacttatatagccggttctccaactgatttaaagagtcaaactcgttacttactccaatagtctattcatctacactattttaagtctatgacaatgagacccacatgtcagcctcttctttttcctcctcctccttctcttcttcatctttctccagcatccatcgccgagctcctcttgagcaacggcgatggcggaaccgtgcgcacgcgaggcgacgatgagaggggagaagccggcagcggcaatccgtgcacacacgagtcgacgacgatggtgtgtggcatcttggcccaattaggatatggtttgtgtggcccatgagagttttgtgcatacctccttgttagtttagcaagagtggaaccaacttataagggtttatcctttcaaccatgtcactcccgaattaactcttttacacaaagcgaggacgaaagtgtaagtggagtgatatgtgtaagtggagagctatttaaccattctcttcgagatctctaaggacgacttgctagtagcagctaagataggagtactagcaaataaaacgacaaaaaaagggcttaggccaatagcccagcccatggctcgtggcgtgtccgataaacgagaccatgaagaacgtcgcgggcaccgtcacggctgccggccactggcgccatgccgccatccagcatccatatctttcctctctagaaataaagccatagagttattctagtgtaccgtgttgtgattgggcaggcgcgattaagcttcatggaccaacacggtttggattgggaagcgaaccatccaattttgattggttcttctagcccactcactgtaatgggatgggtatttggccttggaataagttcactttgggtccctctatttgtcgctcagtccgattttcgtcccttggtcgcaaaaccggttacgacgggtcccccaactttcgaaaccgtttaaatgaggtccctcggcagtattgcatctagtttttgctaaggtggcacctacgtggcttcttttgactagttctttgttcaacgtgtcaatgacgtggcaattagatccgcaaaaaataatagtacacgtgggacccacatgttagtcgcacacaactaataaaaaatggtgggcccatgaggacccacacgtcatcctctctatccctcttctatcgctctcttgccggcggaacgggatgggtggcggccggagcgggcgatggcggggcggagcggcggcggaggcagagcggggcggagccgaggggcgaagcggggtggagcgggggcgagcggatgtcgtcgagccgtcgccatctcgccgcggcggacgccgtgaacgatgacgtgctcgcgcgggtggtcttcaactcgggggtgtccgacccggggaagggaggaggggggggggctcctggcgccgtggttggaggacgccgaccgcacccaacgacgacgagcgtgcggagaaggattaggcggcggaggctgtggttttcatcaacggggaggacgacgaggcgacgatctgtccgggttcaggggcctggttcttgatctctcttataggtgacctcaacgacctcaacttgatccgacgatatcatccaaagttgcaaactattttgtttatgatagaccaaaatttgcagtgatcgtgttagaaagagatgaaaacaatttgaaggaattttgcatttttacctcgaaatataaccaggcctgtgaacgttgtctgctggaagcgcgcaatttgtttggaattcatggcgaaggttagattctctgcttccaaaatcatttttaacttcaccatcagttattcaaagttcattatttgatccaaaaacatgcaacagcagcgctcagaggggcagagcagacggcggcgatggcgggagcttggcgcttcgacggcgtcggttcttaaccccgtagccaacaacggcgaggagcacgacggcggtttggaagacgtagtgacgacgacgacgccgtcaccagcagtagcctccgccgccgcccacggccgtgctgccccgcgtccccctcgaggaggggaccgacctcgccgctgtcgtcacgcacgagggctccggctactacgtcctcaccgtcctccgccgcgccctccgtcctcgccggaagcaggaaaggtgccgccagggtcgtcatgcgcgccgcccattctctccatcggccgccgctcgtcggtcgtcctccccattggtcgccgcccatcttggcgccccttctccccgccggtcgccgcccatcccggccccttctccccgtcagtcgccgcccgtcgcgcattctcctcgccgacagtcacccatctcttcgctgcctgtcacgccgtccaccccgccggccgctgctcgtctcggtgccctggctgcatctcctcctcctccggcagccaccgccgcacactgccccttctccccgctggccaccgcccgtcggccgtcgcgcccgagaaaggaggggagggagagagacggagagaggggagatggggagtgaggagtaagaagaggggagtgagattgacatatgtgggccccaccttttttaattattgttttgtgtagctgacatgtgggtcccacgggtattttttttccaaatcgaattgccacgtaagcgccacgtcaatgccacgtggatggagacctagtcaaaccagccacgtaggcgccacgtcagccaaaaccgctacccaaaccgccttaggaccttatgtgtccggttttcgtaagttggggggcggttcgtacccggttttgtggttcaaggacgaaaatcggactggacgacaaatagagggacttgagtgaacttattcctttggccttgcaaagaagaaatggccagataagctttgggatagggaataaatctattttggttccctcatcttttgcggtgggtcaaatcgcatccctcaaccacatcctcgtcccaagcgatcgttaacctccttggtgctcatcatcttcccacagaacatatggctgaggtcgtacgaaggggtgtaagtgggtcaaccacgaaccacttatagatcaaaataagcggattcacggcttattttagcctataagtaaattttacgggctagccacgtacaccttagccgtacgtgaggcagcagcctgaggtaggtggcacaaatgatgttcttggagtcccacatctgctgggttagcttgggaaccgtgagggcgcggtactgctgggtccccttagggtgtgtgtcacgcccggaatttctatccaaaattccaaacgcttacatgtgtgtgaaccctcgtccaggaatcagccgaggcacacaataacaaattgataatagagtacaaatattactctaattaataagcgaataaaatgtcattacagaggtagatagttcctctcaatcaataaagttctaagcagcggaaaataaataaacggcgcagacggctccactccacaggcagcttgaccaaggctacacctaatcctccacaccatcagcctcattgtagaactcttcctctgatgaatgattgcaaggtgagtatatgacatactcagcaagccacgcagcaaatatgcaagtgcacaggataacaaaggatggcataatagggtttcttttgcaaaagcagcatttagcaaacatttgagaatttgataaaacagttaagtaattaaacaatattaagccaacgctatacaacatgccctattgtataggcccaaccattctgaacaaccaccccggctgcacagttctatctccaaaccaggaatgtaccattccaaaccaggagctaatcaaattattaccagttatagcatcttttactatgatgagaggtgtgagactaatcacgaaagacattgttagacccgcccataaccgcgggcacggctattcgaatagttttactctgatcagaggtgtaccactgtacccacaagacacaaccccacatcatgtcaccatgtgcctcaataccaccacggtatctcggaaaggagttgtgacaatacccctcgcataacacaatccactgcagcgcaccttcctggatcataatcaccccctcataaacaaggcatggactccccagcgacccccgtgggcttatctccgccacttctcagtctggtgccccgcaatgaaccatgctatacaaaagataaagccgttgcccatgctggcttgtggttggcacgataaatgtttcacaaccgaaactcgtgaaccggtccttaattgccatgagcacgaccatcaaaaccatgtgctcacaacccaccattaccaggttttagttggcacattaattaattaactaatcacgatcgaccatcgtgaactatcaataagccatcatgaaataatagtgaatcattagttatcccataagtgtactaatgtttctaagcagggctaagcaattgtatctaatatctagttgaaccaatataaataaagctcaactagtcaaattaatataacccaaggtatcaaggaataaggtaatcaagtacgaaagggccatagcaatcaataggttaattccacccaatgacattcgaaaatagatgcaatagttgaatagaaacaatagctttaaataggatcaacatgctcaaagggttgtttgggatctgtgtgacttgccttgctggccttggaactcttcaaactcttctccggcgaaaacggactctccggaaacgacggaatctaagcaaaaagaagcaaaatcaccaaaacagcacataaacaagcatgaacagtacatgtggatatttttaatgtgtagatctcaattttagaaaaatttagagacttgaaccaactaaatcggagctaagatgaattagttatgaatttttaaagattaaaccggattaaaacacttaaatcggtttaaattgaattatgacgcaataatgaattatttttgaaaaggaaaagagggtttattgcgtcagcgggctagggtttggtggaccgggcgcacgggcgacggttcacgcgaacggacggccgagattgatccgatccaaatcggacggccgagatcgaacgagtccacggcggctcacgggagaggggcttgatgacgccagcgatgacgtcaccgacggcggcggcagctcggcaaagaagacggctcgggcggcggactctcgccggcgaacggcggcactaggacgcaaacggaggacaccaacgggtagcggacggcacggcgaactcaccggcgaccaaagcgacggcggaggaccaacggacggcgacagcgacgaggttgaaacggcggcggtcttcggcttgacgacggcgacgatgcttcggcggtctccgacggcagcgaaggggcggacgaggacggcggcgacttggcgatgacgacggcggtcttcccgagtggcggcgacggctggaacgacggcggcgcacggctgaagcggcggcggcgacggcgaagctagggcacacggtgctagggctactccggcgacgagaggcgaaggcgagggtggcggcggaaagagaagaacacggggatccttttaaaggggctcggaggcgacggcggaggcccacggcgacggcaacggcgaaggaaacttgcggcttggagaggaagaaaaccaaaccgaatcgaactcgattcaaagctttccaaagcgattcaaccgacgattccaaaggagaaaaggtagaggagatcccggagattgtttcccctcaaccaattcgaccggagaaggaaagagacggccggatttggaagggaaacggcggcggcggcgctagggtttgcgggcgacggcagccgaaggaggacgaaggatctgacaggtgggacccacctgtcagcgtccgaacgcgcgcgcgcgcgggcggctgcggactgggccggactgggccgaaggaaagagagagagaagaggggttttgggccgactttcggcccaaagccaaaagaagactttttaaaaccttttcaatttaaattatttcttaaatgcaattccatttattaaaaatacttccttagctcaaataaatcccagaaaaatctaggaattatagaattaagcaaagtatttaatgaaattttatctggccactttttatattggaatttattaattaaacttagattttcttttcaagacttttaaaataaattctagaaattccatttaaacaacaatttatatattttgaattttcagggtgtgacagtgtgtttagttcacgtcaaaattgaaagtttgattgaaattaaaacgatgtgatggaaaagttaaaagtttgtgtgtgtaggaaagttttgatgtgatgaaaaagtttgaagtttgaagaaaaagtttgaaactaaactcagcctaagctagccgaccatgaagagatggagacgcgggaacggaattgaatcaaggtgtctgcaaagcttccggaggccagagttaagctgttccggccgggaagagctggcagcaggtgacaccactcatggttgcagaaataagatggttcagatcaccaactgcagaaggaaagaaacaaagtagagtcagaatcatgcatatagaaacacatacatgaaacgaggtagaacagcatgattcatgaagaacaccgtatccatatcaacacgtactgtagaccatacatgtattttacagacaaacgtatagatagatcatttattcagcagtatcgtcagtgtagctgaatgcaagtgccagacatactcattatgaccatgcactcaatagcgttctcaagtctcaacaagctgatggacagatagtgtgctgctccaccatagtgtatcagaaacctctggtgaggggaaaacttctcagagaatgtcagcatcatcctgtctgggtactcctccctgatctttgagatgagcagggtacccatgctaaaaccagttgctccttccagagagtggcaaatgaatcgcacacattaatttctacccaattttcagttgattatgaacacaaactgcaacacatcagtgtgaatcataagcacttcgctcgaggcaccaccagtgaactactgatgcgacgatgtgacagaaatcacataacaaacttattcttcatggtgatgtcaaaacctccaacgtacttcttgacgagaactatgccgcaattttggtgccaactgacgaggcccaatttgtcaccttggtgcaaggaacctgcgggtacctagatcttgagtacatgcagacctgccaactgacagataagagtgatgcatatagctttggtgtgcgccatcctcgcttcgccactgccggagtgagccgtcggtaagctgtggcgagacggcgagctgggacggctacagcggggcaacacctagggtgaggtaacaggttgtggtgaaggtggagtctggtgaggcgctgggaggtccatgatggccagcgaggagcggcgtggtgcatcaaggcggcggtcgacgaggagcagtgggcacatgaaggtggccatcggcgaggcggcacggctagatccggcgtttcctcgcttggatggcgcctcctggcctcgtttcgccatctggtcggagtggaaccgtcatcgaggaggcagggtggagctcgccggcgcatacggagcggaggtggctagccaggtagttggggagcggccggcgaggaggctggttggagctcggcggtgcagatggagggttagctgcagcgacaagactccgtggtaacgagaaaattgcatatctaccatcgcataagtttggattcgctgaaataccatcccttgatcaggcttcgctagaataccatcctcaacca

SEQ ID NO: 66053 - DNA, 1012 bp, Oryza sativa
attcctggttcttctctcacttgtttccaagatacggatcggtttctccacataggtcaaatcctcttggacttctatctgctcaatattagcttcttcggtaggtacccttaaacactttttcaattgcgacacatggaacacattatgtactcctgccaaagattgaggtaactccaactgataagcgacctctcctcttctactgacaatcttataaggtcccacaaaacgcggtgccaattttcccttggtatgaaaacgatgaactcctcgtaaaggcgtgacacgaagatacacataatctccctcttcaaaactcaaatctctgcggcgattgtcggcataactcttatgacgagactgagccacacgcaatctttcttgaatgatctttaccttttcttccgcttcccttaggatatccgtcccgaaaacctgacgttctcccgtttgatcccacaaaagcggagtgcggcacttccgaccatacagtgcttcgtaaggagccatctgaagactagcttgataactgttgttgtacgaaaattctgcataaggtagattcttatcccaacttccaccgaaatctagagcacaagctctcaacatgtcttccaaaatttgattcaccctttcggtttgtccgtctgtctgcggatgataagcagtactaaagttcagcttagaacccatctcttcctgaagtttcttccaaaagtttgaagtaaactgactgcctcgatcagacactattttcttagggacgccatgcaaacacacaatccttgccatatacaattctgctaagcgacttccggaataagttgtctttaccggaataaaatgagccactttggtaagtctgtcgactatcacccaaatagagtcatggcctgatgatgttctgggtaaaccagtaataaaatccataccaatttcttcccatttccattcaggaatcttcaaaggttgcaacaaaccggcgggtttctgatgttctgccttgact

SEQ ID NO: 66054 - DNA, 4388 bp, Oryza sativa
  unsure (1)..(4388): unsure at all n locations
ctgagatgacgtgaccaaggaatttcacttcagacaaccaaaattcacacttgctaaacttagcatacagttgatgttctcgtagcttctccaatgcaaggcgaagatgttcctcatgctcttctttgattcgagagtagataggaatatcatctataaagaccaccacgaacttgtctaagtattccataaacaccttattcatcaagttcatgaagaaagcaggggcattggtaagtccaaaagacataacagtacattcgaacaacccatacctagtggtaaaagctgtcttaggtatatcttcctctttgattctcaactgatgataccctgatcgaagatctatcttggagaaaacagtggctcctttaagctgatcaaacaaatcatcaatcctgggtaatggatacttattcttaatagtcacatcgtttagtgcacgatagtccacacacattctctgagtatggtctttcttttccacaaaaataaccggagctccccatggtgatgaactcggtctgatgtatcctttctgtagcaattcatctacttgcctcttaacttctgccaactcattggctgccattcgataaggtctcttatggatcggagttgttccaggtaccaaatctattctgaactctatatcccttttaggcggcataccaggtaaatcatctgggaacacatcaggatactcccggactataggaatctcttccaaagttatctggttcagtcttgaccttaaagactcagatgacaatgcatgaacagttacaactcgaccatcatagctgttgagagttacttttctgttggcacagtctatcacacctttatgtctggctaaccagtccatccctaggatgacatcaaggtctttggattctaacaagataagattggccagaaatggtactccttgaatttctattctgacagaggggctacgttgcaaagagagtgcttgattacttggggtactaaccatcaaaggacgtctaagatcttctacttccatcccatgatttcccgcaaaactcatagataagaatgaatgtgtagcaccagaatcgaaaagtactgttgcaggaactgagttaacaaggaacgtacccaaaatcacatctggagcatcttgagcttctgcagcagcaacatgattgacacgggcctttgatgctggtacagcagagttattctgagcaggaacaaccttcacgcgtcggggcttcggacacttgtcagcataatgtcctggatctccacagttgaaacacaccacgggcttgttgccttgctccctcttggcaggctgttgctgtgctggaactgcaacaggacgtggagcttgattacggatgttgttgccagcattgttgttgaagaactgacgttgcggacgaacaacagacgaagaacctccctgtggcatgggctggggtcctaaagtaagacgcggcttctgattatttccctgttgtgtcttgaattgagcaatccgacgtttcttctgctccatgcgattgtacttgtcctcctgacgaatggccttatccactaatttctggaaatcaggataatctccaaccatgagtaggtaagaaagctcatcattaagtcctcccaaaaacttctcctggcgctcttcatcattgcgcacatcttccggagcataacgagcaagacgattgaactcgtgcagatactccgtaacagagcgagatccctgggaaagcgacctgaactccttcttcttgagagacactactcccgatggtatatgcgtcttccggaaagcagcggtgaattcaagccaagtgataggttcagcagtagtcctgttaaggcggaagtgatcccaccattcagaggcagggccatgcaactgatgtgatgcaaatgagaccttctcctgatcagtacactgaagtaaatccaacttcttctctatggcatgcagccaatcactagcttcaacaggattagtggtactagagaaaacaggcggcctcacacgaagaaattctgctaacttgttctgtggaggtgcatgattattcccttggttttgctgattctgaaattgctgcatcatcatgttcataagctgtgtctgttgagcaagaacttgggccagagtgggattctctccattgttgttgctattggggttgttgggaccattcccattgctacgagtgttcaccatctggcatgggcaggataagaagagaaaacgggggaaactacttaggacagagaattactttaacttttattgatcttaactgagtttcattattacaaactgaagactctcacaccactaaactcaccaacttcctaacactcagaagcaaacaaacacatgcaattacatcccaccactgatgtaaatcacatgcaagacccacacacacgaacaaacttaaaacaagcaaactaacacaacgatctaagacaacgacttaacaagtcactctagttcttccgagcataggagatcgatcgaaggctcgttcggctcatcttcctcatctttgatagctacccactcaaacttggaattgttgcgcttgggttcttcttcttcatcactacttatgatgatgacgggaggatttgctggggcaacttctttctccaccacgcggatctttggcgccaattgataacgagggacaaacaaagctctcttccttgcggtgagacgaatcctggccttctgcggcggtgcttctcccttcaatgcggctaattccttctccaagcgatccaccttgtcttctaacttgcaaatcttaccacgattccgatcttcacgatcttgagctgctaacacagtctccgcacgactttcatccatagcccacaacatctcaaccaaatgtcttgtggtaacatcattctcaattccttcagtctcaaggtaactgccacggtcacttccctgaggttggcgaggatgatagcgatactcagtgtcggccaactgatcactgtagctatcacggagttctcctgtggcgatccttgccacttcctgacatgcatggatgtagtttcttcctccagcttcaaacatcactgaggggacctcttcactattgctgttcaaggtgactttgactcggcacttctcttcatgacgatcatgacgaatctgggcataaaaaggggcagtcccaaatccaatgacaaaggacatcgtacgcaactcctggacaaaaccctcaacaccaaacaggtactcaggcttgtaacgcggcatctaaagacaagtgaaaggagggagttaagacctttatccaattaatagcacaagttntnntnntngnngnanntntnanatnntntgannataaagttntagaaatcaaagtagaagggaagtaaataaagtaaaccaagctttgcaagataagttaaaacagttggaaatgaggtcacaaattttgtaattttgaataactggtttcaaaagaaagttataaaatcaacatactaaatttattttattgcagcaagattaaataaaacagtattgtaaaacttttgctgaaaaatgagccattagtacagtaatggatgtacagtactaataatactggaataaattttcgaatgagaaccattaaaagagatttaagaagtgcatgtgccattagtttggtttaattaaaagagaaagggaggagaacagttctacttttccaatatttttcagagggcttctatgggtaaccatttggcataacctagggtcaaagatgctctgataccaacttgtcacgcccggaatttctatccaaaattccaaacgcttacatgtgtgtgaaccctcgtccaggaatcagccgaggcacacaataacaaattgataatagagtacaaatattactctaattaataagcgaataaaatgtcattacagaggtagatagttcctctcaatcaataaagttctaagcagcggaaaataaataaacggcgcagacggctccactccacaggcagcttgaccaaggctacacctaatcctccacaccatcagcctcattgtagaactcttcctctgatgaatgattgcaaggtgagtatatgacatactcagcaagccacgcagcaaatatgcaagtgcacaggataacaaaggatggcataatagggtttcttttgcaaaagcagcatttagcaaacatttgagaatttgataaaacagttaagtaattaaacaatattaagccaacgctatacaacatgccctattgtataggcccaaccattctgaacaaccaccccggctgcacagttctatctccaaaccaggaatgtaccattccaaaccaggagctaatcaaattattaccagttat

SEQ ID NO: 66055 - DNA, 4971 bp, Oryza sativa
  unsure (1)..(4971): unsure at all n locations
aaaagatatctaagaattgtttagtattgcaagttgcatctcatcccagctcgcgaagaacaaaatagaagaaaacaactcagaaagaagatttttcctacttgattgagaaggcagaaccatactatagcacgtgtttgaccaattaaataattaattatatagttgtgtttgaccaattaattataacaagttcaatataaagataaccaagtagggtgtggaagctactatatttagagaaataagagacgaagatgtccattgcatatacatttcatcagcactgaaactgtagcatatcgaacccaactatggactgctactacaagctcccagttgaaaaactagcaatgcgtctgctgctgttcataggcctcgtgatctccctacagttcatggcagacggcgcatcattgccggacgataggtgcctaaagaagtgtggtgatgttgacattctatacccatttgggattggcgaaggctgtgccattgaaggctttgtgcttagctgcagcaagacagaggatggacgtggggatgtggcattatatggcaccacgccggtgctgaatatatcgctgcgctatggtcaggttcggatgaaatcaacgtacatatcctcgatgtgctacaacctctcaaccaagaatatggactacaagaactggctcctgaacctcacaacctctccgttcaccatctcgcagaaggagaacatattcatagtcatcggtgccaacacggccgcaaacatgtttggttacagccgctactctaccgtgagttgatctctcttgtaaattcaccatatatattctgctgctgccagttttaaaatttaatcttcgatacgctggagtaaaactgtaaaagagtcgtttttgtggtaatatatatcatccataaactcaaccgggatttggatgcagatgctaaatatgatcgggtgcttgtctcagtgctcaccgtataatagcttcacagctcaagatgggtcgtgtgtcggcatcggctgctgccaggccgtactcagcaacaacatttcctaccacgaagtgcaattcaaccccttatacaacaccacaacgtcttacaacaacagaagcatcacggacagggcaagctactgtggctacgctgtggtgatggaggctgctgcattcaggttccgaacagcatacctgaactcaacggccttttgggacgagcacaatggcagtgtcccggtggtcttgaactgggttgtgggtaatgagacatgtcaggttgccaagcaaatgggagatagatacgcatgccgtagcaaaaacagcatgtgcatcgattcatccagtggccctacaggttacctctgcaactgcactgaaggctaccgtggcaatccgtaccttcccgatggatgccaaggtctgtattgccaatttaccttgattgaattttgttgatatataagtacatatatactactccctccgtttcaggttataagacattttgactttcgttaaagtcaaattactttaagtttgactaattttatagaaaaaagtagtaatatttttaacctaagactaatatattataaaaaattattcaattatagatttaatgaaactatgctggtgttgtaaatattcatattttttttctattgagttagttaaatttaaagtagtttaactttgaccaaagttaaaatgtcttataacctaaaacggagggaatactttttactgtgtctgtagatattgatcccatgatgattcaatctttgtagagccaaacactaagtatcatgctacttttactgtgtctgtagatattaatgaatgtgatgttaacaatccacctccatgccctggccgttgcaagaacatacctggcagttttacttgttcaagcccctcacaatccagaacggtgatactagctgttagtaagttgtcgttccctaatcttatagattttttggcacacaactgagtttgcaataacaaaaaattgataaattaatatgcaggcctaagtgttggaattgttgccatggcaatgatcgtcacctgctcatacttggtccgtgaacggaagaaactggccaatatcaagaagaagtatttccaacagcacggtggcatgcttctgctgcaggagataggcttaaagcaagggcagagcactgccttcacaatcttcactgaagcagaactcatagaagcgacgaacaagttcgaggacaagaacgtccttggccgcggtggccatggcactgtctacaggggcatgctcaaggacagccgtctgattgccatcaaacgatgcatgtcgatgattgacgacaggcaaaagaaggagtttggcaaggagatgctcatcctgtcccagatcaaccacaagaacatcgtcaagctcctgggctgctgcctcgaagtggaggtcccaatgctagtctatgagtttatccccaatgggaccttgtttcacttcattcatggcggcaatgactgccgcaacatccccttttctactcgagtgcgaattgcccatgaatcagcccaagcactagattaccttcattcatcagcatcgcctccaatcattcacggtgatgtcaagacctccaacatactactggacgagaactataccgcaaagatatcggactttggagcctcaatactagtgccgactgatgaggcccagtttgtcaccttggtgcaaggaacctgtgggtacctagatcccgagtacatgcagacgtgccaattgacagataagagcgatgtgtacagctttggcgtcgttctactggagctgctcaccggcaaaatggccttcaaccttgaaggtcctgaaaatgagaagagcctttcattgagcttcttgtgtgccatgaaggagggaagactcatggacattatagatcatcacattcagactgatgagaatgctggggtgctcgaggaggttgctgacctcgcgagccagtgcctggagatgatcggcgataaccgaccgtcgatgagagatgtcgccgacaagcttggccggctgaggaaggtcatgcagcacccatgggcgcagcatgacccggaggagatggagagcttactcggggagtcgtcggtggctggtttggagatggttagcaccgggaatttcagcatggagggtggagctgtgcaaggcattctggagtctgggcgttgatcatcatagtgatcatcttgtgtatacataaagctctgctatttgcaaccattgcttcggcaggaaaggtggctaaaaatgtttcgggatttttttgttctttttgagaacttattttacaaatgcatccctgaaaaaagttattccattaatggacttttttttttttttggagaaaggctgacgcccagctttcattaaaaagcataagagttcatacatcgaacgacaaaggaaaagggaaaaagatgatactggggattccagctagacaaaacaagaactggagccaannccnggncnaanggggnccttncancnancaaaagtgggctgctggcacaaccaaaacaagccagtttctttcagctagtaacattgtcctactaaatgagactccatagcaaaatcagacaaggaactccctggcattagatcaagtatttgatcctccgatctttcggatactggcaaggagcaagccccttaatgtatccaaagcactcctcttcttcacgggtgctaagcttctccactgtagatgtaaagacacaattttgtgaggtaaatgtgacgcatcaacaatcatcttattattaaacacccagtcattacgcaaaagccaaatggaccaagcggcagcagcaaacaaagatagcaaaacaggaattgaatcaccgctctgaccactcagtttattcaaaagttctgctctagatttggggataccatcccaaccaaatgcatctctgaaacaacaccacgtaaactgagatagcgcacattgaaacatcaagtgatctgtatcctcgatttctccacagagtttacagttgggactccccttccatttcatcttctttaactgatgacctgtttgaatttttccttttagcataagccagaaaaacactttaactttgaggggaatatgacacctccacagctcttgtaagatgtagtctttaatccccccaaaacttatttctcgatacagggattttgtagaaaacatcccagttttgtttaaattccaacacatggaatcttttcctgaattcaattcgatgttctgcaataaagcatgtaattgaccccactcttctaactccccttcacctaaagttcttctcaaagagattttccactccccttcaacatacatctggtgagtagttttgttatcatcagcacatacactgaatatatatggaaattgagtcttaagtggtgtttcccctaaccaaatatcatcccagaaggatatatttttcccatctccaagcttgtatgagctaccaagtttcatccagccttttacctcatgtaaccctctccagaactgtgatcccccctcaactttggattggaaaaaaccccctccttctaccatatatttccttctcagtagatcacaacaaggattctctaccccagtttcaagtttgaaaatccacttgcaaagtagagccgcattcattatccttgtgttaacaaaacccaaacccccaaaatcctttggtctgcacagggcttcccatttgatcatgtgatattttttctttccctctaaaccttcccaaaaaaatcttgctctgaaagaatccattttctgatgaaccccctcaggcagtaaataatgcccatcatatacataggtatactactcaagcaggaattaatcaagattgacctccccccataggacaaatggctacatttccaggtagcaagtctcttctcaattttggcagcagg

SEQ ID NO: 66056 - DNA, 1428 bp, Oryza sativa
ttcctgcaccctctcagaactcaaatccccaccctcgaactcaaaattttccaaggaattcataggaactgcatgagtttcgaacgtacccttgcccggagttgggatcagggtggtgaccacccccgatgccctcctccggaaattttgtggaatgccgtggccactggtccatttgccatcgccctccgctgcggtggggtgagcagcaagcggcggtgtgggcagcaacggcgccttcctttcctcgtccgtcaacggaactcgaggggaagacgtcgtcggagaggcttgtttcgtcttgccgacgaggtccagctgctggcggagatctcccacctcctcccgcagttcctggattgccgactccacttggggtttccatccgccgaaccccgcgtccagcttgttcacgatcgcttgcgtctccgtttgcttgttgttcaacgccaccagcgactcatggatgtcgccgaggattttgccgaaatcgaggttctgcttttccattgcctcaacctgtgactgcaaacgagatgtataccttggcttctccaggatcgatgctctgataccaaatttttcgggagaatagctactgtagttcctaatgtttcactctagggtcagtttagtccccgaatctttcaaatggtccaaagaaacccttaaattttgtcatatggctcagaaatagttattggatcaaccgaaatcgccatatatacatgccatgtcattattcatgtaaaatccatgatgaattgttcaatttatccttaagtatgtcatagaaaaataaatgtaagtgtgaattagtcataatcataggaaaaaaataatttccctttttttcacccttctgacatatatttttgctcttatatataccatatttttttaaaaaaaaattgcctattgttttttattttactatgatatatgtaagcgaaaattgcacaaatcattatgattttttcatttttgcataggagggtgattttgcataggagacgtacgaagcgcgtgttggcgaccatggcacgccacgacttgcacaaggacctgaacctcaggatggacttgactggaggtggacaaggatctgcgagccaagaccggcgcggacgacataggatgccggagatcggtggagtcgccgagaaggtcctggtcgattccgcttcactactccatccatcccatcgccacctagttagcagcagatcgaccgttccccgccgctgctgcgaccggccgcttcaccgcgttggcatctaccttggcgaccccatctcgctgccacagcggagaagagaacgagaagaagcatcgaaaaagaaaaagagaatgaaagaaaagaaaaggaaggtgggacattacgtatattttttattttaaattggatacttattgacatatggatct

SEQ ID NO: 66057 - DNA, 13622 bp, Oryza sativa
catgaagccgaaaccgctattcaaaccgtcttgggactaattttatattggttttaggagttgaacaatacattatatctagtatcggttcggggataatttcaaacggaacaaggtcaccggaggtccctcaacttaacagcgagattttttgagatcctttaactacaaaatcagaaatgtgtacccctaaactctctcaaaccgttcaccggaggtccctcggcagtatttttgtccggttttactgacgtggcatcctagtcagcaaaattttttaaaaagttacatggggcccacatgtcagctacacatcttttttttttccttctcttttcttctccttctcttctctcttctctcttcagcaagcgcgacagccacaggcgaagcggcgtgacagggttctcctccgtggtggcgacggcaagttcccggacccggagccagcaggttgccgacgccgacgcggcaagcggcgggcgagcgcggcagcgggcggcggcgcgcggccgaagcaggcagaggggcggcgttggccgctgtaggcggcggaaagcggcgatctgggcctgggggcacgaggagaaggaagcgcgagcaccggggcccgaggcgcgtggggagctggtcgcgcagcacggcgacatcgtcggggccgaagaggaacctgcggtgcacgagctcgtcgcctggacgaagcttgtcgctggcctcgtcggacgccggctcgtactcagggtggtcgtacgccggacccggcgggtggcgcgcgtcgaggggctccctcgctcacaccgaccggacgctccgcgccttgcgcgagctcaccgacggtctgcaagaactacgtgatccccgccgcgtcgacgaggttgtggcagatctgggtgccgaacacgaagccgccacacctcagcctcgtcacctacaagcatggcatcatcatcatgaaagtcacgtacaaatggtgcgaattttgcaaagtttattcaagttttatgacgacgtacgtacgtgtacgtagagtagtggtcggtcggtgacgacagcggagttgctctccggcagggtcaggagttcgccggcgcaagggatcggcgggcacatgcagcgagtcaccgaactcctccagcgagacgtcagcgacgaacgagacgaacgcggaggaggccgatgaggaagtccaccgcgtccttacgcgcctctgtgtacagcacgcgacgcgagcgcttccaccagcagcttgagctgcagcccggccccggcgccggcgtcgtgtcgttcgccgcggcggccatgccggtctggtcgtgtcgttcgccgtctgcaagcacgtagtgctcctagctatcaataatgatgcccacatttttattgacgagagcaatcaaggagaagctgaacggtgagcccggcggcgacgaggagcgcgcggcggagaatgcggcgtcggtgtagcaaccgttgctccggctgaacgtgctggctccgagtccgggaacctgccgtcgctgctgcggccgtgctcgtcgcctccacggaggataaccccgacacgccgctctgtctgtggctgccgcgctcgctgaagagagaagagagaagagagaagagaaggagaagaagagagaagaaaaaaaagatgtgcagctgacatgtgggccccacgtaatattttaaaaaaaatttgctgactaggttgccatgtcagcaaaaccgggcaaaaatactgccgagggatctacagtgaacggtttgagggagtttaggggtacatatttctggttttgtagttaagggatctcaaaaaatctcgctgttaagttgagggacctccggtgaccttattccatttcagacactgcatcaaattgagggacataagtaaacttattccattcctaaataagtaaactgaactgcagcgacgtagaacacccacgtgacgaaaataaagcattgttggattcgtggatcagaagaacatctcaaggtgggaaaaacaaggctaaagcactcaagtcaatccacttgttggtggtatggaaaatatgttgtgaacgaaatagaagggtgttccaaaatcaagataagaccataccgcaactcctcgccaaaatataagacgaaatcaagctatggagcatgtgtggggcaaaaaatattgcgagaatatccgcttagatttttatttcatttagtgtgtgtttcttttctatttttcttcatgtttctttttttttctctctttcaccttccttggtgatattaaatactttctattctccttaatataactccaacttagcctggctacggtttcaaagaaaaaaaaagtgtttgggccggccacgagttgttggctagctcccggatggcaaagagtctacttggattcccttcacgttgtgccgagtttgattcatgtacaccttttgctgtagaaaaaaacttctgcaaatgtatggatgatgaatcatatgtcatatcatacagctagcaattgaaatgactgaaaaaaatcatcagttaaataaccagttgaaaaaacaattcaaatccccatctttgttctaggccatttcttgcagaagactaacctttcccctccggcctatcgctccccttccaaccttcttcctcctatggcccatcgctctccttcccaccttcttcctctgccaggccgaccaccctttccttcccggaataagttcacttaggttccttaatttctcgtcatgtttgaaattcgttcatgaaccgcaatacaaggtataacgcgtccctcgatgtgtaacctatgtcccaggccagtatagtactcagtttccgttgacgtggtggctgagttagcgtggaacacacatgtcaaagtaattcactctaaataaaaaaaaattggtggaccgcacatgtctctccttcctcttctctatcggtttccctttttcttggcgtcggcggcttggttgcacacattgtaggcggctcctgaatgaaattcgactggctttgagtgaagaatatcttttcttaaagggctagaattaaatactccatccgtttcgaaatatttgacaccgttgactttttatcacatatttgaccgttcgtcttattcaaaaaatttaagtaattattaattcttttcctatcatttgattcattgttaaatatatttttatgtaggcatataattttatatatctcacaaaagtttttgaataagacgaacggtcaaacatgtgctaaaaagtcaacggtgtcaaacatttcgaaacggagggagtacaaatgttgaatccaatcattggttgtcgttatttttatcacatgttgcaactcacggacaatttgtaattagtctcacaaaatattggacaaaatttggtcaatataaatgtgttgaaatagaatcaggtggaccacaagagggcaatcctaccctatttttagaggttaacaacgaacagatagaaatagagtaaggtgggtttttttttcagctgtgttcttaagttcccaactctcccatctctttttccacgcgcacgcgtttcaaactgttaaatggtgcgtgttttgcaaaaaattctatacgaaagttgctttaaaaatcatattaatccatttttgaaaataaattatcttaaacttaattaattatacgctaatagattgctccgttttccgtacgtacgatttcttggaacacaacctttgtgaacacagaacgtgtgtgtatatatataatctgaaatgacactatagctgaactcataataaattaatttgcttggacggataccaggctctcactgtactgaatggtacggtacttcaagtaacctggaccacggtacagcttggaacggttgatgtaggtcatgtcgtcgatcatgtccaccacgcgttccgcaactccgcgttccacatcgtaccggtaaatcaaggcacaatccacgttgaaaaatatgcttccttggtaatcgtggtcaaatgggtagatggtttgaaaggggtacgatagcacgacggtgcaatgcagcgaccatcgcggcccttcgtcggcggcggaagctgtccagagctcaactttaccgtcggcgggagtgtgcatatagcacagctttccggccagctccgtcagggtcccattaacgtcacatatctcctgccgctccatgaacggtgggctcgggaaactggtaaactcctcgctgcacacgtcgaagcgtagcatttttccgggggtggtgcagctgccggtgggcggcgacggtaggatggcgatccagtagatgccaccgaggatgcacggtgacgttttgttcaggacgaggtagggagggtcggcgagcggcctccacgccggcgagccgagggacaaaacctcgcatccgacgctgtagtccgtgtaggtttcgttgcagtggcggatgaagtagcgaaccaccttcgtcttgcctgtaggctggtcggcgtagaagcctactctttggatcctcaagtagtccggcgtacaggccggtagctcggcgaactccctcgttgccgggttgcaaactaacatcatagaggagttctccatcgtgctcagcaacacgagcccgttgcagtgcagagggaggccaaacctgatggcgccattgttgatgtaccggtcggcgccgtccccgtcatcgtcggtgtcccaatccgtagtagcgtcgtccccgtcatcgtcggtgtcccagtccgtagcgtcgtccccgtcatcgtcggtgtcccagtccgcggcgtcgtccccgtcatccacggcatccccatcgtcgacggcgtcccagtcggcggtatcatcctcgtcggcggtggcgacggccgaggagcatgtcatctcatacgcgaggtccgcgagggcgccatgccccgggtagcgaaagaagcatatcgatcccatccgttcctgtaggatacgccagcctgacagtacgcggcgcgccgccgtggtggagtggtgcagctggaggcgaacgaagtgcggctcggcgaccatggagcgccacgacttgcacacggacctgaaccgcaggatggacttgacggggagacggaggaggatttgctcgatgacgtcttccgggatgcaggctgcggcggcgccggtgggttcgacgcaccgccgccgcttggccacgggcagatcaccaccatgtcccggctgattcatcatatcacgttttcccgcgctcgcacaagccatatcgatactaagcgaattccctgtaactaaaacaagaaagacttttataggaagaggatgcttgcattgtccgaatcgtttttactttttgttttttgattcggaatctgacatcagttctgcaatcaaatcggaatctcgcctctcggagtcggagccgtacgtccgttaatcttgcgtgccctgtcgagtatcctgaaacttgctgcgttggttgaacacgtttgggctgctacgagatgggccagaacacgtcccgcgccagcaacaccaacaaccaaccaatgggtctccgtcgttgcatgaaggccccgcttgacgccgaggaggcgcgtcgagctcgcgcccaccgccagcgccagcatccaccaccaccgcccgtcgccatggccttcctccgagcaggaggaaggattctgcgtccgtgcgccgccgaagctgaacgccaatagcggcctagatgctctggaggacgcctggcggctggcggcgggcgcctcttcatcgtcgactggctgccacggcctccggcaccgacgcccgcaggttggctgccgaggccattggccaacgccgcctccgccgcggcgcaagaaaccaagagcgcagcgaactgctcccctccctccgctctcccctcgccgcgccgtctcttcttctcgccgacgggagcgccaagaaagcaagagacccgcgccgcctccgccgctcgccggaggcaatggagaagttccacgacgggcaccacgtgtggctgcggacctccgcgccggcgaggacgggagcggcgtctacctgcaccaggaccgcgcggcgtggacggtgcacatactccacctcgacggcggcgacatcctcatgctccacagcgccgcgaacgggcggtacctcccggcccccaggaccgggtggtcgtggaacagcgtcaaccttcgcgacctcaaccagctaggaatagtgtgatcataagatcgagaaggtggcaacccgtctggttcattaaaaatgtcagcaaattcatccaaaatggactgaattgaacttggaacattttgagaagaactagagccgtcactggcagtgagctgaaccaaggactccacagctccttgattgtgcaacagctgtaactgatgaatagagaccagatcacatttatccaattccggtaccactcctttaagttccactgacttatcaagaagaccaaactgaattgttttggcctgccaattgatatccattggactatatttctctaaccagtccatacccaagatcatatcataattgtccaaaggaagcagtttgaaatcagtagagaactgatgcccttgaacctcccattttgcagccggcaactcagaggtacaagaaagaacagcaccattggctacctttacttgaactggagtaagtaaagatttcacaccagtgagatgaggtaaaaccactgaactgagaaaactgcaagagctgcctgaatccaccaaaattaacacatcaaagccttgaatggacccttgtaatcgcaaagtatgtgcagaaaccgtgccttgaatggcctgtaaagaaatagccatcaaactagagatagaatcagcatcctgttcaccctcagaaacatcagctgccaaaacactgaagagttcttgaacagcatgtaactgtactgatcctgaacacttgtgagtaggagaccatttttcagcacaaacatagcaaagaccttgagctcgtcgataggccttgagagcaaccaatttatcagaagaattggccactttaggaacttcagctgttcttttatcatctcccttgccagcatgcacaaatttgggtggtggtaaaggtaaagggtaagcacttttaattcgagcagcgtgatcacccaatttcttcccatccttggacaccaaagatccaccagcctctcccaattcctcctgtaagatagcaagagccaaagcagtctccaaatcttggggaaaatgcattaacactgcatttttaatatcactgcgtaatccctccgtgaatctatggacacaactcacagtgctcaaggttggatcataaactaacaactgactccacaaatcatcaaaacgctcataatactcattcaccgaccctgactgcttgagttgatcaatctgacgaacaagctgaaggtgtctattcctatcaaacttcctatccaccgtatcacaaaaaactccccaattcccacaaagcaaatgagctcgcgaagaacgtaaccaagatgcagctcgaccaatgaaataaatggtagctactctaacccataaatctggatgagtgccataaaccccaaaataatgttcacatcttaaacgccaattctgaggatcactgccatcaaattggggaaaatccaatttcggcaatctgtgattgtacccacgccccactgatcccccactctcctcgcgaccaacaaactccgaaaaatttggatgaacacgaggagaaaatggtagagagtgcgtacccttgcccggaggtgggacgagagtagtgactacccccgatgccctcccccggaactgagttgaaatgcggtggccatccagaccaatttcgccagtcgaggctggcatagacgcggttggcggcgtcggcaacagaggtgcgcgacgagcaatttcctcccgctcctccaacgcctgcgatactggcagagacgtggttggcgacgtcggcaactgagatgtgcgacgagcaatttcctcccgctcctccaacgcctgcgaggtgttcgacgatttgtcagcttccgcttgatgtcgctccaccgcaccgacttgatttctcagcaactccatgtcgcgctgcaagctctgcaccgcagcatcaacctgaggtcgccaacttgaaatggatttctccattttgttcatcgtctcctgcacctcgccttgcttcaccgacatggcgccgatcgcctcctgaatactggacagcatcttcccgaagccttcatgctgcttctccatggcgtccacttgaccttgcaaacgcgtcttgaatgtcggccgctccaggatcgtgctctgataccaagatgttacgaaccctagatcgaatcacagatgaaattggggatgagaaggaagaacagaacagaacagagcatttcagagcagaggaaaaaggaagcagagttaggaggaggaatgatttcttcagatagaagttttgattcaattccaacgcacgcctctagaagatccttctagtatttatagacttcctcaaccagtaacccaatcacagcccatatactttgggttggtgtggacttctcgtttggatcttctaggcccaatgatactagagttacgggtagtgctctgtattgatgcagtaacacttccgtcgttcaccgtcgggtggttcgccgtcacggtgggttccgggttccgaattggacacaccgaaccccgagcggcgccgcagccttgcgaggtcggcacgtcgcagaacgcatgtgggcgtcgatctgtggccgctgccgctgttggggcctctactactgccgttcaccgtcgccgcgacaggacgagttcgccgcttctgccgctccgttctactcgcgcatgaggtgttcgttgaaatgctcgggagtctttcgcttgctgaccttgttgcttttgatgtcacagggaagcacgcaacacaatcgagcatggcatttggcatccctctgctgacgtagtcgtcgaacacgacgctggcctggtcgccgtggctgggcgcgcgccatggtccgggtgtggccggcagcagctagctctcgttgcttccggcgaggcgagcatgacgtcatcggccatgtgggccctgaggcccacctgtcaacgaaggggacaaatccatcaaattgcggccgccttggcaccgagagccccgagccgtaaccatcgcgacgagctcctctcctccctccgctctcccctcgtcggtgagcctagaaatcaagagccccctgcgccgcctccgccgctcgccgactggagcaccaatagccaagcgcccctaacttttaaaaccaatgtaaatgagtaagaacgtctattttgcacccctcaacgatggaacgtgttttgatttgcatccctcaataacaaaatcgggtaaacttttaaaaccaatgtaaatcaaccgtctctatagtattgatagcaaatccttatgggattatctgcccaaccgactggaggctgttcttattctacgggaggtcagtgcgcaatataagtgcattgctggcgattgaggtgggcatcaaaaggccctgcgacgccattttgtgtgttcgagcgggcttctttggaccaacaacgcacttccacgcggtgcggataaagcgaggaccacggcgagaggaagcaactggggtgtggccagcggtgtaaaagggactgactgggtgtgggtagggagactacactggcgagtatggcacacgcaagctgggggagcgcgggccgctgggagtgcgagtagaaccacgggaactgtggaaggacaggtggctggcatggcagagacgatcggaatcccaagagatagtgtccacggaggagacaccctcctcaacaaggcgagcctccaaagcggcgtagcggcgagccagggagcggtaggcctcaaggagcaggtcgtgctgagtggcttgagcctcagaaagctcaatcatgcgggtcagcacggggtgcgactcgtagtagggacaagggtacttagtgtctgtgtggccaaagggaaggaagggaccatccggaaggcggaccctgagaggcggtggctgtagtcatgggccaaacacagagcgcagtctaagagtggtcctagtacgtgatctggagagtgggcctggccacattgaagtggtgtgggtgaaggccagccccctatgtacctccacgagggtaaaggtacacaaacagcttacagcaaggaggaacacggtccacagagtaccccgcgtactcgggacacgagaagccaaggaaacgggcaaggtcacggagctgatcgacatggtgaccctcaccaaagccgtgggaatactgtaactggcgttcactgccacctacaattttgaaagagagagaaacatatcaataactattttaacaataaattactgaaagaaggaaagcaaaagaagccttagcttttcgcaagtagattttataacttagtatccttagggtcatcctaacgttgggtttcgccctaaggccaagcccgtgctctgataccatcttttgtcacgccccgaactagtcccgggcgaaactagcccgagacgctccaaattaacctgttaactgataccagtcccaggaaacagtgctggtatcacaggaagacagaatatcacaacaacagtagtctatttatcatagagtaaggttacagtcatgttgggctgcggacagaccccaagctcacaactgcgttttgaaatataaatttgaaaaggatgcaaaatgctccaattttaatagaattcaataagaaccaaatgtaaaactcgtcacgaacaattttctttaagaatttgaaaattgaaaatgaagtactctcaattaggcaagagaaggaaatacaaatggcgtggtctctaattttggatgaattttgggaaggtggtaaaaatagctggaagagaataaataggattttagccccccccccccctccctaacatgtggtagggatccttgatgtaatatttgagactaaaggaaattggattttctgatgaaaggaattgggaataagtttcttagcacaagagcaatcactcaaacatttgtgatactatgattcttgtgccggggaggaaatcaagccacgacaattagactggcgacttgatcaaaataggagtatgaacaaagaataaatgattgaatatttttggatggagaggaagtatagatttttggagataggtgtagatagaggtttgatccagaataaattccaataaaattagaattatgctggttttgcctcaaggttaaaaatggttaattagagagacggccgactggggaaatattagcccagttaaacagtagacttttgaattttgtatggaataatttggatatacgaaatattagcccagttaatcagtctcaagctcgacgtcgtcagcttcggtgtcatcctgtccgagctcttgtccgggaagatagcgccacgacggcgtttgtcaccgacgattagtcccatgctctggccgttcagtgggtggcgcgggatccatgggagtggccttccatggaagaggtgttcgtcgctctcggcggtgtacaacctgacgacggtggattgggatccgcagaattacagcgcatcaacttctatggttctcggcgggtagcagatcaggcttgaaagctcaatttttcaacgtgaaatatcaacaagaagcttaattagttaatatcaatggtcttaaaaagtgaagtgaaaatactactccatgtttctctccctaccattttaatggaagaaacagcatacagcgccatgcaccgtagtgctaggctagctagcctatcgcgggagcgagctccaatgcgttagcatctaccccggcgaccccatctcgagaacaagaagaagcagcgagaaagaagaaaaaagaaagaaaagagaaggaaataaaagaaaaggaaggtgggacctattgcatatttttatttctaatcagatactaagagcaagtttaatagtacatagttgctagtagtatagtccactactagctccaaattatctatagccaatgtaatagctaattagttgcttgctatactattaatgcccggttccacctgtcatacacacattacatcttggagtccgtgctacagctagctacagatctgtagcccgctgctcttctctctcttcctttatatctttaaaataagtttatagctggcttatagcctgctattgtgcctgctctaattgacacgtggatcccactgtttttttataggtgccacatcaattaatgtcacgtggaacgaggaaccagtcaaactagacaggtagacgtcacatcaagccgaaaccgctattctaaccttcttggggttaattttgcatcgattttaagagttgaaggacacgctatttctggtattcagtttctctaccttttttatcggcatcggtggtgtggttgtagacaccgtaggcgccccctgattgaaattgattgaaattcgacttgctttgagtgaagaatatattttcttacaggactaggagtaattaattacaaaagttgaacccaatcgttggttgtccttatttccattacatgttgcaatgcaccgaaaaatttgttagtcttacaaaatatcggataaaattgggttaatatatatgtgtgtaatctgaaatgaaactatagccaaactcaatctaattaatttgcttggacggataccaggctctcactgtactgaatggtacggagcttccagtcccctggacggcggtacaacttgtgcgttgaacagttgaagtaggtcatctcctcgagcatgtccaccacgcgttccacaactccgcgttccacatcgtaccggtaaatcacggcgcaatccacgttgaaaaatacgcttccttggtaatcgtgggtaaacgggaagatggtttgaaaggggtgcggtagcacgacggtgcaatgcagcgaccaccgcggcccgccgccgccttcgtcgtcgtcggcggcggcggaagttgtccagagctcaactttaccgtcggtgggagcgtgcatgtagcacagctttccggcaagctccgtcagggccccactaacgtcacgtataacctgccgccccatgaacggtgggctcaggaaactggtaaactcctcgctgcacacgtcgaagcgtagcattccaggggtggtgcagctgccggtgggcggcgacggtagggccacgatccagtagatgccaccgaggatgcacggtgacgctttgttcagggcgaggtagggagggtcggcgagcggcctccacgccggcgagccgagggacaaaacctcgcatccgactgtagtccgtgagggtctcgttgcagtggcggatgaagtagtgaaccaccttcgtcttgcctgtaggttggtcggcgtagaagcatactctttggaccctgaagtagtccggcgtacaggccggcagctcggcgatctccttggttgccgggttgcaaactaacattatagaggagttctccatcgagctcagcaacacgagcccgttgtagtgcagagccccgcccaacccgatggcaccat

SEQ ID NO: 66058 - DNA, 1071 bp, Oryza sativa
tgacagggaggcggaggaggatttcctccacaatgtcttccgggatgccagccgcggcggcgccggcgggttcgacgcaccgccgccgcttggcaacgggcacatcaccaccatgtcccggctgattcatcatatcacgttttcccgcgctcgcacgagccatatcgatagcaagcgaatcccctgtaactaaaacaagaaagacttttatggggaaagatgcttgtccgaatctttttttacttctttgttttttgattcggaatctgacatcagttctgcaatcaaatcggattctcgcctggctctcggagtcggagccgtacgtccgttaatcttgcgtgtcgagtatcctgaaacttgctgcgtcggttgaacacgtttgggctgctacgagatgggccagaacacaagcttatatagccacacacacccccacgcgggccatacttgcccatatctaactccacgatcaagagccccctgcgccacctccgccgctcgccgactgaagcaccaatagccaagcgcccctaacttttaaaaccaatgtaaatgagtaagaatgtctattttgcacccctcaactatagaacgtgttttgatttgcatcccttaataataaaatcgggcaaacttttaaaaccaatgtaaatcgaccgtctcggtagtattgataacagttcgactaacataacacttggtgcagttacaatcaggaatcagcgaaacaacaaaaaaatataataggactctacatgccaatctctagtctactctttcaatattccttatttctaattccgaatttcagctatttttaaattgtattattatatggattctactttttatttttctccgattaatgtgagaatttctagaccgtgagagaccaaacgtgatggcttctttttttattactttaataagataatagatagattagacaatcctgaagctagttcagtgattcagaacaatgacttgctagttgcatacatattcatgctccttttgttattttgtcttgttagtagtgttgatggattaaaaccatgatcatctcag

SEQ ID NO: 66059 - DNA, 7524 bp, Oryza sativa
ggataagcatgcattcatataacaaatattatccaaaacaacaaagcaaaaatctgtttatcaacttgcgaattgtgaagatttaattcttccttagaagcaacatttttctcacctctcccacaacttcttaactgctgtgatacatagttgaccttaatatcttcctttgtggctagcttaatctgttcataaaaacagcatcacgtccatttagacagattatctgctatattttggactaatgtctgatcttaacgatatatatctgacgatggacttcatcgatgcaagcatctgccgtttgcgtgaggtttatcctggtcaaatcccaaccctgcaatcaatccattacctgctcccctaccaaacctttactctaatcgtaaactgaggctaattaatccactctgcgttaaattcgtattctgtgatcaaaactaatgatcagctaggtgcctatactgtataataggactgtagtgtcagcacaagagatgcacactttgggaagggcatgtttaatatgtctacatgtaagtgaatttaatttatttcgattggagaagttgttagagattgttaacagtaactgttaaagaactccctgaaaaaaaaggggcctgaaagaaaaactatatggagagggcatatgtcagtgcatttaatttatttcgattgtcaaactcaattgttaattaaagaagggaaaaagtctaatttgactctcttaaatatacgtccaatctgactcgtatccctaaatcacaaaaccagatatgatgatttctcgaattattaaaatcgtctaaaataactctctcggttattttaagggtggttttcgctgacgtggcgtacatatggcagcctagtcatcctctccctctaacatctctctcctcctttcttcttctcggtgctagcgacggcggcgttcggcggcaagggcgcggcggcgagggcccgatgacgagggcgttgcttgcagctgctgggcccgacgacgacagcgttggctcccggacccgcctcctcagtcgtcgtcctcctcgtcgaccaccccgccatcgccgccaacatctcggccccaccgcgcgccgtccgctcggccccgtcgtgcgccgtctgctcgcgtctgcgccggaggatttcgcccccgccgccgatggtgctgggctggtagcacgctccggactgcatgatctgggtgcagtcggcgctgcgccaacacgcgtagtcaattgccttctgcatcgccgccggactctggtcgggcttgaacacgcagaacgccccatctgcccgccgctgccaaatgggaacacaggttagctcaaatcagtagctcaaaagttcagaactgaatgcatgtctcaatctgattcaaatctagcactagcatagcctcgaagtgaatctttcctctttgatgtttctagtgtgcacaaaaacaaaaagggaaagaggctatgcaactaagcaagaaatcgcaagataacattgagccattgctctaggcaaagattcctacaagcaactacatggtggtaataataaaaaggggcaggaaactcaagaaaaactgaacaaacacgagttttatttgcttttcttttttttctcgcagaggatgcaggtctgggttggggcctcacctgagccagtggacatggccaacaagagcagcagcgcagcagcagcggaatcaccatggtggcagcagcagcaagagctcgagccctctcccaacgccggaccccgtcgcctcctccaccaccggggggacgtgccgcgcagtgctccccctcgccgtccatggccgccgggagagagagggggccgacaagcctcttccaacgtgctgctcacgtcgtcgctgcgcgccaaggtgggcgatttcgggttcgcgagatgggcgtcgggaagagtgacgccatcgtcgtcgtcgacggcgtcaagacgaagcgtcagctacgatacgctcgtggggttgtttcgtccgccggcgagcggaggcgatgaggcggcgtccacggcggccggcggcgggagcctgcggtcctgtactgccgaagcgccgccgccgtccgagaagggagaggagagaggcggcgtagcgaaagggggggaaggggacacagacgacgacgatgacatggagatggcgcggagctggaggtggtcgcctgcacgccgccgctgccgatccggtggggaagagaaaagggggagagaagagagagaagggagagagagggaggaggaataaaggatgacatgtgggctcacaattattttgtgtgtgtgaatgacagatgggttctacatatattttttttaattttaatgccatataagcgtcatattggataaagaccgggtcaacaccgccatgtcagcgccacgtcagcaaaaccgccctccaaaaccgttagaggagtcaaattgcactggtttcaatagttcggggaatcgtcctacccagttttccagttaagggtcataaattagattcgatgaataattaagggagtcaaaatggactttttccattaagtcacccatccagtatggttgcttcttctggcccacccactttaaccgcgttggaaatctgggccacatataaagcccataatttatgcggagccgtaagattaggcccacccacagtgacggcctcgtggcaggtaattgggccgaattcttctcgcgggcccaccaccaacgcggccacgccaccgtcgccgccttctccatcggccgccgacctccgtgctccggccaatgccgtcgcccaggacggacacgccggggaagaaggagcgccgagagagggaggcggcgccgccgccgcttgcgcccgggcacatcgacgctggcgccgtcgcagaatccgccgccgttttctctccaatgcgtcgtgagtggggttcggagatttcaactccgaacaccattagtagccgggttttttttttttttttgcatcgccatgccgatgatgatcaacttggagcaccggtgaccttatttttatctccatcaacccgtctgctcttgatctgttcagtgtctcagctataagtttatgaatctaggaaaatctttttttataactgtaatcagctcgaatatggattcagtaatcgtgttaatagttaatgcatcagcaagcacatggtaattaggcttcagattaagcagtgagcacatatttggactggcaggtttcttggtgtgaaaagaagagagaaatctggtcagatccaacatatataatgcagatgatccagcaggtaagacaagtacgactgcattttcagcacatgctaaacacagtttgagcttgtttaatttctacacgcaactgcattttccactggagaagttgttgggaattgtcagcttaactgtcaaataacttcaactaaaaagaactgaaaaccatgtgaagggaccctataggaaaggtagccaaaattgtttaccacttcgcactttgcactttgcagtagttaacaagtatactaacaattggttagaactgctctgtctgttcagataaaaagccgcccttttggcccctccttttgaattagtcttttcttttccttccaatctcatatatatctgtcatctcaacttttcttcagataaacagtgacatctgaatactttggtgggagagagaagtgagaacatctgtttttgctgttccgtttttctacccattcgaaggatgtggactgaagaggatggcaggatgccgatgctcgtggggtcgatgatgttcaggttcagcaatgtgcaatggttgctgtgattagagcaaatggaccaccttttaactactagtactcctgaagcttcggcttaaagcacaagctcctccaaaaacaaggtgcatctgtcacagatcttgtcaatttcatattgatgaatctttcaccacacttgctaccaatctctaatctccagtttgcatagttgaatactgtatcactagcaggttaacactgtatctatttgtactatgcaaatacaagaacagtgtgaagtttaacattttttatgattatttcaccacacttagttactaccaatctccaatctccaattccttagcattgtgtttatctgcacaatgcaaatacaagagactctgaacaatgtgaggtctgaacactctgaaccactgaaagcaatatactactatgctctcttatgcctctcttaatctatctttttagtcttaaagaaaactcgcttttactaccaatctctaatatccaattccataattgatcccccaaattaacactgtatttataatatgcaaatgctctctcgaagaatacgcatcaccgaacagtctgaagcctgaaccactagcatataacctcctgttatctgaaaaagacaccatttttaccatattctcttacaagaaaagcaaaaaagaaaacatctttttttttaaaaaaaaagacatttttcttttaccacatttatagcgacgtggatctgatcaccgtaaaaaaagatattttcttttaccacatttacagcgacgtggatccgatcgtcgtgtaggctcccacttctatccggccaataggttttacaaaatcgtacggttatcacacgcttatcgtggttatcacatacggtaaccttatccgtttttgaaatcacaatatatctcataataatcacacggttttcacggtaaccctgtgattcgcggagaagcgaataataatccggcgatccaccgggagaaaaagcagctcagcctcagcaccgcacatattctcttctcccatcccgcagccgcagctgcagccgcaacggttgcccgttggttggttggttggctcgcctccactccaatccgcgcaggcagcgacaactcgctgggggtgacggcgaccactcctccacacttgcgcgcgcgcagaaaagctactactactactaccgcctttccaccaccaccgacgccgtcatcatgacggcggcgacgacgacgatccacaccggcagccgcactggtggtggccgcggtggtggtgacgccccactgccactcactgatccacccggccgcgcgcgagctaagctaagctagtagctagctgcctagctcggctccactcgctttctgatcttgcttcgcctacttgtctactcccacgcacgcacgcacgcaccagcgctgtccctcctaattctcttctcctccctttcgctttcgcttttttgggcgcacttatctattggggtttggacggcgacggggcaaagaagaagaagcccaagaaccggtcatctcgagctctcgatggattcagcgccggtaggactcgaggctagttagctagcagcagcaagaagcggttctttgtttgtttttagctccgattttgggcctgcaagaagagatgccttcccggcggagggaggagcgcgggtgcgggtgctgggcggcggtggcgcgggggctacgtggggcatgcttccggccggcgggggtggcggcggcggcgtcgggggccgacgagaagggcgcggcggggggctccgccaaggggagccacgtccacgacgcaggttggcttcttctttgctctccctttttttttccttcttcttgatttttgtttgtagctggttggtgagtttgggatcttcttttgtttttgtttggttctgtggggggtgattttgcttgtttgttctctagtggttggatatttttgcttggctattgttgcggcgatgtgattgatgttcatcgaaaggggaaacttttctgtttctgggaaattctggtcgtgttcactggggactgatctgttgtgtatttgatcggatgattagtgcttagtactgtcagtgatgtaatatacgtgggaattttggatgttataatgagaaattggaacttgggatacagattcagagtaaacggaaattggatactgttttgctgttttatctgagatggaacggatcatgcctatagtagtgctgtaagggctattcatggtggtacaggcatacagcaatgatttcttacaggcttgagtgtcataatcttaaaaagcttgtgctagggaacattgcatctatatgagcttgatcagaattatcttagcaccgtgtgttcttcagatttcaatgagagtgttcgcatgttgttagctgttgccatgttcgtaacaaaaagacatgttttatgttgttatgtgttcttcggattagcatgtttcaataacaataagaggatgaatgggttttgctcatctttctatcataccgtgctaagcaactctttatggtatacatttaaactgtctgtcaaatgggatttttcttatccttgtgatagctgaagaagggttgttgtaaatatgacagaagcatgaaacaaatcgtttatccttttattcaggagcaaaatacatcctgctgtgtttctttctaatgtcatgctgatcatttttgctgaccttgagagacgggaaatgattaagctgaatagtagtactttcaaaataataacctggataacataagaaacacacactgatggtatttcaagtcaacttggtaggttttcttcctgtattaaaaattggttaggagtatgcccatcatataataaatcttggatcaatgtctatcaacttacttaaccaagagctaataactattgcccttacaatattctatcttggcttattctttcaagcttaatttggctctcaaaggacagtttgggtatatagccatgatatctactaagtactttctgttgttgaatttttcagtttttgggtgaggtgctcaagcattttgtttttctctataacagcagagaccagatatctaaatgctagcaatcgagagcttggtgatcattgtcagacaaaccttgatgatgaaaatggtgtaaatgcatcaactgaaaagaaacttcttcggtttactttccaagagttgaaatctgccactgttaactttaggccagatagtattcttggagaaggtgggtttgggtatgtattcaaaggatggattgatccaaacagcacatctcctgcaaaacccggtactggtcttacagttgctgtcaaaagtttgaagcaggatgcacttcaaggtcacagagaatgggtggtaagtatgtgcttgtcctgtacatgtgtttgtgtaggtagagttataacttacaaacataccgtatttgcaggcggaagttgactttctgggacagctgcatcacaaacaccttgttaagctgattggatactgtatcgaggatgaccaaaggttgcttgtatatgaattcatggcccggggaagtcttgaaaaccatcttttcagaagtaagcaatctttacaaccatcttttcagaagtaaacaatcaaatacatgcattagtatttctttttaattcaaataagattggcatcacatttttaattcatgcaaaatatatactatatgaa

SEQ ID NO: 66060 - DNA, 11680 bp, Oryza sativa
  unsure (1)..(11680): unsure at all n locations
ttcagattttgggttagcgaaagctggtcctcaaggcgataaaactcatgtctctacacgggttgtcggtacctatggttatgctgcacccgagtatgtaatgacaggtattttacggaaacttttggttttttgtcgtctacttgaatcaaattttctttaatacgaatctaccagttagtattttattatgtttctgtgagtttctatggtgtgatatctacatctttgcttctaatttcatcacactgatattcctactagattgaatattaagatgcctcgggattccatctgatgacgtataaactgcagtatctagacatgatcaccaagtaacagctgatgatttttacttaagtaacaaatggcttgtttgtttagacaatgatacagacaacattcatcttggagcactcttccgtagcatgatttgattatccgaattcattggaataacctgaaaacgtggatagcaggaaccagtttggtattacatgttctactctgcctttctggttcaatattatggtggtggcttcccaaaagtttatttctacaaaacttttttggtttataaaaaccttaaattatttaaaaccaatgttgtgtaaaatttcaaattatctttccctctgagaaaaacacgcatatgtgttaaaaatctcattaaagtacacttttcaggacacttgacatccaagagcgatgtatatagcttcggagtagtgttactcgagatgttaacaacggtagacgatcaatggacaagaagcggcctactggggagcagaacctagtggcatgggcgaggccgtatctaagtgatcggcgaaggctctaccagctcgtagatcctcgcttggggctgaactattcagtaagaggggtgcagaaggttgctcagatctgctaccactgcctcagccgtgacaccaagtctcgtccgacaatggatgaagttgtcaagcacctgacgccgttgcaggacctaaatgacatggcgtctgcatcatatagacctcgatcatctcagcgtggtgagttatcatctgaacaaagaaagaattaattcatcatcactgaagtgacctcaatttgtttgaactgcaagaatgaactgttttctctgctctctttgctttgcagttgtttttgcttttgtaaacttcttctgtagatcttttgcatattcgcgaaaaaagaatgaactgtctttactcacagctagaacgtgatgaatgattaaaaatgtgaaacttttggattagcaaatgaagctaactgtaattttttttcctcatcgcaggaaaggcacgtcggtgatggccggatccactgctaaaaagcagcgaaatttgatgatttttaaggtcatttccgggtgctttgttttggttttaattgtatagtgaaactaggcttgataatcctcaaatccctggagatgtgacgccccctgatgtctaatctcgcttattagatgatcagccgaacactgtgtttggtggctggttgcacaagcgaaaaacggcatgtacgtgtggttggctgcaacgtgtaataacaacttatttttctgacaagggctgatcatccggttgatgctttccaactgtgaataccgaatactactttcgagatgcatggtaatatagtggaaaggggtgtgtggtttaaccctcggtccctcacgtctcatatttaatccccaacacacttataatttcttctttaaaaataaatgtttgggatggctctccctccaatctcgtttttttttcccgaatactactttccctctcttcctcactttgtagctctgtatatttttattttattctgtattttagatctttatttactcgctcagcaggttactaaatgatgtgttgatacaaaagaaatttatataagattttgtgaaatgtttttagtagctaatttatttattttatactcttaaatagctgtcataagaaccagattactcatccgtctataatttcagctatttgaaatggggcatatatccacgtaattccattacttaaaaagtgtagcattgtaattgttgagttgtgatctaaattcatttgcacatatataaaggccaacttctgctggagcaaagcagaggtccgtcgccagaggcttgggccagaggcctgaggacgcctggggtgtaggggccccgcgttacggatcgttatccttttaagtttcaccttcatatatacttcttgtaagccgccgtttgacgttgtaacctcgccccgatatagtgaatatatttttctgtctggtgcccatggttctttctctcctgttttgagagggttttccacgttaaatctcgtgccttatatgattgatctattgtttttttatcatttgtatgtctatcattttctaacaggcctctcactctctgtatctcatagaaataagatcgcggcttgtcaaattacacaggtttttggttccaagcctgagaatcaccgtagcttatgcaaatttcgaatagaggaatgtcaactgaactaaattacataaagaaatcatttaaatttcttgcgcaccaaaggaacaccgacaatatatcaaactgtaaggtgttgtttgattggtatactcacgttaccaaagcttgccatattttatttaaggaaaaagtacgaattacccccccccccgaactatcgtggtcgtccgaattaccccttgaaccataaaaccggacattctttacccccaactatgcaaaccggacgaattacccccctcgatccaatccacgatggttttggtctacgtggcgtacacgtggaatcccagtcagcgttttttaaattaaacaatggtgtgacccgcctgtcatactctttcactttcccctctccctctcttcatctcttctctctctcccactcttcgtctgtctctctcaaggatcggcggcggcgggagacactgaggggtgggcgggcggacggcggtgcacgggggcgggcggcggcgcgcgtcgcggcgatggccgagcggaggcggctgcaagcacggcgcacagggcgggcggcggacggtggcgtcgcggcaacggctgagcggaggcgactgtggcggcggctgccggcgctactgggtgagtggcggcgggcacggctgggcgagcggaggtggcagcagcgacgggctcgattgggcgccaacgtcgcctcgcgtcgcaccatgcccgtggtgcccgtggtgcgcgtggagctgaagctgctcccagtggtgcgtgggggcgacggcgcccgccgcccgcagtggatttccggccgccagccgccggacgcggcccaactctccaccacgcccgccgtgcctagcactggccaccaactcgcgggccacatctgagaccagagagagattgagaggaagagggaaagagagagagattgagaggaaagtggggaagagagagaggtgggacagtatgacaggcaggtcccaccattttttttaattaaaaaacgctgactgggatgccacgcgtacgccacatagaccaaaaccatcgtggattgggtcgagggggtaattcgtccggtttacatagttggggggtgaataatgttcggttttatggttcaggggggtaattcggacgactgcgatagttcgggggggggtaattcgtactttttcctttatttaactaacatgcctaacatgtggctcataaaattaaagccacacttcagctgtatgaaagcaagtttgctacacttttactccatctatcccataatataagggattttgatattttgcttatactatttgaccactcatcttattcaaaaaatttgtgcaaatataaaaaatgaaaagttgtgtttaaagtactttgtataataaattaagtaaaaaactaaataataattctaaaattttttgacgaatggtcaaacagtgcaagcaaaatattaaaatcccttatattagaagacatagggagtatataccaataacacatgggacccacatcatggtgaaggaatcttaccttagaggttgtttggtttgctcctaaaatttgccaaacgttgacacacctcatgttagacaagtttgaccaagttaatttattgtttggttcatagccacacttgtggcaagattccttcttatctattataaccccacgtgccattaactcaataaggtgtggcgcaatcctatttcgctagttaaggtgtgatttacttattgtaagccacaacttagataagtgtgacataaaaatacggtgaatggtggcaaacttagtataacatccaaacagtcaaatctggctaacttgagttgtagcaatagtcaggcaataagtggtagtgaaacaaacaatccctagggtgtgttctgaccaaagggttctcaacccctctcaatcgtattccgcgcgcacgctttttaaactgctaaacgatatgttttttataaaaagtttctatacaaaagttgcttaaaaaattatattgatctatttttttaaaaaaaaattagctaatacttaattaatcgtgctatggactgttctgttttcgtgctagggtgatatgttcccatccatcagcagcgaacacaccctatgtccctatctgtggattgccagtgcgaatctcgacgtacgtggtggcaaatgcagccgcagtgctaggtggagccccaagcgggcgtccaggtcgccggaaaactccatggcgcgctctggcggtgtcaggtcacgggcgccatggcgcgtcccatggcgacaaccacctcagtctccccccctccccgcagcggcgtctcgacctcatcgtctgtgcctgtgcgcgccgtgctgccgagtgctagcgcgctagaagcgtcggcgcgcgtacgtccgcgcgcgcgcgcggtgctcgcccgtgagcgcccccgcgccgtggccgctagcgcgcgcgccccgggccaggtggccgcctcgccggctcgccgcgaacacctggcgcccatccacgcatgcatccatgccatgccatgcacgagatgacgagacgagactgagttgattaattgattaacatacaagctgcttggttagtgcagtgctttgtgaacttgtgattggatcaggtgttgaccatgggagattagtagcactagctagtggcactgacagtagttcgtgttcagtgtacgtgttcagtgttcagtgatcagcggaggcgtgggcgtccatggccgctctataaaaggcgcgccaacccatctcacgccaccgtgcaacgtcgagccgcgccaccagcatctatggctgcggcgctcgccaccgtcgtgtctttcctgctcgtcgtcctcgtctccgtcgcccacggctggaacaaagactgcccgcctcccggtagcggcagcagcggcggcggccaccacggcaagccgcccggtagcggcagcggcggcggcggtcaccacggcaagccgcccgagcaccaccaccaccacaaacctcccccgtctccccggtgcccgtcgtgccacccgccctacacgccgccgacgccacggccgccgccaactccgccgtacgttccatctccaccaccatacgtgccaccctacatcccgccgccgacgccgccatacgttccaccctacatcccgccgccgacgccgccgtacgtcccgccgccgacgccgccgtctcctccgccatacgtgccgccgccgacgccgccgtcgccgccgccgtacgtgccgccgccgagcccgccggcgacgaagacgtgcccgatcgacgcgctgaagctgaacgcgtgcgtggacgtgctgggggggctgatccacctggtgatcgggcagaaggcgagggcgaagtgctgcccgctggtgcagggcgtggcggacctggacgccgcgctctgcctctgcaccaccatccgcgcgcgcctcctcaacatcaacatctacctccccgtcgcgctcgagctgctcatcacctgcggcaagcacccgcctcccggcttcaagtgccccccgctctacggcgcctgaactgaacaaacgaagcagcagctagcaaagcttcgtcgtcgtcgtcaatggcggaggctactatactacaccctcgctagctagctatactgtgctacctttactctctcgatcgtactcgtgtctgcgatttgtgttgtattaatgtactacctccggttttaatccaagtgtagtttaattaattaatccacgagaaaagatccgacttatgatcaagtctctgtgcgaattgaggaatctctcggtgaattatactggaagcatatcaatctgaactagttttcgatttttttgtgtgaataatcgtccaaattacatcggttttccgtaggtaaccaaatggtaatgacaaagctgctcatcagtacttcagctttgcagttaagaatgagaaggcccaacaggcaacagcccattagatgctagctagtgcagtacttagatggtgtttagatccagggaattaactttagtccctgtctttagacactaatttagagtattaaatatagactacttacaaaactaattacataaataaaagctaattcacgatacaaattttttaagcctaattaatctataattagagaatgtttactgtagcatcacataggctaatcatggattaattaggctcattagattcgtctcgcaaattagtccaagattatggatgagttttattaatagtctacgtttaatatttatagttaattttcaaacatccgatgtgatagggacttaaaagtttaaaagttttagtcccatctaaacagggccttagcacggcccatcacatattgcatcggtgacgtagtgagtgacgcacgctgttgcagtgctctgcgcctctgcatctccttctcctgcacacttccctctcgaattcgaaaaactcgtataattcccctccacagctcaacggtcgggatcccatctcatcgtgcccgcatggcgccatcttctccgagaagaaaccggcatcggacggctacgcccacaatcatacggtccccgaaagtccacgccgccgtctcaatttcagcggccgccccgcaaaaaattcacaaaaaaaaaaaacccgcaacagcttgcactgcacgctgccccctcgccatgttccccgcgtttcctaccccaaactcactgacgcgtgggggacaaccggtagggcccacatgtctgtcggggtgggcggtggtggtgcccactagcctggttacctggagatattgccccccaccccacgacgccaaaatccgcgcgggaaacagctccgcgcccgcgcgccaaacttgctccaaatcgaagtattattttctctcgcgatttctccgatttttttttctagcgataaattaattaatgctcctctcgccgcgccgggaaagcatttaaatctccccctcctccgcgcggttctcccaacccaaaccctaccacgattcctccccactcccaatccaatcgccgcggcggaggcggcgggcgcgcgtgcacaccaggtgttcgacggaaggcctcgccgggtggggggcgaagatgtacgtggtgaagcgggacgggcggcaggagacggtgcacttcgacaagatcacggcgcggctgaagaagctcagctacggcctcagccaggagcactgcgacccggtgctcgtcgcgcagaaggtatgcgcgggtgtgtacaagggcgtcaccaccagccagctcgacgagctcgctgccgagactgccgccgccatgaccgcgtcccaccccgactacgcctcggtaacagccactgaacttcaccgttgttggtttttttgttccccattcggtagtaccttgtctcctcctgacatgtggattgctgttgtgaagctcgcggcgaggattgcggtttccaacctgcacaagaacaccaagaagtccttctcggagacgtaagcgattgattgcttttgtttcagttgaatcatgcgaagggtgttgggatttatggattaggatgtgaattgggatttggtcgttatggatgcaggattaaggacatgtatggacatttcaacgagagatctgggctgaatgctcctttggttgcccacgatgtatatgaagtcatcatgaaggtgagatatcaaattaaactttagggacttgcactgatagctgttcttgttctgatttgtaaaatttactgttccattcaatttattggtcattaggattattgatgtatgttatgcttcttacggtttctgatgttctgatccttattttcagaatgcttctcgcttggacagcgagataatttatgatagggacttcgattatgattattttggtttcaagactctggagaggtcttacctcctgaaacttggcgggaaggttgttgaaaggccgcaacacatgttaatgagagtttcagtaggtatacacaaggatgacattgagtctgctatcaagacctaccatctgatgtctcagcgctggtttactcatgcttcaccgacccttttcaatgctggcactccaaggccccaagtactgcacatttgaccagaaaaatcctagtcttggactctgaaattgcttgcttactcttttattctctgcaatgcagttaagcagctgtttccttatctgcatgaaagatgacagcattgagggaatctatgatactttgaaggaatgtgctgtcataagcaaatctgctggaggaattggtgtatcagttcacaatattcgagctactgggagctatatccgtggaacaaatggaacctccaatgggattgttcctatgctacgtgttttcaatgatactgcccgttatgttgatcaaggtggaggcaagagaaagggtaggttctatggtcaattttatttgtgaaaattactctaataccataatctccaggaattctcataccctcctaaaaatcaggtgcatttgctgtgtacttggagccttggcatgcggatatttttgagttccttgatctgagaaagaatcatgggaaggtaaattctcaaccagatcctcttattaattcctttgcatagaaaactgtaaccatttaaatcttctggatttgttgcgacaatgagctgatttcaatgtatccttgcatctacattttctgaacttgaaatggattgcttacatgtaatagatgttatgatgcagagctgaatgttcaagtctttggtgcaaattagttataccattagaaaaaactggtggatagaagaatagcaggctctagtgtatttcttcctataatgttcagaagcttttcactatccagcatactgtgatcactggacaatttgatatgctttgaacaatttgatatgctttgcttgtgctgtttatgtttctaatatatgccatttctcctaacttaaaggctttagcctgaagaaagatctgaaatgcatgtttttatgaatgacaatttaataggaggagcatcgtgcaagggatcttttctatgcactctgggttcctgatctattcatgcaaagagtccaaaataaccaagaatggtcattgttttgtcccaatgaagctccagggttagctgattgctggggtgatgagtttgagaaactgtacacaaaatatgagagagaggtaagttggaaacgaaatttaattgtactacagtttattgaagttggaaaagattacaataacatagctttgtactttcagggcaaggcaaagaaaattgtcccagctcagaccctctggtttgacattttaaaggcacagatagaaactggtacaccatatatgctttacaaggtaaatttggtagcaaaattagtagcaaggagtacttgattttggacccaagattcctccaaatatgctgctggctatagtcaggttccaagtattcattccgaatgctcttgttgtcccacaggatacatgcaataggaaaagtaaccagcagaatttgggcacaattaaatcttcaaacttatgcactgagataattgagtacacaagccctactgaaactgctgtctgcaatctggcatctattgctttaccacgttttgtaagggaaaaggtatatcttgttagtgctttggctgatttcaaccctaaatgttgtatgtttacatgtctgatcataagattctgttgcagggtgtccccatagagtcccatccatctaaacttgtcgggagcagtgattctaaaaatagatattttgactttgacaagcttgctgaggtctgctgtctgatcgaatctgtttattctaaaaatagatactcttgcctatgtcagtgaatgttctgacacgctgttgattttaccaggttacttcaactgtcacatacaatctcaacaaaataattgatattaattattaccctgttgaaaccgcaaaaagatcaaatatgcggcacaggccaattggcattggtgttcaagggttggcagatactttcatattacttggcatgccatttgattcaccagaggtaactttcctagttcagtaatatagtagtactagttagtagtccttcctacacttaactgatgtaaaaaatgtgatcccctcttttcaggctcagcaattgaataaggatatcttcgaaactatttactttcattctctgaaagcttccgctgagcttgctggtaaagaaggtccctatgaaacatatgaagggagccctgtcagcaaggttttttgcttttactaatgtcactttttttagtagctgaatttaccaatttatttattggtgtagtttgactaaattgttggttggatatcaacaagtaatattctttctaaggctgttttctatccacttttcagggcattctccaacctgatatgtggaatgtagttccatctgacagatggaactggccatctctacggagtactatttctaaagttggattaagaaactctcttcttgttgctccaatgcctactgcttccactagtcagattcttggcaacaatgaatgctttgaaccttatacatctaacatatacagccggcgggttctaaggtttgtaactacactgttcttagtgctcgtgctcactacaggtgcttatgattgattttgtttaattcttttccagtggggagtttgttgtggttaacaagcatcttctccatgatttgactgaaatgggtgtttggactccagctctgaaaaataagataatttatgaagatggttctgttcaaaagatgacagtgatcccagatgatctaaaagcaatttacaagtatgttgttcattgtcctaaactcctaatgctatgttctaccagatgcagatattcatttatctaaacgtttaacctcaattgttccagaacggtttgggagataaagcagaaaacgcttgttgacatggctgttgatcgtggatgctacattgatcagagccagagtcttaatgttcacatggaacaaccaaactttgggaaagctctngganactttcctttccttgggccaaattttttccatgcttggtccaaggtattattaaggctatgtgaaagcatattcctgaactctatgcagcccatatttattctgtatttgtcatgccatg

SEQ ID NO: 66061 - DNA, 4111 bp, Oryza sativa
aaggggttatgaacagtatactctccccattactccgcaaatgtgtgttggtgtttgtcaacgatattcttatatacagtaagaccctacaggagcatgtgcagcaccttcagcaggtttttcacattttgtcaaagcatcagttacaagttaagcgcagtaaatgttcctttgctcaacagcgtttggcttatcttggacatattatcacccccaacggagtttccactgatgatgacaagattaaagtggtgcagtagtggccgacccctcaatctgtcaaagaactgcgcagtttctttggcttggctggctattaccgcaagttcgtccgacactatggtatcatcagtaagcccctcactaacttgttgcgcaaaggtcagttatatttgtggaattctgacaccgagcaagcatttcaaactctgaaacatgctcttgtcactgccccggtgttggctatgccaaattttgatgaaacatttgtggtcgaaactgatgcttccgacaaaggcattggggctgttctaattcaaaaaggtcacccgattgccttcttaagcagagctttgggtcctcgtcatcagggtctgtccacgtatgacaaggagagcttggctattatgttagcagttgaacattggcgaccttatttacaacatgctgagttcctcattcgaacagaccatcgcagcttgtccttcttggatgatcaacgtctcactactccgtggcagcacaaggctttgactaagttgcttgggctgcggtataaaatcatctataagaagggttgtgacaatggtgtagcggatgccctttctcgtcaccctttacctgattctttggaactctcggccctgtcagtggttattcccgattggattcaagaagtggttgctggttatgcttctgacccggatgcttgcagtaaagttcaaacattgtgtatcagtgtaggagctgttcctaatttcactttgaaagatggtgtgttgtattttaaagatcgcatgtggattggtcataacaaggctgttcagcagaaaatcattgctaatttgcataccgcagctattgggggccattcgggtataaatgtcacttatcaacagattaagcaattgtttgcttggcctcaattacgagctacagtcacagaatttgtgtcggcctgttcagtttgtcaacaagccaaatctgaacatgtgaagtaccctggtctgttgcaaactctaccagttcctgagcactcttggcaaatggtttcattggattttatcgaaggattgcctcgatcagcttcctttaattgcatattggtggtagtggataaattctccaaatatgcccactttgctcccaccatttttccgtgcggtctgacttacggaccgcatggaaacaaaatggagcggcgtccagaaaaatcaatcctgtaatagtgttattgacatgtggatcccactgttttattttactatgtgccatatggaacgaggaaccagtcaaactagacaacgtcacagccgaaaccgctattcaaaccgtcttgggactaattttgtatcggttttaggagttgaacaatacattatatctagtattggttcggggataatttcacattgtaggcggctcctgaataaaattcgactggctttgagtgaagaatatcttttcttaaagggctagaattaattacaaatgttgaacccaatcattggttgtcgttatttttatcacatgttgcaactcacggacaatttgtaattagtctcacaaaatattggacaaaatttggttaatataaatgtgttgaaatagaatcaggtctaaacacagcctaactctacaattaggaatggcaatggggaccggaaccagatctaaacacagcctaactctacaattaggaatgacaatggggacccgaacccagatctccgttgggtaaaacatccattagaggccacagttattaaaaccagaccggaccggtggttgtgttagttgtaactcacgagactaagtactccctccatttctaaatatatttgataccgttgactttttagcacatattagactgttcgtcttattcgaaaacttttgtgaaatatatatgtaaaactatatgtctacataaaaatatatttaacaatgaatcaaatgataggaaaagaatcaataattacttaaatttttttaataagatgaacgatcaaatatatttaaaaaagttaacggcgtcaaatatttagaaacgaagggagtatataagatttgctctggtctggtctagtaaaagttcatatcttgtggagatcaatagtttcaaactttggagcaaaactttaaaaaaatcagttcagcacttgagcatgatctggagttgtgtcctcgtcgacgccgataccttcctcaccggcggtgccactgccatcgacggaacgtggcggatgccagcaccgccaccgccatctgtgctcgcttaattcgtctcgtttccgtgcacagcagcacaggcaataagatggccaaaacgagcagccggagagcgcgcgcggcgagttcgccgccaacccgccgacggccttgccgccacggcggcgcgaggacatcaccgcgcgcggcttcctcctcacgccgaagtgtccctgtgcaccatgagcgcgtctcagtccgtgcacgcggcgtgggcgaggcggcgtacgtgcacatacatcgggcgcgaacggctgtagtccaatttttcgagaggcgagaatccgatttgatgacatgacgtacttacggatgttagattcgggattatcaaaaaacaaaaagtactaaaaaaagaatatgttagattcggacaaggatcatcctttcctataaaagtcttgcttgttttagttacagggaattcgcttgctatcgatggcttgtgcgagcgcgggaaaacgtgatatgatgaatcagccgggacatggtggtgatgtgcccgtggccaagcggcggcggtgcgtcgaacccaccggcgccgccgcggccggcatcccggaagacattgtggaggaaatcctcctccgcctccctgtcaagtccatcctgcggttcagatccgtgtgcaagtcgtggcgcgccatggtcgccgacccgcgcttcgtgcgcctccagctacaccactccaccacggcggcgcgccattacccaccgtccatgctcatcctggcagactggtgtttgccagagcaacggaggggagcgatcgacttctttagctatccgggccatggcgtcgccgcggactccgcgcttgggatgacatggtcctcgaagtcgaccgtcgccgccgccgcagacgggtacgctgggctgatggggacgccgtggacgtcgggaacgccgacgacaacttggacgccgccgtcgacgacgggaacgccgccgcggactgggacgacgacgacgactgggacatcgacgttggcgccatcggctgggccttgcatctgcactgcaacgggctcgtgtatagttggccatatgggccgcccggcacggtacggcccaggcacggccgggcctgggccgaggtcagttgggccggcacggcttgacgaacaagccgtgccgtgccgtaccagcccacgggctacaaccacggcctaggcacggcccaagtagcctcgggccgtgccgggctggcccgacggcccggctagcccattgtgcccgtgccggcctaggcacgccctggcaaaaaaaccccttcaaaggttcaattcaacacaacaaattgacataacacatcaaattcatgaaattcacatgtaattcatcaaataagtcaaagaatcacaaacaattcatcaagtcaccagttcatcaaatcatgcatacatcacgtcacagatttacaagcacagatttacaaacaaatgaacaattcttcaagtcaccaattcatcaagtgtaacgctccgcttttcgtgaggcgttaaaaactaattcggcaaaaatcctaattgcgaaaatttcgttctttgagtgttgagtctaagttgtgccaaggatctcaatttaatcccgttattccctctcatcgagggcgcaggaa

SEQ ID NO: 66062 - DNA, 721 bp, Oryza sativa
attcctgcagcccgattaaaggacttgggagtgaggacatgacaaatcactttgttgtcaaaagacttctccgtacttttggtccaagaaatcccactcttgtatcaatgatacgggaaaggaaagacttcaagaggctcaccccaagtgacattcttggaagaattgtgtctcatgagatgcaagaagaggaagctcgtgaagtgagacaaatggtgaagaatgccgccatgatcaagaatcaagaagttgctttgaaggcaaaacaagaagaagagtcaagtggtgaagaaagtcaagatgaagaaatggcttttattgtcaagagattcaagcactttcttcgcaagagtggctatggaaaaggaaggaaggatgatgacaagggaaagaggcaatcaaagagagcgtgcttcaattgtggcgaatttggtcatttcattgccgattgtcccaagtcaaatgaagctaaggctaagggaggcaagaagaagacggagcgtgctcatgtggcggaggcacacatggcggaagtgtggtactctagagatgaagaagatcccgaagtcaagctcaagcccaagtcaaaagacaaggttgaaggagaaggtggtgttgctaccatcgcctttaagtcatcctcttcaagcaaggagcgtctcttcaacaacttgagtgatgacgacgacgactcctaccactactcttgcttcatggccca

SEQ ID NO: 66063 - DNA, 1124 bp, Oryza sativa
gaatagtacctctcaaccaaatgtggtttctaattcctctaatccttctactagcaatggttgtgctaagtgttacaatattgatttgaactcttatgctactaatattgatgctatgcaagctcttaagaaagagaatgaaaggttgggcacattggtgaaatatggatgcatgaagacataccattcaaaagatgccctttacaagaccatcaccgctcatcctaacaaggatggacacgggcacgggttttcgggtggaagtcctgtgtctaagcgtgtgatggtaaatgggaaagaatgcttgatgtttgtgagagaaggaaaagcaccacaagcaagtgagatcactaatcttgtgagcagccagggacccggaacatccggacaaaccggccaaaacctctgggtgggagtctccatctctcaaaaattcccaccaggaagttccggccggtttgccaggaagttccgggccaatggccgtgcacaagatatgaccggaagttccaggcataatgccaggaggttccgaccagatggtctttactatgattcatatgtaattttcaaaaattcagagggcaaagtggttgcttattttaatgggaattacaatgatgagtatcgcacttgtgtgtgggtgccaaaggctttgataactaacatcaagggacccaaacttagacaagtttgggttcctaaatcccaagcttgatttcttttgtaggcatactcctccggtggttcaagttgggttgtggacagtggttgcaccaatcatatgactggagagaggagtatgtttacaagtcttaatgatgagaacggaactcgtgagaatattgtgtttggagatgatggtaaaggaaaggtaattggtctaggtaaaattgccatctccaataatcaatctctctctaatgttcttcttgtcaattcattaagctacaatttactatccgtttctcaattatgtaagttgggttacaattgcttgtttaccgatgaggatgtgaccgtctttagaagggatgactcctccgtagcattcaaaggcaagataaagggtgatctctatcttgtcgatttcgatgtggatagagtgaatccagaagcttgtt

SEQ ID NO: 66064 - DNA, 6010 bp, Oryza sativa
  unsure (1)..(6010): unsure at all n locations
gccactcttacactgatacatctcaacctccagcaaagcggcagctgccgtgtcaatgtccgtcatccactcgaaagcttaacgaaggtcttggaagacggtggaactacaagtgtaagcgtagtgcgtcctcgggttcaataccgcagctacaaaacatagcctaaattagttcaagagttatgggtttaggaattgaacattatgtaaagnnnnnnnnnnnnnnnnnnnnnnnagtgttttagtggtgaggtcgtgcatccttctgtccacaatatccatataagcgttgtacttatccctttcacaagcgaacagactatcatactccattctcaacagttgatatctcaaaagaacctcactcaaattggggttcttgtcctcgtcggcaaaccaaagaaaggagtacatcggttgcactgaattcactaccgcctccaagttttcccaccaactcatgctagataggcaggcatgtgcatatctaccctctgttgtgccattgaacttactttgcatgaatgtagaggaagccatccactgcatgaactgatatcgcttcctttaggaaactctgaaggaacatgcaattggtgccaaaccgcgtagcattccacttaaccaattcaccacctatcgctgagaccatcatagaatgcagcttcgaatgattgtatagccatctgcaaatttttctaccactagcaatcaccatatcatggtctgccatctttccaacctccttaagcatcaagttaattgtgtgagctacgcaaggttgccacataatagctcggtactcttgcataagcagtttgcaggccttcttatagttggacccattattagtgataatttgcatgacatgttgatggcctactttgcataccaccttcctgatctcctgcattaataaatcacagaatacacgtaagtccatcacctatacttcatgataacatgtgaggctaatttgttggatccagtgtgttaccttaagtacaaattgagcatcctggctttggcctgtcgcatcaatggacttatgaaagaacattattccattacagtatatcaaaaagttgatgatggccataccggtcggtctagtccacgaatcacacatcaaagtaacaccataatcatcccagtcgtgcttgaacctctcaaattgtttcttcacgtccttctccgtagaatcaaggtatttaccatctatctccctacttgatggagaaggtatgttttcacctacaattcacataagaaatattagtgtctaaaatgtttatgaaaatataagttgatattagttgcatacgtaccccacttctgtgtctctctcacgacgctgacaaagtaaggattatcgacatttcttgcagcaattccggaggtatgttttcacctacaattcacataagaaatattagtgtctaaaatgtttatgaaaatataagttgatattagttgcatacgtaccccacttctgtgtctctctcacgacgctgacaaagtaaggattatcggcatttcttgcagcaattccggaggtgaagaaaaaccttgcccgtgactcaccaatggcctccctagcctgctttcccttctttgtgaagaaccctgtctcaatgcgtgtctgcacaggggccttggcaactgctagattgtaatctctcaaaaaaggtgactccctctgagatgtagcccttcgtagcaaattggcaattgggttacttttacctctccttgcctcaggctgagcggatccacttccatcgccatgctcatatgtgccacctcgctcctccacatcccttctaaagtcttgctctcgccgtgatgcttccatggcctgttccatttgttcctcctcgtcggcatcacctgtgaggtcatgatagatgacccttgccgcttcaaccctggttgacttttcactcttacgcctagcaccggcagcttttatcctgtccaactcgcgcttgaacaagtcacggacatctggaggcactgaattgcaatatgttgtcccctttccctttccagccaaatgaattttaagtctagttgccctaccaccgctcttttgctgatggcaatatttacaatgaaatccatttcctatgctctccccgtgctcccacacagggtccctattatcagccatctccaccctgaatcatatggaaaaattatatcactaaaagaattaaccaaattacacattaacaacaaatgacccattatcgttaaaagtacatttacatcaataaacatgaaaatgtctactcacccaacaaataacgtactgtacataaccactgtccacatccctaccataattcagaaatcttcatatctcaaataacatcaaacattttacaatgtatatttgacataaaccaacatacaactaaggctactacttgcacaacagtgaaaaattcatacaactaaggctactacttgcacaacagtgaaaaattcatgcacaatgtcgacatcggcactgtggctggggcttccagggcaaggaaggcgcgtccgggaagcggcacacgcggcgcggcacacacggcgctgtgcgagcggctcgacgcggggtggcgcacggcgctgtgcaagcggtgcggaatggctcggtgcatcacttgcctagctcagcattttgtcgagcaggtggtgcgcggtgtggctgctgggtagggaggaagaagaggggagatagatgggccaagctgggccaccttgggccagccgaaagtgagggagggagacagtaacaagggaaacccaaaggaataggaacttctttcctttttctggtaattggaaatttggaatttgatgcaaaggttgtaaatggactgtaaaagggaccgtggactttgataattctaggagtttatttgtggacatggaatgagagatttgagatttttaatggcataggtaaaaattcaaatgagaaccaaattttgaaaatagttttgtatttaaaataggtttttaaaagaaacgaaaaatcaggatgttacattcacaatctgtcctgaccgtaaattctttgaatcccagatataacctaaaagcatttatcgcattgattattgctaagatttctcgatctgtattgtttacaatttttactttataacttccagaagcatacctacatatattttcttctcatttggtagagtatttagtaggtctttgctttagtattgcaccccaaccttattgtgatgcatctgtttcaataataaagtaattctcttctaatggtagttctagaggttttagctcttttaccctttcttttattatatgtactaatttaatgtctttagagttaaagtatttctgaccatttttccttaatttagcatacaagggtcctgctagcgttgccaaattatcaatgtgatttctagcataatttacaattcctaagaattgttgtaatttatttttatcattcataacatcaggaaattgtaaaattttcttagcaatatgttcctgcaaatgaattttgccttctcctatttcatgaccaagaaagttaattttttttctttgcatatttccatttttttctttgataggattaatccattctgctcaacttttctaaaaaataactctaaaatgagcggattgaaacattataactctaaacgacaatgttgacatacagatccacgtcttacaaatattataaaagtcttacacaaatgcagcggaaattaaaaggataacagtagctaagccttgacttggatagcagcgggagacaccattccactggcatccttgacggcatggacgaagcctactcctctgagaagccaccatcggacgcatactcgaactcttgggttgggagatagagcaagactaagtactacccactgtactaagcaagtcataccggaacgaagggtatgatgcaggatacaaccaaagagagctaaaggagtttatttgcataaagctagcatttatgaacagtagttgaaagcggtaaaatagttaaataattatccatcatttaacccaatcactgcttaacgctacaccatgttaagacaggcccaaaaccaccacctgaactaatcagttccattaagctaagctaggggtgagactaatcacagtgaatctggttgaccgcccataaccgcgggcacggctattcgaatagttttactttgatcagaggtgtacaactgtacccacaagacacagccccacgacacgttcccgtgcgccggcatgccactacaatatactggaaagaggccgtgataggacccttcgcatagccccctctaaccaagcacaccacacctcaggtttcacccccactcctcaaaaggtagcgggcagtcccctctcgtgcctaggtgaatccggaagcgacacaggccgttgcagggcccatcctgctccatcacacccacccttgcttagatgcgtcggctagagaaaagntacattacaagcccagctattgcccacgctggcttatggtaagtacgataagttcttccagggcatcccacgaaccggtctttaattgccatgggcacgaccatcaaaaccatacacccacagcccaccaattaatgtgttctaattaactaacactattgcggtggcactaatccaaagttatactataatccaaagtttatgcgttaatgtgatttccccttcgtgtactagttgaactaagcatggctaagcaattcctaatccgacatctagttatgttacaacccaagctaacaatggattaagatgaacaaatagtatatctgaggcagtaggtaaacatcccataataacattataaaaacaatgcataatttaaaggaaacaatagagcatttgcaatatgggatcaatatgttcaagtgacaagcatgacttgccttgctctgtggctggagggacctcggcaactatctcaaagtacaccggagcgtcgggagagccggaatctatgcgacatacaaggcaaacaatgcaaacaagctataagactactgaacagagaacaaaaccttttgtaatggattgtttgcatttttcttgatttactgagacttgaatgggcttaaacggagcatggacgaattagttatgatttttagaagattatatgtgtttattactataacagaaaatccttaattgatttattgcgtaaataatacccctggcgacatcatcagagagagtggcagcgccgacatgtgggccccacatgtcataggctcggggtgcgccggtccacgggatcggtgaggggtgcaccacgtggcggcgacgtgggctgccacgcgggcagcagcgaacggccccgatctactcgagggtagatcggatggcgagggcggctcgcggcctggcacgcatgggcggcttaagccggcccagcggccatggcgctcggcggcgcggtgcggcgcggcagcggcgcaaggcggcgatcggcggcgagcggccagcagcggagagcggcggcgctactagagggagagggagagggataggggatgtcggtcgtcatcgaagggttcagccggcacggaggaaggcgacggcgaacgacgacgacgggcgatggaatgacgatggcgacgagcagccgagcttcggggaaacctagggaatgcaatgggggaaattagagagggagagggagagcagagagggtggaggcgccggccgaaggcggtggccatggtggtgctcaccagcgcgaggaggaaggcgtgctccggcggcggaatcggccgggcggacggcggacgggatggcgcttgggacggcgaacgcgacgggcgtcgacggcgcggatcggcacggcggctagcggcggctggagcggtggcggcgacggcggagaggagggtgacggcgctagggcagtggagtgcacgggagggctcgacgagaacgggaaaaaggtggaggaggatgcaggggt

SEQ ID NO: 66065 - DNA, 3302 bp, Oryza sativa
tagtttatatagggccggggaggtcggacatggccgagaggtgggaagtggctggcgaagtgggggaggtggagagagagaggccggtgggattcgaaattcgaatcccggccgtttctcggtacgggcgtgcggggaaagtggggcggcggtcgcggacatgcgggagagggcacgaaaggcgggcgacgtgcacgggaggcgcgggagaggcggggaggcggcggttgcagcgtgggcggcggcggcggccggaggttggggacgggcccgataggtgggccccacctgtcggtgactcgggagggaggaggggcgcacggccggcctactgggcctcggcctcgagccggcccagctagcgcgcggggaggagaagagaacgggctgatggcccaatcaaaggaaaaaggaaggaaaaagggaaaaaagaaaagaaaacaatttccagggatgaaataattgcttgtgctcatttttaattgattaaaattatttctagagctctgaaaattccactaaaaatcctgttagcatattttgacatgaataacccaagaaaaattccacatgctatttccaattattatttgcattcactactttagggtttctctcttgactttaaacaactaatttcttgagacaaattccaaattgaatttaggcttgggaagaacttcagagtgtgacaaataccctctccaggaaagtaacttaggattatatactaacgtagaggaatacccgtactgagctgtcaccatcaatggcccacctctactgtcctgtagcatataaccccaaataataatattcaatagcctaagcacctcgcttatgctactaaatactactctacaatcatcatcatgacttagagcaatcatataaatgaacattatgcccacaccaatgcatcccccaggtaagctagctagacaattatatctcaaataatatatcgaaaagtcggtactcaagggatcagaatgaagtaaagtaatattctataaatagtacaagtcttacaaaagaatgaactcttctgaagactccgaggattgaagaaactattctattcctactccactagctctagagcactaaactaaacttgagagaatatgagaagctcttgcttgagtgtgtgatggagtggaggatgagagctccctttatagcctcccaatgacggttgtgatggttggaatggtcagaaatgccctccaactgtcattgggatgcaatcctggacgtccacgccaaaccctgcatccaatggtgcaggtgggggttcggccaaacccatggtttggctgaaccatgggctgggccaaaccaccccaatttcggctggcggcctccttatctcctcccttatccagaacagtgaattttgggcctattggatcgtggcaattttttgttcttgtcccatttatccataagtctggatctcgacagcgtccgattgatggatcgtctattttgctgtcgattctcctccattttgtacttattttctgcaaggggttataatcctagtgctagtggaaaataacttattctaacacaaatatgcattgcaaacataactagttctcctttattttagtaatattgactggcgaaactgatcgataacgatcgtcaacaacgggcatgtgcgacacgtgtctggggcaccaccgaccctaatgattcgctgcagaagtcttgtcgaagtctttccattgtcagtgggataaatcttctgtaagctttggtttcatcataaggggggtgcagtgccttacagctgaccgtgccccttgcgtctttaaggcggtagttaggatatttctagtcgagcttctcgaggaagatacaaccggacggatatctctgagttacttccctaataagctttcatgcacttccttcgtagagaaggagaaacgatccctaccgagggcaaagtcagcctgggccccgggcatgccgagaccgtggtagcctttgttacgtaatctgacgagagcgggagagtgggaaagagagactcgcctgggtaggttcagcccgtacctaggtccgggcgcttcctcggctcctacgctaggaacgctccttgttgagcgctcttcccttccagccgaagggcgcgggcttcggcaaggagcttggttagagcatctccaacatgctctctaaattcaactctccaaatgtctatttggccaactctccatttcatttgttaagtcaaattggttgtttactccaacaatctctccatccatcctctctattttgagtctatgacagcgggatctatgcgtcagcctctataccgcttctcccccatctttctcccccttttcctctccctctacctcttcgcattagcacttccgacgacggtgcggacggcggcggcgggcgcggctggagacggcgcggaaggcggcggcggcagcgggcgcgcggctggggacggcgctgacggcggtggctggcgcggacggctgtggcggcaggcgtggctggggacggcgctgacggaggcggacggctacggcggcaagcgtggctggggacggcgctgacagaggcggctggcacggatggggcggacggcggcggcggcggcaggcgcggccggggacggcgctgacggcggcggcggcggcaagcgcggacggggacatcgctgacggcggccggcggcgggcgcggctggcgacgatgacgacgcagaggacggcggcggtcgtggctggctccggcgcctctctcctccctaccgtcgttgtcgtgtggttctgcggcgctgccttcttgctagggagagaccgagagagagatgggggtgggagagggagtggtgggggccacgaatagccaggcagggtgactctccaagtttggccattgaggggtgagatttggccatctggatggcttagctaacatgatggagaggctattgaagggcattttttctttatacttgttaaaatttaacttggctagccatttggccattcttagatcggggtctcgggtatggcccgatccgcggctaacctcgagccgcattctcaaaccctatagttggggcccacgaccatgtccttctattagttccctcgttaaaaggtgctttattgttttgacggtgaaatgggtacacccattcccatttcgtcgacagttcgtattaaaaagtcaaaaaaaattgaaaaatacatcatgtataaaaaaattttatacacatatgaaaagtttgtgtttgcacgtatatgggctgcaggaat

SEQ ID NO: 66066 - DNA, 2754 bp, Oryza sativa
  unsure (1)..(2754): unsure at all n locations
ttgattccccctccacttgccgattccgacggcgcctccccgccgccgcactgggttctcatcgacatatggtgctacatcggcgacctccccaacgccaccaccgccgagtccacaaccagcacaggcctccccatcaaggtcaccttccgcaccgcacgcccgccgctcctctcccacctctgcgtccactgcccgggcctcgacttcctccgcgccacgcccaaggtcatcgcctcccacgccgacctcctcctcctcgtcgtccccttcgatcccctcaccgccctctccagcgggacatgggattacttcgtctaccgcgcggccgaccctcctctgctccacctcatcccgcccccgccgcgctccatgcgcttcaacgactccgaggtcgccatcgtcagccacggcgacggcgagtacgccgtcgccgccctcgccttcgccggcactttcctctccgtaaacaaggatttccacctccacctctaccatggcggcaagcagcagcagggtgagtgggtctccaagctcttgacgctggaggatcagctgagagacaagcttgtgcctttgcccaaagcggctgcggagtacaggttttaccaggagacaaggaagacgatcgtgattggcggcgagcgcggtacggtcggctgggtagacctctggcgtggcatcatcttctgcgacgtgctcgacgaccaccccgtgctccgcgacatgcccctgcccctgccagcgagcggcaactgggatcgcctcctcaagcagactgaccccaactacatccgtgatgtcaccgtcagtctttgcagagactccatcaagtacatagagctggagatcgttgggacaggagagacccacaccactgtccagccaactgaatcttaccaggaatgggttcggcgaaagccaaggtacaccagctcagttgttctccgtcgtgnnnnnnnnnnnnnnnnnnnnaccatgccaattccggtggcttcatgggagcactggcgccgtgattgtcacctcaatgtcaaagacctcagcatcaatgtccgtgacccaagccacctgaagctgctgtctaagctgagtggatgtggccacagcaaagctgcattgcggagcgtagcaatggtattccccaccataagcatggatgatgatcatgtctacttcttttccatagccggaagcacggacaaattggaggccgtggttactgttgatgtaaggaataagaagatacaaggagttgctgagcttgatgtccgaaaatactatttcggtatgcccacctacatcgccagtgagatgtccacatatctgaagaaagtcactacaggtaacttctatgtgctggtatatacttctgatatatgtataaatgcactacttgcttgccatcattgtatttgtcgctgtttagtttagaagaagggccttatgatacctcactagttccaccagttaggaacatattgcagtctggatctcagatttgattacggcaatgtgaacacaaggggtactaatacggcttgtttcattgtataagctgtatgattggcaaccaatagaaatagaatttcaaattgtgctgtgctcaatttaaattcctttttgtctttgagtgaaagtacagcaaacctgtttaggattatactcccaaattcttgagcactcaatttctttaatgaggcggttagagttttgccaatttaggaatataccacaccatttagaccaaatgcttgttgattgattgaatgccaagctggcctcaaagcatagtgcaagaagataagcacccaagaaaatgggtttcaccctttgttctgggccaaaagcaccgttgaagaccccagtatttcaaagttaccctttcagacaaaggttatttttggaagttggttctgttcccttcctgcaagggcaaaagaggggtaaaggtgtcattttggtgccatctctaatcaaacatttaaatttataatcaatctcttctaaaatatttagattggatataatatgtatagatatgtcttgtccatgatagttgatttaacacacgttgaattgaaattaacggtcaaagttatatattttagagactgtcagtgttcaaaacagcatggttctgctgctcgacagagtagtaagatatatttgatcaaaacaaagtaaccaacctactagcagctaatgactagttcttgctatcgatttttgttttgttttttttcccctgctactagatgatagtagtagtatgggtacttcctctttataaaaaaaaatgtaaccaattccagttctaggcaattttgacgaactcttttgttgttgttcaggcacaggagaggtggcacatggacaaactgaaagtgcagcagttgaagtgaggcgcatgtgaaaggcgtgggggcccatataaagaagaagaaacattggaagaaagagcatcagtgtacagatggatagatggaagccagttggtgttgagattcaggatgctggtaacattgttggtggcggtttaggagttcatttgtcgtttgcagtatggaaactggcttggggtttatctgcgcctagagagataattgtaggatacgatttattgtgtactagtgaacttttactgcaagctgaagccattttatagaaatggggagctagtagtgataatttggcaagcagttaccatggtcttttaaggacgaagcagcctaagttctgatgtacgctata

SEQ ID NO: 66067 - DNA, 1206 bp, Oryza sativa
ctgcagcccgtgatagttaaattgggatagagagtacaaaatatactgatggacacaaccatcaatgtgtaagctgcctaaatcagatgaaaaccatcatgaaccaagttcgaagctcttggtatatgtcctcttgcctcttaccaggaaccagacagacaaccagtcacaaacaactaaacaagacaccagagccagctaaacactatctacaggaaactttcagccgattactgttcgtttgactactcaggttctttgccactagtagctgagggcatggattccagaacggacatctgtcgatcttcagttatatcttccactgttgcaaaagaaaaaccacactataaacacgagtctcatgattttgtttcataagcaaaaacatacatcattcatgaataaagacgtacatcagtgattaaaagtgtatctagtcactacagaggctccaccatgttgtgtacatccaatatctcctcgaacctacaaaagaactcacagttagttctcctttatgttttaatttggattagattgatagattttaggagaacaaaatacttacacttgccaaagttctttcgtcatcataccactgtagaacaactcttccaacatgtcattcaactccaggtaatgtgaatacagcaaatctagctctgaaagcatctcaattgattcatcgtctagttgatacatttcatcttccaagacttcatcatcgctctaagaaatttaatgttctgttaggattcaagttcaagttaagaaaaaaaaacaaataaaagatagaatgtattacctcaagttgtgctggatccatcccgtgttcaatcacgtggcgagtgtaaataacaagatggttagctgaattatcatacttcgtcaactttgccatcttgtaatctgcatcatttgttttttcaccacctttctgatccttagaattctcaccatttccttcctttgtctttccaccaccatttccttccttatccttttttttgttgaataggtacacttttaccagaatgggatggctgtgcaatagaacaataaccctccagtctgatcttaatgataagctcctaagaatggcaagtagagtttttctaacttgtcgatttgcacatctccggagcctgtaaagatttgaaaggaacccaatcctaacgacaggacgcttcaaagcaaattgcg

SEQ ID NO: 66068 - DNA, 723 bp, Oryza sativa
aggtacgtcaatacctgtacacacaattttccaaatacttggatgcaaagagattagatgcaacttcatcttgtgcttccaagcggcgtaatatgtcccatcaaattgaggagcacgcccggaaggcacggagacgaagttgtgagagggaatggtaagtttgttgtaatcaaaaggtatagtggctcccttgggtgatggagttcccttgttgctcgctccatcttcatttccaatttccccgtcctttccccctaagtccgacatcgtggatcactcaaagcggtgaagcttgaatcaagagcaccttgatctgataccaattgaacgcacagagatgtagcctagagggggggtgaataggctttcctgaaattttctcaacaatcgcagcggttaaattaacagggcccggaacctcctggtgaagaacaccggaacttcctggcagagatgagcagcccggaacttccggagttcttgagctaggaaattccgggcaacagagaaaatcaaaatttggggaagcaaaacaagtcctagctagagacaatcaggcacaaggttgcacaagatgtaaatcacaagataccagcagattcaaacacaaatcatgcacaagagagacaggcgattttttcccgaagttcggatcacacggatcctactctccgttgaggtgctcaaagagccgggtctcgattaaccccttgcctcacttat

SEQ ID NO: 66069 - DNA, 10696 bp, Oryza sativa
agttgtgtaacctagcaatatatagctacagaacgtcgttttagtgtcacttatatagtgttacatgcttttggtatttcctttatgcgttacgagccaaacctatcactatatgttcagacatatattttactatatgccgagttaatgccatgttatccttatttttatttaagaatagtaggtatatatgtagttatatgcatttatctatcaaaaataataagctattatgagttatgtacatatatttgtccaaaacgttaaatttccgtcaaattccgattattcgcccgtactccgattattcgtttagcggaaccatctccgtccgacatccatattccgtcatccacaacactggcatcaacaagagatagatgtccacaaggagcaaggtgttactttaactgcatttatttacatttatatttgagcaaggtgttactttaactgcatttatttacatttatatttgtccttgtcctcgcatccaagaaaactcactcttggatttatgactaaatatctaaccatacaattagattgtccttgtcctcgcatccaagaaaactcactcttggatttatgactaaatatctaaccatacaattagattgcctagctacaacattctgccaatctgccaataactaatcactaagaaaaaaagcaacaatctactcccatgggccaaaatttcagccggttatcactgctaaccggtttttgaattcaaaaatttggacctaaacatctattggattttttatataaaaaaaattggacctaaacatctatccaataaaaaccagccaacaccggtaaccggtctggaagggtactacacgggtggctctttgctgtgctcgtcggcgacgcaggtggctacctgtgctttctcggtgtcgtcgccggcctgcagctcacgacgagacacgaacttgacggtgtccttcctgaacgtcaggtagatcacggcgacgacgtagagcagcatgagcgggaacagcacgatgccgatgagcacgttggcgaatgtcgggagcgcgttgtggaggatccagccgaccagctttgtgctgaggaagtagatgtttatcccgatgatgacgaaccccagcacccaggagaatccaacaatctgcaggttttaattaccaatgcattattagttttccaggattttttttgtttttgttttctatgtgtggacaagctagaaagaaggattgattgattgatgggggagtgcttacatagatggagttcttgttttcacccatcttgttgctgctgctgctgaacttgagaagagggatcagagcaaatggtagctcaaaggatagaatcatctgtatgaaacgtaacagccaaaccaaaacaagcattaggttttgattctttttaacagtatgatcagaaggaatgaggtacaacaaattacataccgtccattttttgaagaaagaagcatttcgattagcaaataacttactaattattgagaaaattagaagatggttgattgtatggcagttttttttaatgagtgttcttatgggcaaactgatattttcatttgtagtaaaagattgtaccgatgcaatgacgatgagacgaccggcgccactagaccctccaatgatggagacgattaagctaggcacaatggcaatgctgcgtgtcatcaggttccgaagccactgtttcattttgatgtctaggaacccctgtagatacatggaaaaaaaaaactgttactatacattcaagcttgatagattgcaaactttttttcatttctttcaccattttggagatcttctagtttactgcgtggttaatactataccacttgaactggtcattaagaaaatagttcacagatagtacttggttaatttgtaaacaaggttagagttcaggtaaaatatacctgcataacatattgcccagcataagtgccagtaatggtcgagctctgtccagaagccaagagtgctacaccgtacactgtcgcacttgactttcctagcacattctgaaaaaaaaataaataataattctgtaaatgaccattatatggtcaatgataacatgactaatttatttttgtgaagaaaataacacaactaaatataaatggtgatgaactttgcacatatatgcagtaccctgaggaggaaggatgaggagtccaatgtaaggtcgctgcattttacagcatcttctggtgaaaggttggttgcattacatacagtgccggagacagagatgattgcaatgttgacaagcagagccacgaaaagagctatcccactctcaaagaggaagaacctacagacatcctggagtacaaaagaatgaaggaatatgtatcagccaactaggagtaccatttcttttttaatgcaagaacacggacatctgatcaccttcattccttttgctgatgcgggtgtattcctcgacagcaccagggcagagtgcaagaatagattgtgcctgtaattaataactgataatgctcacttatgattaacaagagtgcattttgtcaaaatctaaaaaaagactaaaactaccattgtggagatttgtaattactggagagttgaaaaccttatgcatgtttacagctaccctagaagaatcttaagacgcaaaaaagacattgcacacattaacaactgggggtatatatgcatgtttgactgcttacggcattacaagagccccaagaagggcaatggagtctcctgtggcaccgggcccactgagcctggggatgaataatccttgaaggacctcattaaccggaggcttgactatgctcatctccacgaagaagcaccctgccatgacaaacaccaatagcgcgaccacaacctccagtttccttacctagttatatagatgaaggaaaaatgcaaacaagtcaattcaacaacaaacccatttgtaatgaccaccatttacaatgaccaaacagtaatgatcaaatacaatacaatgatgtttagacattcattaaaacattttatacagacatctatcatatatccagtcataaatagttggttaccccatatctttgcagtccaagaagaagaagcgtgctagagccagcaatgagaaccccggtccacactggtatgtggaacaaatggttgaaagcaaattctgtacctataactgcacaaaaggtacatgtgtaaaaaacaccaaatattagattagatgttgttgctttcttctcacaaaaagtgctacatatcataatgttcaatggataagagactgtatacaatcagtgcaagtgttgctcgtacacttatatcattgagagagttcataaacttaatcatctgaaactcaaaggtgacagttaaacattaacttttttttatctagatctatcattctatttacaaacttctggaatatcacaagcaatcacagttacttctgctagcagccataaccaggttttcacccatactgaatattcagtcttgcacagttcagcaagatggcgccctgtatcaattgacattcattacttgctacttccaactgaaatgttaactcgattgtgtgctgaaagtgtctatttattacctgtcaccactccaagattagccgataatgattgtataatcagtgcaaagatcaggccaatcaaaatcacccaaagaagctaagaaacatatgaaagagcacatcaagaagcatatcagttaattgtttctttcttctcgctgtaacaaaagacatgacaactgtgataaatggcaggaaaagtcatatagaaaaggctagagaatgtacctcatatttgtgattggcaccagcttgtagatcagtctccactgtttcaattcgtcaagcgtgagaaaccatatgagtgtgagaaaataaatttagagagagaatattactatttccaggatcgaggtaagccaaacagaccataaagcctggtccaatgtgggacaaaaaccttttccatgctggctcctgtgttacatgaccaattagtaataaatatgcatgcacatcatgtcaaagaaaataattaaaacataaagcaaaatataaaataggtacaaaactaagactattttcagtcaaagtctcaaagacgtacaaacaatacaagaatgagtgaatgatacattcaactaagcattggaaaatgagttatggaaatataaataaatgcgacaatggtagggcaagtaaaataactagccacaaatgtgaagaaatgtatattaatgtaagaaatgatgttcacatggactcgctattatagtccaacaagaagaggctaaactttcaatatgaaatttgtaatttgaagcttataacgaacatctatgcgaagcagataatgtcaagctatatgattttggattaggtacggcggagaaacaaatcatattgtactatcggcgacctatagtaagataaactgagatctaggctaaaccatacaagagatgaccaaaagtagagacattaaacaacagacttctattgtacaatagacttcgtttgtcaaacaagagcagagaaccgtaatgccttagtttgtcagacttgatatcaaacaaaaaaactgaggtgatcacaatctattgttttgtatctcatctttgttccataataaaaatgaactattaagtcatagttatcgaaaggagaagctcctaattaacaaaacgacttctcccttttattttctcctataacttaatgccacttttcttttgaatagagacatagaagactactctactaaacacgatttttcagcaaagaaacatgaaagaaacccatcattgaatcaacttataaatattgaaggcgccgtgtcctgtggatgcatcctctggggcattttcacaaacagcaagagtgcataccaacaggaatcagatcagagataataatttctcactcctgtccgtccaactccaactgcgacatcgatgcgatccctcattcataggtagatttaagtatgagcaaccaggagtatttgcagagagaattaacctttctgagatcggcgagcgcctcgatgtcgtccaccaccttcccgccgtcgccggcaaccgcctccgccttcgtcacccccatactagtgcggcttctttagctcagtcgcctgagtttgccttgcctctcaacaactcgccgccggcgccgaaccccgatctctgcaagaaacctcctactcgaccacgactgatatatataatgtataacacatgtacgtggcggcctccggtgacgtgcggttagttggagagagagagagagagggagttcgagcggagatcctccggtcgccgcgggggcgcgcgccgccgcgtgccgggcacgcgccgccgcgtgggcgcgcgggtgctctctcttcagctgcgcgtgcgcgcccgtggcgtgggcatggcgtgcgaggaggtgggccgggccgagcgaatgggcccagttgttgctggagtatagagtatttcccgattcaattttgctattttctttcgtagtctgttggatgtaaatataatagtagaaaaaatctaggtgaatttttgttagaaatcacccgacaattggatagtcagttcccgattgtgttttcaaaagttagtcatctatcaataacggattgagtatatccataacgtttttggagtgttttctttcttgaaaacaccttccaaaggacattttttcttatgtggtaaacttcaccaatgttaacgccggctgatgcgtgggcattagcaattttgcagccggcccacttgtgagttgcgaccctcttagaggatcttttttgcctgactagggggcctaaaattatttggcgcttcacaaattcatcccaatttataagatcaaatacatgtatgtaaatatgaaaagatgacgctcaatgaagtcggcgtcgttccatcctaatttaacagatcaaacacatgagaggatcgaacacataggaacatgaagaggtcttgcttaatgacatccaaatttatacatttggatgagtttgtgagtaccaaatcatttcaagtccacctaatctatgataacattatttgggagggtggcaagtaggctgcctcaagaattatacctgtctcttagcatggtgtgaccggtggttggtcgtttgacgtgacataaaaaaaattaaaaaagcaccttttgaagagcgtttatcctatatacctatacaaatcatccccactactaggaaatctctgcttcctggtgcttcacatcgccccatttgctatgaaccgtacgatctgaatcattcggaagggaagccatgaagcagcctcccagagttccccggttgtttattgggccgaaagaagcccatgttatggcccaactcaacgggtatccatccctaaccagaggcaaaccctccagttccctataccgcagcgccttaggtgacggcgcccgtcacttcctctcccgtgtcgtgtccctccccctatccggcgctccctctgcctttagttcaagcccacctgccggctgccgcctcctagccttttcgcctcctcggaatgtcatgagaaatgaaaccgctgcttcgagagcagacttcatggttgtcatcaaagacatcaatttactgctcccataacgtcatggtgaattcatccttggccttcgcttattactggggaatgcttcaatcaggttctctgtccttctccaccaaggcaccaactctgcttcatctgagtttccacatgtacaatgttctgcattgataaccgtagtaagtagctttatttttatccctttggatatttgatatgtacagaaagttatttggtgatgtggtatctacagccttccttctgaatgtgttatgctgctcctgtagatcttcaatctgaaaaaaggaaaaaaaaaaaggtgtgcaccgcttttccttaaaccttcctccgaaatttattcagttgtctctaagcgaatgatcaatttaccctattctctttgtcagagttaagttcaatggttattttaaatagctaacggtgatgaataccttataccatttaactgaattttattcagttgtactctcgatctaacgtatgttcaatccagctgattagtactaggttgattttctgaatcaaacattgcagggagtcccccgcagttaagtcattgatttgttgtacaataagaacatgtgctcgctcaatgtattggcgctaacaattggtcaagattctctcacctgccaccattatcctgcgggtaggcagctatacttctattctctctctctctctctctctctctctcttacattattcatctttgatcttggtattaggcccgcagctggctcagattattctgtcctctttcccagccaatgaccatattgcatagatttaattttccctaaactgaagtgatgaagcaagcttctacccaaccggccacctttattctctgatgatgaggtagtttactttattatccccaggtcttctacctttaaatgtcatggtttttgcctttatgagaatccagttttccttttcataatagaaggtgattccgaaggtgctctaatctttctcctttctttctcatttttcttgccatagtatcatcaagtgattcactaccttaccatagtattatcaggtgattcagatgtagtgaaaggatgtaattgcatgaagtgatttgatcaatacacaaaatagaagtgcaactgatcgtcatctgcagtatagggcaggtatttcactactctctgctcaaaactcatattagatccatcagttaagtgtgttagtattcgttctccgtagcttctattttacggattgtttttttctctttctgaattcatcctgcaaatatcacgtttttgtttagtttaaaaaagtctagaaatgtataagctttactagggaaatttttcagctatttgtttactcaataaagtgcaatacagcactacgaggtaaaactggcccttccaaatgttcccatagaattttacttaatctattgttcaaagtgtgttgtacgtattttttttatatttgaaaatatgtacactgttaattacacaccgttaacttcacatgtgcagcctacatattgttgctcgactaaccgagtttgttactgtagatggcaggttcatttgttgtaagagcaagtttaatagtatagcccactactagctctaattcatctatagccaatctaatagctcatccatacaatagttacatactacactattaatacatggtcccacctgtcatacacacactgcgtcttgaagttcgtgctacagctagctacaaatctgtagccctctactcttctctcttcttatttatctccttaaaatatgtttgtagctggcttatagctagctatggctggagctcagaagttgcttgcaacctaatcaggctaaccattcaatcatgagttaagaatataacaaactggtgaatgtgattcagaaaacaaagaagctgataattaattaagaacttccattatttcaggtgaacatcttcacaatttactgttacaaacatcagggtttcaaattaattatcatgtaacattagactacatgaaacaactttcgggctatatctattactacaagtttacaactctaggtcatataaaaatgtcccgcagcaatgtacggagtattatctagatatataaataaagcttccaaagaacgttaaagatccgtaaaacttgaaaacaaaaagatatagtactgtaaatatatttttgaccaagtagttttgtaaatcttcttctacttaaaaaaaatcataattaggggtgaaaacgagcaagtatggtcggattatgccattcccataccctaacccatattttcttttaaattcggagtcggatacgggtagtgccggataatatatcactcatcccatatcctatcctatattatttgcttcgaatcggattcgggaatggatatctatttgtatctctaattcatagatattaaataaaataaggtaattaaagtattaaaaaagatacgtcaagaaaaaaaattatacaatatacatatgagcacgtaaatagtgattaactaatcttttatcatgtttttaggtggatttataataaatttcatacatgttatataatagggacatacgggcggatacatgtcttcccgtatcctaacccacattttcccaacaaattcagatttaaactcggatagtatcggatatcccattttttctcccatattcctcccgcgagcctcgggtcaggcgggcggtacgtcgggaaatactcaccccattttcacccctattcgtaatggtggtcttgatttttgacacagtagacgcattaggcagacatgcgcaatcgtagccgtttgatcaccaaatctaacgtcccagattgcctcgatcatcccctcccttgcactctatgatatagatggccaaatggcccgcccgacccgacctacatgccgagccttctcacgggctgcacccatggccctggagaggcccaacatcgtgtttctccatataataagtctatttttcctccctcatagctttgcgttgcgtcttatatggctacaataagtctattttgtatccttttttctttgggccgtaccttatatggctgtaagtctattttggacccctcaactatttttctttgaccgtcatgccggggcgacccaccatgacaaggcatcggcccaggcacgatccaactgttgggtcgggccggcatgagctcaacaccagtcgcaccgtgccgtgcttgggcgggccaaatgatcgtgtcgtgggtcgtgtcgtgtcgtgtagtgggactatggggccccctttagttcgatcgggggtagcgggtgagaattgaggcttagtggaagagagatgtggagggggtcgggcccctctagagcaacgagacaaaagggatttttataggttcgggccactgagaagcgtaacaccctactcctgcatgtggttgattctgtggggaatacaagtgttcacgcaagccgaatgccttcaaaaaaccccccttcttcactaggcctggacctccttttatacctcaaggggttaccacagaggccctaaaagctacctagggaagaaggaaaacattctttacatttaatgcatgtcttgttcctctgacttggaagtccttacgcccattggtgcggcatgtgccctcatcaattcaagccggacgacacgggggacgcatgtgtcactcctcattaatggatgaagacttctgggcaccctgtcccactagggaacggaaacccggatcggaccggagcggaacgtggactcaggcctaggcaaggggcaaacaaccctcaacataccgatgtgatggggcagcgcaagctgcaagccgtctaacaagcagtcagcagtcaggtgcactaaccccgtcggacccatcattcgggcgacgtgcggcctgtcagccacgcctgcatgccacattaaatgcgacgaggcgcggccatctggctcaccttaaatgcggttaggtgggtgttaggcgcgcccacctaaccctgctcacatgggctgacacgtggaggggg

SEQ ID NO: 66070 - DNA, 2935 bp, Oryza sativa
agccacatgggtttgggaatggctcctccctctacacttgatatcccaggcccatatcaccgacaatagcccccggcgttagccgtgaccaaaaccttccttaggtggtcagggttgatgccactcttttagtctaatgacatgtgggcccggtctttctttcgtgttttgtgaagcgattcggtagttgtggccccacgcgaagcaaaaaccgcctccccggcaatgatgggctatcacttcgtaactgccacatcacctgggtaggtgcgcggggcagatatgtcagtggatttgccagcgaataatgatggcggcttccccggttaccgcgcgcaattaaggagggcgtggttccacttccgtctcagtcgcaacggcagcgtgcctagcacgcgcgctagaaacggatgcgtggagatagtgggcacgaaaaacgagggggcgaagtgagtggccgcaagaatcgaggtgccaggcgtggaggaggggaggataaagggcgtcgaggagggattttgttcacatcctttcaccactagaatccgctgcgctcctatgccctagctctcgccgctctcttgcctcctctcgccacacacactcgcttctcgccacaccaccttcgttgacgccatgacacggagctccgtgccgctggatggcagcttcctgcctccctctcgcattaccaacgagaggttcgcgggtctgccgcgcaagttcatgccgacgctgtcggctcccaaaactaatgattcggaaaccgatatgtttaactgtatcaagccctggatcagtagattgatacagcttcaacaatctggatcttcattgcgtacatttaaacaaggctccaaaggagatgttattacataaaataataggggaatttgcaagtttgtggctaactatcacaacagaagctatagaatgactcaactctaatgttttgctatagacttaaaccatctaactaatctagatttgagaactaggttgaaataagactaacttatatgattgaactcctggcttcagcaagaacttcaatttaactctggaaaaagggggttgaagcaaggatgagtacaacgtactcagcaagctattatattcaataatgaatgtatgaaaaggtaatatttgagtaggattacgattacttgcagaaggcagagaatatagaaatagaaagcctgatgcttgaaatgcagcagcatttagtaaaatcttgaattaagtttctaaccaaagtaccatctgagtcccgatactcaattccatgagcacggctattcgaatagattcatttttactttactgcagtaaatgtacgctttacccgcaatccatgacatgccaatattcattagcttagtcatggcaaagcttttcggttactaacatcagtggtacctgttccatgaactctcatcctaatgcgctctgaacgtaacgttatcagtagcgagaggagttctggcgttcccgaggtttttagagagagaactggttgagagacccccgtcatctcaactaggttttcacaatatacacacacttgagctcaacatatcatttacctgcgcctcagtaaatgttatatttgcccttcgtggcatatgcccttcgcggcataagtttgcctcctgagcgaggacttaaataagaaccactgtatagaggtaccacctttgctagataacttactttgcaaggtctgtccctattctaaaattgcggtcgtactcgttcgtttgacataagtacttggtaataactatattgactgagacagtactagccacccgaaaatcaaccaattcctacgtactgtcccaatctaagttcattatatttttatgcagactaactaggcagggctaagcaaagctagcatatgtctggtttgctatatgttcaggttatgtattcaaaatcatgaatgactaatgcatagaatagagatatagaatataggataattatgctcaaggggaggaataataacttgctttgctccaacgcaaataaatccaagataggcaacctgattatccgatgctagaaatacctcaggttgccatccagaatataatagactctactagagaagaggaagagccaatttcaataaaatccataaaatagcaaaagatcgataaacggctaagagagctagggtttagggtataagctatcttctttatagggtatagggattatgggctaatactttatgtggaggttctagagggttggaggctagaggggattaagtaacaattgtcacttgtattttatgtgtgggttttagtttcttggagagtaggggatatactaaataatctaattggttaagtggatatgtggctagtattggttgtagttgggctttggtagaagaatggctaggatttacttgttctcgagtcgatgctgaaataggatagcatatgggctcgtatttcatgtataggttatgggtagttggagggtaaatggttggtatggagtttggatagcagactggctggggtttcatttgattaagccgatatcgaggtaggatgaatatcggctgggatttgggtgtttgctagtcgttgctagagttgggcagtataacgactaaaattggtatcttctctagccagtgtcaacagacagcataacggttagagggataggaagtttgtgtgggtttagtggggcggaagtgttactccgacaaccgtgagtggcagcagaacggttaggatcacacagagcccaagagctaactgtgcggcgtgctgtggaggtcgagggaacagtgaagctccgaccactatacgcatcgaggcgtggggtgccaggagcagcacttcgaccttaggtttggttttgccgggctttacaaccaacggtccgacatcggggatagtaaacc

SEQ ID NO: 66071 - DNA, 1254 bp, Oryza sativa
tctggatcttcattgcatatattagaataaggctccaaaggagttgatattacaaaataataggggaatttacaaaattgtggcaaattgtggctaactaatacaacagaagctatagaatgactcaatcctaatgttttgctatagacttaaaccatctaactaatctagacttgagaactaggttgaaaggaaactaacttatatgattgaactctcggcttcggcaagaactccaaattaactctgaaagaagggggttaaagcaagggtgagtacaacgtactcagcaagctattatattcaagtatgaatgtatgaaataatagtatttgagtagagcactactacagatctgggcttcagtgacgggtcatttgtgacgggccaacacaattcgtcaaagatgagtcatctctgacgggccgaaaaaatatcctcttcaatatatggctaccagggaggacccgtcacagatgtgaggtcatctgtgacggcttgcacttgtaacccgtcacagatcgtctgtgacgggtcacaacaatggctcgtcacagatcatctgtgacgggtgtagtattatgaaccatcacaaaagagaccacttatctctgatgggtctttaactaacatacgtcacagataacgttatctctgacgggtggtagtcatgacccgttagtgatgagtgaaaattcaaattttcaaattttacaaaaaacctcggattgagacatgtcctatataaaagttgtagctctcgatgatatccacaactttataactaacaacatttctattagagatcatttacatccccgaacatgcattacaagtgatcagatctacttttaaaaacaaaattttgagtttttttcaaatgacatggatggatacatgccccgtatcaaagtcatagaactcaaccagatctacaatattataattgaaaatattttcatttcacaaagtttacatgttataaagtgagatatattttgaaaaatgaaattttgaattcttcaaacaacatcgaatgaagatattttctatgtaaaagttataaaacacgatgagatctataactatttagttgataatattttcatttgaagtcatttagggtgttaaatatatgttaaatgattcagacaagcatagacaaaataataacattgggtgagtagtcaatatttgttgagtaggtgagttggtaagggagctctatatggaggttgaggtcttgagttcgaa

SEQ ID NO: 66072 - DNA, 2474 bp, Oryza sativa
ggtcgtaagttacaacccgtcagagatgagtcatcagtgacggacaggtagttacgacacgtcactgataactcatatgtgatgggtgacaagttttatcccgtcagagatgacacacccgtcacaggtgattttgtcatcagtgaccactaatcactgaccaagaccaaacctgtcaaaggtgagggtttgggcccgtcagagatgacatggtccggcgtagtggctagatctatttgcagaaagctaagaaagtagaaggagaaattctataatgttttgaatgcaacaatatttaataaaatctggagttatatttctaaccaagatgccatagtgagtctcgatgcttaatatccgtaagcacggctattcgaatagtttcagaaatactcatactgcagtagatgtatgctttacccgccatccatgacatgctaatattcatcaaacctgtcaaaggtgagggtttgggcccgtcagagatgacatggtctcgcgtagtggctagatctatttgcagaaagctaagaaagtagaaggagaaattctataatgttttgaatgcaacaatatttaataaaatctggagttatatttctaaccaagatgccatagtgagtcccgatgcttaatatccgtgagcacggctattcgaatagtttcagaaatactcatactacagtagatgtatgctttacccgccatccatgacatgctaatattcatcagcttagtcatggcaaaacttttcggttactaacatcagtggcatctgttccatgaactctcatcctcatgcgctctgaacataacgttatcagcagcgagaggagttctggcgttcccgaggtttttagagagagaattggttgagagacccccgtcatcccaaccaggttttcacaatacacacacagcgcgcaataatcaatatatttacctgtgcctcggtaaatattataatcgccctgctcggcgtaaatttgcctcctgcgtgaggacttaaagaagaaccactgtacagaggtaccacctttgctagataacctactttgctaagtctgtccccattctagaattggcggtcgtactcgttcgttcttcagatgtacttggcaatcttatgtcggttggaacagtatgagccacccggaaatcatgcatttctaccgtactgttccaatctaagttcgttatattttatgcaatctaactaggcatggctaagcaaaatctagcatatatctggtttgctatatgttcaagttatgcatttaaaatcatgaatgggtaatgcatggaataatagagatatagaatataggataataatgctcaaaggggaggaataataacttgccttgctccaacgcaaataaatccgagataggcaacctgattatccgatcctcgaaataccacaggttgccatccaaaataaaatagattctactaagaaagacgaagaaccaatttcaataaaagccataaataacaagaaaacgataaatggttaggagggctagggtttggtggtgtgctagtcgatgctagagcataatgactaggtttggtatcttctctagccggtgtcaacagatagcataacggctagagggataggaggtttgtgtgggtttagtggggcggaagtgttactccgacaaccgtgagtggcggctaggatcacacacagagcccgagagctaactgtgcggcgtgctgtggaggtcgagggaatagtgaagctccgaccgctgtacgcatcaaggcatggggtgccaggagcagcacttcgaccttgggtttggtttatgccgggctttacaaccaacggtctgacgtcggggatagaaaaccgcgaacgtccccatggaaggcgtaaagttccaaccgacagcttttagtggctaaagcgtattttgaaaataaaaggaaatatttggaatacaaatataaatttaaattggaaattcaaatataagaataattaaatcaaatatttattcaaatggtatttgaataaattaaggaaatttaaataaaatcttaaaatagcaaatttgatatcaaaatgaaggatttgaatttagatgaatttaggtccaagttttatcggaatcggatctacggtttaggagatatgggtttctaaagattggaatttggattaaatagagtaaattgcgaaagtatactgttcatgggcccacctgtcagggattcttttctttttcttttctttcttcttcctcccgtcgtcttcttcctcccgcttcacagagggccgagagaagggagaggagagggagagaggggcggcggcgctccggcggccggggggtggcgacgtcggcggccatgcgcgttcccgagcaacgcgcatacgaggagggtggtggccggcagagggagttagggaggaggccggaacggcgacaacaagagctcggtttcggccggtatagggg

SEQ ID NO: 66073 - DNA, 3043 bp, Oryza sativa
gttttagaggagaagaagaagaggagcccgttagcggcgacgtgaggaagaggaagacggcatcgttctcgttctatgattgggcatcgatgtcggtttgcttcagaggctgacgtcggcggcgtgagatggcggtgacgtcggcggcgatgccttggcgacgacggcaggacgttggcggcggcgtgtgaaaccacggcgatggtagcggcatgcgcgggtatgccgtgcgtgcccacgacgcacggtgacggcgcccacaggaggagatggagcggctgcttctgttgggccaaactgggccagtgggccaaaaaggaagaaaaagaagactttggcccagattagaaataaatgtttttctaaattttgacaagggtttgggtgattagaatttaaatttggagaagatttggaaggaatttgaatagggaagtttgaaaggaaattatgtaggagatattttctagtttgagtgcaatattttgagggagaggatataatggaatttatttgttgcactcaaatgagaagaagagaatatatatattggcatgaatagtatgattcctaaaatagaggatataattgagaatatgggaggagatggatggatgaagataaataggatttttagcctcgaaatatatggcatgggtttcaaagaattgtttgaggctaaaaggaaatttggatgacaaagatataatctattttcttagcacaagagcaattattttaatatttataatattgcttattcttgtgccgaataggagatcaagccacagagattaaattagtggctagattaaaaggaggaatttagatatttggatcgggaatcaaagataggtttaagatcaaaggatgggttaacaattaattcaatagaatcagaatttcggtggtttaggttcaagggtaatatgggaagatttattggaccataattcataataataaaaatggttttcaaactaaatttgaataaaagagctttagtcgaaagaaggtttaataaatagaattccaacaggaaataccaaatatgtttttaaatgaaaaacacaaaagagattaaataccagagaggttttatgcgagttagttttaggaggtcccactaattatattttcctaggtttagaaggttattaagaacataagaattaacatgatgcaagattagaaaatagctaattttcagtatgttacattcgaattcggagaatatttgaataagaaggtttgaaaggaaattatatccaaatataatttccagaagagagattttctggtttatttgagtgcaatattttggagtgggagtttgtttgatgcactcaaaataggaattcaaaatattcaacaccataaataatatggctctagatttgaatatttttgagtatgtggagcgaatatggagggagtagaataaatagaattttagcccaaaatatatggcatggattctagagaagtatatgaggctaaaaggaaatttggatcgagaatcaaggataggtttaagatcaaaggacccaattaattccaagaaaattggaattactttggtttaggttcaagggttgtgttggtggatttcttggaccacaattcataaaagtaaaaaggatttttaaactaaatttgaataaaggaaattttggttgaaagaaggtttaagatgcaaaaatcaaagagaatacctcaatttaacaagatcaatttttagaataaaagccacgaaagattttaaataccaaaaagggattttatgcatgttagttttaggaggtccctctaattataatttcttaggtttaggaaggttattaagaacataagaatcgacatgatgcatatttagaaaatagcaaattttcagtatgttacagacgtcgtccggtcgggcaatgattatcctgggcgaggcatgcccgacgctgcgttatccggagcggccagtcttcttcctcttgttcgtcatggtgggattgactccccctttttgtctttcttcctcgatgttcaggacttctacgagatccagatggcgcacctcaccctgaacgccgtgctgacacttgccatcttcgcacatctgtgcgagatgttcatcggggtgaggccgtgcctccgcctcttccgttggttcttaaccatgcaactggtgtcccccgcgacggaagccgacggctgctacttctagccgcgcgccaacacgcaacagcactatttcgggcagacgctacgcaagaagtgggacgactggaagcacgattggttctacaccgtcctccctgacaacgtccacctttggctccctacagcaccgcccgttcagacgtcgagctggcggtcattgtcggtgttgggagacacgtatgacgcagtgatcgactacctcgccggtctgcagtataaggggctgactggtgccatggtcttcagcgactacactcgctgccggattgcgcctctccgggagcgggtccggggtgcatggtcatacaccggctccgacgactccatccggactcatccggggcagacctgggactagaactatgccaacctcaagctagtggtccagtgggtgctcagcctcagggatgtcgagccgtcgctaatcccccacaacatccttcctccatcctggccatcatgcaagcgataggcgcaggcggggaccgcagcggaggtgatggcgctggcggcagccacgttttgggggaccgctacctatccgcccgaggcggccatggaggaatgtccacgggcgggggttcgggcagcagccgcccctctgacccgaaggggaagaggaagcaaagggactcctctccctccccgtcccggccctgcgggggcggcgcagagtgcgccgttggcaggcgcccaatgggcaccgaaccggcgcagccctcaatgaccgcatagctagtggctgggaggaggaagaaatggccgtgcaagacggcggagaccaagccgtgccggggggagtttatcaagtccccggaatggagctcaa

SEQ ID NO: 66074 - DNA, 793 bp, Oryza sativa
ctcgcccgctggggatggcgtggccttgtgagcgagaccggggcccgcatgcaagacgtagggcgggacacgaggtctagcccccagcctcgcgttccgaccgccgacggatatcgaaaatgttgcagcaacacatggtcaggtaaagacgagtatgggccagactgagttaacagtgagaacttggcccaggctgcagcgagagattccttctcgttccgtcaaaaagaaaggatgtctaatcaaagattaattacacgggttaacagaaagaaggcaaggcagaatttgcactttagctcctattcaccgtggaatttcctgacagacagagtgtaccattgctttgcttcatctctaagagaaaaaaggaaacaatttccatttaagagtttcatgtgtcatgcctacgatggataggcacgaacacactagctcaaaatcacgaagatggaggtataggttttcaccaatactaccagagaaggtttgctcttgaatcatggctataaagtcaggactaatttcgtagccatccgaaaggattggttttgaagaacaggatggctcacaaagatcagcccgaggagcaaaaaggttttgaattgtgggttgctccattgttggtatttcttaacctgacagatagaatccataagcgcacggaaaataccgatgtagtacttcaccccaggagtattctcaggtatcgatttccatagggaacgtgtgtgttaactcctagtcaggttcatccaaggacacgaagctaaagataggcaaaggatagaga

SEQ ID NO: 66075 - DNA, 1433 bp, Oryza sativa
gcttaagatgtcttcaagcacttcgccaagcaagcccaaaacctctatgatctcaccatcaagagggtgcgaagcgacaatggaggagaattcaagaacactcaagtgaaggaattccttgacgaagtgggaatcaagcatgagttctccgccccatatgatcctcctcaaaatggcattgttgagaggaagaaccaaactcttattgaagccgcaagatcaatgcttgatgagtacaagacttcggatatcttttgggtggaggccgtgagtaccacatgtcatgccatcaaccgcttgtacctccacaagatcttaaagaaaacttcatatgagctcttgagtggtaagaaacctaatgtttcatattttcgtgtctttgggagcaaatgctttattttgagtaagaggcctcgctcatctaagttctcacctaaggtggatgagggattcttacttggctatgaatcaaatgcacatgcctatcgtgtcttcaacaaaacctccggtattgttgaagtcactagggatgtgacatttgatgaatctaatggctcccaaggagagcaagttgttgtacatgttgtaggtgatgtggattcaagtcaagctataggtactaaggctattggagacatacgaccagtcaagacgcaggatgaccaagaagacagggatcaaccttcgtcatcgacatccaatagccctacattgagtcaagtgtcagtcgacccggaagttccgggaccagatggtcggaacctccgaacctctccaagccaggaagttccgggtccatctgccaggaagttccgggcagaggacagtcaaggcgtgcctacggcacaagtggatggaattgatgctgagggcactgtagagcatcctgatcaggctcaggtcccctcggtgcaccatccaagaatacatcacactgtccaaagagatcatcccgtcgacaacatacttggtgacataagaaaggaggtaactactcgttctcgtgtcgctaacttttgtcaacactatttgtttgtctcttctttggaaccaaccagggttgaagatgcacttggtgatctggattgggtgatggctatgcaagtggagttgaataacttcactcgcaaccaagtatggacattggtggagagacccgaccaaaatgtcatcggcaccaagtggatcttccgcaacaagccagatgaacatggagtggttgtaaggaacaaagcccggttagttgcgcaagggttcacccaaatcgagggtctcgattttggtgaaaccttcacacccgttgctcaccttgagtcaatccgaatccttttagcctatgccgctcaccatgatttcaggttattccaaatggatgtcaagagtgcctttctcaatggacctatctcggagttggtctatgtggagcaaccacc

SEQ ID NO: 66076 - DNA, 6252 bp, Oryza sativa
ttcctgcaccccaatttagtagtatcatgactaaaaggttcgagatgtctatgatgggcgagttgacctttttcctcgggctacaagtgaagcaagtacaagagggcactttcatctctcaaaccaagtacgtgaaggacattctcaagaagtttgggatggaagatgccatacccatcaagactcctatgcctaccaatggccacctagacctcgacgataatggtaaatgtgtggaccaaaaggtatatcgctccatgataggatccttgctttacttatgtacatctcgtcccgatatcatgcttagtgtttgcatgtgtgctcgctttcaagcggagcctaaagagtgctatttgattgccgtcaagagaattctaagatatttagtccatactcctaatcttggcttgtggtatcctaagggttgtgactttgagcttttgggctattccgattcggattacgccgggtgtaaggttgatagaaaaagcacaaccgggacttgccaatttcttgggcggtcccttgtttcttggtcctccaagaagcaaaattctattgctttatccaccgccgaagtcgaatatgtcgccaccggttcttgttgtgtccaactcctttggatgaaacaaaccctaaaagactttggctacaacttcaccaagatcccactcctatgtgacaatgagagtgccatcaaaatagccaataatcccgttcaacattctcgaaccaaacacatagatattcgccaccactttttgagagatcatgagaccaaaggagacatttgccttacacatgtgagaaccgagagcatattggccgacattttcaccaagcctttagatgagaaaagattttgcgagcttaggagtgagctcaatatcttagattctcgcaacattaggtgatgggtggttggctaatttatagccaaacatatgtcactaaaatgtaaattaaaaaaaataaaaaaaaattaagcttttgtgtcttgagatcacttcttgtgtagaagatggtcttgataccaggaatgaagctaaaacattccccttttatccaaaaactcccttttgtgaaaatttttgcaaaatcctttgtgtgccttttattgcgaaattttggtttttatttccttcttgtgatgtattgtgaccatagttatgtaatgttgtttgttggctggtcatatacatcataagtctcttcatgtccatagttcctaatttcccttcgttaaattctcttctcctccttgtttttgggcctgactgcccttgttctgtcaggccggaagttccgggcctccctgtccggaacctccgggtgtcggggagtatatatactcagggggagttagaaatcccggtctctctcctcacttcttctccctccccgacgccagccctagccgccgctacagtaccccttgtggcgattttcaattccatccgtgaaaatttgattcctctctgtggaatcaatcacattggtggctaggaggttcttcccgtgatcgatctgcgatttcctctctcaaggtagcacttttgatcttctcttttggttcatcatgtttttgccccaatctctaaatctgtgaacctagggagaaaaccacttggatagtcttgtttctgctaccttgtagatcaccgatctataggatttgttcacatgcactggctatttttgagaccactgttcttcatttttgccggccggaagttgcacctggaacctccgggcgctgtccagccagcctgccattcttgattctctcaaattttgcctaactactgcactccaatttgttgattcctgttgcagtaagcactatgcctcgtgagaagagacagaaagcctctcaggatgtgtccggtgatgagagtcctcctattcattttcctcgtggtcgtttgggaaaagaaaaagtggttgaaggtggcagtagcagtggcactcgtacctctcccaggtttaccaggcaatccagcaatcgcccagttcagattcgtgatgttgacagtggtcaaggtagtgatgctccttcttcaagaggtcgtgggagaggtggtggtcgcacttctggggctggaagggcctctcatgatttccttgttggatctcgtgtgaatcccgttcggctctacaagactattggttttgacaccactcctatgcatcacattggaagacccaagtccaactaccttcatcagcttgccaagtgcagaagggaccgtttgattgatccaaagacacagcctggggagtcacaggatcctcgtttcagaactttaactcaattggattggtacaactcagtgattatggctagagacaatccagtggttgagatgaagtggattgattggacttacatgaggaagaagaacaatgaagtgttcaaccaagcaatgcaagtttgccacaacaagaatcttggagatattcttgccttggagtatgattggaatgaggaggtcattgcacagttctatgcgacagcattctttgatactactaggaagggaacttcttatgtaaagtggatgactgagggtgttaggcacaagatttccatagcacagtttgctgagatattgggcttagaggatgaggatctcaataggcctaacatacatagtgaagcacttcttcccatgatcaagactaaattcatgtatactagggatgctcctaggacttgtatgggaactactcatggtttgcatccaaactacaaggtgctgtactccatctttcgttggtctttgcttccaaaggttggagatgccattgctttgccttccaaacatgttcatcttctcagtcgcatgcgctacaatcagcctcctttcagtgtgatgcagttgatttggtatgagattgccaacaccattcttgagcctaagcgaggttgcatctatgctccattcattatgaagatgattgagacagtcaccggggtgttctacattaaagatgggcgccacaatcctttcctcttctccagtggcacctagatccatcccttctacctcagctggtccttcttctagtgccccaccgcaatcctcgagctcttctcccatcaagaaggcacttcaggcaatcttctgtatgtgtgctaagactgcaaagaaagtgaagaagatagaaaggcgtcagaaggaagatagaagagaggctgggaaagaagtgtcagatgattctgaagatgaggtctatgtggatccttttgaggcttatgaggcagcccgcaatgttgccggtgaaggtccatccacctatttcaatgaagagtcttcccaatcagatgatgatgatgatgaggatgacactgaggcagctgctgaggatgctcctactgatgttgacaccgctgcacagtccgatgagtctcatctcttcggcgataccgagattgttccttcagatggagatggagatgagtgatcctcttcttctcttcatggtttcttgctttttggtgccttgatgctaaagggggagaaattgtgaattgaagggggtcatttaaatcatttttgctgccttgactgctgtctggtcatttggccagaagttccgggtcctgtgatctggaagttctggccaagcagattccctccctattatctatctctctatggacatgtaatcgtattctattatggttggatgtaatgactgttagatgttttattatcctttatgtcagtaagttagactatatgaatgttgcattttgatgtgatgtagtgttcttttcatctttttgagtgtttgcaatgtcatctagttcttcttctagcatatcactcatcatttaagcactcacatctgcttcttatttgattggggatagtgtgaagttacctttgagctttccttcgtttttatgcatattgtattcttctctcatttccttatatgcatatctttagggggagcttcacacttctctcatcatttcaatttaaattctattatctttttgtgtgctttaaccatgttgtcatcaatcaccaaaaagggggagattgaagatgcacttaaaccccctagtgggttttggtgattaatgacaaggtggttaaaggggactaacgtgtttatcaagtttattcacaggagtttagtcccaaagcaagttgtgatggctaagaatgcaaggagacccccaaatttgaatgctcctaagtgcgaaaaacaccgaaggtgattagactaggtttttcactttcgaaattgagtttaggaaaaaacatactattaagaggggtttcaagtgtggttctagggtatacaaagtgctcttagtcatatccatgtgtcaaaatatttttggaatcatttttgaaaaatgatttttgtccccgggacagagagggctacccggaggttctggccggaacttccgggcgccatttcaacagcaaattttcctaagtgctgcccagaagttcctggcacttttgcccggaacctcctggcaggcttccagtttaaacttgtgagtaacggctagatgacgtcatctagccgttatatatatggatttcgtccccaggccaccctttggccattccacttcagctctttcatgttctagggttttctagccactcccaagattcctttgcttcctccactcaaatctagagtctatcttgtgagattgagagattagattagagtgtaggagtgttttggagatggcttgaagattaggtttgtttgagcactttggataccttgtgggctgtcacttgggcttattactcttggagatcttctcatagacggttaggtgtcgcccgtgagcttccaaagatcttgtggatgtcccgggaaagtttgtgaaggttttcttcacctccgcaaggaaacgaggtaagtgagtaaagattcttgtgctgagttttcagaggttgtcctaggtagagcaacttacacttgtggtcttttctagaaggaattgtgagttggatcttggtggtcactcaattctagaaaatgacctagaagtgttgagttgaaggttgtggacttcttctgggatctttgcataagtgaggcaaggggttaatcgagacccggctctttgagcacctcaacggagagtaggatccgtgtgatccgaacttcaggaaaaaatcgcctttgtctctcttgtgcatgatctgtgtttgaatctgctggtatcttgtgatttacatcttgtgcaaccttgtgcctgattgtctctagctaggacctgttttgcttccccaaattttgattttctctgttgctaggaagttcctggctcaagaactccggaagttccgggctgctcatctctgccaggaagttccggtgttcttcaccaggaggttccgggccctgttaatttaactgctgtgattattgaaaaaatttcagaaaaacctattcacccccccccctctaggctacatctctgcgcgttcaatgacgtctaagacgtcatggccttcctgaagacattgtctaggaggtcatgttccttgcattcaccaccttttctttgtttggtcatcggcggtttttggttgtcttcatcaggttgggtgagggactagtggatctccttctctcttgacctcttcctctcctcaacctctctacgtgtggataactgaaagctttttgacgtctttcttattgagtcggtgtttagcagagcatttgtaacctcccggttggccaagtggtgattgatcacgcttagcggcggtcggcttggtgctattgtcctctctagggtgtgctacgaggagttgccagctcttggtggtggtgtgtttgttttcatttgtttttcttggttacgacctcgtagggttgtaatattgtaactttttcttgctatactaatatgaattttgcattgtctagcgtgaatcattaaaaagagaatctaagaaatgccattgataagcatccaatttcaagaaataccatcaacaagttcaagttccatgaaataccatcttacaagcaattttatcctagaaatgccatcatcattaggattccgtccatcccgcgccattaaatacattgtaacttgtaagtgcaagttttattattgaaagaatagcgtatgtgactacgaggagtccatggaattgtcatcaactataagagctttcataaagaatatagacagagttatccataaaataaaggggttgtttggttttcataaac

SEQ ID NO: 66077 - DNA, 10787 bp, Oryza sativa
ttagaaaaggtgcaaaatttttgtatataaccctatgcactaagccaaacgagcttgcgagcggctcgtgaaccagctcgggcttgactcgtttttgaaacaagctaggaaggaggcttgggctcggctcatttggctttcgagccgagccaagccgagctataggagcccgaactttttgtccacccctactctcagctccgcaattcccagtagcttttaatataaccgattaaaacagaagagagtaagttggaacaaccattagagcatctccaacagtctctccatatctaactctcgaaatgtctatttggccaagtctccatctaatttggcaagtcaaacttatggtttactccaacagcatctccattcaccctctctattatgaatctacgacagtgggacccacatgtcagcctctacaaccctttcttcttcctcatacttccttttccccacgctctcgtctccgtgctggtggcactcctctgcgtggcggcggtgtcgccggtggaggtaggggtggcgcggttcgtgtgcaacacctgtttctcctctctctccacgccgccatccacgccggcgccctcactgctctgcatctgattcccttgcctttgttccagcggggccggggcaaccttccaacgccccacctattgcatctgcgccggcaacaccctcgacaccatcgccaggggcgtctccgctggcctcgtcccctaccaggacatcgctgcgccagcaacatctccaacccaaacaagatcgccgtcgcccaggagctctggatccctgtgcctgggtggacctccttcccgatggtgacggcgagctcgaggaaggatgcaagcaagcgacgacgcgcctccttccctatgtcggcagcaggcacgagcggaggcttcccccggtggtctcgatgcaggaaaggagttggaggcgcccaggcggggttcggcttctccaaatgctaagccactaccgccattgttgtcctcttgtcccatcgacgtggtagatcggagcagcaacgggggcgacgatgaaggccaacgatgggggcggctatagggccggcgacggagtccaagacgaagacacctcccgctccctccttccttagctcggcctaggacgaggcaacgacggacgagggcgtaggtagtggagacagtggagggcggcgatggatgccgccacagtagccggtgtccagatcatggcacgggcgatggctgctgcacgcgctcagcaatgcctcggatgaagggtgtgcatggagaaacaggcgtggctcccatggatggctagccggctttggctggccaaactagccggctttggctggctaagtttggccagcgaggaagcagtttggatggcttggccattcaaatagcaagcctgttggagtacaattttagtctaaaattgccaaattttgacttgtgggatagcaagactcttgaagatgctcttatagctctacaatttctgaataatccttgaaagctttaacaaataagcatattcacacgactgatacgaggattaagtgcatacaaaatgagaaagccttatacattattaattaagtttaattattataaattaaaaaattagattatataatattttagaagaataacttttataaagttttcatacgaaatactgtttagtggtttgaaaaatatgttaacaaaaaccaacccagaatcaggcgtgagtaatcttgagcggtttgtaacatctatataaaaggttttctcataaatcatgtgttaacaagaaaaaagagcgcatattatattagcactctctctgttaataaaaaacttaacttaaccaaggacaaatgtgacttatcttagtagtatagtaaatataaataaaaggttaccgaaatttattcgagaatgctgggaatcggtaaccggcagggggtgggggtggagcaaaatacgcgcacgtgccttcccccgggccccccacatgtctctgctcacctgccacgtgtctccaccacatactccgttgcaacaaatcacccacatattttggaaatgctctattaagggaattcgtttatttttttattccaaaaaaaatgtttcacctagtgcattcacaatgtttgcccccccccgacgcgcacatgcctcccccgggccccaccacatgtccctgcccacctgccacgtgtctctaccaataaatcacctacatattttggaaaccctctattaagggaattcgtttcattttttgttccacaagaaatgtttcacctagtacactcacaatgtttcactatatataaatctaaagttgcagtgaattgaaacattctttgcaacaaatcagccacatattatagaaaccctctattaaggaattcgtttcatttttttccacaaaaaatatttcacctagtgcacttataatattttagtatgtatggattaaatctttcactatttactgaaacattgtatttatataaggtgaaacaacgccctatttaaatgactgaaacattttcgatctacttagtgaaacaattccgatataattggtggaacaacgtgcaacatttaaaaataattcaataataaactaattttttcatcgaaatatatccatatatggtcttgttttaaatatttaattgcaacgaatttaatggtgtaatcggatcatgatttagataaataatttaagataaaaaatagtttaaagatttaattgcaacaaatttaatagtgcaatcagatctgatttagataaataatttaagataaaaaatagttcaaagtagttttggatgcatgcatgctgatgatgtcaggctgatacgtgcgtctgattttttctatctccatcgaaaatccgacgcgtagacgtctcccatttattatattatattagaatgagtcacgtttaaggtaggttgaattttgttcagagaaaagtaccagaaactcatccgtgagtagggcctacagagccacagcctacaaggcccatttataaaattctccaaccgggggcccatccatccatccatcctcgacaccaccgtctccgcttccctttccattcgcgccgccacctcgccgtcgcacccagcggcggcgccgccgtgccggaggagcggcgatgtggtgccagtcgtgcaaggaggagtacgaggaggaggacgccgggacgtgcaaggagtgctacgaggaggcgagcgagacggaggaggagctcaagcgcgagatcgacgacctccgctcccgcctccacttcctccgcctcccttccccttccctcgacgcctcctccctctcccactccgacctcctcctccacgccatccccgccgatgcgcccgcccgccccgacacccccgccgtccccgcccaccgcgtcatcctcgtgagtcattcttgcttcacttttttccaatcgattagtcccaacacgtagctttctttgttcatgccattcttgacttctcatgtgctagtgctcaattaagtttgtggactactatttgccagattgatctaggattgatgttccggtagccaactagttcatgattgattatatataaattgggggtcctgctggctacttagcggcaggtcgctgattttttgctggcttaaatcttgtaacccagagctacccctgtaaggatgaacttcgtttcattctgatgcctctggtcttcttcttctctagattgatttggattctagaatttccctagccataaccattgtttgcactgcctttgtttcgatgtagcctgatctgtgacgtacaaatttctctttccacaaagaacaaagatatgtatgcattatatactaggacatgtttaattgagatatagagtgggtaatgtgttaatgtctggcttaatattgttactttgctgtaccactgcaagtctgcaacaacatgttaaactagtctagtaactaataaaggagaagaagctgcagaactgtataagtgtgcagattcttcttcgcatgtttttagtgttttgagttccttttctttttccaatgtgttggtgctacttgctttgaatgtgtttgagttgaactcaggcatgttttgcaatgaagttttactagcagtaaaagacattatctagcaagtaaaggcttaaagctgatatccaatactccaatgtgatgaaggaggttgaatttcactattttagtgtctcaataacattgcatgttgtaaacagtatgacactgactaaaactattttgagggcatgtagtttttgaaggcatgaagcataacagagcctggacttcaactgtgatcttacacttatcactgttgatggacagagtttaagtggcttctaaaaatgtaagctgtagggtaaacaggaaaatatgcttctcggtacatgtgtattccaatggttattgactggatgtgacaaaatttgtataagactgattttgttcctaagaaagttaacttattatggtacaataataagctacaaactgtagcatgctcataaatctcaaatacagtcactttaggctgtgttcgggaggtgaggttgggaactcacctcccgtgcacacaaaacactttaggctgtgttcgggaggtgaggttgggaactcacctcctgcgcacacaaaacggagcgacgcattttcttatgattaaataagtatttgttattttttttttgaaaaatggattaatatgatttttttaagcaacttacgtataatttttttttgcaaaaaacgcaccatttagcagtttgaaaagcatgcacgcggaaaacgagggaggtgagttgggaaagttggggaaagaactcagctggagtagtacaatgagcaagcaatggcaagatatcatgttaacatggtaaaagagtcatacttgagtctttataagttattaagacttcatttatctagtttggaatgcattcgcccatcaataccttgacaatttttgttgctcttttttttttaaaaaaaaagtccgcattaattgtataggagcatgcatttgatcaagtgaagttgcatagaacctattttcttatgatataaatcaataaataacagatacgacaatatatatttttgagagtgtctatagtacttgcataccaatttatgtatctaatgcacaaatggaattaggtactcttctgcttttatgtttccttttcactttgtctttgctcttttgatattccaaaagtaatttccatgttgttagatctggaaagataactttggcaatgatgatccatatatcattcgcctgtagtgctgttatgataactttggcaatgatgatccgcatgtaatatttgtaaccttgtaaatatttcctttttttataaaattacactgctgggcaaagccctagcagttttcctggtaaaaaaaaaaagatctttgatgggagttcgaactacaggacatcacctgcctcacaggcaaacatgaatctcccgcttcttgaataggcaccccacagtagctactgctggttggacaacaaggaatattaccatgactatacaaattttggattttgctctcagtgagtggctttagagtatattcatagaggctttggaaaatatgtatttttgaactcgacgcaattccattcagattccttgatctgtcaactgtactgattcagtatttaacttttggctcatatgtaatgcatcatatctgttgtattttggcaaagatacaaatagctttattccttgttcacagactttcaattatatcatcgttcttctaatttcttagctagctattagtatgttctgtagttgatttgcttgagatatttcgcatttgtgaattagttgcatcttactgatgcacacggactagtttctgctgtagaatttattttattatccattaaactgagtttcttctctttgaaaacaggccagcagatctcctgttttcagagctatgcttgagaacgagatggaagagagccggagtggcatcatcaaaatatacgatgtgtcctacgacgtccttcgtgctttcgtccattacatgtacacagcagaagctctccttgacgagcagatggcatctgatctcctggtgttggctgagaagtacgaagtgaagaacctgaaggcctactgtgagaaattcttaacatccaaagtgagcaacgacaatgccatcacgcattatgcgtttgcgcatcgccacagcgcgaagcagctgctcgagacatccctggcagcgatcatggacaacatgtcaacgctggcagatcgggaggaatacaaggagcttgttgagaaggacccaaggcttgttgtggagatatatgaagcctatctgaacagacaagtgaacactgctgctgggaaggagacagattccagtagtaggaaggggtaattcaaaagaaaactgctatcagagatgtaattaatgttctaaccaagcttttgcatgttcatgctaggcaaagactggcacatcaaattgtcatcctgcggtgtaggcgcagaacagctatttctgtatatgcttgaattgatactgtgtgctcgctactgatagaatgagatctattgccatctttatgtaacatataggtcaactgatatgtgatgatcatcaaacacactcagtatgaacaaaaaactaagtgtaaactatttgcaacgttgaacggttaaattgattaccagggctctgtagtgatttgtgcatcgttccgagagtgcagaacattgcatgaaccggactagcttctactaaccttgatcgatttctttagtgttcattgccatccctattgctacgttcatgcacgtttcatcggcgttgagattaaaaagataaaatatgttccaactagctgaagaacatatattattcggctggttgccaaatactatgagaaagtggtcttacatttggtgaatatttgaagtctcgacatttgaaatagggccttgagctctcaaaaagccagagataagttgcatgagagagtgctaaatgacagttaaaagtggtcccactcacctacatcaattatacttttttacttgtgatgtataactcaaatagagcaaaaaacaaaactcataattaaggactattgtaattctttgcattttcctccattaaccattagattgaagttgccattgtctagcagtaacttttctgaccttcgataaatacaaaaggctaacctttttcttttctaaaagaccaaaaggctacattttctgaagagaagtactccctccattccaaattgatctacatatagtttttttgaagttattcctaaatgatctacatatttgtgttcatttattaagtctattcgttatttgtacattggagtaaatagacattgatgcatgcatccatgcatacaagtatttataacccacatgtaatatcttaatttgttattggctaggaaatagtgagaatgatgcatgcatcgagtttgttgctagagtaaatatagtatgagagatttattagtttttcttggtcttagtataccatgaaatatgtagatcaatttggaatagaggaagtagcattcaagtttctagtgaaacaagctgacaagatccttcaatcctatcatattaaccagggattgcaggtttgcacaagattgaaacaaacaattccgttgtctgcaaaggctcctttgcgtgatgagagaaggtctcatccactgaaaacatcaattacaatttaatataatgatgttgtaatgatctgggaagctgcacttatctgaaaccagagtgtgacgtgatagcctgagtaaatcgctaaagtctaccaaaagcatcaaccattaagatagccagttcaaattaagtaccaaatctggtagctccttgatcagacattcactcctatcctaatagtcagcaaacagttcagatagctgatcatctgtccattcagttacagaagccatcttatttggctgtgaatgcaacgatgcactgagagtagttgcatcactgttacttacagagctattttcttgagttggcaggacaatgcccaaagttccagtaatgaagtccttttgctgatgctcattgggttttttgattgaagcgtgctcaacaagatgtgcgacatcatccagaccaatgtttagattattggctaacccataggtctcaatattcgtacttgacataacattatctggcaataccgcatcacccctttgctttttgctattagggtgcacccgttcaccttcaagaggtcgactcagcttttcatcagaactagctgcaatagaatttcccgttctagacatgaccgagcatccacctagagtagactgggaacatcttgtgtttgggttttcaggatcattcaaagtttgctggtgatgctcttcaccattgtggtttgatatatgcctgctgctgaggcgctgcatcaatgtttgtagttcaatcccttggtgcttacctgaactggaactagttttttggaattgctgatcggcactgtagcttggtgtattcttgtttgaaggatttatatctttttccttcatccttgtatctaggtgatttcctacaccttgagtactgccattgtccattcttaacgtactatctcgaacagcatttcctgcataattattatcagaaagtacatcagcaatcctatcatccctggtacttaagatcgtgcggcagatacctgttgtttgtccgtatgtttcaactccagttttcctgatgcggttatctccttggcatgaagaatcccgtgtttcttgacactttactgttatggaatacatgtaacatattattgttcttaagagattaatatagagaaagggatatgaactggaagttaccaggatgttgactttcagaaggacttgatgaaaacacttgcttagatgggaagcagaagtcctttggcacaagctgcaaatataaaaacattcataccgccatgtccttaaatgattatgatgttaatttaaggaacattgtaatggcagttcaaaagtaccattgtgaaagttttgtgaaatggttacatgcttctaaagaactgagacttgaaatacaagtgaatccaagtaactctgctgataatgcaaaggcttattcttgattaacacaaggtctgaagcatgaaaggcctaaatatgatggttaatctgaaggacaaacatcctcccagccagaagttttgatttatataattacatgtgcaagaatgtttggaagatctaaaatggtaaaataaagtatgattttttcatcgatgaacaatgtggctatcttgaactaatggtgtattttaacttcatgaaagttttagaagcaataaaacaaacaacaggatcatggaattgtaggatacctctctaccattttcactcaaaaaactgagaaggaaaaacagaagacaatgatgattctttacacaagtaagattcacagagtgccttcttttcatcctttactgatgctctagtatcattgtattatagctgtctacttccgtaacattatgtatcagtgcatcttatattattttcactctactgtgcagtgcacgtatagtaataatggcaattattatactagatagtaatataaagaaatgcaaatagtaccatctctagattttctttggtgacattaagatagcaacccttgtgagatggacggaaaacagctacctgaaattaacaatgaaccaattactccatatactaagttagtttgccaacaaaagaaatcctttttcaccacaacaccttacatttttcagaacaatgcaagaccctacagatacaaccatgttatcctcctttgtaaatactttctggtgaactgaagcaccaaccgtaccacttggatcctatcaagaataactcaccattatttcccaatcagttagcattcaataaatattccgtactcagattgtaaagtaatatttatggctttcggtttaattacttatctgaatgtctcttaatgtagcccactctacatgtaagatgcaaacatgaagagatgcagataatgcaataagaggtgataagtaatcagaagaaaaccaaccagtacatcaatcaaagaccaaagtccctttttccaattttaacacgagctaattcccgcatgacgcgaacatgataactcggccaagtagggatgcaaagtgggtagtcccgctacccgcataaaaacccgcttgctaattcatttttcatatggcagtataaaatttagaagaaaaaatgaactagaagtgggataagcgggttaaaaaccccgcttgcccgctccgcttgcatccctacggccaaggaatccaactcattccacagtacacacataatcatgccatgatgctttgtgttcgctcaccttgagagaaaggaagagatcaccgagcctgttcggcgcgcacgacgtcaccacgccgaccacctgatcacaaccaaacgccccaagactaatcaagccatcagcaaagacacgcacaaaactagcgaaacaggtagagccaggagatgtccacactccgcacgcaccagacgtgctcgatacaatgcccggtcgccacggatggccgcgatctcctgccgcttccacgcgcgcgcctcgcctgcatacccacgccacgatgagcaaccgaaaacgcaaaaccaaacacggaatgtctgat

SEQ ID NO: 66078 - DNA, 3347 bp, Oryza sativa
ttctaacaagttgttgcatttatgcgatcacttataaaattcttgtactaaattgcacgtacatgccaaggtgttatactaaacgctcatttctcaagttcttacaccaaattgtacccacctgccaaattgatacactataggtgcaatttactctaaattttacatacaatagttcaaattcaatactaccgaaggttttggcactaccaaaattttggtatggcaaaaattggttctaaaccaaacaagccctattccatattagtattatcagaaaaacggacagacggaatccaatggggcggggggcatgagagcacgggatataaaagatgtgagcgttatcttccatattcgtttctcccatcaactcatttttctcctccaccaagcaacaacgctttgccttcctcctccctccatccactcttccatcccagtgatcatcctcctctctccctcctcgactcaagactattgtctccaacgctgacgacatccctatcctcttttcttccttcctataccggatccggagcatgtgacggagtggaggttggagagggcatgagagggagctaattatggctgtgaggtttggggattgtcgtgtctcatgtgtgagaaggaaaggtcctgggaaccgacaagaagagggatgcagccggtctcgatgtatagtgaccgtggagttgatgaaatggatgagcggtcattggttttcttcattactcatcactgttgtatacaggtacgttgcaattgatacccttggtatcaggggattattagtaccaaggtctggtaccccagatatcatgcctgatacctaggtactagggtttggtacctcgagtatcatgcctgatacccaggtacaagcctaccagggtctagtatctcgggatatcgtgcctgatacctcaggtgctaaccgatacccatagcaattaggtctgatacctgtggtatcgagtagagttaaggcgtggagaaggagagcgcgttgtcgtcgtttggctggccagtaagtcaactgttgttgtctcatcttctcttctcccttcctctcatcgacgccttcctccttcctgtattgttgctatggttggtgggggcaaggcgctaggggttgccgttgcttcaacgttggagcttgaccatggttcctctttgctatgtatagcagcttgaaggttttatttactatgtatagcagctgaatggttcctctttgctatgcacgtccaggctccttagtccatatatttggagggcagaaaccatcatcttcgtgcactccatcattcctacgaacactcaaaagcataggctcatctaaagtaatttgattatttaacacaaggttagcattcacctgagagtgaatttccttccccaattgtttggctctgctccttgtaattggacccactatattagatgcacttttattaggaggtggggaagagtggctactagggatgtcctcatcagcctccccctcttgagaaggagtcgtcctcgactcagactcaccaacaaatggacacaaatctttgacattgaatgttgcactcacattggtatattcttgagggagctcaattttgtaagcattatcatttatcttctctagaaccttgaatggatcgtcaccccgaggggataacttactcttgcgctattggggaaatcgatccttgcgtagatgcaaccacactaagtcgccggcttggaaaataacagttttcttacccttgttcgcttgccttgcatattgtgcagttttcttctcaatattcctccttgtgtcggcatgtagcttcttaatgaattcatatctcttggcagcatccaaattcacctgttcctgtaatagtgaaggcaaaaggtccatgggcgtatgtggtttaaaaccataaacaatttcaaagggacaaaatttggttgtggaatgtactgccctgttataagcaaattcaacatgtggaaggcaatcttcccacatctttcagttctttttcagcacagcccttagcattgtggatagagtatggttgacaacctcagtttgcccatcagtttgtgggtgacaagtggtggaaaataacaacttagtgccaagtttaccccctaatgtcttccaaaaataactaagaaatttggtatcatgatctgaaacgatagtctttggcactccatgtagacgaactatctccctgaaaaacaagtcagcaacatgtgatgcatcatcgctcttatgacatggaataaaatgtgccatctttgagaagcgatcgacaacaacaaaaatggaatccctccccctctgagaccgaggttacctcagaataaaatccatagatatatcttcccaaggtacatttggaatagataatggagtatatagaccatggggattaagacgggacttttcaaacaggttatgcaccgctcaacgtgtcgctggacatcacgtcgcatatgtggccaaaagaaatgatcagaaagcatgtccaaagtcttttttacaccaaaatgaccagccaaccccccagcatgtgattcctgcaaaagaacatttcgtatcgagcaagctggaatgcacagtttgttagtccaaaataagaatccatcatgcacatagaatttgtcccatccttttccagcaatacaattagagaaaggttcgttaaaatcagggtcattagcataaagttttttaattgattccaaaccaagcacttttgtatctaattgtgtaaccaaagcacattgtctagacgaagcatctgcaacaatgttatctgtgccacacttatgtttgacaacataggaaaatgtttcaatgaactcaatccatttcgcatgtcgacggctcagtttgccttggctttgcagatatttcacaaattcatgatcagaatggattacaaattctttaggtaataaataatgttgccagacttccaaaactcgaactaaggcataaaaatttgtgattagaatggattacaaattatttaggtaacaaataatgttgccagacttccaaaactcgaactaaggcataaagctctttgtcatagacagagtagtttagatgtggaccatttaacttttcagaaaagtaggcaacatgtttaccttcttgaagtagcacacctccaatgccaataccacttgcatcgcattcgatctcaaaggtcttaccaaagtttggtagttgtagcagcagtgcttcacaaagcttttgttttatctcttcaaaggcatggtcctgttcagctccccacttgaatggaacatcctcctttgtcaaattgttaaggggtgtagcg

SEQ ID NO: 66079 - DNA, 6656 bp, Oryza sativa
catgtgggccgcccggcacggcccgaccgacgcaccgggccgtgcagtgccagcccacgtgccgcactcacagcccaggccggcccgaaggcacgatgggccatcgtgcttttcctcagaataagtctaaattttctccctcctattgggctgtgacattgtatagctaaaaaaagtctattttacctccctcttctttgtgctgtggtatataaatagctaaaataagtctatttaaggtccctattctttagacattgacatttatatgtctatttttattccctatactttgtgtaccgggtctggcctgccagcccatcgtgccgggccggcccgaccgtgccgggccagcccagcgtgctggtggggaggcccaggcacggcccgacagtcgggccgggccggcatgggcccgacccaagtcgggccgtgccgtgcttgggccgggccaaaaaggcgtgccgtgggccgggccttcgggcctcgggccttatggccaactatagttgaaccactcaattcatctaacatgtcatcaagcctaggaattgaatggcgatatctaacagttatagcattgatagcacgataatcaacgcacatgcgccaagacccatctttcttagggaccaaaagtacaggaacatcacaagttgagagagattcacgaacatacccttagtccaaaagctcttttatctgtcgctgaatttcttttgtttcttcaggattggtgcggtaggttggacgattgggaagagaagcaccacgtaccaaataaatttggtgttcaattccgcgtatgggaggaagtctagctggaacctcattgggaaaaacatcctcaaaatcctgtaataaatcaagaacaacactaggcagcgacaatggtaaattgttagctgaaaataggacctccttgtgcaagagcacaaagaacgaggctatggtgttcctcacttctctcaaatcactctttctcacaaataaaaaatgttgtcgtggcagttttgtattttcaggaggctttatgtggctggatggtttaggagtctctcccttactatttgtgtggctctctcataattttcttttctcactctcatctcttttcatgcgagcaacatcagaagagcttatgtcttcaggagataatggaacaagaaccaccttattctctttgtgaataaatgtgtgtttgttcgactggccgaagtgcacagaatccacatcaaattgccatgggctacccaaaagtaagtggcaagcttgcataggaacaatatcacaatcaaccttatcatgatagtcaccaattgagaatgacaagcggaccatagatgaaaccttcacagtccctgaattattcaaccattgcatatggtacgggtgtggatggcgacgtgtttgcaggccaagcttctcaacaagcaaggcactaacaatataatattgttgcagctctcaccatcaattataaatttgcacacctgccgtttcactttgcatcgtgattgaaacaaattatggcgttgcccttgctcagctgcaactaattgagtagaaagaactcgtcgaaccaccaatgactggtctggtgcattcaaactataagcacgcacggtggaagttgtagcagacccaaatgaactatcatgtcggggcgaaataggagcctccaaataattaatatcaacaagcaaatcatcaaaatcggcactagtgatttcctctggatttggaggaattatacgaaaaaaagatcaaatctataaataaatcatatggagaaccaaaggcacaatgctgctgccgaccagtatatactttgcaattacgtaaaagaatatatatatatactttgcaattgccgtcttttggtgctttatcttcgtaaagcttttgttccggcggtttcctaggagcgtttgttccattttttctgctacactctagtggagttatatagaattctttgtttcggcattgtgagaaaaaaaaaagtgagaggttaacggatggcactgggacaacctagcaaaatcggaagagaaacactcccataaatggcatctcatagaatttgcatttatcaacaaaacaacttaggatattcacaatataaaaataggatcggtattaagccttgtatgatctacttatatatattacggaagtggcttttataaatgtccttagtatgagctatccatatgcatatgaactatctgtatagaataaattaagtaatacatcgatctctactcccatctctctctccttctaatgctacaatggcatgatatacaatgaataatgcaatagttaaagctaatatgtgtggaccccatctatatggattatatattttgttgatgctctacatagattccatcaccaacgataaaacacataatttatccaaataacaacaacaacgagaagaattaatcatcggtgtgatgatgtattaataatgctggagcacgactctacgcactatactcgctacaaacagttggattttcaccaatgtggcctatatatcccaggtggttaattaattagtgacattaaaaacctcattatatatagaaagccaaggcgatgccatgagaagaagaaaaacaagaacacacacgtttcaattccatcggaaagaaagaaaagaaaagaaaaaaaaaacaagaacacgctgacaccataagcagtacgtacgtcgatccgtttcatccgtctgggtacgtcggtgatgatcgatcgatcgatcgatcagccgcggcatttctcttttgctatgcatggcctcttggtaacggcgacgcccggtggaggcagcttcgccttgaggttgccgtagtcgaggtagccggtgcccgatttcgccgccggcgagtcgctgctggacgatgccgcgtcgacggtggcctcctgcaggatcgccgccagcacgacgcccaccagcaccagggccaccatagtgcccaacctgcagctcatcctcaccttcgtctccatggaaaattggtgcccaaaaaactactaccaacaacaacagcagctagcagctgcagctgccttcttatgccttattttttttgtgtgtaattattgaatttctcttatgtgttttggaggttgatgatggcttgctgggagagccctttttatgggagactgtttgcctataaatatcaacggcggggctgaaatttagagccggattaaattataactagtcacgggctcgatttttagcttgtactaaatttggtgatcggactcgacacagggaataaccgatgacctaaatttaattataactagtcaccaatatgtatatttgcatggccttagtcttggtactgtttttgggaaaaaaaacagttttagcatgtggccggaaaatgacttgccacactgcctgtgatttaaggcatgtgaaaaaacaccttttgcagatggcggacggccgcctagcggctatgttagcgttatgggactatctacacaaaaattcacagtagtgctgaaactaatttctataggtcctcaaatgcataaccgaataaaaagcgaataaaaattcacaacacaaattaatagaacaaaatattaaaatttatagcacaaattcatgaaactcgtagcagttgaagacgtggttcgatcatgttgctgcatgaagggttccccttcatgacctcatccacctccgccgctgtggacggcctctcccctcttctggatccgcacgccaccgccatggacgacacctcctaatctggattcgctaagtcctcctcatagcctttatcatatgcatttacaacccactagtttgctataaaattccatgtacattgaaacatattatcttatgtttggtatataagcatattatcttatgtttggtatataagcatccaagtatcatatagaattacaatttcatattaaccactatagaacgcattatcaaataagataatatgagtacacgagatgattatcgagtacacgagatgaactggtgtctagagccgtgctaactaaaagactgctagcacggcttcagacaccagcttggccggaattacatgatgttgttcagacaaattcgataatcatccagcaaattcggtaaatgaacgaagcaaaaggccggcagatgcaacaccatgataaagagacagcaatacggtactgtacattccagttttcttctactacctggtagtagattgcatgatgcatctaccaatttcagtccttgctcttttcggtacacactccattgcaggcagcatcatcagttgtcctggagcactcggcagagctgagctcccagtgccggcagcgtgaccggtttctggaccagcccgttgatcccggcacgctggcacagctcctgcacggcgccgccatcatcggtggcgacgacgccagccgcgacggcaatgacgatcagcagccagcagctgttcctgagctccctgatcctgagggccacctcaaaccggtccatggccgccgagggcacggcgcgatcgtcgaggtcgaggacgacgagctggaaggaggcctcggcgctcgccaggaggctcaggcagtgggcgcccgacggcgccgacatgacctggcacccaagcctctccaggatcttcttggtcaccccccggttcatggcgtcgtcgtcggcgaggagcaccctcaggccgttcaagtgagggatgtacggcggggatgcttcgacatgtccctgctgcagcttgaactgcaggatcagggtgacgctctctccgacgccctcggagtccgacgccgaccacatgttaccattcatcatctgatcaagtaatacataaagtaaattcatttgtttcctcggattacacaactcttacaggtgttaaagaacctataattaaactgagaagttttatcaacaaactactgataagtgatgataattctagcatttccagaacgctttctgtcggtgagtcagtgtgtgttaaacaatggctgtgttaaacaatgggatatgtaggtacttgctatgtgcttatcaacagaggccagagagatgtcaaccatttctattacttcatccgtttcatattataagttgcttgatctttttctacaaagtttgattaagtttatactaaaatttagcaatatctaaaatattaaattagtttcattaaatataacattgaatatatattgataatatgcttattttgggttgaagatgctactatatttttttataaacttagttaaacttgaagaaaattgattatgaaaaaagtcaaacgacttataatatgaaacggatgaagtatttaaaacagagcataattgagtacagtaaggcagcaaaatagatttggagatctgcttccagtacttgtatgagagtgtattgtgagtgatcccatatacctgcacaatcttgttgaagtagccgctgaagatatgccccatctgagagctggtagtggccgcagaacgacgaggcaattcgcacggcaaactcctctcaatagcacaactcctagatctcccgatcccgaccttgaacttgacgcaaacgttgcaaccggagaaggtcggtcgcatcgggatccagtcaaggctatacctctcttcacccacattgcagatcctgaccgagaacgagaggcggcacgccccggacccggtgttgcatcggttcagcagggtgcccaccatgtcaagcagcaggtggaagaccctcctctcgtcgccgacgacccattcgggcagcgcgcattccggctggtgcaggaacccagctcccccgcaatgagacaggcagccggcgacgctgatggcctccttgatcagcgcgtgcaggctgaagggtttcctctgcacggacaaatgctgccggttcacggtcacctcgtccatgagcgccgacaagaggttgcttgttcgggcaatggcgtcgacggcgagcctctgctccggccgcattgtgtctgcctccggatgttgcagcattgagaccagcccgactacggagtgcacgggccttcgcatggcgtggcacatggcgctctggatggagctgaacgccctggtcgccatggcggcccggtgcttggcctgcatcagcgctctgtgctgctcggcgaacctgtcccgcatcgaccgcgactcctccagcaccgcggcgtgggagagcgcgacggcggcctggtcggcgacgacctggacgatctccaggtcgtggctgctccacccgccggcggcgtcgtgggggggaagaagcagcaccaggatggcgtagctcgcctcggtcacctccggcgtccctcctccgtcgtagatggacaccctgaggatggggatccgaatggcggccaccgcccccgccggcgccgcgccgacgctgctcgccatggcgagcgccgagtccggcccgagcaccttggcgaccttgctcgccattacgtcgaccacgtcggggtcatcggcggcgacggtgcacgcttaaccaacctccagcagcaagtcggccgcttcttcgggccgggaggtgaggtgatgcaccagaacaaggtcttggggccggccggcggcggccttccaaacggcccaggcttgtaggccaa

SEQ ID NO: 66080 - DNA, 6408 bp, Oryza sativa
gagcaccttggcggcggtgagcgccctgagcagcggggcggagtgcgggtgggcgtgcgtgaacgcggcgaggaggtgggtggcgccgcagaggacgatgaaggcgcagaagtggagcacggcgcacttgacctcggacaggtcggcgcaggtggcgaagtagaagagctcgagcgggatggagaggaaggacgccgcgatgagcaggtcgctcacgcgctggcactgcatcagcgcctccaccccgccgtcctcccgcatgtcgcacgcgccgccgccgccgcagcgccgccgcccgctccccagctccgccgccgacgccaagaactgccgcgccgtcaccatcgccatcgcaaccgagagaggaggaggaggggagtgaggagggcgatggatattggatgggagggcggcgcgtggaggtggtggagaatcgtgcgagcgtgagcgggtgacaagtgtaggcaatgcagcgcctcgtgctgtgtcgagtggtgggagagacaagtgtaagggatacccttgccgctgggcacgcgggcaagggaaggcagaggccggtggactggacagttttgaaaaaaacaaaattggcgcaaaagattttgaaatggtgtttggtttgcctcgtgagatcgtgtcatccgtgtctccgcctctcaggcagcggcgaagccacatgagtattaggggtggaaacgagccgagccggctcgcagtgggtcgtaataaattagatttggcttatcttagctcagttaagaaaacaagctaaaacttaagctcggctcgactcgtttcctggctcgaactaaactcgagccgacttgcatgccttcctattgaaacacctcttcaaatatattttgtaattattaaaaaaaaataagaacaaatcatcaacatataaaatttaagtttatatattcaattcttcaaaatcttaatgataaattttaagttgacaaataataactccataaaaagtaaaataatggatataaacatatgatggcctagctcgtgagccagctcggctcggctcatttaagcaacgagctgaaaaggaggcttggacttggctcgtttggcttacgagccgagccaagccaaccaggctcgagccaagctcgagctttttttccacccctagccacagaacaatgagctaaattaataagggtttaatttttttcataattacataacattttttttaaatatataatgagagttatggggttaacatagggcttcaaccttagctgccctatgcctattaacattcttggtcatagaaagcaaaaccaatggagagtatctacgtgttatttacgagtagtttggaataaattattaactgaactattatagtggactagatgtttgcagatcagatggtttcagactatatccgaacccatggtcctatttggtttcattgctagattgactcgtccactagattgacgagtttctttttataaaataccagacaacattagagcggctacgactattagccagctataaacatattttaatgagataaaagataagaagagaagcgggctacagatctgtagccagctgcagcacggactccaagacaaaatgtgtgtatgacgggtgtgtcgaggagtgatcctctctagcgggagatcgtgagatccccttttgtgagttcggccgagggaaagggttcgcctctcgagatcgtatatccgccctcagggtttctagatcgcgtgccggcgacaagattatacaggttcgggccgctatggagcgtaacaccctactcctgtgtgtgggatttatggttgagtgttacaaaggttcctcaactccgaagagcgctcttggtcttctccttctagagctcaggcctactgagtgtcgtcccttttctcggtgggcaaggtcctccttttatagttcaaggggataccacatgcgccggttctacctactctttcacgggagggggacccactttacctcgaccgggccacgatccgtgccttcgcccggaagctaagcagcagtctgtccttgagcgggacccagcgccaccccccgcttgacacgggggacaaccctgtcattccctcataaatgagtgaagacttgtggcggtcctcctcacgtggagggaactccgaataatactctgatgggacgggacatacctgcctccactccgccggagacagagacggacgtgggggcgcggccgcctgtcgaatcggacgtgaccggcgataggccggtcacagtctggtcacacccgattgacgtgggtcagtcggacggcaccgcacgtctgcccttagcgtattaaatgcggtgagggacagttggggcgccgcgcgcattgatggcggttcagcctgggtctcctccccgctcgctccccccgccacatggcagttgggcgagggcctcagggcaaggcagcgcgagggcccgaggggcgtgacgtggcaccccgaggccccctggctgcttctgagactcgcgaggcgcggggggagggccaggctggagagccacatggctggatgggaaggtaactttccctcacttggcatacccccgggcccatatctccgacaaggtgggaccatatattaatagtagctactattgtatactagtaatcgtgcacatgcaaggcacgttttgacagtatatattagcaaacgaagaagaatctatgcaatcatttctatgcaatgcactccatataaattcttctagcaattaagacaatttcacatagactatactaacatgacaatttggatggttctctataaaaaccactattttgaatcactacttgcttaccaacgaatgtaaaagtatttagtgggacaaacacaatttatactgtgatgctgctaccttttgaaatcaaacaattaatgatcgaactctgaacaattcatggggatagcagtaatttcataaaactgaaggcaatatcatctagctgcagcaatattctaactttaacaccaatcttttcacctttttggaatatgacaagtactgtatcaagaagcaatggatattattaaacctacatataacatgagacttaatgcatacacctgaatagtgaatactaaccaaataattaaattccaaatcgcattgatttgttgtgtgggctaaatcatccatatgttcagaccgatcgatttcatgaggttggtacaggatcaataaagaacatgttgcgctgttaaaattattttgaaataacttaagaattgagtcaccaacataaagtgagcattggcagtcatcaactgctgttgttgctagctgagaaaattgccacccattgaacacttgctggatgaaaagaaagtgaggtttggacgaactcatcagaaacacattataaactttcaatgattttagatcctgtgagttgattaccaacatgcgaggaccgtactgctgaggaatagagagcttgagatcctcaatccaaacagggtcaagttggctttgatcactgtcgccactaagattcctggcattccaacggtccagttcagaggaagaagcctgaaaccagatatagctagctaggtttgtcatttcatctgagcaatgcatatttgtatcaactatggctagcgattattgttgggagaaccaaaaacatacatacatacatacatacatacatacatacatacatacatacatacatatatatatacatatatacatatatatatatatatacatatatatatatattcttggacaacctctcggccgtcagctttaagcttaccacaccacactgcgtggtcggtatgcgaacatatcgtaattaaaacacacaagtattaattcagaactgcaaaaattttcatacaacacactggataaagactgagcagtaatcagataaagccacaaaagaagggtgctgggtccactctctctatctctctctctctcagatttggggataaaaagaaacaaagagaatagtaagagagtatcatcctctaaagaaaaccctcaaaaagtagaataataaatgtggcccttttttaatgcagcactccatataaattcttcacgtaaaaaattgagtttcatagacttgttgaacacaacaaaccttcaattagcaaccagctgatcattagagcatgattaagaatcaagatatgtgtgcagcgtttcagggtaaatatttccaatccacgtaacattgcattgcaactgatggttacataataaattttgtagaactgaaaaaaccaggtcataatctaatacaatcaccttaaggaggtgcagactgcagcctaatcactcctttattttttatgagcactatgctcaataagttttaggacctaggataggaaaaactccccttgctgattcatttgcatccattgccatttgccaacaacagcatatcataatccaagcatttatttgccaataatttaagaactcggcaaagaaagtaagaatcaaattaagcaagaaaggaaatatcgttgactacttggctcatagcacaacaaagtttcagttaataattagtgcatgaagaaaaataaaagaaaaatcaagtgcctgtgcttaccaccatggtgagtgagaccaacaaacagaagggcgcggccacgacggtaattacgaaagccaacagagcaactcggtcatcagaagcaatcggcagaccaccaatcacatgaaggatggaagaagcaaattccatatgtttgtagtcagatttctgaaattttctgttaagttcagtgcagtaaacattttagatactcaaaccttatatatacagatacatatttagttgtttatatattgcttaatatcttaattttacaattcatctgcacctgtggtcagtacgtgtacaaacccagctggtttgcacatgcatctgtagattactatataattcatatagaaaagaaatggattagggaccaacatacctgtcattggctcgagcagtctaaacttcaacagcttttcaggacttctcctagcacaggaattgcttcaacctcagtccctttgattgctctactgatgtttgtatacaagaagaaggacaggataagaaacatcataagtcgtgaccagacccataatagactagagcacatatatgaacaaaatgaagaaggtgtaatatatgttagattgcgattgtgtatatttgtttccctcccttccttatcccctccgatattgtttctataaattggttgcggtagatatggaagtcttgggcctatatgtactctgtcatatcgataatgcaatctatcgtgatgagccaatcacactttcatggtatcatattagtttctttcctctgcttccgcatcttctccaccccagccggccggcgcctcccaccgccgccatggcttctccctcatctctcacagctgactccgtcctcgaagataccatcaagttcatcaccgacgccgtccgctcctccttcaatcccggtcctggcctccaagtcgacgacggcctgaccgatgctgtcaccggcaacgccgccgaccgcgccgcgaacgctgcccggacagccctcgctcttgtgctgctcggcctcttccagtcggcgccggctactgacgacgtcgtctcctccgcggtgccactatcgacgcccttgacggctgcgcccccgacgaccgtcgtcctcgcgtccgcgtcggcaccgccaccggtccctcctccgacttctgcggccgtactcccgcccgagctcctagcgctcctcgcccgactcggcatcaccaccacgtcggccgcccctactcaagacgccgtcgctccaccaccaccaccgccggcactcgacgccgaagccgtcgccactctccacagccaagccgtcgccgtcctcaacgtgaaggccctcgtccccgtcaccctcgatctcaactccgacaactactcccgctggcgaggcctcttcctcgttgcgctcggcaaatacgccctacaggaccatgtcttctccgacgtccctcgcgccgatcaggccgactagacacagatggactgtgtcgtcctcggctggctgtacggttccatctcccatactcttatgcaggaggtgctctctcccacggcgaccgcgtgctctgtgtggcgtgacctcgagctacaattcctcggcaacggcgaatgatgcgccgtcaacctcaccgccgaactccatcatctgcaacaaggtgatctctccatcggcgactactgccagtgcctcaaggtcctcgccgacaacctcgccgacgtcggctagcccgtcaaggaccgctccctcgtcctcaccctcatcgacggcttgaacgacagggtgcagga

SEQ ID NO: 66081 - DNA, 4308 bp, Oryza sativa
agtcccgttccccccctttgccgaagccggcgttcaactcctcctcgacgagctgaccaagggacatcagcctaccggcgctgccacggctcttctcgcgtagtcctccaccaacatttgctcgtcatccaccaactcctccaacggcaactcccgcaacaacaatcgtcgccacggtcgcggtaacggtagtagcagcggcaccgccggcggcggcggcggcagcgccggtggcaccccccacggcggcggcggccaaggaaaccagggttccaccgcttcacaggcttctgctacatgggtcaaccagggatggcccacggcctttaatccctggactgggagcattcacatgtggccaggctaggctggcccaggtcttctcgggccacggcccggcttcgcaggcgctgccctcaccaacgcgccggcccacgcctacccgccgtccttcgttgctgcgcctgggccggcccagttcgcggccccctccacggtgccgccgactcccatggcgccaatcgccaccacgccgttccagtgaaacggcccctctcagtgggacccacaggtccttgcaggcgcctacaacacgaccacgctgactactccgccttctactgaatggtacatggactcaggtgctacttctcatatgacgtctgacactggtaccctctccatcccccaacgccccacccacaatactcactctcacattattgttggcaatggctcccttcttcccattacatccgttggtcgtgcctttttacattatcccagttattcctttgtgcttaacaatgttctggtttcgcctgagattattaaaagccttatttccgctcgccgtttttcttgtgataactgggttctgttgaacttgacccttttggcctctctgtgaaggattacccaaccaagaacgagatcgtcaggtgcaatagttccggtgacctctatcctctcccggcgtatgcgtactcctcggcgtcctctgcacgtgcctttgtcgctacctccaccaacaccgacctatggcatcgtcgccttggacatcttggtcatgaggctcttactcgcttggcgcaggcgtctgtcattccaccaccaaaagtcaccacctcgctttgtcatgcatgtcagttaggtcatcatgtgcgtcttcccttccccactagctctagtcgggccaaggcaaattttgatttagtacattgtgatctgtggacatcaccaatacctagtgtgtctggatttaaatactatctcgtcattcttgatgattgctagcattatgtgtggaccttcccactccgttttaaatccgatacattttctacactatctcacttctttgcttttgtgaagacccaattttccacgactattcgcagcattcagtgtgacaatgatagagagtttgacaactcctccgctcgctctttatttctcaccaacggcgtctccctctggatgtcctgcccacataccttcccacagaacggtaaggccgagcgtatgcttcgttctctcaataacatcactcgctccttgctttttcaagcatgccttcccgcttcctattgggttgaggcccttcacatcgccacccacctcataaaccgtcatcccacaaaaaccattcagcatcacacccctttctttgccctccatggtgcacacccctcctagtcccacttacgagtgtttggttgcaagtgttaccctaacctatccaccaccgctccccacaaattagccccacgatccaccccgtgtgtgttcctaggctatccccccaccataaagggtaccggtgtttagatcttgccaccaacagggtgatcacctcacggcatgtggtgtttgatgagtcagtttttccttttgctgagatgactaacaatgaagtggctactgatctggagttcctttaggatttctcagcttcacttccgacgccgattggacgacgcccctgccctgaccacatcggtccggcggcccgcttctccacgacggccccgcacaccgaccccaacaggccggcctctccgacgcgcaccggccccagcaggtcagcctctccgactgggcttgcctcgcccagtcccccagctgggcctccttcacctttggctaggttgcccagcccctcctggtcggctggcgcgccgaccgggcctccgccgactgcaccatcaccagctcagccgcccctcgctcggttggtcggcgcaccaaccaggccaccagcacctcttcggcccccgccgaccggcgcccccacacgcccccagagtgcgcgtgtgcctggcgtccgcataccgacacagctcggtctctcacccgtcgtcaacgagcactctatgatgacccgcggcaagaccggtcttcgtcagcccgtccaccgcctcaatctcagtgtggctaccctctctcctgtgccgcgcacgtatcgtgccgcacttgccgaccccaactggaggtccgccatggaagaggaattctccgcacttcaggccaaccacacctgggatctggtgccccgtccacatggcgccaacgtcgtcaccggcaagtggatctttcgtcacaagtttcaggcagatggtagcctggacaggtacaaggcccgttgggttcttcgcggcttcacccagcgtcccggcattgactacgacgagaccttcagtccagtcgtcaagcccgccactgtccgcacggtccttagcctggcagtctcgcgtgattggccggttcaccagctagatgtcaagaacgccttcctccatggcactcttcaggagacagtttactgcacacaaccggctggctttgttgactccaccagacctggcatggtttgccgcctcaacaaattcctctacggcctcaagcaggccccccgagcgtggtacagccggtttgccagtttcctcctatcacttggttttgttgaggctaagtcagatacttctctgttcatctaccgccacggtgctgatatggtctacctgctactctatgtggatgacattgtgctcatagcttcctctgatgctctccatcagtggacgatccggtcgctacagttggagttctccatgaaggaccttggcagccttcatcacttcttgggcatttctttcacacgccagtcttctggtctctacctcagtcagcggcagtactgccttgagatcttggaccgtgccggcatgtctgactgcaagccgtgtgctacccctgtggataccaatgccaagttgtcagctgttgatggtgctcctgttgctgcccctaccgactaccgtagtcttgccggcactctgcagtatctgaccttcacctggcctaacatttcttatgccatacagcaggtgtgccttcacatgcatgacccgcgggagccgcatcttgccgctctaaagcgcatcttgcgctatctccgcggcactcctgacctcggtctccacattcggcgttccactccggtcgatctcaccgcctactctgacgctgactgggcaggttgtcccgacaccagaaaatccacctcgggttacgctgttttccttggtgacaaccttgtctcatggtcctcgaagcgccagcacaccgtgtcctgctccagtgctgaggcggaataccgggcggtggccaacgctgtggctgagactacctggcttcaacagcttcttcatgagctccatacccctccgagtcattctacactggtctactgcgacaatgtgagtgttgtttatctctctactaacccggtgcagcatcagcgcactaaacatgtggagattgatctacactttgttcgtgactgtgtcgccgtgggttcggttcgtgtgttacatgttcccacgacatcctagttcggcgacatcttcaccaaaggtcttcccagcacgatcttctcggagttccggtccagtctgaatgtctgctccgtcgacgttccgactgcgggggggtgttagattgcgattgtgtatatttgtttccctcccttccttatcccctccgatattgtttctataaatcggttgcggtagatatggaaggcttgggcctatatgtactctgtcatatcgataatgcaatctatcgtgttgagccaatcacactttcaatatattccaacctggtccagaacctgcaattgatagtaccagatgattcagatgaatatacctatcaagtatcaacaggagtagcaaatatccatagaactaaccccagcttgagcgatgcgatccaaacaagttgatctagccgggctgcagg

SEQ ID NO: 66082 - DNA, 2426 bp, Oryza sativa
tggggagggagggggtgatgggaacggggaggagaggctgagccgttggattcgttgaattgatagatggacggtaggatttaactggttgatttcacctgtaggattggagggggcaactccttctttttatattagtatagaaattggttattagatcggttataggtgaattggagcttgtaatgggctatactattaaacttgctcttatatcgaactagcctataaagaacgggaaaactccttgaaaaaaacatgtagaagattgcaaataatattatcatcaacacatgaggggtatctctaaggcaagtataataacatcatgcgagcatactattagccggtccaacttagcattaatgtgctatgggtaacctttgtaaagcttaaccgagcatcgtagggcttacttcatcacacatagctgtctttactttagtactttagaaggggagctcacatgaaaattaatgtaacttcttttttaaacttttctttgttttttcatggtactatcaaagggctcctattatttttccatattttttaattcctttaggatttgagaatcgtctacttcaatttttatgtttttttattcctagtttttttctatcctgtaaataaaagagaccttaagattaggaagaggtcttaaacattatttgcgtttaccacaaataaaaataatgccctgagaaccagccaccatggatgatggatgggatagatcgatctccaaatacactatgaattattcaaagaagcgacatcctatgtataaccgatcactacgggagaagttatttttgctgggtcaggctatttccacaatagtcccggtttaaaaaagaggccggccatctttagtcccagattttccctcccggttcgctacctaggggttacaaaccaggagagataaagggtttctccggtggctgtaattttcaagcgatatgtggcgacctcactacaaatcgggcgcccctactactgtgtgctgcctgacatacttacatgcacaacctccatgcatgtgaactaacgtactacctctattttttaatagatgacaccgttgactttttctcacatgtttgaccattcgtcttattcaaaaattttatgcaaataaataagatataaatcacacttaaagtactatgagtgataaaacaactgataacaaaataaattataattacataaattttttgaataagacgaatagtcaaacatgtgagaaaaagttaatggcgtcatctattaaaaaaaacggagggagtagctatatcccctttcactcatctcacttgtaaaaacaaacttttaaacgatttttctattaaaacaattatacgatctaaatcgttatattccctataactaaatccctacaatcagatctcacgcaagtatattttgataaaaaaatcaaccattgtttcactctttatagaacattgtttcagtttactgtataaaatattttaaagaaatacaacatttaaaacggctaactgcaacatcaacaaacacttatatgaaacattaagtccgaacaagtgaaacacaaaaataatcatatgaaatatatgtttttttatgggaaagattgccatgcatttggccaacaatataattttataacaaaaagagttatttacagtaaaggaaaaaaagatcaaagttattataaatttgtaaccaatcaaatactatttgttttcgaagcatttaacacaaatacttaatgttttgatgcatttttatatatctatgatttcattaagttgtcactattaaaacattatgaaatacttactaaaacatttcagaatatcatgtgcaacttaaaaatccgtttaaaaaataaatattttttcaacggaatataactacgtgtgatcttgttgtgaaatatttactcgcaacgaatttaatggtgcaattatatcgtagattggaaaaatagtttagaagaaataatagttacatgcatgcatatgaaggattactacacggcataaaataagaataagagtaccatgtaaagaaataagcaacaagacgagagggcgcccgatcttttaggcatggattgggcacccgatgggaagcattttcggatacgttgttggattcaagtgttgtataatgtatagggcacgaaacatgataaatcattacttcgttaggactcatacatgtttaattttgatgctggattcatttccatataatactttaaaaactttaactatactattaagcatttaattaagccactatttctagtgatatttgtgcttgtcacctcacctcttgggcaaacagtctattttaaataaaaatcattgaagggtatattttcaaattttgaaaagtacaagtctaattctaaagaagaaaacata

SEQ ID NO: 66083 - DNA, 3159 bp, Oryza sativa
ttttgaattgagacggtattcgtcaggtcacaatccgattttggccaatccaaaatcccaaaccgtgtccctctcactccgcgcgtgcggctcactgctggttgtgacgggcggcgatgccgctgcgccagcgccaccccaccccacccgttcgacgaaatgcggcgcgccgctgccctgctccgcctcctccgctccggggccagcgccggcgtccgcggccgccccgcctgcgcggcggtccacccgctcgccgtcaagtccgggagcggctccgacgcccgcgtggccaccgcgctcgccgacgcctacgccaagtccggactcgtcgaccgcgcccgcagggtgttcgacgaaacgccgctccgggaccaggtgctctggaacgtcatggtctcctgctactcttcgcacggccttgtgagggagtgctgggatgtctttggctccatgaggcggtctggttttcccggcgatggcttcacgttcagtgccttgctcagtgtgcgtgcttcttcttcttcttcgtgctatgaccatgccaacctgttgctggtcctgggaagctcggtgcatgggattgtgatcaggttgggtctccacctggatgtggtggtagccactgcgctccttgatatgtatgccaaatgcggccaagttgctgaggctagccgggtgtttgatgccatggtgctgagaaataccgtatcctggaatgcaatcattgtttgctatggtaagcatgacagaggcaaggaagccttcgaccttttcgtgtcgatgatgagacatgggttttgccctgacgagcttacgcttgccagtctacttagttcctgtgccgacatggcggctgctaatgaggctactcagcttcatgcttacactgttagaagaggcttgcaagactttctacaagtgggcaatgcccttatcatggcttatggtaagaatggttttgttcaagaagcaaaacgaacatttggtatgatccataacccagatctagttacatggtcatcaatggtttcttcttttgcatatcttggacttgccaagagtgcaatcgacctgtttgacagaatgctccaacaaggcatacgggctgatggcattgcatttcttggagttctttctgcgtgcagtcatgctgggctcattgaagatggcttcaagtactttcttctaatgacgagggactacaaaattgatccaactccgcagcatcttgcttgtctagttgatctcttagggagagctggtaggattagagatgcctacgaatttttggtcaatatgtcctgcgacgcaaatgttgatgtcattggagctttccttggtgcttgcagaatgcgaggaaacattgagtcagcaaagtgggctgcctctaggctatttagtctaaagccagatgatccaatcaattacctgcttatatctaatacgtatgctgctgcaggagattggaatgagcttgcaaaggtaagaagtgtaatgaggaacatgtgtggcaacaaggtgccgggctgtagctggatagagataggtggaattgttcagacatttgtatccaatgatatgatgctccatcagtcaagagagatgcaaagaatgatggaacttcttgtttcattagtggaacaagattgcaatggtgatgacacaatttgcaatgatccatcatcgattttaaaatggcaagatttttatctggcatttgattaattcagctgtttgggataatttcacaatggaatactgtcagagcttcctaatgtgactattctcaggtcattccgagatgtatctattttactgtttttttatcctttgattatatacacaaacataatatgcttactagaattaccttgtgcaggttttcacttaccatagacatgagataatgtacacccaggaaggaaggaagtctaccgtttcttctaggtaatccatgtaaatatcaaaatatggtataacagccacatactgatttttgtatgtaagcaaccatatttgttttgggcaatcatgtgtaccagtcaactactaactcgggtcagtaagtaatagtaattattttagactggaaaacacattatgaacttaccaaggcaagggtggatagtcctgaccaaagggagggaggggactaaacaagtcaagggactgagagtcgcatgcatgaccaggctcaggatcctctctgtgtatagtggcatggtacctctgttgtgtgccttggtaggacagtggagtaggtaacttgattgggttgcatcagtgttgcctgttcatgagagtactgcaagaacgctgtaaatacaagccatggacctgatgcacaggtggggtgaacattgggtgtagcacatcatggatttaaggatttaagtggtacgataagccttaaacacaccaaacaaaaaaataaattacttgtgaaaaaggccccaaatgttgctgataggagagtattacttatggaacttcagatgttttgctgaattgtttcaatactgttagtttataacaactaaatgaaagctttattgatttcatttccttacagctggtatgtgcaaaatcgcctgcattggaatttggaattgctaaaattccttcagcatttattggttaatggtggccaagcagaataaggtaaacctactataagcagttcagcagcaaataccaatcccaaagctcatagcttaagctatgatcacccagtacttcacctctttagatagttttcattaaatatcctgatactccgaagtagagtgtgaaagagaaggaaaaaaaatgaatttctaccaagaagtacaaagcatcttgccattgatctagtccattcataccttggtcacggtatcactcctttctcacattgcccacattgctctattcatacatttggaataagggaattcttaccatttccgatgggaattgaactgattcttgtgcatttaaaaggaaccctacatgattatattatatttttcaaccattcaatgttgctgaagacaaaccgatttaagaattatctaaaacattccaaactgctacaatcataggaataagacacatttaggaaatttgactacctctctttcaatcatgcacaacagcccaatctgatgctatggagac

SEQ ID NO: 66084 - DNA, 2366 bp, Oryza sativa
tacattgtggatggcctaagaatataagatgtcaagaatattctgattaattgatgggccgcaggtctaggctcaagtttattgcttatttttcactacttgttccttccgtgagctccagtgtccaaaggagatatgaagcattcacttccttttcttgactgagacttttttttaggacaggcttaaagccatcttgactgaaactagagtgcgtgggttaggattcatcgggatgttcatccgctcgtttcccttccaacattggtaggctgtcgttttggtaggatgacgattctaatcccttgagtccccttgtagctttttcgttcaaattcagtgtgaatagttatgaaaaataaaaagaaaatgacaatgtagactatattactaatatctagagtgaattgcactttgggccatgttttattgtcaaagtttcactttagaccaccctgtacacaatcttttcattttggactaggtaactttacctttcttgcgtaatggaccactctaactctttacgttagtgatgtctagcgtctcttttgacaaaggtatagcaagcatttaggtatgaaaatttgttggcatgtcgttaacaatttgcttgaaatcatcgaaaaactgaagatgtggtttggggtggttcattgtgtaacaaaggtaaagttacctagtccaaagtgaaaagattggacaaatggtagtttaaagtgaaactttggcaataaagtatggcccaaagtgaaattaactctaatatctatcactccaccaaaaatcattttcaaattctatctactccctccgtcccaaaaaaagacatcttggttttccgtgtccaacgtttgactgtccgttttatatgaaattttttataattaatattttcattgttgttagatgataaaacatgattaatactttatgcatgatttgtctttttaattttttttcataatttttttaaataagacggacggtcaaacgttggatatgggaacccagagtttgtcttttttttttttggacggagggagtacacattaagaaacgaaaaagacaaaatcagacatgaatagcaccaatactattcatatgctggatttatctttttttttatttctcaatgtgtgagttaagttttgatttgatttttgtgcagtagtttatatatatggtatgaatgttgtcaatttttaacgatttttgaatcacgtttgagtagacgaggggacattctcttaagagtttaaaacaattgttcccaagatatacacagtggtagtaaaaatattcaagtttgtactatcaatatttttgtgataaaaatattgtaaagtaaagtatatattttggggcaatttttattaaagttctatcagcatgcaaataccacacacccaaacaaattttacaaactttccgatactgatgttttggttttttctttatccaatttattcgtgtgagatgacgtcaacattgcctaagaaacgagaataaaaatagatgctttgcttgtaactcgtatttaattgtttccaacaaactacaaaatgatgcagataataaaggccaagaaattacttctccgacaaatatatacagtatatgtcccaaccaatttgagatccatgagtacatattaggtgggttcattagtgtttttttcttatgggtgataataatatgtgcaaactgccacagtttcttatgggtgagatttatggagccaagtacaatgtgccacaattaaatttcttccagactagctctatatacagtacaaaccatttccttctgctgtttctcaatcattcatgacttgagattgtgaaagtttacaggtcaaagtaagatcaccgacggacgaagacacctccaatcattcgtcatcgatacccaagtatatatataggattaggatgcatctgggaattcgtcaattggtttcaatttctctaaattccagtagcacgtagccgatatgcgcatagcactggcatttttttgaattggcatatttgcattgccatggatccaattaacccatatcatctgtagttgtgtgttctcaattgattttttcagctgcaatgtggtatcgattttctaataatcaaacgctaccaaaactcccaaacctttctttaaattcatggcgttgcattgttttggcacgtcggcattacacttcatttgtcatgcctagacacaataaataaataaacaagtaaaaaataatgaagtgatgaaagtaaaatagtgcatccaactctcggtatttgattattacgaatttcataattcagaaatcagaatgaacctaagcaccctgcaagttctttaggggtgca

SEQ ID NO: 66085 - DNA, 10058 bp, Oryza sativa
agtcgtgttctatcatcttcaaaattttcacattaaactcaggtctccatcggttggccatgtcttattataagccataacggcttattagcgattaaaaaatgatatgtgagtaaaatttttgtatatatgttcttagtgattgaaaagttaaagctgaaaaaaaaactatgttgaaaagcatcaaaatcaaattcaaaatcaagttttaaaatttaaatttttgccttctgacttactgttgccaattacagtaatgggagagagtggcaaagtactgaacattatatgacctagttaatcacccaactactgatgtagctcttgttgaacaccttgactgctggcaactgtataaagaaatgctagttgtacttgtatcgccaattcaagccaaaatgctcatgaattgaatgcatgagaccgtccactctaaaggcatttttgctagctcttgatttgtgtttacagagacttcctacatatatcccatgttatataggattagaatgcaacaggaaatccaaatgcctggattggtacctgccgcagaaaatggacttttgcaggcggcaagataatgccaaccgctagagaaaatgattttccagaaaaaaattaaatccccaaaatccctttctaccatctcaaccaagaagttgccaaaaaaattgaaaatgaacatgaacatcattcaagcatcaatccaaatacagagcatcacaaatatcaacattggcatcattagcataacagattaacaacaacaatctgccggctgccgttggcccaagtgaacccgctgccggctttgtcacactcgaagttgtcgtcatggccacggtggactcatggtcgtcgtggtcactgtggactcggtgtcatcatcgttggattcgagcaccaccggcgccggatccacctcttccgagcacccccgccctcccgagcaccgccaccagagccaccactgcctgcacgagccacctcactgccgccatccctcatcttcgccgctgccatcagtggggaggaaggaggaggcaccggatctgctccccgtcactccctccccccgcgccgttgatgccgaaagccaccagcaccgcttccgaggcctagtggcgctggatccgccctctcaaggcccaccgacaccagatccaccctctcgaggcccaccggcaccgtatccactcccaaggacctccccgttggtcgatgcggcgacagtggaggcaatggcagccggcggcagtggaaaagggaggccagagaagggagggagaaggagagaccgagggacaagcgagaggcgagtttggtgggcgatggattttattcacctcaaaagttttttttttttgcagcggtcctcttgtcgatgtttgagatcacgactacagtatttgaatggtatggggatcgttggtaccagggtatatgtgagatcgaggtaaaagagatggagacatggatttttatacaggttcgggccccttatctgacaggtaatagccctactcctgttgaccgaagccggtgttgcttctttattcatctgaatcacacaagtacaataattggataacccgtctagctgtcgtcgacttggcggctagataaccaacttgtagtcgacggcagggtagtcttcctccttgaacgaactcatcgagatcagagatagtgctagatctcttttgccggccttcgcaggcaccgtattgggtttgtctaggcttatctctgatgttgatatgtggcagcgtattggtttgtgttgatctatatgtcttctggcttgtctcctctcctcctagggggttgtatttatacccatagatgccccctgtcgaagtaaaactagcgagataaatatggatacgatcctagtagtcctggttgtttccatatagaactccttttgtcattccttattcggaactccttctatatatgaggtttgttttcgtataagatatggtatatggtgggtcctgccgagcttagtcgattattattgggtatgtggtatccataaccctaacacctctttacctaccgccggcgaaaacgcgattttcattggtgtacacttagaggttcgcctcgaaaaatagagttgttttttatggcggacctcttagtgcggccgttaaatcggttttcattggtgatccgtagccccctatccctcgatatgtttgtgcttgcggttttcgcgtacggccgctagcaaaaattatagggcgacatcatgaaaaatcgttttttatagtagggattcttccacaagacaaattttgcaaatatctcgcaaatgttataaaatgtgtctaaggctattcccagtgtgcaggttccacaagagtttccatctcattagatgagatgtcatatagactaaacttatgacatgtcaatgattttatgaatagagagaaaaagttgagtatcgtctagatgaaacttgatttgcgcacttacctatacctcggaaacataatgaaatcccactgaatcatttcatcctataccttggaaatgaaatgaaatccccactgtgaccaaatagtttcataataccatttaataattaaatgtcatatgtagcatatgaaaccactaaatgaaactatgcattgaaaatttttctttcattcatcaaaccaaatgtttttagattatggctgcgttcgaatcttataaagattcacaaatacgggcatgcaaaacaagaaagctattagcatatgattaattgagttttaattattacaaacttgaaaatgatatatttgatactttgaagcaactttcatatagaaagttttcgcacaaaacacgccgtttagtagtttgaaaagcatgctaatggaaaccaaggtaaaatcttcatcttcatgataaaagaacggtgcctatgtgacactcttagaaatcataatatgaaactctctatttggaatggcctgaaatgtcttgtaggttgacttttaaaataccacttgaaagtgtctttagacgaactatggaactcctgatattacggatgatttgaaaaccatctctgttaagatgtactacacggaaggtttctgttgtaaggatttgatttatcttcgttcatttttctttctgtttttctatatatccaattgtcgacctcttcttctcattcaaaatatcttattgaataaactaggattaattaagttcatccgacatctctaaactttcatgaaaatctagaaaccaaccaaaaatgcacggttcaacgcggaactgttaaaaccatagagtagttcttgacttcttggaggagggttattttctagactttccagagtaaaatggacttctctgttgaaaccttggtaggtccgagaataatttaaccttaattgcaaaaaaaaagtttaggataatatgctagcacaaataaaaatgttttaccacgcaataaattatatatgaacaaaagtagccaataaatatatgagttgttgtaaccaatagtagcaaccatgcatcgatgctatggattgtaagtagccaatcttgtaatatccttccagccgtgttcattgtttcctatgcactctaagaattccgatcgacactcctagcaacaatacttttcttcttcatcgcacttaattagggataggaagcatagggaactagaatcatacatcctccatgagataaaggatcagctccagccaactgatgcataaggttgatacatattgcgatagaagttcaattcggcagccatccgtacctgccttacctgcgacttgttcccgcaccacactgcacaagggaagaaggcaacacagacatagctagagaacaacagcgatccttcttctcgggcttctaaactatgttttcacgaagtttattcattagcatttttttagaaaacgtttcaaatcattatcaactttataatatttgtcacttttaagatgtgaaattaaagatttatcacttacagtctatgacatgtgagccctcatgtgtctacgacatgtggatccagtgacaaatctataattaccacttgtaatagtgccaaataattaaatatctcagggaagtacggttggcacatacacacaagtggagggggaacttacatcacttggatggagggtggaacgcacgtgacgggaaggggtatttttaagatggatcaaaaataaaaaaaaaagtatcgacatatctaatggttgaaatgaattaaatatcaatggttagatgtattattatttattatagagtgaagtgcacagacggtctctaaacttgtttgagtgtgtaatttaggtccttaaactctcaaatagtttttttttaggtttccgaacttgtcatgtgttcatataaatccaaacaggctctactctacttcgtgagctaatgtggcatgccactgtagcacctacgttagtgggatccacaagtcagttacatagaaaatataaaattaaaaaagagaggagaaaaaaatgttcttaatgtttttcctattggtgatagacatgtgggtttcaatgatacagacgttaccatgacataccataccagcacacaaagcgggttggagctcgattagacctaaataatacacgatgcaagtttagagatcaaaaatgcattttgagagtttagagacatagatgacacacatgcataagtttggaggctatttgtgcactttactctttcttataatatttttttctaatttattagagcgttacataacgatttaggagcgtgtacaagatgtttaacgaagtcatagtatataatagatagacaaataaataaatactactatatatcttataggtggaagacatgcatgtaaatagactttaaaaacttataccacacaaaaataggaaaaggaaaaggtacatctgagatccctcatctcgtcaccgagttacaaaatcgttcctgaactgaaaaaccagatacaacgcatcatccaactttcaaaaccagtgcaaataaggtccgtcggttgtattgtccttggttatgactgacatggcgcttatgtaacacttcaccctcggtggtattatccctttgcctaggtcttcatccacgtggcattgacacgacggttacatagcaatttggtaaaaaaaataataaaataataaaaacaatggggcctactggtcagatccccttatccttttctgtctcttcttcctctctttttgcgtcaggcatggaggaagggcagaggaggggacgcctctccatcggctgtgggcaacctcgatggtggcgggaggtggccccggctccggtggcggtgaggccagcggcgtgtataatggtgtctcgggctcctactcactctcgttgccggcgccggattcctcatcgatgatgtagaatcctccaaatgcagtctgctcatgtctaacacagggcacgcattcgtcaatacacaaacaaaattggccatatccaaatgcagtctgcactgaacaaaatcctccaaatgtagtctgcagttctgcactaaacaagaacgattcccaagttggatattgggtaaaaaacgattttagcaccgtcaattttcctagcgcggcaggcgcatcaacaacgcaaatttaccaaaaccgaaggaacgagaccaccgacagagctaccaacgatcttcccttgttcctcgagaaggacaaaggcatcacaacccccaagccaggaggagcagcagtagcggcaaagcatcagaaccttccggagctaacccaagggcagcaacctaagaatccaaccgagatcaccttcctcttcgtcgacaggtatcgcctgcttaccttcctccccctgcgtagcggcggcgggagcatggcaggaggcggagcagcgcggcggagaggagggccggcatgacggcggcgtcactgacgcagcggggagaagggccggcgtggcgagcggtccttggatccacctgctggtggctaccactccattccctaggccctagcgacaccgcagccgaggccacctcccgccacggctgagccattagcgcataattaattaagtattaactattttaaactttaaaaatggattattatgatttttaaagcaaatttcatatagaaaacttttgaaaaaaaacatacaccgtttagtagtttgggaagcgtgcgcgtggaaaccgaaacaaacaaactcactttcacctcccctagagcagagagaggaagaaggggatctgatcagtggacccccagcatttcttattattttttctagatcaaattgtcacgtcaatgtcacatgggtcgaagacctagtcaaagcagccatgtagacgccacgtcagccaaatcagggataaaactattgaggatcttgtttatattggttttaaaagttggaggatggacgaggcacctcaaatatacttttacccccaaaatatacttaaaagatactaccttcatcttaaaatgtaactatttctagcacaataacttgtcctaaaataaagttttttctccacctacctcctctcaaccaatcacaatcattcccctttacctactttctcttttcaaccaatcacaccatttttttaatcattttttacctatatttatatttttaatagccgtgccgtcggaggaagtaaatcagtactagacctgtttaaaggacagcaatatggacaatatcaacctgcccactcacaatatgtgtgtgtgtatacagccataggattcattcgtttattcacaaacttcacttggtcctctcaaaatgaaaaaagaaaatgcatgcctacagttcagcttgattagatgcctcaaaagtaactgaaggaaaaatacttcctctcttcaacgtggcaccggcacattacacttgtattatttagaaagcaacggtccaattttaattgttacactcctccataataagattaggatgcatcaggaaaatagtatcgactttttctgcttgatttcgtcagttctttcatgctgaattcaccggtgcccaaagtagccgttgccgatgggtcgtcaggtgaagatgtttgctcatgttggtactttggacagcgcacactacgatcgatctgtcgtaggcattgccaaaagttttgctcaaaaatcaaacaagattagcattgaactgtgcgactatttgagattttttactttccccaaaatctcaactggaattgctcggtgtctacaaagtttctacgtagagggctaagtcaaaactttaaagtcgttttactctcgatttgccccaaatggtggttcaaactttacagtcgtttcacactcatcacactcaaatcaatggcaacattcaagaggtagattcaacatgaaacagtaatttcaaggcgatttaggcagtgagataatagcttggttaacttggaacgtcatggcaatgtgcagtccaataaacaaaactaaccacactagctttgtttttttcttactttgatgtcacaaggttaactgtaatgaatcaagaaggctcaaacttaacatacacacaccaaagccatccattcctcaaaataaatttaacaagcttatgcacatacaatcgaaagggctaaactacggtagacatcattcacctgatcacccctactagttattccaacaattgcaattttacaagtggtacagacagcatatactagtagtaaaaacattatcactgaccttctaccgatgatctaacgaaggaccttctccaccatacctggaaagctctagtaaggttcgggcactctgatcctttggatgcaaaacactgaaaccactcctcaaatagacactgctgctgcttgagtgggagggttagtagggcctgtcctagattttcctccaaagatcttacatccagacctttggagcatcgctgaagccagccgaaatcaagcaacatcgggctgaaccatccgtagaagaggaggctcctcagctctccacggcactgaacttttcctttgccgagtgcgatgaaaacactagcagatattcggcttagttcatacctcatcatgggtgatgcctgctcatgtatcctgatgagcctgtcttgctttgcccacagctccacaaactcttcagccatgtcaatattcacaagaatgtccaagagccagttgaggttctctgtctgctgagagattctctcaataaatggtttactgcccttgataactaatgcttgagcagtgtggtttgtagcctctgttgcttcgtcataaagatccactagtgaatttaaacaggcataacagatattatacaggctctctctgtttagccctgccatgtctttttggtagacagaacttttgcttagaaggccatttaccaaagattgcatatcttttcttgcaccactgttggtgctgctcgtgactgattggataagatgcactgtgaggtcttctgagctgctccagctgtgaggccgcaatctagccagaacatcttgggatattgcttcatcaaaagtacatcttgcaaagagattcttgagcttctcctcctcgttctcattccatggaactgcttctatgtatgacaaacacaatttaactcctctttcaaacatgattgatgaagacacctgcaattaaagcattaataaacaaattatgtacgtgattaattagttggcatttaataaactcattaccaatgcaagaaagaagcatttaataacatattattctgtaaatccccacttgagaaatatacatgctagaattgaaaagatgttacaaagatattggacagcaatggtggctgctttatttggatcactagatagcaattatgggcaacaggaatacttgcttttaattgcgggcctagatgcattcaaaccactaaatgcatttgtagctgactttcatagctgtagaatgtgatctaatggacatcaagccatagaatgtgtatggttacaagacttatagtgattgtattattatctaatccatgatttaacatattaaacaaacaataccagcatgcaaacaattcacatagaaagtgagtgatctacaacatctaatatggttataattatatacttacatatcactttgcataacttacatgaaagcaatggtttaataaaagcattagatgatattaaatcactaatatcccaggtcaaatgcttctcacacaatcatatcatattagtttcactcgaatgctagagctatcgttgtttggcatatgctgattataagccgtaacggcttatcagcgatcaaaaaatattccgttcgtaaaactttatatatgtgaactagttagcgatttaaaagccaatgctggaaacataaactacaatgaaaaaaacctcataatcaattcaaaaattaagtttccaaattaaattttggcagtggcttataagctgaaaggcaaacgctggggctctaacttgtgcgcctatcaaaaaaaaatgtgaaaatgagtattttggtaacaccacactggatatctaccaccaaaatggcttcggaaaatgaacatataaggaacacaacatcaatgtaccgtgaatgattgtttggttgcaatgcccactaaatttcctgccctgttgtgggtaacaaaatgccatccattattgcaagtagtactacttcttttgcaaccacatcatgctactagtaacacaaaatcaattaagagaagctgcttaagcttaattcgtttccctcacctcgagcacatcaatggagcgcgacacgccagcggcggcgagccaccgcagcggatcaggctggtacatgagctcgacggcggcgcggaacgcctccacattgtccaccccgtccacctcgatcctcctgccgctccctcctccgtcaccggcgggcccgcgcggcggcgccatggcggcgaagaaggcgctgctgtcgcagagcaccccggagtcgagctccatcaccacgcacgtactcccgtccctcccgcgaaggaaaa

SEQ ID NO: 66086 - DNA, 10618 bp, Oryza sativa
ccagggggacttgggcggcagcttattcctcccggcaccaccacccggcgccggggaggaagacgccgccgtggccggcggcgcgagggagggagggaaggggcggaggtcggggctctgcgggacgccagcgaaggagcagcaccagccccggggcgttcgcgcggcggaccccgccgcacctcggcgccgcccgcggtggtggcgctgagccccgccgccttccatccttgccgtcgccggcgcagatctgggtggggcgcgagagagagagagagagagagagagagagagagagagctagggttcggaggcggcggccatgagaggggaggagggagaggtgtgatgagtggaacaacacgggacgagagctctctctctctctctgctgcttctttctctcactctgtgctgtggcactcactgtgcaccgcgtgggattggtccatgggacaagactggtaggtggggtccactgtaagtggggtcctcttcctcggataccgcgggcgtggtgtacgggcatcacgagaggagctggcactgcactggcaactcaactgggcaagagagggtttgcgatcgtctgcgtccggggtatgggtatgggcgtatggctgtgccgctgccgatcacacggaaaacggtcctaaacgatactcgggaggttccaactcccccacacgaaaaatggtggtacccgttaaaacgtgattaattaactattaatctcaaaagctcgaaaactcgattattatgattttttaaaacagctttcctatagaaaacttttaaaaagaatatacttccttccgtcccataatataagatattttaagtggatgtgacacagacatgatgtgtcatatccacctaaaatccattgtattatgagacggataaagtattgtttagcagtttaaaagcgtgcgtgcgaaaaaaaagtgagttgggaaagaaggagaaagaacacaaccttactcttataaaaataactttaacttttacttccggatatagtccctccttcctaaaattatttttaacttgttccatacatatgcatatctctctactattataaaaattaaatatgtttttgactgtactttggaacatcatccgtgtatgatcggtttctaagtccttttgctttttaaaatatagatatgtatttgagtcggattttaaattcattcgtttttggaaataatgaggaatcttataagaaatctctttaaaaaaacttgcatactaacttaaaagatgatcggacttataattgcaactcatgattttctagaaaaatatatatccaagtgaattctcacaacgaaactattatatatatctctactgttataaaaattaaaattgaagatacttttgcatacgttatctttctttgagttggtttttaagttcattcgattttagaaatacagatccatgtttgagttgaattttaagattatttgcttttggaaatataaaaggagacgtataagaaacctctttaaaaaaaactcgcatactaacttgagatgaaatatagactcctaattgcagcttatgattttcaaagaaaaaaatatccaaccgaattcccacggtgaattttaccatagctaaaccttataacaataataaaattaaaatagtatttaccgttgcaacgcacgggcattttttctagtatgttataaaaattgaagatgtttttgttggtactttagtatgtcatccatgaattagtcggtttttaatttcgttcgcctctgaaaatataggagcagtattataagagatctctttaaaaaacttgcatgctaactttcagactcagctcatgattttctagaaaaaatatatatcaaagcgaattctcacagtgaatctaaaccgtataacaatatttctcacttcatttacctgtaatgcattattctctactttcacaaatagaagagcccaaaaaataacttattttgggacagatggagtaaaaaaatattagcctgtttggtagagctccaactcctaaatttagctctaggagttgggtctggaagtggagtcgtggagcaacctaaacccagctctaactctctagttcattttgtgagagagctctacccagctccgctcccattttagatggtgctgaaactatttggctgagttctagcttcaggagaggtgaaggtggagttggagcagtagctatgccaaacaggtcagactatcttcaaaacacattattaaaaaaagagtaaagtccatcaccggtccctaaacttgtaccgttgtgtcatcccggtccctaaactcgcaaatcgaccgttcaggtcctcaaacttgttcgactgtgtcatcccagtccctaaacttgcagatcactcgtttaggtcctacaacttgttcagttgtgtcaccccggtccctaaacttggatttgaatatcatctgggtcaaataagacagtctaaagactttatatttaaaaataatttataactttttcatgtaaattctaatgaagaaaaactttatatcaaacttgtagccctcgatgcgatctacaactttgtagttgaatttttttattttaagtcattttttgtcccaaaatgtaattttaaaattaaaatttcaaaatatataaacatgcaacaatattttgggacctaaacggttttaattcaaaaacttttcaactacaaagttgtaagtcgcgtcgaagactacaattttgatataaagtttatcttcattagagttcacatgaaaaagttatgaattattttttaatataaagtttttagaccgtcctgtttagggaccggggtgacacaactaaacaagttggagctaaacgagtgatctgcaagtttagggaccgggatgacacagtcaaacaagtttgaggacctgaatggtcaatttgcgagtttagggaccgagatgacacagtggtacaagtttagggaccagtgatggactttactctaaaaaaaaatgcacgaaagccaggacctaagcatagacaactggctaagagcgaggccatcctttcatgctaggcatgatttggattcaaacaggtgaattcaatgaaattagatgataatcttgcccatacagcatgtacactttatgtatctatgtacattatactctaggcatacatatgtacattatactcaggccacatgtaaccccgtgtaaaagccacggacactattagggttgtaatatacaaaagtttgcacataagaacaacaaaatatatgcgtaaaagaagaactgtttgtagacaacctaaaatgtataaaagctaagaattcactagtacaaaaactgtgataggtattttctcctatgttccggtttatttaaaaccgacacttattgatcgttcccacctctgtgggatagaaaaaataaaggaccaccaccttcgtacaactatatctgtcggttcaaaatatcccggttcaaaggcatccataacatattataggttctgttcttttaaaaaaccgacacctatgaaaaactaagccgagccattggtcatcgggtgggtattccttttaaccccactgagtcaacccgcgttcatcgtctctctctctctcatgcatcttgtcgtccctatcccctccagcttgccttcgtcgtcaacgccaccacccgtcgtcatgtccccccctcttcctcctcctcaccacatccatgcctccccccctcctactcgcttccacctctatccccgctgccacccatcctcacagccttcgctgcctctaccacccattgtcctctgcaccacattctcgcctgctcccagctgccctaatctcttattgtttaaggtttatgaatcttgttaatgatttactagtttactgatgcatataacatgtaaaaaaaagactggcaatgaaaatggtaatatctcaatgctatacgtgacaaattgaaaacatatttaattactattatattggacgtaggctaccacttagaagatccaataatcaacaatctcacctaattctagaagaaagtaatagcatacagagcagcaggggtgtactaaatttttaattggaaaaatggccatctatataagagagccatagctgtcatagtgccatagctcaagagtagcgagacaacagattcattagggattttttttttgtcattccagtgattagtattgccatatcattagcattcatatagggctgtgaggcatcagtaatacttgaaattgacttgctatgaaacacagtagtctggcaacatttctatgcagtagcacactgagcactcggttggacaagatctggagtgaacaatacctcgctcacggtgagagtccgaccacttacttttgcaaccgttgtcggagtgccgccatggatgtgagcaggcacatgagtcagcgatctggagcgaatggagccttcctgggcaacacacctgcaccgtagttgcagtcttcctgagctcatgatctgcttgacatcgacaggcaatggcagcgcgggcgctcgacggcgtgcaggggtggttggctagggcaagcaaaggcagattaggaggctgttaatctggtcatgaacttttttgattattttgcgatttgtgaagatcgagagaggaagggaaaagggaaatgcggcggcaaatccagccacatcctcttaaattggtatagatatatattgggaattttaatattgtaatttgcaaagtatacagtttcgtcgtgtttgcaaagtgctaactgcttttgcagattgtgagaacatttctcctttccattcgttcttcctatggtctgttaattcactctaccacactggtctataggccacacctctccttttaccgtcctctgccatcaccccttacctgtagataaaaccttcataggtacctgttctgagccctttgttggtgctggtttttttaaccaacatcaatataggggaactagtgaggataaccaatgggcacccaattttatttttacatgcgtgaaaaacctaaaaacatagtattactccctccgtttcacaatgtaagactttctagcattacccacgttcatatagatgctaatgaatctagacattattatatatatagattcattagcatatatataaatatggacaaaagtcttacacactgtgaaacggaggaatgacatatttcactaggcagccatggtcaagtatcgtttcccacaactcacaagattttaataccattttacctctctctccacctaaagacttcttaccatctcaccggaaaacacttattgtcttggaagcaaatactattcttttgatacttctatcattcgaaacatataatccatatttagatctacaactgaaaattttattaactacaaaattatcgatctcatttagatgatctacaactacaaattgttgacctcgaagaaaaatgtaatcaactccaaatttgtatatctcgtcgagttatacaaatttgatataaagtttatcttcatccaacttcatatgaaaaacttagataaaaacagacatatgtaagtggcgtcattataggtgccggttttaattgtcgattggcacctatgaactcatagaggctggtaataaccatacataatacccatatatgacggttcacagtaaaaaccaacacctttaacatcgtttataggtaccagtttattataataaccaacacctatgacttgagaaaactattggtgtaggtttttttatggacatgcaccaataagtaattataggtgttggttcttaattttatccgttaaaagatgaaaaacgcttcatagatatcggttttagataccggtacctatatgaccggtctatgttgtgttctgcactagtggctagcattgtcacagggtaaaatgtgttatggcttcattgtgggccaagcatgatatggttgaacaaggtcgacaaggtgctgatcgagaatgatacgtgaaagccaatctaagcatagtctactggatggctaagagtaacgccatattgtcatgttagacatgaatgcatgatttggaatatgcaaactcgtgacttcaaggaaattagataatgatcttgcccatatatacaacacgtatacgttatgcatatacgtacattatactctaggtcacatgtaaccgtgtgtcaaagcaatagacactatcaaaatcatagtatatataagaacgttaagttctcacataaagacaacacaatatgggtatataactgagaagattgtgtatagacaacctaactacttatcatgtataaaagctaataatgtttgatgtgcatgaatgttattaacggcttatttgtttcctgatgcataaaatgtgtcgaaaattttgttaggcgatagaaattgtaatatctcaatgctatacgtgtcaaacagaaaacatatttaattactgttatattgggcagtggctaccagctagaaggattcaataatctagtcaactagatgattctccgtactttgctgcggaaattactaagtaacttttaatattttttaataattaagctaaaagtaaaaattatattagttattaacaacaaataaaaactggtttgtcaaactatgttaagagagaaataaatctaatagactatgtatgagattgtagatgaaatatatgatgttgcacgctttgattatatggatgaatatatggtaaatattataaaaatattgtgaaaaataatgtgaagtaagataattgtatgttaatttgtactcaatgaattatagatgatgttgcatacttacataagttttgtatgtaattattgctagtggatgataaggtgccatatttgaatgttgagctttagaattagcgggttataactttatagtaagataggatgtggaataaaagttactattatattgttaacaactcatttttctctattttctttaatttttcctcgtacttttcatacttcccctattccccctaaattcgcctcatatcccccgccttcatgtttttctttcttttttcacctcacattttcaccggcccatgtgtcacaagagtgctcatgccggtccggcatctttttaggttgtgccttgactgaggccttgcacgcggggcggcacgcgacagaccgctgctgctgtcatgccacaccactgtagaatcaaggagttgatttagattttgtgatgaaaatattggtggtttgctaatgttaatttggagattttataagatggttgattttgtgaagtggatgttttcggttgaccctggcggtcagaccggccgagtgccgtcggtcagaccgcaggtgttgcggcggtcagaccggccggcccgacggtctgaccggcaagatcctgattgatgtcggtttcgggttgttttgttggatttggatattaccttcggggatttggcttctagatggtttctatgcgtatggatactgttgttatactaatgtgagttaagttgggacgaacttgggctcggaatatggtttcttggttgttgcatgtgcaggtgttgcttgagaccttgggatagtgttgccggtgatagattattggagtcaacttgggagaagttgatgtccagggatcaagagatcatgcgggatactaaaggctagaggacaatgcacgtagtgatgaagaaatccatatggtatacaagagggattgtgtacgtatggaaagaggagtcaaatttggaagggagtccgaattcgggaagtttgattgagataaggaaagagatgagttgtttacttgcaagagagggtttcctacatgggttaggagtcctaagttgtgttagattcgtgggctttgcatagcctacctcatgtataaatagagagggagggtgaggcctcccggtatcgattttagagagactagagttgagagaaagttagggttttgaatttagttcgagattttggtgagaagtgttgttggtgcactttgtaaacactagttgatgcaataaagtcaaaaagtttcaatctacatcttcgagtttgtcatgaatcggtgtttctgggtcctgacggtctaaccgcacgtgcgcgtgcggtctgaccggtgggatagcggcggtctgaccagtgaggagttggcggtctgaccggcggcaggagggcggttcgaccggcggtgataggacttcatcgtcgtcttcgttcgagggtaatctttaattccgcaaaagatttttgggtttttggttttccttaccattcacctcccctctgataggttattttggtcttgtgtgatcctacactctccttaattctaagtatactatagaatatataaagaatctatagtatatttagagcctattgtagttcagctctacatcttggtgtgtgttgaaatgaatgatgagagggccatttataggtggaggtgccttgggaggatagagtttcttccaagcatccaatgagcatcttcatcctcctagtgccgggtgtccagcttatgatggttttcaccggtgaaaacggctataaccatcattggggagcggattgttgccgaacgcaacctgggcctagggcagcagcctctgtcatggttcggctgaactctggccagcttctttggctccggttttcgcctggacactcatttcgggcccctcattatattggtatggatgtttgtcccatttgaaggtgtttaattgggtttttgggtccaaaactctataagttcggatacgagtttgattctcctcctccttcttgtatatttcttctcgacttagatagtttgtcacctgcattcgaatatacaccaacactcatagaaattgttagaaataaaccctaccactatgttggatgttttatatttatggtcttatgcaagtattgacggtgttaatttggtacttaatagccatcaacaaacccacacacttagctctttactcgtcccgagtaaatgttgaggattaatgtggaacaaaattttcaaaaatataataaaagtacacaaactattctaagccataactgtacctataaactttgcagtgtataacttaccatcttgggtaactgatgaatggaacggttgtgactcaagtccttcatgtttctcctgtcaatctcttgagttttcatatgttttcacaaagtatctatactcctcaaatgactttctctcaaatcacgcatgtggtttaatttgtggatcctcaccaaggcatattttgccgaattgtccctattctaaaaggttgtatatgtggagcttggtagggatcaatcggggcatacctgcatcacatattttgcaaagccaaaaggtcggacccaaggagatagcgagttatactctctgatcaagaatgtgcatgtgtgtgatatgtgtatgggtatgtatgtgtatgtgtatagtatatttttggatggaaaaaggaaaataaaaaacaacaactcctttggtataccgcttcctccaattttctctctttggaaatttgagagagtgcatggctatctcctttttttttcatcatgccccatactttgtatgagcagattttttttctattttctctctctcatttttttttatcaatgctccatacttatatgagcaagactttatttttccttcttgtgcatagtcatgcatctctctttcttttttctttgaaagaattttggaggaagagacataaatgacatggagtatttattttgtggataatgaatataataaatgatggatgagagatgctaacttccagtgtagaagtttagcataacgtgcgtatgaggagtgtggtgtgatcttgatcatgaaagtatgaaaagtatctcacacaggtcacaataatttgacaaagctcaatgtaatgtcaagcggcctatacacatataaggttttgcaatgagaatcatatatggccttggtaggtaataatatagtcactaaggagtattgctctaaaagaatttttaattttcacaaaataaaatcccaagtatcatgaaagttggacatgaatttctttcgttcactagcacagaacctttcatctgtgatagccactaacatgcctggaattagcgggccgtcacaaggaagtcatctcaatcgggccaaaaaagcattcgattaagatatggtcgcacagacatattagatgggcataaaactcaggctcgtcatggatgacacctatccgtgacgggccgtagtttaggcccgattgagataacattccatatctcaatcgggcctcaagttggctcccatcacagatgaccatcatccgttacgggcaccaacttagggcccgattgagataacaactaggcccgccacagatgactcatccgtaatcgattgagatgacttagtatttttttctatttttcatatggaatgtttatatttgtgagtcgacctgtagcaaaataattaactgcagtataataattcattttattagtcaaaataatttttcgagtagtaaaggatttcaaatgga

SEQ ID NO: 66087 - DNA, 6277 bp, Oryza sativa
aactataacgcaaatatgtaacattgttcacaaaatttacatatctgcgttatagtttatgaaaccagatgagagatatgtgagttttgtgaacaatgctactatcactttgtcggatgaagaaatgaccaaaataaaagttatagatcttgatgagttatacaactttgttgttgatgactttttcagttgaaatcatttagtatttgaaaatgttgtttgaagttgccatatgtttaaattcaaattcaaactgttcaaaaaatgttatatagaaaaatgaccaaaataaaagttatagatcttaatgagttatacaactttgttgttgatgactttttcagttgaaatcatttagtattctaaaatgttgtttgaagttatcatattttcgaattcaaatttaaactgttcagaaaatgttatatagaaaaataaccaaaataaaagttatagatcttgatgagttatacaactttgttattgacaattttgccatttgaaatcatttactacccgaaaaattatttgaatttcttatattttaaaattcaaattttatatagttcaatcaaacccagatggagaaatgaccaaaataaaattagtagatctcaatgagggatgctggggtgtggcatcttggcccaggacttaataggattaatagaatactcataccaacaagttaccacttcttatttctaaagaactctgaggttaagcgtgcttggcctggagcaatttagggatgagtgacttgcacaagcctggagcaagcacatgagtgaggacaaagtgtacaacaaaaaagacttgcctggcctaggagaggcgggacgttacatgggatttcttttttttttttgtggattatactcatccgtgacgtgctaatgagagtcatccgtgacgggcttttttgttggcccgattgaaatgtgtgtcatccgtgacggtcgaatgccccattgagatatttcaccacatcagtgacctttgcttgacggggcccctacccgatagagatggggcttgccgcccattacaaatgactgaacccgtgctagtggtcataaccatatcataaatatcaattacttagatgagcatggttccctatgatagatggttgttcacaagtgacaagtggtagcaaagaataaaaggtatacacgattaatcataggaagattctatttgttgagagttaatgttttcaattttcattttgagtcaaactaaattatatttaaactttcgatgcaggtttgacttacaaacaggggaggataagggaggagacgcgcaaacctgaccacacggcgaaagggtgacagagccaggctaggcaagggtcgggtgaacacttggtttggccaacccagccaggaattggttctggctgctgaattttgtgcacagccgtgggccagcgttcatcataccatcatgtcaagttgatcttgttgcgcgtcgggagttccgaaaagactcccccacatttgtcttgtaccttttctttattcaacaaaaacataaaaaacaaaatgggcttccatcgggatgaaacaccggccaaccaaactttattcaataatcctaggcgcatgaagttcctaaatttattttttttatctttatcttgataatttttttcatggcaacaatgagcatggtgggtatcttagcagggtggagatatgatgcacaaggtggttgagattcttaccggatagttcttaccaagcttagaactaaatcgaatgcaacaaagttttgcatttgttctgcttggttccatgtgcatctttgttttctcggagaccaaggagcgtggtatgagtgttgtagttattttacactgctccttagttgtctttttatttactgcaaaaggttagtggacaacaaatacccgagggattacaaagaattggaaagattttatcataccctcaagatcagttgttcacatccatgctaaaaaggaattgaattcaaaacttcagaagtgtggatctcacaaatttgccataattttattttgtcatcatttttttcgagagacctttattttattcttgaaaacaaatatatatatttttcatttttttattgttcaccaaattttcatttaagcaaaactcttgcagggctgaggtaaatttgcctgaacaaggtaaaggagcattcaacaatatacgcactgtgcaccttgagaggtgatctatttctcttttgcatgttagcaattgctttattcctggccctgtcctacctctagtgtgactcgtgcatgagaactcacctcggttgacggaactcgtcatgaaaagcttgtagacctccccccacacacacacttggacttttgtgtcataagacgtcaaaaaccaagtgtgagatgttggggtctcttgtgttgcatcgccaaggatcaccaacgtgctcggttgatgtagctcttgcattcttaggcatcgtatgaccctcgttcttaatctcaacctgtgattgttagtgaccaagaatacccgaatgtgcatactattctaaaactggtccttgccttcattggaaaaaaaaacttgccatgataatccggggtaactcctggcagtgctttgtttatggtcacaagctcagccatagagacatcttgctgcaaagttagtgccacaaacacatacgagatttgcaatagttatgataaatataagcatccacaaccacacttctaatcatgttagaaatgatggccaaaaggcggttgtggtcctcgcacaagaaagcgatactaaactaataggaccctggggattccttatgtgagcatgaatcttggggaattttgaaagagaagctttcatgctcaaagtgccgttctcatcctccagagttgatgtctcaagcttatccataacccaaaggttctccttctcaagagatgcatcgtgcaagaacgaggttgtttcttgacaactgtcaagaacaacatattgagggccagagagataaggttttggctcgattggaggtcatgatggtggttttatggaatgtaattcaaagatctcaaccgactcttctttttcttggataaaatccagagcgtcttgtttagaagatgatttgagcagctaaaatggaagaacaaccattatgtcctccacgatatcttcttcaggaagggtatcagtcaaggcttttcttgactgcgagaatggaacaaagaaattgaccctcctaaagagaatttgaggctacctaatcgaggagtattgatgagaagtttctcgattggatgtcttattagaacatcaaaatcttggatttcaaaaacatgaataatccaagattgcctccttgccatcatgaatgacaggcacgtcttgtacaatacctaattcttcaataagactcccgttagggtgctcgaagaatttgtttgtcggtgtaattgccttgtcactcagaatagtgaatacaaaggattttgagacaatattggcacagactgatggactgtaaaggataccaacattattcccttctaagtgatagggaatggttcgaggagcgatatttattagaattacttcggaagaaagctctgcctcctttagccattcgtcactcatgattgatgtcagctcccgaactgtttcctttagatatccatattctattggatcgagagttggctagagaataggtggccgtaatattcgagaagatcgtccctgaatttgggagcacatcccggatcatgaatttcttcaatatctggagatagttcccgggaggattcctcattagatctgatgatgttgacggttcaggttcctccgtacctgacacagatgcctctggagggggttcaaatcactgcccgaaggtatttttggatattctatcgagaatttcctttccttcgacgggggttttgtgcatgaatgacctccagcagttatgttgaggtaaagtgcagactccttatccaaacccgtatggaaatgttgcagtaatgcaaaatcgggtatggcaaggttgggactagactgtaccagagtaacaaatctggcccaagctgcacctattgatttcttattattctaccgaaagctgaggacttcgatccggaggaaagtaatacgactaacaggaaagaatgtgaggcacaaaatctgtctcgcaattcattccagctaccactcacactcccaacggtgtaaatgtaccattgttttgctctctcttgaagagagaacggaaacaatttccatttaatagtctcccgtggcatgccttggatcaagaggcacgaacacagatgctcaaactctcgcaggtgatgataggagatttcctggtctagactagagaaagatttctccctaaccgtaatgatgaattcgggacgaatttcatagccaggtgttaaataggctccgatgaaggaggtggctcgtaaaatttgccccgtggagcagatagttgaaagatatattgtggctccatgggcgagaagagttttacaagaacatttctctgggtagcaggggtgaaggtagaagaaagaaaagtaaaaaggatatgaggatgaacaaggtgcagagataaacaacaaccgttctccggcaacggctctagaaatgcttgttggtatttcttaacgtcgcagatagaatttgcaagcgcacggaagataccgatgtagcacttgacccgagagtattccaaggtatcgatttctgcagggaacgtgtgtgttaactctttaccaggttcatctaaggacacgaagcaaagataggcaaagggtagagaggatttactagtgggagacaatgtctatggaaagcttaatttaatcctaacgcgatacttcgggtactggccagctcgctactcccagatatcgctctactacgtacccggacaggaaggactttagtgatcttgagggctgtcaccacctctacacccactgcacacctactgtgggatacagagcaaacactggaaatcaactacctagacaccatgtctaagcaattaatagctattctagtgtttagaactcactaaagcaatcactattttactgtattatagtgaacgatgatctagcacgctgattaggaaataactaagaggtaattctcaccaagcaaaactaaattactcaaaagatatttctattataatcagagtaattaacagagcagaaagaaataagaagaggattattgataactccggaactcctccgacttcttctactctctctccctaatctaatatataataaagtacaatagagcctcttataatttagctcaagctttggtgtgtgtgaatgagggagaggagagggccgtatttataggtggagagatgccttgggaatgtggagatgctaagcatcctaagagcattttctctcttgtgttgacaagtgtcctctctatgacggtttccaccggtagaaacggtcacaaccgccaatggatgaggattgcaactgccaggtgaaaaatgggcctggatggactagctggtggtttggccgaaccctggccggctctgctagcccagcccttcctcctagagactgatatgtgggccccattgtatattcttctgaagattggctcaaatgattgcatcttattgggtttatgggctcaagactccattagcttggatatgaaagttatattctcatccttcatgtatattttctctcaactttagtaacttgtcacctgcatacaaatatataccaacactcgtggaaattgttagaaataaaccctaccactatgttggatgttttacatttatggttttatgcaggtattgacggcattaatttggtacttaacagccgtcaacaaatccccacacttagctctttactcgtcccaagaaaaggttaaggattaatgtggaataaaatttccgaaaatatgtacaatataagtacacaaattattttaagccatacctgtacctatgaatttttgcactgtctaacttaccatcttgggcaattgatgaatggaacggatgtgactcaagtccttcttgttcctctcgtcaatctcttgggttttcatatattttcacaaagcagatatactcctcaaagggctttctctcaaatcactcatgtggtttgatttgtggatcctcaccaaggcatattatgccgaattgtccctattctaaaaggctgtatatgtggagctctgtagggatcaatcgg

SEQ ID NO: 66088 - DNA, 4751 bp, Oryza sativa
ctaaccacatttattgcggtttggctgagcgtgtcacgccgcatgtaacgcagtgcagtgcacttgtttatccggtctgtgaccagtcacagaccggtcagatcgcgggttaggtggcgacaggcgatctgacgcacgcctcgccccatcccgtcaggacgagggcttctaggcgctcgtccccagctggagctagcgtgttacctcccagagatggcacgttagtcctagtcagatatatgccaggcttcatcctaaaccattacaggcaagatgttgtgtgaagaagggcgagcatgtagattgctaagctgacacgtggtggacaagaatgaccgacgtgactggtctgataccggtcatgtcgtcagcagacagccacgattccacgtcgcacctgctcccggcgaaagtggaggtagttgtgggccgtctcatcagaaggtgactcggacggcaactatacaaacctccgtccatttatgaaaaggggggggggtaagtccccacaaaaaagagagaaattgtgcatgtggtatccccttaagatataaaaggaggaccttgcccactgagaggggggactggacttttccagattagaaacccagaacaagggagaggctggctgatactttgtagctccttcatacacagatctcccaaaacacaggagtagggtattacgcttctcagcggcccgaacctgtatacatcgcccgtgtcttgtgtgtttcctgtctcgcgagccttccacatacagagagcttagaatctctccctgagtccccggccgaaccggcaaaggggggcctgcgcggtctcccggtgaggagccccacgctccgtcatctggcgcgccaggtagggggctctgcgagggattttctgagctctcgcactctttcgtgtgcgccaagtttttcctgttcagcccaatggccgagccagcaaaggcgcacgacctctccccgagtatgagcggtgacgacggggagccaaacccacgccgtcgagctcgtactccaccgccccctccacgccaaagtcctaggcgggagaaggcgctcgagagggccgaaggatccgcgacttcgacacccacaggaggtggagaagggcggcgagatggggagcgtcgcctcctcgtctacggcgacggcagcacgccctagggcgcgctccaagctgcgggcgcgctcctacatcacccgcccgtcgcccatgacccggagtctccagcccaacgttggctggacgatgtggccaaattggtcatgactgcacggcagcgcctagatgctggtgggcggtcctccgccaccaaggcctctggtgctgctaccaccggctccgcatcgtcaagacggagggcgcggcgagcggcagccgctgttcgccattcggccgccactccttcgtcaacgcctccgacccgggaagatctgcgtggggaaccggatgctcgcatcagtatcgagcgccggcgtaatggccgacgtgctccccacgcaacggagggcgcctcctcgtccggagtgtcacctcaccacggacgcggggatcagccctccgtgcccccggttggtggtgtcggctgtagagcctttgtgacgagccttcggaatgtccgttggcccccaaggttccggcccaccatcgccgaaaaatatgacgggagcgtcaaccccgccgagtttctccaggtctacacgaccgggatcgaggccgccgggggtgacgacagggtcatggcgaatttctttcccatggccctgaaaggacaagcgcggggttggctaatgaacttgccacccgcgtctgttcactcttgggaggatttgtgccaacagttcaccatgaacttccaaggcacatatccgcgtccaggtgaggaagcggacttgcacgcagtacagcgaagggatgatgagtcacttcgctcgtacattcagcggttctgtcaagtccgcaacaccataccatgcatccctgcgcacgtggtgatttacgcgttcagggggggtgtgcggcacaaccgcatgcttgaaaagatcgcctccaaggagccccagactaccgcggagctttttcagctcgcggaccgagtggctcgtaaggaggaggcatggacctggaacccctccggttccggtgtggcagcttcggccgcccccggatccgccgctcagatagggcggcgtgacaggaggaggaagaagaggtcagcccataccgacgacgagggtcatgtcctcgccgtcgagggcgcttcgcgggccacccgaaaggggaggcctgcgggaggcaaaaagaacgaggccggcgctcccaacagggagcgcccaaccggcaagtggtgcaccgtccacaacacttcccttcacgacctcgcggactgccgtgcagtcaaaagtttggctgagcggacgaggaagtgggaggaggagaggaggcaggagcgccgagagggcaaatccccggcggttccttccggtaatcggcgaagtgaggccaagcagaaggcccccgccgaggacatcgatgacggcgatgatgacctaggtttccaagagcctggggccaccattgccactgtcgatgggggagcgtgtgctcacgtttctcgccggagcttcaaggccatgaagcgagagcttctggccgcggcccctactcatgaggcgacgtgtcgggcgcggtggtcggaggttgccctcaccctagaagcttgcccgcaggtacaccgaccacccaccgtgcgttgcccggggagggcagattgcgatggtggtttctcccaccgtttgcaacgtgaagttggggcgtgtcctcattgatgggggagcagccctcaacatcctttcccctgcggcctttgacgccatcaaggccccggggatggtgctccggccgtcccagccaattatcggtgtgacgccggggcacacgtggccgttaggtcacatcgacctaccggtcaccttcggtggatccgccaacttccgcacggagcgggtgaacttcgatgtggcggacctcagtctgccctacaacgcggtcctggggaggcccgcgttggtgaagttcatggcggcggtccactacgcctacctacagatgaagatgccgggccacggtggccccatctctgtccatggcgacctcaaagtcgcgctcgcttgtctggagcagcgcgcggaccacctcgccgctgcatccaagcccgagggtggcgacgagaggcttggcgcttccgccctcgccaccccgaggcaacggatgatcacaggcgacgaggtcccggtcaaggaggttgccctgggcgacggcccgtccaagaccacacggatcggtggtcttctggacggcaaataggaagacgcgctcgtctccttcctgcgggcaaacgctgacgtcttcgcatggagaccggcggatatgcccggggtccccagggaggtgattgagcaccgtctcgccgtgcggccgggcgcaaggccggtctggcagaaagtgcggcggcaggccccggaacgtcaagccttcatccgcgaggaggtggcacgacttctggaagccggattcatccgtgaggtcatccatccggagtggctggcgaacccggtggtcgttcccaaggcgaacggcaagcttcggatgtgcatcgactacaccgaccttaacaaggcatgtcctaaggatccttacccccttcctcgcatagatcagattgtcgactccactgcggggtgcgaccttttgtgttttctagatgcatactctggttaccatcagattcgcatggctagggaggatgaggaaaaaactgcgttcattacccccataggaacctattgttatacgacaatgccctttgggttaaagaatgcaggtcctacttttcaacgtactactcgaatttctttgggtaaccaattaggacgtaatgttgaggcttatgtcgatgacttggttgtaaagacgcgcaaccaggaaatgttactctcagatctagcggaaacttttgagagtctccgctccgcccgcataaaactaaaccccgataagtgtgtgttcggtgtacctgcgggcaagcttctagggttcttggtctctgcccgaggcattgaggccaaccctgagaagatacgggctatagagcggatgcgccccccagcaaacttagggatgtgcaatgcgtcaccggttgcatggccgccctaagtcggttcatatcgaggctgggagagaaggcgttacccttatttaagcttctcaaacgctccggaccgtttacctggacggaggaagccgaaaatgccctcacccagttgaaggcgtatctaagctctcccccagttctggtcgccccggagccagacgagcccttgttactctacttagcggcgaccccgcaagtagttagtgcggcattggttgtggagcgcgatgagaacaattctcatttcacgcttccccaccctgtgccgacttggcccgggagagagcagggaggagaggctcccgagccgaacggtggcccaaggcccccgacgaccggagttggccctctgcccgcttgtcagacggtgctaggagcccccgacccccaggaaggccctgaggccactgtgggaaggccgcacctatcgcccttcgaccccgaggctaaccctgtgctgacccgacccgggaaagagcagggagaagaggtccccgagccgaacggaggcctaaggcccctgacg

SEQ ID NO: 66089 - DNA, 7245 bp, Oryza sativa
  unsure (1)..(7245): unsure at all n locations
ttcctgcagcccggcccagaagatgctttacgctattctgatggcctcgaggaaactgcgctattatttccaggcgcatcgggtcacagtagttacgtcttaccccctcggtcaaatcttgcataatcgagagggtacaggacgggtggtgaaatgggcaatcgaactttctgagttcgatttgcactttgaaccacgccacgctatcaagagccaggccctcgccgattttgtggcagagtggaccccggctcccgagcccgtctcgatccccgaggccagcacggacccctcgcagctgcctcacaccgcccactgggtgatgcagttcgacggctccctgtctcttcagggcgccgatgcgggggtcacgttgacctctccgagcggagacgtcctccgatacttggtccgcctcgactttcgagcgaccaataatatggcagaatacgagggactccttgccggactaagagtggcggctggactggggatccgccgcctcctggtgttaggcgactcccagctggtcgttaaccaagtctgtaaggagtaccggtgctctgacccgcagatggacgcctacgtgcgccaagtacggcgtatggagcgccattttgacgggattgagcttcggcatgtgcccagacgggataacatgattgccgacgaactctcacggctcgcgtcctcgcgagcccagaccccaccgggcgcctttgaagaaaggcttgcccagccgtcggcgcgacccgaccccttaggggagacggatgcgcctgaccggcccccgaggcctgtcggagtccaggcctcgggacccgaggggagtgctcccaactcccttagattgattgcttggatcgccgagatccaagcatacctcacagataagactctacccgaggaccgcgaagggagtgaacgcgtccatcgcatctccaaacgctacgtgctggtagaagggaccctctatcggcgcgcggctaatggaatcctcctgaagtgcattcctcgggaacaaggcgttgtgcttcttgccgatatccatgaaggcgaatgcggagcccactccgcctcgcgcaccttggttggtaaagcttttcgccagggtttctattggccgacagctcttaatgatgcggtcgacctggtccggcgatgtagagcgtgtcaattccacgccaagcaaatccatcagccggcccaggccctgcagaccatactactttcgtggccatttgctgtctggggactcgatatcctgggaccgtttaggcgggccccgggcgggtttgagtatctgtatgtcgcgatcgacaggttcactaagtggcccgaggcttatccggtcgtcaagatcgataagcactccgcacttaaattcattaagggcatcacggcccggtttggagtgcctaaccgtattattacggataatggcacccaattcactagtgaactcttcggcgactactgcgaagacatgggcatcaagctctgcttcgcctcacctgcccaccccagaagcaatggccaagtggagcgcgccaatgcggaaatcctcaaaggccttaaaaccaagaccttcaacatactcaagaagcacggcgattcatggatcgaggagttgccagcggtgctctgggcaaaccgaactacaccaagccgagcaaccagggaaacgcctttcttcctcgtctacggcgcggaagcggttctcccatccgagctcaccctgaggtctcctcgggctaccatgtattgcgaggctgatcaaaatcagcttcgcagagatgacctcgactacttggaagagcgaaggcggcgcgcggccctccgagccgcgcgctaccagcagagcctgcggcgctaccatcagcgccacgtccgggcccgatcactctgcgtcgacgacctcgtcctacgccgcgtccaaatgcgtgctggattgagcaagctttcaccaatgtgggagggtccgtatcgagtggtcggcgtcccccggccgggctccatacggctggccacgggcgacggcactgagctgcctaacccgtggaacatcgaacaccttcgtcgcttctacccctgagggggggggtcgggtgtcaggtttcgggctcgggccaaccccgcacccccctcgggcgtgcagggttggccgggggctacaacatatgcatattcttatttctcttatatctgaatttctataaaagcagtttcaatttcctaaaggctgtatctgtgctgttttttccttttgaagaatcttgacttgaaataggtcactcgtgctcaatcctgccctcgggggctcgggtcggctaaaatcgccaaacggggcccagaaccgagccgtgccccgaggcgtggtgaactccgggggggaatcggcaaaaacccacaatcgggtcacccataaccctcggtcaccacgttcccggcctggccagtctcgacatgtggatctccccaggcactagccccgacccgcgccttttgaggaccagaacctgggcacaagcccttattcaagctaagacacaaaaggaccacgacacagatcatcctcatctcatactcacagcaagatgaaattaacacaaaaatttcttcatttttgattacagattaagttgatctatacaaaaaagaggcccgaaggccttagaagaaagaaaagaagaaaaaactgaagaatggcgggggtctgggggctcaatccgatgcgcccggatcgccggcctcgacgtcactgtcgtctgcaccaccggcattgccctcctcgtcggagttgggggcgaacgcaagccgaggggccgagccctcgaagctgtcgacgatatggtcggcggcatcctggacctgcgcgcgcgcgcggtcctcggtcccaggagggaactcatccagcgccatccatggagagaaattggggtctctggcctggtaactcgccaggacgagctccaccgctccttgggcgaggtccctcgaggatgacttaattgtcttctcgagctcctcggggagccgttggagagccccggccatcttcgagaggcgctgggcgaggcctccctggttggcggcgtactttacggtccgccctctccagaggcccacttgccgaccggcgcaatctaggcgggagacggcgtcccaaagcatgccgggccctacctcgcctgccaagcggagggcttcgacctccccggcggacgagtccagcgcgccctgcagatcggcgatggtgcgttcggcagctgcgaggcgggcggctaagtcgctttcgcccgtggccgccccgccgctgcgcgccctcgcgtccagctccttcgcccgcgcctcgagctcagcggcccgttggttcagtacggccctctcggtgcgggcaccttccagattgcggcgcgcctgctcctcctgcgctgcctcgcggagggacaggttgaccgccagctgttgcgccgcggcctcggccccctcgagagctcgctcccgttcggtgagcgcgtcctcgcggaggcggagcgtgaactcttcttcagcgcaggtagcctcgtgcgccgccagcgttgcttcccggatggtgacggcggcctcgcggtccgccagatccctctccacgacgcaggcgcgctcttccagcgccatggcgcgcgcctcaagggcctcttcgcgccgccgggacgccgcttcggtctccaccgcccgctgttctcgggcagcggcagcgtcaagcaccccctgggcggcgtcgagcttcttccctagctccgcctcccagctcccgtattgaaggcggagggtgtcctgcgcctcgttcatcacggtggtggcaatgagggcagccccccgctcctcctccacttccttggcgatctccgccagcaccttcttacgagtttcaagctccgagacgtgccggcggtgagccttacggcccacctccaccatggcctccaccgagcgtcgccctcttcgacacgcgcccacgcggcgtcgagctccgcccgctctgcctgcaggacctccacctgggcacttaacccatccaacaccgtggtgtttgcggcggccaaggcctgcagaaggggctctgcgttcagtagggcgatagaaggcgtggggaagagccgccttggagaggatgccacgcggctcgggccgccgatggaagtgccggactcggggatgtcccccggacccggttggtcctgagcgtcgcccgagggagtaggcccaagcgacgcgcccgcggcctcgtcgccagctgccccggaagttgtcgcctgagtgtcgcctgagggagtgggcccaagcgacgcgcccgcggcctcgtcgcgagctgcctcggaagtcgccatcgtctcgtcctggcgaaatccggcctcctcccgagcggcttccccggcctggcgggcccgggcggcctcctcccaagcggcttccccggcctggcgggcccgggcggcctcctcccgagcggtttcctcggcctggtgagcccgggcggcctcctcggcttcccgtaggagatccgcggcctctcgccggtcagattcccgcctgagggcctctgcggccgccggatcctcggcctcagactggccggacttggaatggcgggagggacgcgacgggatctcgctgaaacgaaagaaaaaaccagaagacgaacaagatgggtgagtgaaaactcgcgttgagagaatgaatacagccacgatgggagagagacgaacctgcgagggggtcggttaaacgaccactttggaggggaaatgaggtttccccgagatggttctgtctcccccatcttacggggccgcttcttcttgcgctccccctcgggctgcgatgttggcgcagccccctccgggcgcctgttactggcacgcgccgccgcgccccctcggggaggagatgggggaggtgttcctccctgcttcctcttcccccgggcgtcggcagggcggctgctccccgggcccctgtcgcgggacccagaagcacgaccccctctcggggtagattgttcccccctgcggctcccgcctgcgccgtcgtggccctttggagctcgctcctctgaggccccgaccgccatcataatggtcaggatggaggcgcggtctggatcgctgcagagggggaggattccttggggaatgagggccgcctctacggagttgagattcagcacccgttggaccaatatcttgaagtcctcaggagcccagtcccatctcactccctggtgggtcctcgtgaagtcttcggacccggtgtactcccaggcgccccgagcgcgtcgctggagcggcgcaatccgacgacggaggtagtcgccgtacaccatggcccctgtgagcccctgggatcgcaggcccgccaggcggtcgaggacggcgtcatagccatcccccagatctaccggcgcccgccagctggaggcctgcaccgggggctggctcggaagtcggaggcgcgcttcgtcggcgaggggagtgtagaaccagtcactcttccagtcgtcccacttcttgcggagggcgcaggggatgtagcggttcagcaccggcccccgtggctggaagtagcagccaccgactaccgatggcggcgacaccgactgcacggtgaagaaccaccggaacagccgaagagatgggcgcaccccaatgaacatctcgcacagatgcgcgaagatggccaatgtcatcaccgcgttgggggtgaggtgcgccatctggagatcgtagaactccagaacatccatgaagaaagaagaaaatggtggaaccagccttgccattgcaaaggggagaaagaagacggaccgccccgggtagtctggcgccgggcgtccctcgcccagcgtgactatctcctggccggtggcagattccggcatgaagcggcgcgacagcctagcctgcctctcgctcacgatccgggaaggcggcagcacgctaccatcgagcagagcggaaccccgtgccatggcgccggaggaagagaagattaagagcgagcgcgtgtggcgaaggtagggcacaggaaagaaggagttagggcgcaagcggcgaagacaaggggaataatggcgaaaggaaggaaacagatcccttcctcagtgcctttatactcttgccaacgctgtgcccggctcctcgcttctcgcgcccactatttcgccccctcgtttctcgcgcccacgcttccactaatcccattcgcccgcttgcggcgcatgaggtgggtatgcggttgtggcagtcgagatagatcatatcgtgcgcgcattaattacgctcgccgaccgaagcgacgttaccatatctttagacgaaacgaatcgccatgtccagattcgtgtgctactcaagtaatgtggcagtcttgaagagaccgctcattgttgacagcagagttaccattgccgatgtgcgtggtttgtgaccgttggttttctgcccaattgtggagaccggtcccacctgtcaccaggtcttaagagtggcgtcacgcccgaccgtttcccttaaagagggcgatcgccctggcataacgccgggggctactgtcggtgacatgggatcaggagtatcatgactagaggtttgaggcagacacaatcgcacacgtggcctggtacccccgagggacgtcgggcccgagggtgatgcgttcgccctcctcttagtccccccgagggggantgtatgtactgtatcgccccataggtgaattagagctgaatcttttgttatttaatttttttaaaaaagcattttttttaacaacgaacaatgtcaaactttttttttaacctgaaccttttgaccatgccaatattctttgacattaccaccgcaaagcttcatacaacactatttatgtggtaagaggtgccacattgtatgttgctatcctgtggcatggcattgccacatcaaagctttttcccatttcaaagaggattttgctttgcgtgtgcatgtgttcagagcaaaaaaaaaaaaaagaaaaaaaaccacttagacatcatagctaggacttttagcataaccaatgttgtacattcttcattctccttgtaattatttttccctcaaaaattattttttgcctgttgtacataactttctctttataatggaaaattacagtaggaggctctccatgctgtgtttgggtaaaaagaaaaaaagaaaaagcttccgtcacatttac

SEQ ID NO: 66090 - DNA, 7098 bp, Oryza sativa
  unsure (1)..(7098): unsure at all n locations
tgaaggtagttgtgggccgtctcatcagaaggtgactcggacggcaactatacaaatctccgtccatttatgaaagggggggtaagtcccccaaaaaagagagaaatggtgcatgtggtatccccttaagatataaaaggaggaccttgcccactgagaggggggactggacttttccagattagaaacccataacaagggagaggttggctgatactttgtagctccttcatacacagatctcccaaaacacaggagtagggtattacgcttctcagcggcccgaacctgtatacatcgcccgtgtcttgtgtgtttcctgtctcgcgagccttccacatacagagagcttagaatctctccctgagtccccggccaaaccggcaaaggggggcctgcgcggtctcccggtgaggagccccacgctccgtcattaacgaagtacaaaaataaggaaaggattaccgataactccggaattcctccgacttctattttactctctccctaattctaagtatataccatataacatataaagatcctaaagtatacttagggcctattgtagttcagctctacatcttgttgtgtgttaaaatgaacgatgagaggagtatttataggtggaggtgccttgggaggatagagtttcttccaagcatccaatgagcatcttcatcctcctagtgccaagtgtccagcttatgactattttcaccggtgaaaacggccataaccgtcaacggggagcgatttgctaccaaacgcaacctgggtcgaggcagcggcctctgtcatggttcggccgaactccggctcagttggccccggttttcagcctggacatttattttggaccccttattctattggtatggatgtttggcccatttagaggtgtttaatttggttttgggtctaaaactccataagttcggatacgagtttgattctcctcttccttcatgtatatttcttctcaacttaggtagtttgtcacttgtatatgaatatacaccaatactcatgaaaattgttagaaataaacattaccactatgttgtatgttttatatttatagtcttatgtaggtattgacagcgttaatttggtacttaacggccatcaaaataatcacctatataaatttactaactaaaaggggcatctatataagatagccatagctcgcgagacaactcattcatcataacgttatatcaagtgatccaccaccacttagaacaaagctttattattttcctctcagtactcatgcatgctttctgtcgttccatcaattaatatagccatataattatcactcaagcataggattgcgaggcatcagtaatgcctgaaattgggcgctgttgagatagtgtcttctactgaaattgggcgcctgtgagatagtgtctgctaggaacattttcgtgcagattcatccaattacatctaaaatatgttatgtggcttcattgtaggccaaggatgcatgtagcaaactgagaatgaagccagaaccaagcttagagattttggctaagtggctaacagcaaggccatcttttatgctaggcatcctttggaagcaaactaagggctcattcgaaatgtagggttgaaaaaaatataaaacataggatttgaaaatacaagaatttcggacatctttgaaatgcaagattgagaaaacataggaataagaaaaacataagaatataatgttatgattattgaattcttatgggattataaaacacagaaaagtctctaaactatcgtttgattagcacatagaaaaaacgcaggaattttagacacatgaaaaggaaaacatggggtgaggcctcatacttattttcctccaaaattgctgtagcataggaatttcaaaggaattggtagaaaacaattatttgttttaaaggactctataggattatttctcataggataaaatcctctaaaattcatgtggtttttcctttgaaacaaagggggccttcataggaatggatgtctagatgaaccatgggaaaaacacgggaaacaacggtacgtgaaaagtttattagagagttaactatagtcttatccctaaaaaagcattaaataataaaaaggagaagcctgatgatgcttaagccttgcgtacgttagtgtggcatcagggcttcatttgcctcgatcctccgcaatgagaaagaaaacaaagaggtcagactggacatttttcccctgcagttttcctacaaaattagcaccataagaaagtttccaccatttttccaaagggataatcctccattccgaatggacaaacagtaccatttcctattggaattagaatcctctgtttttcttccatgaatccccgatccaaacaagccctaaacatcatgatgtataaaagctaagggcccctttaaatcatagaaataaaaaaacgaaggaataggaaaaacatatgattatgagagaaatacaagtataaaacagatgattgcaaaacacaggaaaaaatcataagaatgattgtttgattgagccgcatgaaaaacacaggaatttgaggagagataaagactcaaaggattcttaacatgaggcaaaacctcatgttaaatttcctccaaaacttacatgggaagagacattccgtaagaatttcatagctaggattccataggatttattcctttgattcaaagggctatataaaaaaaattcctataggaatgaaaccctttaaaatttctatgaatttcctttgaatcgaagggggccaagaatgttaacagcttattagtttcctgatgcatataatttgtcaaaaaatattggcggacgatagaaatcgcaatatctcaatgctatgcatgacataatgaaaacatatttcattatattggacatagcaactactagagcgatttaataatccagatcaaatgtggaaagctcctattatgttgttcatcagtagagcttctccttttccactgttacaaatggattttcttaagcttcccctcattacaattgcctgcttagtgctaagtagttacaacatataggatatgcaacttggtatttaaccaatagaaataacgtgagatgaacacaaacactttattataaaccttgtaaccatcatcattttatctgtctcatggatatatactggggaaaaactcatgcgcttatgtgtgaagcatgatttaatactattacatggatatccaaaatgaatgtaggactgttgaatagatgtagtacaaatgagcacatcaaaagttagaaattaaattgcagggaaaatgaaagcatgcacggaaatatagcatggtgcatgatgtactttgttttcaaccataaataaacagctgccatagctattgatatcatatcagcacatacatttttttgatcttttgcgattgagaacagaaactttgaatcaatgaacgcaaaattttgaaggaaaaattaagtaaatgtgacggaagctttttctttttttctttttacccaaacacagcatggagagcctcctactgtaattttccattataaagagaaagttatgtacaacaggcaaaaaataatttttgagggaaaaataattacaaggagaatgaagaatgtacaacattggttatgctaaaagtcctagctatgatgtctaagtggttttttttcttttttttttttttgctctgaacacatgcacacgcaaagcaaaatcctctttgaaatgggaaaaagctttgatgtggcaatgccatgccacaggatagcaacatacaatgtggcacctcttaccacataaatagtgttgtaatgaagctttgcggtggtaatgtcaaagaatattggcatggtcaaaaggttcaggttaaaaaaaaagtttgacattgttcgttgttaaaaaaaatgcttttttaaaaaaattaaataacaaaagattcagctctaattcacctatggggcgatacagtacatacactgcaacccgtgcaactatgcaatatatttattccctatgtttatctcttggctttgcaggacggaacacgttcttctgggtttaagccatgaactggtcttgccttttatttttaatccgcattgaatttatcttgttagagatgacacaccagagccatggcctagtccctgtggcctccaccctgactagccacttgtcaacagtaggttttaccaaacttgcaatacctcacattacatttaaggaatattggcattattaatacacaacaatttaattttttgtccatcaaacatcatttttttttaccagagagagtaaccaagtattcaaatcgcattagatgccttctcttctgcgaattcagaaacagctatctcatcttataagttcagatttcagaatgaactccaggataattgagccaccagcgaatcctcggcccctccaagcaacaatcgcccagcttcattccccctgctccagctttggggagcaggggagacagggcgggacactggaacagaaaatgaaattgcattagtccatgctgagcaaaagatgaacaaggaacgtcctcttggtgtcctagaacccctggcagggccatgaatgctcacatggaagaatcgcccatttttcgcttgcgattgcgtggcagaataactcacggtctctgaatgcacaaggtgaaaatggttccatgtgtttctggtatcccagtaggccagtatacttctgatcaatgctttgtgtggagatctctggtttctataaaccccaggatgatgatggctcttgtgagttgtgaccaccaatttgtccaatggttgtccttgctcccagctgcacatgaagagcatgagaaagtagtcaattagttgagaacccagtactgtagtactacgaataattgagctctgtgcgatacttccaagttccagcatgtattttaccagtatttatggttcaaggggcaataattatattattattactattgaatgaaaatatcgacaacaataggactgcttatttcagttgggaatatcaaaatcaactggaacactgagcattcactttactagcagataaggtgtaagttgcaaatactcctactagatagtaaagagaaggaccagttatgcgatcgatttcctcacaatagtttgtccactgatacaacatcgggtattcttaaagtagtaaaagttttgtacgggaagcataatagatggcatcaaattgcatgtcagataaatgtgatgcagataaggcttccacagaggagaatctaatgtatgcaaaaaatgcaaataaataatattcttttggaccaaactagactccaagttatgctgtagtacctaggtttttgatatgcctaaacctatgatttccttgtgtttcagtaatgtgatgctatcgacctggagatctttaaaatcataaaaaaaaaagtactagatatgtgaaatcatccaactcaggagtcaggaagcacaaaattaccgctggcacgaatttgaaggactgattagttttaatcctcggacagcagcctgaaagcaaattaaaataacttatcatgagtcatgattggagtgacaaaggtaaaaaggaaagaagggctggagagtcagaatgacctggtgatcaaaacttcgatgatcttcctgaatgatggaaaacagaaaagttacaatataagccaatcagatcttctagtctctataaactaaagcaacaatatcttgagattagccttgaaaaaagaagtcctgaactgatgtttcaaaatttgttcacacccttccttacaaaagttcaaagaatgcaaaagcatgtcacagtcttacagaatgtgaattaaaatgtcaggaaagcctcatcggacaacatgaagattcaaaattagatcggttagacttctactagtacttcataaattaattggtcacttagtcatctcttagcattaggtgtcctttttgttaaagaataaccttgacactgtaaacattagggtaataaaaaggtaaagataggaaaaatgatgaaatggagcacacggcataaacgaattttacaggaaaaagttcaattccctaaatcagggaaattcctgagaaatagagtccagagtgtccatcagctttctatgtcatattatcttcatctattttgtgattttccatatcaatatcatctctttgggtaatgctgcttaacctcagacataaataaacaacaaatattctctttgctaatgacaactttcagtagcatatataaaaaattcaatcaatttatcactccaatgttgtcttatattcacatggaaattattataagattttgcacttaacattcgtgtccctgctctttttttattctccacaacaaatatctcctaaatgtattacagaagagaatcactactgtaaatccaggtaatttgttgtcttaatttaattcaatcataaatagtgttcaagtcgacaatgagtactcaagcataaaatttgctgaataatccagccaaaactaaagataaatttccacagtgaaaatatgagaaatcagacaacacaaagtacccatatatcattaagaaaaaatgtatgttcctatagctctaatgacccaggagacagtcagacagtatgtctgtactgaggaagaagcggaacacaccacaatcaaatgtgaagttcatcctggtatgagttgtcactgtaaaactacatcttgacatgagcacagcaacttctgcctgcaatgcaaattctcagtggaggttttgtttcttgaaaaagaaatttcttctttaaatggatggtagttcactattaattttacattcatgcttgtaacaaaataagagcagaaaaattttaccttgtaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 66091 - DNA, 2514 bp, Oryza sativa
tgcattttaattctagttcaataaggaagcaggtggcatattgatgccatcatcagccaaacatgtaggcactggactgaacttcgaacaattaacttctatacttcagaagaaaaagagcaaatttgacaccgacatattaatgccgacaattgactccatccgccaagtatgatgcccatatgcacacttgatgtttttattctgtataatagttagccatagtttcctattgattttgtatactgtatatgatatattaatatttattaatgaataatttgcacatctaaatgcagtgtactggcaatgaaattcaaccatactctggtaaatttggtcctgatgatattaatgaagttgatttggcataccggatagttgcagatcacataagaacaagtagttttgctattgccgatggttctcagcctggtaagtatatactgtttgatggtgataaatgatatgaaacacatgcaaatgcttagggttttcttgttgtgacacatgcaaatgcgattatgagatgtatttgccttgttaatgaaataaggagctttgtcaccttgcattctatatggtatgatgatcttcaaagtttatctgtcatcagaacatcctctagattcttggtccacctggtttactagggacggtaatgaactgaaaagattatgtggtgcatactgcactaccattacctgttttatttgtcatatgtttgttatcctttcagtcttcattttgtagtgaaaaatggttcttgcctgtctgtaatattatatcctttttaggaattgagatagcaaggaatatgcttaggcgggctatttacttcggtcatcaaaacttgaaggccaagcaacgatttcttacaatgtaagaacgatcacttgtctatgctatttgccacgtcttttggtccatatgcttgcgtaactttattcttgcacagaatgccacaaaacaatgtttcctctggacacaaaagctagtccttttggttttgtggatttaaacattatgaaccttggaaatcaaatatcagtttaaatggtacagttgctaacatggatgtgcatatataagtctctaaaagtactagtacataattttactaagttgaatagcttattccgtgcactactaaatttactgcacgaacacatggaatttttatatactacattgcatggtaatatccatgtcaatctgcatgggtggtttggatgtaaatagaatttttatcatgcaccctgcatcaagcacatagtttccatctttttttgttattgtttgcaccagcagtaacactccacagctcaagttgtaggatgctattatcttgtatgtattgagatggatacttggtactacatacggagttcagcactgatgcatatcatagtcctagaagtattaggttatagtattgcatatatgagatggtaacttgttaccgcatatgctatgtgtctttagtggaactgcaaaaatagcacatgagatggaagtattttaccatgggaggcagaataatatgactacacctgtgattatggaagaagagcattactgcagatatctgttactcctgtcccaaaatataaggtattaggactggatgggacacatcctagtactacgaataacttatattttgggatggagggagtatgataaaaggtttaacatgaaacaaactagttttatagtgaatttaggggctgatgtggtggacgttatcaactattactttgttttagtctgagtctttttccaacaaatatttggtttgtcattggcagatttaacatggaatctgaccgaactgtttgatctattcacattagcaaaggcctatgatatgattgctttaggttcatgtgtgccttttcatttgatagtttaatttattttagctgatacttggctttgatatggaaaatttttttcctcccagaccgttgccaccacccatgtacaagtattgttatttggagtaggctaaattgcttgcaatgtgggtcaataactctgcttagactgtagggaaaaaatacatgtcctatatgatgactgcctgggatttataatacttaaattgatctttttttttccttgaacagccttgtaagtgcatttatcgaatcaatgagtggagactttcctgagcttttacacaatgaaaagaagataaaagatataattgcagaggaagaaatcacttttgcaaaggtaatagtggtttccagatgatttactgagctgaagaatcagtttttccaagtaaagtttcaagtgtttttgttgattaaaatttttcactcaaaaagagtgggcacacttcactgctcttaccatgcattaataacaaatcattttgactacatttggcgaagggccctttgacatttcaatttgctgggtttttagtgccatttgatactgctatatagttatgttatttctagattggtgttttactatactgctagaagagggtgatgt

SEQ ID NO: 66092 - DNA, 2846 bp, Oryza sativa
cctccgaaggtgtcctacaagactaggacaattgatttctttggtcgtcccactcacattattcaccagcatgagaatgggccatgcggtcttatcgtgatctgtaagagtatacagcttccctttttttttttgttctatgtttagcttaatttacattagtttcatgtgcctgtgcaggcaatgttcttctcctaaggagtgagattggattgttcctaaacaaaactgaagtgatggaggatgatcttcttagtcgtatcatttctcgccttaaaagatgcagaaagatgcaggtttgcaacttttatataactgtaatttctcacaataaatacaaatgtaactcaggcttccctttttcttttgcagtttgagttgcatgagggttttcagtactcagaattccaacataaagttttatctgtagcaaaaaacctctggagagaagtatgcataaatgtgacttttaaaaggtgataatgatataaaatgtgctgattggttgtgtttgtgcttgcgtgtgttctgatgtttgaaatgttgacattgcagtactgatggctttgtgttctcacctgaatatgcactttttgattatcttgaaatccctgtattccatgggtggcttgtggatcaggtaagagaacctaattgttatgttctttttttgtgcataaatgtaagaccaccgagaacactgaatgtgtagttattgcagttgcacttcaatgcagcatcatgcttaatgtggtgtctttgctttgctgcacggtacctttctcgcattatcagacgcagtaatggaacacctcagcccatttgaagcctgtagatgtaggaggtgttggcccatgtggcccagaagtgttgttgtggtggtgttttagtaccaactcggaagtttaggtgagtgggggcctgcttatatgaagcgagttaacccttttacatgaagtgaggatgaaagtgtaagcagagtattaaaattaaactggctgttttgctggatatgtttgtttccaaacctagccaggcaaatgcaaaagtgtgggccttcgttcctgctctggagaagtggagatacagcttctcatcatatgtgcacatatcagtcacctcgcctccctcagattacctcacttctacctctacatacatacaacaggatgatggatgagcatgagcagtgggcaaggaatgggaggacactgttatagggtttagtttagggctttacctcacttctacctctacatacatacaacaggatgatggatgagcatgagcagtgggcaaggaataggagggcactgctatagggtttagtttagggctttgttcctgggtcattctcatcaggcccgattgctagggtttagtttagggctttgttcctgagtcattctcatcaggcccgattgctatcgctaggctaggtgcaggcaaccaaacacaaccatagcatatacataactatttctcagattttggttttcaattgttacattgattatcaggattcagagttggcgtcagctattgctacaagttcttatgatgaacttaatctagaagttggagagtatatatcgcaaaaagaagccatggggattaaagggcgtggtgatcgtgaagaagatgaacaactgctgagagccattaaactttccatgggggacaacagcgttactgatcaaacacggggacaacagcattagtttcgtttttgaattacatattatttgaacataactttgccaatcttaacataaatattattctttaccctaaacattaatattattctttactcaatgttttcttagtggagcagatctcagattttcttcagggccctcaactgactgcccatgggtataaagtttaatttacatgttttgaaatagaatactttggaactaacagaaaaagaacatgttgaagtacaattttttattgttgcagcttgtcatgcttgcataaagaccttgaagaaaagaaaccttgtgtacttttctggaataatcattggagcacagtaattaaggtgagaaaacaaggttaacagtctttgattattttagtactaattttgtttatctgcctttattatattttgacctttgcagtttgaagaagaattatatattttagcttccgattcaagtttcttatcaagtgaatccggtgctgtttggcaaaagttggaagatgtatgtccttatttactactaatttttgtttgattgaaatgcatgtcttaatgtcaaagtcatggtacattaggtgaatgggggtggttcatttgtggatagctccttcacaccaattaaatatgccggtgaaggagcaagcttctgcagtgatcaggctcgtctaattcaggtataacttctctactttgtacgatgtaatgctgttattcaaacctggtaccttgttttgtttcttgtacttcactccaataatctgtcgtagtcattcacctgtaacttcatagtttatcctaatagttggtcttaaggaattttatttctcttagcctatagcttcttactgctcttgcattatcttcattcttggaactgataagcagataatagttgtggtcaactttaaaaaagctccagaggcatgagagcatggttgagacaatctttgctagtggagagtacaaaaataccacatttagtgatgtgggctttgggcatgttctaattctaaacaatacaatttcttgaacaagattgtcagtcagcggcggacccaggattccgtcatgcctgggctaaacccttaacaaccgaactagcactaccttatatctacaatgtgttatagca

SEQ ID NO: 66093 - DNA, 1150 bp, Oryza sativa
ttccaattccatggtatctgtactttacattgaaatggatcatcattgtgcggcgttatttttgtttattaaatcttgtttaatttgattcctgttagtgctagttgtatcaggaagaaattccattgcactgaatcattagtctatgaaatccttttatatttttatacccatttataattattcatactggagacgaacatcattggagcaagattgtctgtttgttgaattcttctctttttcaactatattatttaggctctgtttacggaagcttctggattctcgtagaatggactatggagtttgtaggctaacgtttagtcttctatcttacatattaaatacgttaagaaagatgcttgccatatagttctttcagggacttaccatataattcccagtccatcgccagccccatctccaagaatatttggaactggagcactgccaaacagacctttagttgataatattgtgtttctgcattaccttcctattatgtgttcagttcttgtctgaaaaccatacaactgtgtcaagtgaggatgtgggttcagctacgatgcatttttcttctgcatgtaggacttccaatagattcaataaattgataactgctatgattttaaatatgtttacaccttgttttgtttgaactttgggtggtccgttgtatatatctaactttaataaatttatgctccattttcttccaactcatgtctcaaaggcgttgcatatgtcagacattgacatggttccacttttttggtagcttaatagtggtatgcatctcagcgtatataaataaccattgtgcttctaaaccaccaagctcattaaatcaaagtgttccttgcagttaaactttttcctacattacaactacctattgtcatcaataccacttgcattcagattgttcttaatttctctttggcaactcaactgcagtcatgaggacttgtcagctgttgaagtggtaactgaggagcagttgccacctgctgaaataacagatgttattttacctcaaaaggtacatagctcctcaagcactcctgaagttgcaagatcagatcaactaaaggacgcagcggcttcacaaacccctaaatgttcaattcaagctgtgccatattca

SEQ ID NO: 66094 - DNA, 1037 bp, Oryza sativa
cacctaagaaaaatctaaaaagcgtagatactgaagactgttaaccttcatcattttaatccatattggttaaggtgttttgttgtttcgtgtttgtggattgtgtcacgttttaaatatattgcatgatgttgcactaataaaaaatattcttgcttggttgtatgtagcgcatttaacaatgctcatttactcttgcacaaacaaacaaaaacacttgttagatgatagatcattttagatgatcattttaggaagaccataaaagttttaggggatgattaaaagggaatagagggaatattatcaattaacaacaacgagaaccctgatggctgacggtgctgttatccttgtgttgttatccttgtcatggctctaagatgtttagcttttgacttaccctctatatcaatctttacttttctgttgtgaagttcttggattttgagcaaacggtataacatggctgggagcgtatattgcttttgagtagcgtcggttcttgcgctcaatcttttactcctatcccattttaagcacagttgtgaatttatgtgtccaacgtttgaacatccatcttatttaatttttttatgattagtatttttgttgtttttaaattataaaaaataaataatactttatgcttaacttattttttaaattttttaaataaaattttcaaataaaatggatagtaaaatattaaacacggaaaattattattgcactttgaaataggagtatttacttttaggttgcatcggatcgggcacgtgctgaaaaattgggcaccctccccatgcctgctactgttgcgctcaccctaccgttgtgctatgctgttgcactggctttgcatctctggtgttatcttttcagttgataaattgtagtgcagttgataactaaaaaaaaatatagccttaattgaaagggaacaaaattatagccttaattatagccttaaggcctcaaaattatctacaaatccttctaaccaaaggaagcctcaaaattgtcatgtggtaatg

SEQ ID NO: 66095 - DNA, 3246 bp, Oryza sativa
atcaacacttggatttaggtgttcgatttggcaattaaacatgcatattactaattagaaatggacatgattcaatttggattcaggtgtttaatttggtaattttttttttgacatgggtgtttgagtggaatagcacttcatatttttttataatttactaagggaggccatctttggtcctattattgtagtctaatgatctcatgatagtgatttgacgataaaatgttactgttgttgggctcgtaggcatatgggcctattagaaccaatcataattggcatatttgtcttgaatgaatgccaacagatacatgtcttctgtttatgtataggagatgttgggaaaatgtttgataagaacatggaataggagatgttggggaaatgtttataagaacatggaaaccattaaggaattggaagacataggttatcgtggcagccgaggtggtcaatcccaaagattaaaagttgcttttttagatgtctaatttcctttttccatgttatgtacttatgtagactgatatcttttgtagttatttctgcctcttataagctcttggtaggaggtattttctatcagggccccatgtttgagatagaacaatcaacaaagtagtactcccgcaaagtctatagtttctctccccatgtgcttctctccttcaagccaatattgtatgatctccacctagtacttaccatgttatgagccaaggctcaagtcagattaccgagtatccatattagaggagagtgtagattgtatacccattttctgtttctatctcattttgatgatctcttgtaccggtatattggctagggtcctagttggctatatatatcacaactgcccccctccccaaccctgcaacaggtgtgagccgttttccctaattctatctttctacatggtattagattcagagttcttaccttttccggtgccctagcgctgctgcgtcctcttggccatgcgatctcgcacaccttctgtacgttgacgacatgtctgcactccgagttcgccatgacagaccttggcgacctccatcacttcttcctctgcatctccgtcaagtgctcctccgacggcctattcctgtctcaatgacaatgcaccgtggatctacttcaacgagcaggcatggtcgagttctactctactgcgacaccaacggatgcacatgctaagctgtatgtcagagacagtccacctcttgataacccagtggagtatataggagtctcgccgatgctttgcactacctcaagtcgactcaaccggatctggtgtatgtcgttcaacaggtgagcctcttcatgcatgatccttgacaagcggattctccgctacgtgaagggcactctctccatcggccttcacattggcaccgacaaagtccaggcttacaccgacgtggactgggctagttgtcctaactcatgccgctccacatcaagctactacatcttccttggagataatctagttgcttggtcttcgaagcaccagaccactgtctccctttctagtgctgaggcaaatatcatgctgcaacccacgtcgccgtcgagtgttgttggttgtggcaattacttaagaaacttcatattcggccatcattgtctactacgataacgttagtgctgtctatatgacaaccaatccggttcatcgtcgcgcgaagcatatcgagattgacattcactttgtttctgagaaggttgctttggggcaggttcatgtgctacatgtcctgtcttctcaccagtttgcgtacatcatgaccaaaagcctacctatttagttatttactgattttaggtcgagtctttgcgtttgtgatcctcccgttgcaaatgcgggcgggtattggaggaaagtgtatattgtataactttttttttgtttctatctcctcttttcgaggatctcttgtaactaccggtatattggctatatatataacaaccgcccccactgttgggggaatggctccggatgacggagccggcctccgtcagtagggaaactctgcccggagccatccaccaagggagaatgaccgaaggcaacagctaccccgatgatcgagtccgactaaaggcttcagagccgaccaagggctccgaagcacatcaccaactccgaagctgaccaaccgccccagtgcctaccataggcttcggagcagaccaacggctccggagcagaccaacaactctggagcagatcaatgactccagagcgaatcaatgactctagagccaatcactggcttcggagctaaccaatggctccgaagcagatcgaaggcccgaagtgtccggggagctaaaatactcgagcgtggagaaatggttcacgagcgtagtggggcaccattaatacgcactacgcatccgccaaccacctctgacatcctaacaagggcaagatggcatccgctattatccgggggcatgcctttacctggataatagccatcaccctcgggaagcgtcatcgcttccttaatgggcgcagccctccctgtctctaggggttttaccgactgccctagggctggcccaccggccagccgctctacatcttatctagctagggtaaagatgtaacttcctcttgtaccccatgtataaatatgtaagcattgtccacagttagggacagattgagtacaaaatacacattgaatacactgtttggactttgttccaacacccaccatatatgtgaagagttttccctaattctatctttctacaatccacacttttaacgtcacaacaaccattgacaacatgaacaaccaccttcaataacattgcgtctatggtagatgatattatatcatcattggtcaagtgggttatgttgttttctgtggcattttaatagttgtgctgacacccatgccaactccatctcaaacgatcgtcttcggctccatcactggccttgtcaaagaaaaagaagactcttatcttgagttctcttggtgttgacattggcagtggccaatgggacatgccttatgtcatgttgagcgcaacatattgccaattgttaccaagtcccgcgattagtcgtaaagttggtcaagccacacgactagagtgccacgacttgactgaatagcaagccacacgattaatcgtggttagttgtaaatttagtaagagatgatcgtgcatatctctacttgtaaatgatggtaagacgaccat

SEQ ID NO: 66096 - DNA, 1232 bp, Oryza sativa
ctccgcacaacggcttttttagaattgttcaactagatccctgcaatttatttttttagaattgttcaattggcaagtgagatgttttgtcagattatatgtgctggaattatgacatcaaatttattagtatatatatatatatatatatttattttaatgatgtcacaattttcgcgtgccttttcatggagttggtagacttagtctatactccctagaccttaccctttatatatggcctatcatcctagactccttgcaatccatctcctcaattgaagtattgaaaaaataggtggaaaagaggaagggttaggaagagatcatctaagagagggaagggggaagggtgagggagagatcatctctaacttgcttcttcagcgctcttttgcaatcaatgctgaatctctcttgaactgataggacagcgagcgattcgcaaatctgtccatctggaggtatagatctaggcctgagtctaatttttttcgttttctgttggtggtacaggtggttccgtgaggattttggaggggttaatggtttgttgctctgttcatctggtgctttgcatctagggtatcaacaattatagatctgcaattctttgaggcgtttaaggccctcttttgaacataggaatttttgaggacttttgtgggtgttgaattagtttggtgaaaatcgtgtaaaatccctgtgatccataggagccctaaaccttcagcacatcgtgcctactggttttgacataacatcggaatttgtgtcttgctatgttgatccttctctggaactgttctgttcatggccttaaccatctgctttaatatgcttgttttaggttttttttttcatgtagtgctgtttggtatcagtggagaaaagtagggggagaataatatcagatgattgaaatctaggaatttgagttttgggaagatgattcaaatctatgttgattgcatagctacaataaaatgatttacctgatccatgtgttccaaccatggtcttattgtttgaatcttgtttatgtgctatactgaaagcgtgctgtattctctatagttcattgtgctgcaatccttccatagttacacatgaataatgatatttgtgttttttttgtcaagtggacctgttttgatcactattcacttgaaaaatctgtacaaaggaaaacacctctgatctcttgaaattctggtttgttgcaaagcaaa

SEQ ID NO: 66097 - DNA, 1820 bp, Oryza sativa
ggtgttttatgctgtgtatcttatacctgtgtggcttcaaaggtgactattattggtgcagcttatgacaactccactactttcttgttgcagatgggaatcagtttatgccagcatttggtcttgctcattgtctgagcatgagacaacaatttacttccatggaccgtgatatcatggctgatggaaacatagtgcaaaggtcaattcatttgcgcagaaagagaagggatcttccacagacatcatcattacccaagtttgctgagaaccacgagcttggaagtgccaatatctttatggatccatctttttacacaaaagcaacagagtctagttctacagaaaacaaaagttcatcaaagcctccaaaatttcttggggaaaatagtagccgtcgaccacatcatcgtactgtgagtatcttattgtccattttatatagttctctatccactgtccactttagaaattgcagaaccacatgtacatgtaccatactaccatcctaaatatttactccctcagtcccctaatataagggattttgacattttacttgcattgtttgatcactcgtcttattcaaaaaatttgtgcaaatataaataatgaaaagttgtgcttaaagtactttggataataaagtaagtaaaaaaaataataattccaaaattttttgaataagacgaatggtcaaacagtataagcaaaatgtcaaaatcccttatattaggggacggagggagtatatgacaaatgtatagaagacatgatggctggtttaaattctgaaaggtttgatcaattttgacttttcgaggattaattgatggcaggctgtgttcgcctcccgcacacgcaaaacggagtgactcattttcttataaataattaagtactccctccatttacttttgatagtcatatttccaaatctgaaaaatttatttttgataggcatatttcaatccaacaacctattctcttaatgactttctcggatttaatgcgtgactctctattcttccacacaagattagctacatgggcatcgagaaatgtaaatattaacgaatcgcttgtttgcgaggaataactagtagcatgtttaaatggatgataagtagaattacttatccttggtctatgtgtcaagatgaaatatgactatcaaaagtagatggagggagcatttattattattattattttaaaaatggattaatatggttttttaaaagcaactttcgtatatattttttttgcaaaaaaacgcaccgtttagcagtttgaaaagcgtgtgcgcggaaaacgagggaggtgagttgggaaagttggggaaagaactcagcctaaatggatctacatgtacatgtgggaaatctattctcatatgttattttccaaaggcacagacttgtagtttctggaattgcatatttatatgttgactcctatactgaatttgacaatattgctttgttgtgtatctctaggttggcctacctgttcaatatagtgatttctttatcaccagtttgggagaaatcgataaaaggccaagctaccataattcctaccagatatggccagttggttttacgtcttactggcatgacagaattactggttcactgttcgagtgtgaggtgtgtgacggagggaattttgggcctttgtttaaggtgagaaggatatcatgttcagtgttccctcttccagatgcatcaacaattctctctcaaaatagtacaagaaaggctgagacaatagaaacaaatgaaaacaacactttgcttgaagatactgctaatgat

SEQ ID NO: 66098 - DNA, 3503 bp, Oryza sativa
  unsure (1)..(3503): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntctagctcagcgaccatggtgtcataattcctcttcatcacctgcagcgactcggagtgatccatcctgagtttcctttcgtactcatacgtagccctgagatttcgaccggtgcgcacgcagaaatcgatgtcagtcataaatcaagtaaattcataactaaaaggcacaaacgcggagcatttcatatcgcgcggcacctgaggtgctgatactcctgcctagcggcgtcgcgctcggccacgagcgcggggagctgctgcgcctcgccgaggttcctctgcaggtccttgctcagcttctgcgtgtcggcggccagctgctgcctcgcgacgacgaggccctgcgcctcggcgtgcgcctgctgcagctcggccttgacggggtcgcgggccttgaggtcggcctccatcttggcgaccttgtcgaggatccccctcgcctcctgctcctcggccgccatcgccgcctgcccctgcgcctgcagcctctgcgcctcctgctgcgccgcggcgagctccttccgcagcgagtcgtggctcatcgccagccggtcgttctccaccgccagcttctgcagctccccccgctgcgccatcagcttctgctccaggatctccggcggcggcgccgccgccgccagcatgtcgtacgggaacggccccggcatccccggtgcccccccgtacgggtcccggtgcatcatcttgtgcgccccccggtggtggtaaggcggcggcgccctccccttgctccccatggtgggaaggagagggagggggagatgcgggaggagaggtcgttacctctcgcggtggccggcggcggcggcggcggcggaggaggcggcgggtctagggttggtcgtcgtcgccggcgtggggggaggaggaagacggcttcggatttctcactgaaattttcgtgctatttcagcccacgagcccaggaatggggcgagaaggaccggattgtaaaattccggcccacctgaggaggacaggattgtaatttctgtatttgtgcagggacctattagtattttccctatatttttttttctcctcccccttccttcccttaccctagccggcggcggcggctgcacgagcacgagcacaatccccgcgagctccaaaccctagcctagccgcacgcgcgcgcgcccgccgcgcgccacggtggccggcggcgctccgtccgccggtgctcgcgggctgggaggtgaggccgtgatttggggggtgttcctggcggcggcggcggcggcggcgtgggtggtgagggagcggaggcgcgactactgcatccccgactccggcaactgcagctgtggaagcttcaccgtggccggtaaaaattccgtgcgttcatatgtaaataaatataatggaatatcgaaaatatttgtggaaataattggggggcttcatttcgtgcgttcgtatgtaataaatataatggcttatcgaaagaatttgtggaaatagttggggggtttctttgcttttgatgaatgtttagacattgagctgttcgtgggtagaatttgtggattttgtgagggtttcccgtgatctttctgtcctgggggatggagaggagacgggattagggttggatcactgacgttttgggcgtaggtttgggatctgatgagtaatcatcatctcaccacggtggcgaaaagtgtgtccagaaactaatggatggtcatttctccagtttcaagttttccactttatgtgatatagatagaaccctcagttccatattcttcaatttaagcactgggaccttttgttttgagttatataactaaattaaactgttgggaggataaggggtaagaagaatattttctctaccaataataagctgttgtaagcaatgcagagaaaagtaagggagtgatgggcagattagagtttctgccaaagtccttcaagtcttatctaattgaaattaggtccaaaagttttgaaacctatatgtatggaggggatatgtaatagtaatatggaaattagggtatcctgtgcgttcccagcattccagtaccaaaagtacacttacataaatagtaaattgttgcacgcaaaattaatcatctgactgaacagagagtaatatatattttatggttatctacgattggctgtctaaaactcatttgcctgagtagttaagtggtagcttctttaaaaggattaggataccaggaaactcggtaaaaaaaatgttctgttattattttctgtctgtatctctgttaatatagtggtatagattatagtagtattattctagtgagactagataattcatgtgctggatgctgtttttatgtcctgccccatttgtttaaggatggcctgctgcttgtgtctctcaaaactctttaagtttttcactcggcaatatggtagcctgataatatcttgaacttgatgcactgcctttaactggtaaacaagtatcggctgcacaataagtactttcccatgtagattaacttgctgagcatacatccttaattctgcaaatcattaacactttcattgaacctcttcttaggaaagtgtaagtcatggggagcaaacagatagtagctgttcttcaagtaggtggagaattcaaaactgatgatgatggacagatgtcctattctggtggagaggcgcacgcgatgcatgtgaaaagtgattggacttttaaaacattcaaacatgagatatcttcaacgctcaataacctcaaacttgactcctatgtgttcaagtacttccttccgaggaataacaagactttgatttcaatttccaatgacaaagacctaaaacgcatggttgaattccatgcagagtcagagacaacatatatttatgtcatgaagaaggctgacaacaggtacccttctgactggcataaacatcttcataagtggatatccaaaaatgacatgagacatttttttcagggtaaaaacatctgccgtggtgcctgctgcttctgcagatcatgctgtagcagcaactactccagatggatctaagaggcaaaagatttgtgcaagttgggagaatgcgattactggagctggtcaagtgtttgaaggtccaaaggaattccgtgatgcactacacaagtatgccattgcacataggttccattacagatttgtcaagaatgactcttctcgtgtcactgtggaatgtaccgctgaaggatgtccatggcgtatacatgcatccaagtctcctgcaaagaaggatttcatgattaagaaagtttttggaagtcatacatgtga

SEQ ID NO: 66099 - DNA, 6003 bp, Oryza sativa
  unsure (1)..(6003): unsure at all n locations
cagtgttgtttgctcaacaggcaatgacggaaacaataatgtgtttgaggtatgcgatggcgctgtcaatgttgtcaacattgatacatgggactgcacctgcagaaagtggcatgtctctgggatcccatgctcacatgcaattgcggtgtttgagcgcactgatcataacccacttgacttctgtgccaagtatttcacaacagagtgctaccgcttgacctatgccatgtcaatcaatccaatacctgacattgttgtggctgctccatcaactgacccatcacaaggcgaggcattacatcaatcaccgattctaacccggaggcaggttggaagaccaaaggaaaagccagctgatcctcgaatcgcaatcaaaagggcggtgcgctgcagcaggtgtaagggttatgggcacaacaaggcaacctgcaaagtccctatcgcagcataaaacccttgccatatgttctcaagtgtaaattatgttgtgccttttgttgcccttttatgaactcgttctagtggaacctgtgcaatgccatcatgtatcttttatcagataacgtgtgaaacataatcttattcggtggttttagctccaagtatggtttgcctagcactagccggtacttttagattgaactttttgtggtgggcagaatctgggaaaaggattggagttttttgtacgttgttatccagcactcccttcctccatatggttgtaaattttgacatccgaagataagttattttatttctgttgaactgtgcaaatctttggatgagtaataatatctcgatactactcttaaaccgtgacatggatgagtaatagtatctcgatattactcttaattcttaaaccataataccaggttgatgcttgtaacaaatacgtgtttagcatcaatttaaccgttttaggttgtatttaaactcctgaaattttaactatttcttctaaatattatttactatcatatcaaaatacngcattgttggggcattagaggtcatcagatgccaccaatcaacggcttgccctcgcctgttctgttacatcttcagtttcttgttcattactaatcactgctaataattcatgtcaaatgcatcgagtaatatttggttactgttctttgttttttttgggtgatgaggatagttgacattagaaatgttcattgaaaaaaaaaaacaattataacctctgagaaatacatttgtatagaatcttcatattatattaaactaaatactgcagtgtttcggttttactcatcagttaccactcggatattctgagtaaagaaatgacaattagtactcctttcgatttctaatatttagcatcattaacttatggaccatttgtcatttttttttttttttgcataagtcacgcttaaaatacatttgatgataaaacacatcacaataaataaatgatatttccgtgagttagagttggataccacaatgtaaccatgacgacttagccacacggggagatgatggtggtgtggccatagacttgtagcggctagttgctatgttgattggggagcagcgtccataatcatagtcacaaggatgtaggtttgggtgaacctcgttagcaaatatcatgtgttcctatgtcgtcatatggcatgtcttaggtgatcaatgagaagcgattaggaaggttggtcgtcattccgctatatcgactaaattttataacattatattttagaaccgaaggagtatcactaaataaatgtgggtttattaccttccactaatacaccaaaaatctgaatcatgacaacccatatacagcaaagatcataaatccgtgtaatctgtgaaaatcgcatagcaataaatatatccccattaaacacttgctacaatttcccatggaaaagttaaaacctgcctgaaatatcttctctatgtgtagacaccagccagtacacccagcgaaatacaccaccctagaaacagccgcgcggacggacaccacgtgcaacccgtgcgccgcgctcgtccctctcggtcactgacaagtgggcctcaccgcatcggctgggttccccaaacatggcccacgtcgctggccccactcatcctcatagtatagaatcttcatattatatttaaaacaaatattgtagtctttcagttttacttaccaggggtagagatattttaaccagcgtgccagttctccgggttccctgcttccagtatttgcatcccagtagcattttttttggtttgatgccattaacttatggatcattcatctcatccaatttttttatacatatgaaaaaaatcatccttaaaatatctttgatgataaaacaaatcacaacaaataaatgataattgcatactttttaaataagaaagtggttaaatatatttccaaaagtcaatggcatcaaacattaaaaaccggagagagtaataatatgatagtcaagtggtgaaactttatttaacctgggaaaaacatattacacacttctaaaaatgtttatagcaaataattgcaaaactcaatgaatttcttttttttgtttttattagtaaatactaagatattcacatcaaatcaatcaattctgattcctacaaaccattattctgagaagttaattgaaaacacaatatgaaaatttatactactttaagagaacatagtggtgatggtgattctcccccaagggctaacatccttcccatgaacctccactttatattttgttcattgttagtcactgctaacattttcacaccaaaaaccatagtatttgatcataatgaaatcattctctatgtatttttgtagtattataatggtacgtataatagatattttcaattttgagttaccacttaacactaaacttaacactaagatattactctattttcccccaaaatataaggtgttcatattacttttagctgatacttaaattacaggacaagcttagcataatgtatgtgatgtcgttagatttgtattaaaaaaactttttcataatgttagtttcgtagttgttgattgtatactataagtaaactaatgatcaacgtataatatgtcggaaagatgggcttagacagacgtgggaaaccacatgtctgtgattgactagaggctctaggtgaacttgatctgctcaagagtgcttgggagcaagaaatgcaaagcaagtgtttgggtttccccaaggataacaactatacatataaactagagtagggttattactcatcccgagggtctgaactagtatacaaatccctgtctcccgtctaccttatcgcaaactcacgtataccttagcactagtgttccccatactatactaataccgttgtcggtatagctcatcgatagatacacatcaacccgttttacttaccatgagaacacatataccccttcccggggtgctaatgggttctcgcggtaagacaactggagtgcggaaaccatccccttcccagaggctaccatgtggtggcccctaggagaggatgacccacctactcaccttgacttattttggtcaagccatgcctagcattcccctaccagtccttagtcatgacctctatcttaatacaatgccacaacctagttggccccatgtaacaactcatgggacaagcggctgcctctgagcagctttgcagacacgacttcgacccgagccaattgaccatagtagagtctcataagttcaatctttcttaagactttgatacctagacaggtgatgggcatatagacctccccaccagggttcgtatttggcctaggccggagaaacactcacccaccacccacacagttttgatgacttgcattccatgttaagcaaaccggtgaagtgagggactccttagccacgatgctaatcacgtaaaatgctaatatgtcttacttcctccgtttcatattataagactttctagcattacccacatacatatatatatatatatatatatattaatgaatctagacatatatgtgtgcctagatttattaacatctatatgaatgtgggcaatgctagaaagttttataacctgaaacggagctagtatatctttagaatggagggagtgtcattaaaagaaaatctgaatttaatactttccactaatacaccaaaaatctgaattatgactaaccatgtaaagaaaacaccattactccacataatcttgcaaaatcatattcacactaatacccacctgtattacaccagttattcacagcaagcatgcattaattgtttccatatctgagttcatactgatatctactccattaataacccccattaaagccattaataacccagcaaaatattttccaaaattacctctttgaaaaaaagttcatggagttttgcacaggaaaattactgctgctctgtgtacaccagccggagtacacccagccaaaaaacaccagcgcatcaccataatgtgttcatattacttttagctgatacttaaattacagtacatgctcaacatgatgtgtgtgatgtcgttagatttgtgttcaaaaagtactttttcataatgttagttttgtagctgttgattgtatactataaataaactaatgatcaacgtataatatgtcggagagatgggcttcaatagacgtgggaaaccacaagtctctgattgactagaggttctgggtgaacttgatgtgctcaagagtgcttgggagcaagaaatacaaagcaagtgtctgggtttctcgaaggataacaactatacatataaagtggagaaactggagtagggttattattcatcccgagggcctgaaccagtatgcaaatccttgtctcctgtctactttatcgcaaactcgcgtatactttagcaccagcgttccctatactatacaaataccgttgtcgggtataggccattgatagatacacatcaacccgttttgcttaccatgagaacacatgtactccttcccgggatgctaatgggttatcgcagtaagacagctagagtgcgaaaaccatctccttcctagaggctaccatgtggtggccccctaggagaggatgacccaccctactcaccttgactcattttcggtcaagccatgcatagcattcccctaccagtatttagtcacgacctctatcttaagacattgccacaacctagttcctaggtggctagctagttggccccatgtaacaactcgtgggacaagcggctgcctccgagcagctttgcagacacgacttcgacccgagccaattgaccctagtagagtctcataagttcaatatttcttatggctttgatacatagacaggcgatggacatatagacctccccgaaagggttcatttttggcctaggccggagaaatgctcgcccatcacccacacagttttgatggcttgcattctatgttaagcaaaccggtgaattgagggatcccttagccacaatgctaaccacgtaaaatgctaatatgtcttatatctttagaacggagggagtgtcactaaaagaaaatctgaatttaatactttccactaatacaccaaaaatctgaattatgacaaaccatataaagaaaacacaattactccagataatcttgcaaaatcatattcacactaatagccacctgtattacaccagttattcacagcaagcatgcattaattgcttccatatctggggttcaaactgatatctgctccattaataacccccattaaagccactaaaaacccagcaaaatactttccacaattacctctatgaaaaaagttcatgtagttttgcacaggaaaattactgctgctctgtgtacaccagccgggtacaccagccaaaacacaccagcgcatcaccaccagaaacagccgcgcggacggacacagccaccaccaccggggcacgcgcaacccgtgcgtccacgct

SEQ ID NO: 66100 - DNA, 10395 bp, Oryza sativa
acagttctggacccgtggaaaatcaacagcagtgcacgcccacagcattggaccatctggaagaggctgaacagggtaatgttggagttaacctaaacaacccagctgatggggttcctgatgggcaattgaatgtaggcaagccttacaaaagtgacaaagacatatccagtgcatctatggttgaagaacgcaaatcttcaggactttctgaacaaccatcaggaatggctattgaccagattgatggggatgctattgatgaagggtcccagagttgtgagaagaggtcattaggtgccaagagcagtacatgtgataacttgaacttgaaagacactgaatttagcacacctggaagagagttgcctgatgaaagagccagcacatcattccaagataatcttgaagcatcatcaactaaatcaattgagcttgatgctgataataatgaaatggatactttatcggatgacatttcaaaattgcaggattcaattagcttactagagtcacagattaatatggcatcatcgagaagagagtgtctgggtaaggattccattggtcgattatactgggttataggaagaccgggtaaacgtccttggttggtggctgatggaagcatgctgaaacccaaggagagagatatcagtatggttaacagttatcccccatctgcttttgattgcaaaggttggaattcagcatctattttcatttatgaatctgatgaggaaatccagtgccttcttgactggttaagagactatgacccaagggagaaggaactgaaagactctatcttgcagtggcaaagacatttctgtcatcaaagcagttctcctctcgttgatcctccaatttctggtccaaagggtgaacagcttatggagcttccaaataccaaggctgcagtaattttggaacaaaagtatggtctgcaattggaccaggacacaagtgatctaccgaaaaagcgaggaaagaagataaagttaagttctgaagatagaacatatcgctgcgactgtttggaacctgtatggccttctcgataccattgtttaacatgtcatgagacttatctcatatctacagagtttgaggggcataatgatggaaaatgcagtaaaatccaccagtctcctgatgaaagcagagaaaatgatgagccaaaagtgaaggttaccaaatctgatacgaaggaaaaagattcccttgaatgtagctctgtcattgaaccgtccagtgacagaaaattgatgcaatgcccatatgactttgaagaaatttgcagaaagttcgtcacaaatgattcgaacaaggagacagtaaagcagattggacttaatgggtccaatggagttccatcatttgtgccttcacctgcattttttcttgaacctgcaattgtacaaagtcaaaacagaaaagatgatgaactcaaggattggacctcctctttagaggaatgcaatgcaatgtctgctcaaaagctagttcaagaggtttccaaatctggtcaaagttgtcctggcaatgtgggtgatgagaaggtgcaaaaatctaaaaagcccacccctgataatacttctggtgaggaagcacattctacaacaggcaagccaacacgattgctagctgttaatggggggttggttccagagtcatccttgaggcctcttataggacgaaactctcacatacttaagcagcaaaagataaacttgcttgacatcgaagcagccttgcctgaggaggcactgagagcctcaaagtgtcagcaaataagaaggcgttcatggcgtgcatttgtcaaagatgcagaatcaatatcccaggtaccttaatctatctattcactgtttgttacagaaatatatctatgtagcttaatgtgtaatcttggcatactgcatttggcttacgttcatcaaattgatagtgttccgaaattctaagatatactctcaagcatgcagcgttaatttaccatgtctttgtttgtgtctgcaacagttcaatttaactgtaaaattacttatacaggatccatttatttaaaatttttagcagtaagtctagattcaagtggttagttcctaagttgtaagtctagatacacaagtaaacaggatacaggaattatgggccaccaagacctgagctataatttagccctttctttttttaacttcattatgtgaagatgcagtataaattattacttgagagctcttttgcattatccaatttcctgattaatgacatccatcctcttttagatggttttggcggctaacttgttggagggcatgataaaagctgagttcttgaagaacgattggtggtactggtcttccttcacagcagctatgaagacatcaactgtatcctcactcgcgctcagggtctacactctagatgattgtatcatctacagtaaggatcaagttccaagcgttgagccagctgacaatacaaggtctggaaacagaggtgggaggaggaggagagagcttgaatccttagcatcataatgtaggactctccgttgtagactccaaagttagaagcctctcgggcagcaaaagaatattatcctgctgtcaagtagatcgatgatagatgatacaaagtcttctgttatgtcgtcgcttaaggagggtagcgtggtagacatcgttccggtacccctgcaagagttcaaccctgactgtgttttcttttacctcgtatctaccagcctaccgtttttcgacttctgttgtggttttaggttccagaaggaagaattggtactccatgtgcgagcattcgatcttgatgccaccatgtaaattgtttgaggcacctgcaagtgctggcattttgatctgatccgccaggagtacccggtgcaattttctctgttggactaaccctattcattgtagaggttattccataggagatagaggagacatgtcaggtagggaggatatgtctcattttctacccactttcactctattagccgcagtgggtagtgtagcgggtgttagtttctcattctcatggtctgtacttatgtcgtgtttagggggggcgctctggggcgttgtattgatcatttgtttgatgtttctggcaagtttgcaacatctgataggaatgtagattcatcttgcgacagatataattttgattgtaactaaactgaactgaaaccaataatgattagtcaacaatgattcggctgcctgagcgagtggtcgtaatatctcactggtttctaattctgcaaattctgttttgcttatggtaacgaaaaatcccatcctgtgaaatcttcttctggttcattttagtgaaaaacggagattgtcaggatgggaaaggaacgaatgatgaaaaatcatctgcttctgatattgtttattgttgctactcttttaacttctttgtaattttctagcccaagaatgtatttttccttaattaaaaaaaatagcgaatgaaggttctaactcctaactgcataaaaaaagtatgttggtatgtggcatgtttgctacgttttcgtgtcctttttttggacgcatctccatgtcttcttagatgtagtagacgttgctgtggtgcacggacacggtgctctggtacttgatgtagcctctctgtttgggagactattgctttttgtttcatgtctttgagaaggaagcacgtgagtatttttcattaagagatgtatagtagtaccttgtgtattatgttactgtacatttccccccttttttttacaatgttgttactgtacttctcttcccgacaaaaaaataaataaatattactactttgatgtcattttagctcaagtggtaagaacacatgcgaaggaaacaaaataaaagatgtagtggaatgcgagagaaggctgaacattttggttttgtccagcacttgtctgaccttttttttttctgtatgttattacagtacaacggaagcagagtcatcctgctcctctttaagcataccactcacgtactttgctacaagcaaaaacacatcacgatatcctcctcacctcctccttgcccagatcacaccaattgccctagttttttcttcctgcagtgaccttacactgcactattttttacaatagcacataacagagaaaaaggcaaagaagaaaagaaaaagaaaagaaaagaaacagagaaaaatgagagtaaaaaaatgctgcatgatctttacttcaaactgatttatataactactagactcttgctgaagacatggtgaatttgaaggcggccgatctcgaaaatatatatatttgcttctcttctgttatgattgaggaacaattgtgccaacgtatccgataccgacgatgaagaacgccgcgccttggaagaagaggtagatgaagaaatggtccttcccgaatgcaagatcataccatccacaggagaagaggaatgccgccacgccgagctccgtgacgtttagcctgaaaaaagggaagaaattgtcactcgaaatcagtgaatcatgagctgagaaaacagttataaagatttggcagagtttttgttctgatcaatttttcttacctgtcccataccctcatgaacgatttcttggctgatgatttgcttgatgatttcatcttcagagcgttgccgagcttctcggtgacgacccattcgttcgccctaccggcttctaacaggccgatgagagtggcctttgttctatgcagtgacatgacattctcaaagaggatccagaagaaaagcaagtgaaaagacctgcaaacagttcaattccttgggttaactaaacatgcaatcaatcatgaactgttgattcaccaaaggagcattactgttgatcatattcaactaggattataataaaatcaaaagaaaatcttacctgggagttccaacggaattgagaagggtgatgattgtgggaatgtacacacagccccactttggtatcctgacctcagggacaaagatagttgccgggataatcaagcagtagaacgcaaaggtcacgatgtgcgcgatgattttgcggatcaaaaagaagttgtagatgacatgaatcttcttccagattgtcactttctgcaacaatgtcaataatagcatgttagatgccaacccaagaagctgcatggcttaaatttttctggatttcttggcactatgtttggggagaccttatttctcacaatctccatcagcatcttcctgaacaggtttgccggcccacatgaccacctgtgctgctgaaaccgaaaggctttgaaagtacttggcagctcacttttgacctgaaaacgacgcaattcttgttaaactcattttttttctctcttaggcaacatgaatcaatgtactatttcctcaagaaaaagaaaaagaagggaaatgcaatagcaacttagcaagagcaatgacaaaggatgcattggatgctatctcaagctgatcatgtgtaggatatccatgattggtgtgtacctgaacatctccaaggtagacaaacttccatcccttaagactcgccctgattgccagatccatgtcctccactgtggtccggtccttccatcctcccgcctcgtttaccgcggaaacgcgccacacaccagcagttcctgattgaaaattcaccgaatcaatcagcccttatgtataaaaatcataacatagaatgcatattctatatcctagaatcttcagagacaaagttcttggtgaagaacagatgaaattactgaaggttgaagcttaccattgaagccgaagaatgcgcagacagaggagctcacttcctgctccactgtgaagtggtaatccaaggacatctcctgcatccttgtcatcaagcactcatctgcattcactggtagaaacaaaagacagtatcaatatcattgtagttcaaagacaatgtcaacatcatatagttcaaagacaagatcaacatcatagctccatgagaaatacttgacaggtaacaactgtactatatacatcattaaaacaaagagacctggaaacagttctcagctaaccagactagtagcaaacattttactactgctacactgttgtgaagaaattgtgcaactgtggatgcctgcactgcactgtcctctgtagtaattatttatttgcttgtttctttatttttggcaggttttgtcctgtttcttctactactactgtattaagactagtactactaccactactactaaacagtaaccttgggcagtggccaatactaataatcaattggacccaaactactccacactaatctctgaatttagctgcaggatccaatgcacatcgcagcacaatttctgctcgtgccaaaactctggagatctcacatgccactgtcactgtactgctatgctttgataataattgcaacttgatcacaccactgttggagagaaggaccaattaagctggagcttcagagggcacggcccctaattaattactacactaatcgctgcagcatttgacagcaggacatggccggacctagggctcaaggatcaccgacgagatgggcccacccgtcacgtacacgccacatggtggcggcagtggcagcacgggtgggccccacgtcacagtgactgcagcgagatgggtcagctcagctcagctcagcttcagtgtcaggacaagctgctgctgtgctgacgtagccgccctgggacgcacagctcctctactgcatggaagccaaggaaggaatggggcttgtactttactttccttgtgtactcgtgtttgtgctagcgattggatcaatgctaatggaaatataattagttctaattaagtgaagaagatctttgcctttaccttgttaactatgcttactttagaggattttataggaaccaaatagaagaaggtgtttatatgaaccaactgatatcttttttttaaacgaatagcaccagacaatttgatgaatcatatagtgagaaaacgtttataagaccataatcctataatattttatattttataaaccaattgttaatttaggtctgaccttgtacaatcatgttagatatagagatcggattttaatttattataaataaaaaatgatattttaggtcatatgaccaaagttcagctcttactaactgtcggtcgggctatcgcgagtcgtcatagaagtacgaggcacgtggatcttctccatcatctttacttaatgaagtccacactgccacataccctaccaacaagtaccaactaaaccctaaaaaataatatgtgaacacaatttgcatcccggaagaaatgggacgcataattgccagacgcaatcaccgacgaccctccatgccgccgtgatcaccgacggcgatagcaacacccctggcccagccggtggagccagcaccgccggcgatcgtcggcgacacgcgcatatattccatcttaaaatataattatttagtattggatttaacatcacctaaatctatcggtcacatcatttcgtttatgcttatgtttattagttaatttcaatttttaatcttaaatttgtagttgatttcggagttttttcgtcaaagtttatttttcagcatttgcttttttatcgctaaaaatatgtatataaaaaatttatttataaattatttttcgttttcaaatatttcgtttggcatgaataagccaaacgatgagatcctaataaccatatttttgaacgaatgaggtagttgataatcatcatgatcggattgagagatccggctcgatacgattgatgagaagatctagcaagatgctggtagttgccagtacaatgctagtatgagacaagggcacgaggatcttaagcttatatactctagtagctgtcagaaatgtgcaacgtaccctgcacatgccccgtcagtaagtgacactcactctcactcgcccaaccaacaactcgatcgcacggcccagccattagatcacccataaatggcccagatcaactggacaatattccgactatataaaattcgcggaatatgagatcccttatttacccccaatcactcaccaaccgacaccacacgcaaatgtctagtcaacacgagatatagggggatgacatgtagagtcgggatagatatcgattatactatacttaccgaaacgccagcgggcctggacgagggcgatgtcggagttgtggacgaggaaggggatggtgcggcggaggaaatcagggtccggctggaagtcggcgtcgaagatggccacgtactcgcattcgcggacgtagccatgcttcatcccctccttgagtgcaccagccttgtaccccttgcggttctcccggatctggtacgttatgttcacccccttgtgggcccacctctcacactctatcctcaccatctcctgcaaaaagaaaatggccccacttgtcagccacatactgatctccacccaacaacaatttaatcacatcaatatgatattaacaacaaggtgaatttagtacttattactgcttggcttaacatgagaatgatacatggtaagttgcaagccaattgcagcttctgcatgggaccaaatggacaaattactagcatgcatgggccaacctagaaataagctgatgatgatggctatcctagcttagcttatagtactaattgacacaagttgtttaatatagctcttctaggccaagtatcttgtcttgtttatcgacagtaacagcacatacttatgcacactgttacccaattgtactactactactactactactacacctatctagtgctagtactgggaaaatagccagcgataacatggccgtttcagtgtacaacgtggcctgcacgccgcttacccattgatcccggtgatggcaagtgattagcagtaatgacaggcaggagtaaactactgcctagtgacatgattcttctgctgtcaggattcagtaagagataatctttaatttttcggttaaaaaaatgccatagctagtgtactgtttatcctcccctgaagtaaacctacttttcttgctcttccggccatctatacacaatataaaggcctagctgaaaatgagaattcacaccccaaaaaaaatccacatattccaaataaacctaaaaaacatgccggcttcatatttaaaccattttggaaataacaaactcgcagagttcccgccattttgcactaaaaaccagcacaaataaagacaatacgccccccactaaaatccacagaataaagaaccaaaaaacgcccccaaaaatccttcatatgcagtgatccatccacccccctgacgaatcgaatcctatggccacagcttccacccaaattctcaagctaaagcagtgatgaagagtgtgagagctactagcagctagccacacactgtactgtggcgtccgtactgtgatgtagggacggcaagcgggctaacccatgaacctgtttataggcaaaattactcgtaggttgcctactaatttaacttataaatagatttataggtcaaactacttatatctctaggtgtggtaaatccaatcatgatgtaaaaattcataggttaccacttatttatcgtataagtagattgccgggttcggttcgcttgcataccaactgtaatggtagcgtggcgagaggaggaaagagagaaagttggtcggaggctacagcggcagagtgccccagcttcacggcttttttttgcccttcctcccttccttttcaccaaaagagcaaaaagagacagcctcactccattgacgatttgactctcactcaccgacagcaagaggtttttttttttctttttcttcagtcttcctcaccgacaggtacacatggcgatggggttgagattaattacgctgctgctatgtaggctaggcctttcagtaattaagtgtatagtaggacaggagtagattagtaatttaattacagaggagtgaattattaggaggagtgtgtttttagtacgtaccttgatgacggggtcagtggagtcgtcgagcacctgcaccaccagccgatccgacggccacgatagcccgcacaccgccccgatcgacagctggtacacctacaccccccaacacgtacacaacacacagtaattaactgattaatattaccacgattacaatattcccatcgtgagtaagtaaaccaaaaaataattaatacttatgaagagtaagtaaatcagaatgagtaagtaaaccgaaaaacactaaaatataatcattataattccatcgtgagtaagtaaaacaaaaatatatataatttaataactatc

SEQ ID NO: 66101 - DNA, 12195 bp, Oryza sativa
gccctcacctgcgaccacgcctccggaagccccgccgccccgccgccgttcacctccattcctcctcgccgccgctcgtcggtctccctccctctccgcgccggcgccgacgacgacgagacgaggcggaggagcgagcggaggaggcgcaattaatgggattggagagtggagtggtgggagagcgtgggagagagcgggggttttataaaatgatcccacgcacatgtactagtagggttttgtgtcactctctctctctctatctctctctctgtgcactcaccaagattaaaaaaaaatcccctccaaaatctactctactcttttttccaataaaaaatatttatctttttaggtcgatggaaaacggaatggtttatgtgaagtttccctcggtactaaatatgccgacatacgatggtcgaaacgacttaagttacacaaatagaaatagattgattatttatgtatggtttctcggttctaaatatgtcctgtgacagtcgaaacgactaaatttacacagagagtacaaatcggtaagaagtagaaatagactgatttctgtgaaaatttattggttttgagtaggtcatagaatcatccaatggtctaaatttaccactttgtttcaattttggcaaaaccatgaacctatccagcaagaaataattatgcatgtgaaagttgggctccaggagacgctccacagtgcaagggaaaaaggagaaaaaaaaatcacatgatacatgattgggtggtaatgtggtaataacattgcaaagtgtgttgaaggggggaggccatggctgtcgagtggggcccacagtgagggtgtcggtggtgaggagggtgtgcattaaacaaaaccaactggaggtcagtcagtttaatcaaggggtgtgtgtgaggtttcttgtgtggaggggttgagtggttactagtgatgatcaatcaatcttggggttgggttgcttatggctgctgcatgccacatttttagggttcctttggctttagccaaaagggcatatcatgcagcaaattggggagctttctgttactctaacagtgtggaaagagctgtaaatagatgagtgtactacaagggtcgaattcggcattgttcttttgtgcgggaactcgcacgggtgtatgtcatccaggtctccaaacttctgagtatcggaatggttacgttcgagctcttcttttagcaaatccaatgcttagcgttacacattttactacgagttgagacaacacagctgacgtagacatgaacaaagaacaacaagggaagagcatattcacaatgggaggatgggatctgacatcctacaacacattgtgagcttgtgttgcagccatgcatcccatgtggttttgtttgctggttcttctgacccaatctcaaataacaaaatgaaatgcacactgaactgaacaggcctcatgttcttcattcagtactgtcacaggctcacagttgggggaagaaagagacaaagcaacggaatttatttacagttcatgggcttttgtgcaaaatcagccaccatctgcagagagatatacggagggaaagctagacgactcccgccaaaaccgtcgcatcatgtgccagcgcttatcacgtgccacgacaccagtttcatgaaaaaaaaaagaaaaaaaaggagaaaaaaaatgagcaagctgataaatttttttggttgatgagaaatcaatggctgggtttacatgttgaccaaggcattattgcaagcgcaggagatatttctgaataatggtttggtagcaaatggtttgggacatgtacttggagccttcacagtaccagtttgcctagtttagctaggccctgtttttgatcattggatgcatattttttctatgcataatcacgagttccacataggggtctttaactaatatatgtgctatcttgcataagggagctacttctagctcttaagagcatcggatgaactaggactaacaatattggataaccgtctgggctcgtcagtatatggtaggatgtcagggttagtcgtcatagtgggttttgcttgggctccaaaaatattttcgagctcattattactcgagcgtatgtatcaccgtttctcgatgtggtttaaataattataaaaaaataccatataaaatgaataacataaataatttgtgtcacatatttttcgaaaaatatgtgatagtacaataatctaatagcaccgtcggttagccaacaaccaattgcatgtcagaatagcttattagagaaaaacaaaaatttatgtgtaaaatttttatatacgtgtgcacccttagcgacttaaaagccaatgaaaagaacacgttaaaaatactttaaaattaagttttacaatttaaattttggcaagggtttggctctttctagggcaaatgatggaaccttaaatcatcttttttttccctaaaattcactcgactatatatttagaccatataaaaatccatttctacaagtaccttacaccatgcccacacaaacatttattaaggcacaaagctaacaactttattatctctcttttggacatggcctacacacacacatacatagtccacaagacaaggcattaagggaggagaagacagtgcttcctccgacccggccacatgcagcttaatttcggctcctcttgccgcgccacaacatgcgcagctttacactacttcactcactaataaaccttccaaagtgatcactaaatcaattaattaatatagttgaatgatcctaaattggctttactaaagtacaatgcgattcaacgaagactagattgattattggtgattaattaattcgttgatgaaacccccaccattggtgacggcgccgattaacaaatcggcttttttctttctttctcccttcttctttgttggtacatggcagcaaaaaccgggtgttttgacggtaaccacgccatgatccccgctgcctaaccctaatgcatgaaaaatgaatggggtttgtgagacctactggggattgtgtagccacatggtgatcgatcgatcgagatctcgtttgggagaaacgccagctttcttgcttgcaaccgacacaatgcaaaacatgaacatgaataattaatggtctagaggactgttctccgtataaactttgtatatatacggtatttagatatacgatatgataatttgtgtaattatagtttgtttatttttattagattcgtgaaattagatttttaataggataaaccgtccgatgtagactaataggataaccgatattagaaacccaaatacgtactaactatgatgattgtacaacggtatcgttttccggccacccaaccatcccgagagtgaaaggatggtttaagatatcatgaaatgtaaacggcgaccgggaaacactcttcgtcgccctagggtcgacgacgtcacaactaactccgccactagtatcactcgcatcgttttctctactctttctctttgtctccgccttgtaaaaaccctacgtagcatctcctcctagatgctgacatcactgttcatgctctctctttagatctgatccggccagcaagaaaccgtcggtcgcccaagtcaactgcaaatgcaaattcagccaatgtgttgtgcaatttatggaaacaccacgggttgatgtggaatattcccttctacagcaacttccctgtcagtaatttactctccataggtatctctctatcttggcacccagtaattaatttatgttttgacagatgtactcccatgccaccaatttgcagtaaaattaactacttggaggtactagctagctagatgatctgatctgatgaatgatgcagttgacatttcactcctatttttttcccaaagttatgtatgagaattaattgttcagttcatggaagcaagaagagaccgacggtcacagcctcatctttttcttatgcttatacttattagctaaaatttaaattttcaacattaaatttaaagttgattttagggtttctttcatcgaaatttatttttcagtttttgtttttaggtcgctaagaacacatatataaaaattttattcacaaattgttttttatttgtaaatatgctatttcgcttattcctagagccgttttcggtgggctatgctgttttgcttgtacgtactaatgacttcactgtaccgtacaacatcgtttataagttccaagttgaaacaatggtaaccgtattttttgttattaatgacagaaactgcagcaatccggcaaaactattggcgatcgagaaggaaaaacaggcaaggaggttgcttgatcgatctgagctgacgaatcggcttctactactacttggctacatataaatgcagacatgaactactgaactgcagaatacttctctgcgagagtgtacctaattaagctgtattcgaatcttctgatcttctctgtaaattataagatacatagccctcttgcgtattgtcgaaaagaaaattctatctcgggtgctctaagcatgttctagcccaatgtaaataagttatgataagtatcagttgaccccaattgcagtattacagcagcagaacaggaagctctctgacgtcgagctccgaaacatgtgatcttgaacaattctttagctgaagattaatgtaagtcaaagaaagcgattaaacggtacgacggcatcgaaaagaatattgagttgtatgcaccaaccagttcggttatcccggaaaacttgaaccgacaagacaaaaaatgacgaacaaaacgttcaaatcttcagagatcgatgcttggcattgttcttcctccgatgcagtgatcgacacggcgtttctctgtcgaaaagggatcgatctaaagaagacaagcagagatgaacatgtcttgcgaaaggtgacaccggtttacacgacgattcgctgtacagggtatatatctgtgcatctcgatcgatttcaccgagtcacgaggatgtactgctgcagctggttcttcgctttggatcatcactgtcagagtctttggctagatttgcaagaaccaaagtgtgctctgacagcagtgagtgtgatgatgatgatgatcatagtgcggatgagtacgtactgtatttacacagccccactttgtgcgctgcctgcaaaattccaggaccaagaagcagttgcctgctaattgctggaatttaatcgctcatttaatcaggcaggcagcacggcacaaagctgaccatcttgttcttgttcttgcaggtcaaacagctagtaaaaaaaaacactgtttttttaatcctgaaactctgaaaggctcggtgtcacatatacttggtgctgctaatcttcagactttcaggggaaaatcatgaatggtaggatgtgagagataatgctggattgcagatcaaagatgcagtgaaagatgggacaaggaaagttcagaaaagatcaaagagctttattctttccacatgaaagaacaagaactcagaccaacctagtactgtcactgctaaaaatcacgtgcaatgttctactaagttataactaacggtaaatacgatcaactgtagctcgtaaagaaactctgacgaggcagtaaacatttgcatatgcagatattactttcacctgagcacctgagctacagcattgtacaagcaagaacctgtacagggtatgctatgcaggagtggtcctgaactgtatgtatatatgtagctattgttctgcagcttctgaatatgtaccttggagacccagctccaccgtttgcttattggcttcagtcacagctaaaatttggattttaaagttgattttaatatttttaatcacaatttatttttcaatattacatttaagtcgataaaaatatatatatgtaaattttatttgtttgtttttttcacaatttatcaagtgtagaccaaattatgattaccagtagcagacataagcctagagcctgacccctaggtttgtctccaaaactcctactaaaatttatcaaaacttggcggagattttaaaaacacaaggtgtataagcaagttgagccctgctactgaagattttctgattttctggctccgcccctgatgatgatgatgatggtgatggatgacatggtgttggacccaaacagtgtgggctacaattaatacatatgtaatcagcttcttctaggttaattagagtggacgcatcaggaggaggaagagaaggaatcatggcacatggaagcacaggccccggaaatgccagatgccatgcgcaaagcgaggagatatgcatgagcactactatgagctttttggtcacccttttttctcgccggatttttgcggatacaaccttctcaaaaacctgaatttgcaaagataggcccctctcgcaaagagggaaatggccaaggggccacttatggcatattcgtgttgggtgctttcgcatcacttcgcaggtgacactgctgtgttaagcaagcacaatagttaagcctggggcatgtaagcttataggtaatacacgtacgtcatctaaagacacgttcatagaacaattgaggtattaaaagctttaactattaagtcaccaaaataatttttcattattcgcacttccttttacccacccacaagtaacaattttttcttttatcttaggcttagtcgtatttgtacgagcctagtatagtctcatactccctccatcccataatatagtaatctagtactggacgagacattttatattacaacgaatctggacagatgcatgtccagatttgttgtaatatgaaatgtcgcatccgatcctagattgttatattatgggactgagagagtagacaatacgtgttatctagagactcattcatataacagctgtgacaatcaaaggctctaaatattaaaccaccaaaataattttaattatttgtccttccttttgcccacatcacaaagaattttttaaaatcttaggcttaagaatcgtattgtatggctactaggctcataggcaatacacttcatctagagacatactacctccgtcccaaaataagtacagtcgtggatatccgtgcccaatgtttaaccgtccgtcttatttaaaaaatttatgaaaaaattgaaaatatttagtcacatataaagtactattcatgtttatcatctaatagcaataaaaatactaattataaaaaaattcaaataagacgaacggtcaaacgttaaacgtgaatagtgcaaaactgcacttattttgggacggatggagtagtcatcatacaagacaatcaaaacctctaaccatttagcctccaaaataattattaatcaactgtccttccttttacccaccctcacgtagcaaaattctttttatcagccttaagagtcgatttaagctcaatataaatatggagtcaaaatacaagttaattgttgttgtacatattctagtatattcttagggggtgtttggttcgagaagaaaaggggatacataaattaaacctaatggtagtgggaaatattgcgaccagagagcgagaggagtgatgcacaagggcattatacggcatatttctctttcctgaaaatgattcttaaaagtaagatttgtttttaggtacatgtgagatggggccactgtatgtctgtaggcagtgtaagtggcataacatatgcatgatgaatgattttgataaaaatattgaagaattttgttagtggccaattcaacaaactaataatgggcctcactgtagtctcttcggccctgggctctaagaaacagtagtgagtcttgtcggtggatggcccacaaaacaggttgggccagttgacctccatactgatacagcagaagtaacttctcaaaatctaagaactaacttgttgatagctagattttgagaatgtaaaagaaagaactgggtttttcagtttatacgttctagtctaagttctagattttataactaaagattttaagaatctaggtgaaaatcagcattatttggaagagttggagatttaagaagaagctatagctgctcctctaaacatggcctatacaactatgtttgacaatatactccctccatccaaaaaaaaaacggagagggtactttccaaaaaccataggccgtcgttgttgtgctagtacaaattcagtaaaaaaccataaattttctccacatttcaaacatggcctagcttaatttcccaattttctggtgcacgtgacgtaagcgatttcacagctttcatatctcgacatttcgtcaaacacatggtttgcaaatttcaacaaaaaaataaaagtagttttttttcttttgttattccgtcatttcgtcaagcacatggcatgcaacattcaaccgaaaaaaaacacacacaaaatttcctcttcacaacgacgacgctactcaccaacgcgcgagagcaacgggctgatcctgccattgttgccacctacgagagctcggattccatcttcagagcgccttgagcatctcctcggcgctgctggtggtgaaggcgccgccctcctcgaggttgagcaccttgacgacgccgtcgtcggcgaggagcgcgtagcggcgcgacctgacgccgagccccatgggcttgtcggagaggtccatctcgacgccgagcgcgcgcgtgagctccaggttgccgtcggagaggaggagcacgtcggcgtcgccgaggcccaggctctccttccacgcgcgcatcacgaacgcgtcgttcaccgacacgcaggcaatggcgtccacccccttggcgtggagctccccggccttctcgatgaaccccgggaggtgcttctgcgagcacgtcggcgtgaacgcgccgggcaccgcgaacagcaccgccttcctgcccgccgtcagctccgccaccgtcaccgtcttcagctcgccgtccgccgggtcgaagtaggacagcgtcgcgtcggggagcttgtctccgacggcgatggtcgccaccacggtggacgccgacgccgccgacctccgcgccgctctcgcccccgcggcgcggacgcctgttgcgagggggcgggaggagaaggagagggagaaggaggaggtgatgaagcgcttgccggaggtgacgctggcggtggagagggtggagagagctgctgcggtgggagcggccatggagggcggcgacggcgatgtgttcgaggaaatgcttctctgttgggatttggtttgggagtgcgcggcgcgacgcgagagataggaaatagtgggatttggttggtggggtggtgatggcgaggcggaaggaacgggtggacggcgtggtgttgcgctggattaggcgaggcagagccggcccacgggtctggtagcgacggcccaggactacagtgtcgggcctatttttgttgggccgaaacaggattgttcggcctgccttggtgattcgggttgggcctatgaaaatccagcccagttttccccgtttgactctgatggagttgaattttttttatttttaattttttttattaaaagttttacaaaaataattttctattttgaaaattgacggaagtagtcgcctaccgccctctgggaaggcgatttttaaaaatcgccctcccagagggcggcgaaaatgacgtggcagacggccgttcgctctcgggcgacggccgtcaacgaaatttgcaggcggcccccttgccgccctccgcgagggcgattttgtactgtgcggggggccgcctgcaaatgggcggcgaggggaggcatggaattttgcaggcggcccccttgccgccctcggcgagggcgattttgtactgtgcggggggccgcctgcaaatgggcggcgagggggcatggaattttgcaggcgacccccttgccgccctccgcaagggcgattttgtactgtgctctatatttttgtataaatatcaatagttatcaaatctttttatattgaaaactatacaagattaaaatctccaagactggtaaaatacaattttattattttttagggcatatttggattgttaccgtacaaatattttgttaccgtacaaatattttattaatttttagggcatatttggattgttagtgccaaatttttcttcacgaccaaatatttggtaaggtaaaattgcatttgatcatatttggtttgctgccaaaatgtaaaattgtagtgaagaatgttctacataatctcaaatctagattacgtattaccaatgaataggcttccattttcgtgtgttgtgtgctagtgggaaagaagatatgaagaggttgccttcagattgtcaattatatagcgtcgttttcactgcaatatatgtgaactcaatgagatacattattcattagatgtgacaagacgatcacgcgtgggcgtgattcactttatgtaaacaggcagcgccgaaagttgatagtgataactcgagctgccgcttttcatgtgtgctgttgtggactgtgcgcgctactggatctgacactaccgtgcagcgccgaaagtgtgttgtcgtgagcataagttgttctagcaccatatgaatgaaaagaactatgtagacgagacaaacacaagtagtactgcagtagtaatagcaaaagtagtactgctttacaagtttgtaagccaaaagaaacggtcacataaggactgaagaggtagaacactacttacgaggcctcttacccctgtccctcctaccctgcgccctaatgtgcccgtgggagtacgtgagtcggtccgggggtacggcacggccaacccgtcctgcctgtacaggtgtgacctctggctgctcctgagtgtgtgcctctggagctcctccaagctgagaggagcctagtacgtcgtggtggtctgcaccgtgcaagtcgtcgtcgtagaactggctagtaggaccagtcctaccggcgtgagacgaagaggccccagtaccgaagatcccggctgcaaatcctgctggacaaggaccatcagtttcgtacaggtatttaacagtattaataaaaagtaaagtaccgtgtgggcgagggatcgacgctccgtgagaggaagagctggcgaacgcgcccgaagaggtggcgaacgcccctgcggagctcgtggaagcgccggtcgtgcctgcgaacgcgctcgaaggcagacgaggtcctgcgatgaggaaacgtgcagttaaaacatggtgacataatcgtgcaaaagctgaaacaaaaatgaactaatatctaggctgaactgtaccgtgcgaaaccggtgctgtaggtcgcactgatccgaagctaggggcgctcgaaggcaaacgaggtcctgcgaggatggatcatcaagttacgacggggtgatgttttcgtacaaaaacagaaacaaaacttaagaaacctctgggctgagcagtaccgtgcgaaataggtgccgtaggtcgaggtcctgctccgacggtaggcgcgcgaggccgtggttgtaccggaccagctggaggtacgacgtccacagcgctgcgacaggagaagacgcgcatgaccgcacgcatcttctcctgcatccggtcgaaggtcaccctctgctcaacgtcagtcaagtgcaaacctctgttcaacctcacttggactgcggtgatatcggcactgatatcccgtgcggcatcagcctatgcaagatggaaataacaaattcagtagttgtcctatattatgcaagataaatgaaataattgtaagaagtaatacaaattggatgtaccgccacgaagtagtctcggtcacggtgcgtgggatacgcgtccgtgacagcggcaacgtgcggctctggggcgtctggagtgaaggtcacacgcgcacgagtgcgaggaaggtaccaacgaaggtagtcacggtagttctcctccgtgtgtgggaagagctcgttgatcacctcctctgtagctaacacccagtcgtcaacgtactgctgtacacgtggagcccaaagtgcgcctgctagctgtccccgtcgagtcaacctgtgaagagaggtaaattatatggctcgatgaagtaattatcataaaaatttagaaatgaacaatccggggctgcagga

SEQ ID NO: 66102 - DNA, 959 bp, Oryza sativa
ctgcgcgctgcgaccaaccccatagggtgcgctgtccaccactggtcgacctatggcaaacctctcggctgcccaaagctgaagcaacatagggcagccagcgatgatcgctcccgcgtcagtcttcgtgcacgcctcacagagggcacggtacgtggctgctagcacggcagaaccccagctccactgcggcacgtcctgtggctgagcatccgcgatgcaccgtgcgtagtggaccagccggaagtccacagcgtgcccgtgggtgctagtgaacatcacccacccgaacaaccacaacaggtacgcctcaagggagcgtcggaccgagtaatcatcagcgtcagggtgtagaatgaaatgttagtacaaaacactcattcggtcgcaaataagcacgtatgataataacaacttatttacttacagtgaactggagcaaccaagccttgctaggcccgactgtagagtacggaggaagggtggtggtcggtcctaggtgtggaaggcgcatcacctgctcgaagcgcgcagtgatatcctccttccacccaaaaacaccgtccacgggaccaactgctgctcccgccagcggtagcccgagcaggtacgacacgtcctgcagtgtcggagccatctccccacagggaaggtggaacgtgtgcgtctcaggtctccagcggtctacaagagcggcaaggagtgaccgatctgcatcccaccgcttcgctgggtcacggtcgtccgccgccgcctcaacaagcctacaaagtggtagaaggcctgccgcacgcaacctgtatagagcaaacttcaaacataagtacaacacaaagcaaagttgagttgaaatgtgaacatacgcgtaccaaggaacgtgacgggggtcgacacgcaaccactcgcgcgacgtgcgtggacggaaggtgccgagctgtgcaccctcgactgctgacagg

SEQ ID NO: 66103 - DNA, 1209 bp, Oryza sativa
ctgtgcacagagcctcttaaagagctccataagatgcttgttcttgaattgcttgtagaaatttgcacccatgtgacgcatgcaccaccgactccgaacatcaggccacttagctggaagtcccttctcatcccaaccgttctgcaagtagtcaatagcccgcaacatacccgcatgacgatcatgtataaggcaaacgttgggcctcatacacaccactgcaatgtgcactctctctaggaaccagtaccagctttcagtgttctcactctctacaaatgcaaaagccataggtagaacctggttgttcccatcacacccaattgctgtcaatatctgacctcggtatttacctgtcataaaagttccatctatgcatagaacaggtcgacaatgcacaaaagcattgatgcaagcacccaatgagaaaaaggctctttgcagcacactctttgttcgatcatcaaccgatgtaaatgtatgtaggtcatagtacgtattattattcctctgggcaatggtggctaacaaacgaggcaaattatcataagaagcttcaaatgtgccatacctcatctcaatgatcttttgtttggctctccaggcctttgcatagcttatggtgtacttgaatttgttctcgatgtgcctaataattgattttggttcaaagccaatgttaccaacaacactgctgtacatctcacttgccacaaaagctgaagtgatgtttcggtgatacttctccaccccttgtaagtagcacttgtgctcggtcacaatgctaactttccaataatcattccatttacccttatatgcatggacacgccacggacaatcttccttcatgcacctcacttcatacacataatttgttgacttgaccaccctaaactctctctgcaaggaaactgcccaatgcttcaccgcctccttcctctcatccttatgagcatatcttgcaccctcaattacctcattctccttatactcccagggtacatgatcaccctctgatataacaagtccagagaagtcctcatttgcccaatcagtggccattacatcaccttcctcatcggatgatgcgtcgtcgtccacttcctcattatccgaatcttccctctccatttcatcaacaattataccgactctctccccctcatccgccatgcccatagcctgctcctcccttggttgattttc

SEQ ID NO: 66104 - DNA, 5218 bp, Oryza sativa
atgagggcacagcggctgagccaggactgccggcgccggcggctggcggcgccggcggaggccggcggcgagagctctttccaggcggaggccattgccgactgcttggagttcatcaagagatcatacctgcagcctactacagcatcagcttgctagtgaattttcatcgattaattagtggatcaactaatattgacgtgcaatccttttgcgcgttcgcaaaaaattagtggatcaattaagttacgaagttcactcatcctgtgatgtgcagtagcttaaattaatctgtatatctcagttttgctagcttttgttgcgtaatgctttccatcaagaatgtacaaaaatgatgttaattttgatgaataaaattacatagtaatataattatgtttgctggtagtgatggcctactggccatgttggaaagaaagatagatgtcaatttcttgggggtcttgaaaattgcgtgttgatgcatggttaggcggtgattttcaacttaggaattaggtgatgtttttgtcatggattgtgacttcgaaggtatcaaagattagtttgacaaaagagtggttgggcccttgcatggtacaaaacaaaaagtagaggatgatggcttctagtgacatacatgatacatgtttatcagcattgaccattgttgttattatatcatgggtgattcttgattggctatgaggaacccactccttatttttgtggtgatgggcggtacatatactacatccctcaaactagggatgtcaacgagccgagcttaggcaaaccccaattatttaggctcgaacttggcacaagtttgagcatttcaacctcgaaactcaattgggatggatttgagctcagctcagctaaagcttgatcaggctcgagctcagattgtacgtcaccgtgtatctaggaccataatttctgaggttatataaaatttactttaagaagttgtaattttattggcattaacaaataatgagggataagaagaatatttgatacacctcatattgttttatcatttggatacctgctagtctactggatttttcataatttggtccttctaaaaaacttatttcataaatagacctttaaaaaaacttattctagaaatggtcctttttgagcaccagagtcattggcaccgtggtctaacggggaaggaaagaaaaaaaaagttgcacatctctcttctacagtagagaggaaaggaaaaaaaaggggggtgggggtggggggtgggggggcagagacattggcgcgcttcccctgccacgtcagcgccgactagggatggcaattttgcccatgggttcgggtatctgtggatacccgacccaatgggtacgggcgtcgattttttatctatgggcacgcccacccgagacccgaagatatcgtgggtaacggctgggtttcattttttacgtgtgggtaacccacgcccgacctgatacatatgtattagctaattttgacttatctcttaattcttatacccctttctcttggttcatttgtgatactaactaataataagttgtaatgtaattcaaattattgttgataactgataatttggtaaattgttaattttatttctctttgttaaattatatatctttagagttattatttacgtgagattcattgggtacccgccggacatacccgtgcccatcaagcatgggtatgggcacagagttttgcccgctaaccctagtgggtaggatttggacgggcaagacgggcatggggtcaagcatggttttgctctacccgtgcctgacctgacccgttgccatccctagcgccgaccctccatagtggcatggggacgacggcagagatgattacgctgtgccattggaccacggcgccaatgactcagcgccctaaaaatgaccgtttctgggataagtttttctagcagtctatttgcgaaataagtttctcaagaggaccgaattatgaaaaatccagtgctagtctactaggatatcagtagaaatttgcatacatatgcaagcttacgaattagtatttgagatttagctcgcaaagttcatgagtctgagcaatttccgtgtataaccctaaatttttttgtattttggaacgaatgtagtagaaaatagttcaactaccactaggggtagggatgatcatgcttcaatggggcctataaatgataagtaacttagtaatgctaggcaatacgttatccttgtctaaactaaaaataatatgttatcctttcctgacaaagggaaataaaccaacagattatttccacactggtctgtaaaacaaagagttatctgttaccaatcaactttcatttattgatccatttccactaagaatgacaaatacatgttgcctgcaattcgagtatataaatttaaagcggaaaaaaagaacaacttgatggacgactttaaagtctcttttctgaagaaaatactatacaaaagacaagtaatacaaaggacaaaatgctacatgccaaaatttttgtcattcgtgagcaaaccatttctttgtaaaacctcagcagacctggaagtcagaaagacttgttctaacttccaatattcagttgcctctgaagtctgaacccccatcgaattgaaatgtatgttagaaaaagaatgtcaaatgagcctcaaaagaccatctccaggcacctgggtcgatgttaaatgatgctgcaacaaatggtgtacgattaatcccacattttagttgaaagtttcaacatattaagttgtgaagaaccagaaaaaagatttcaccttcaaacagaattctgaaggcgcaggttccaactgccagtcatttacagcagtgccaagctggtacctttttcttatcttatattctcatgtaaccactatcaataagctataccttatgaaattggaatggaaaaattgtacaaccgctgaacaaatgatatatatactatgttgatattatagggcctatcgatgactggaatatatcatacagtgcaagctgaacttctccagagctatgctcacagcgaatgaggttagttaataaggggaaaaacaggggcaggtttctcctaaagcagtccctctctaggccacccaataactgcatcacatgaaggaccaatgaagttctagcagacagttcctccttcttagcagtgcccaaaggcagtttccagcgtaatgctggatctctaccagatgaatcgttagatcgttcacgccctgcacatttgagatacttccgtagtattttctcagaaacaagcataatatgtgactcaattttcatatcttctgagattgatgggtggtcatgaaccaaagcttgcagaagtttgagatagctctggtaagactcattctcgaaatgaatgactgctggctcagacacctccaaaagggaacatgctttatggaatttcatgagcaaggtagattcggagctcacttcacttgcatgtgacgcaatggctgatagtgtctctaaaattattcccatatgctcagcataaaaagaccacctgtgtgtctcatacaatttaactatgccctgaaaagaaaccagtggtgagtttgatcttagaacaattgttggcatgtagaacatgtgggaagactattttttatttgttatattactgttttagttggatggccaaaggaaagtatagtattaaattaaatatagggcatgttacataagggaattattgacagaagtaacaaaaactgtaagtacctgaacaactaagagctgctgcgccatatgattcttcaatttaataatagcgtatgatgttgtttccatattagcttcctcttcatcatcattgtatatgtcattatctgaatatcgttcaacttcaggataagattcatttctatctggaatttctatatcttgcatcatcctaactatcttgtcaaacacgacaaatgtttgcattgctgagtctttaaaacataacaagatctctttccattcctccttggagagtctgctttcaagtccttctgttaaacgctgaaaaacagataaacctgtgctagcagactgtttataaggacttctgataaagtttgtgacaacagaagtaactctagaaagttctgtccgcatctcatcaaaaaaggtaatgtacaaatccactaaacacttgactgctactgttttagtttcagaattccaagagtcatcctcagttagattaatgtgcccatttggtgtagagctaccagtgctaaatagagaataaacaacagattcaaagatatttctccaaaaggactgcgagaaaaggtgcccatgatccttcaaaatgtcaaagagtacctctactgcaccttttctgattgttggtcttgtgtcagttgtcaacctagctagacctgaaggcataaagcaataactatgttacaagcgcaaagcacttcaaaatcgactaacgcagaaagaccaatctagttttgtgacagaaaaaataactcaccggcaagcagaggaacccagaaataaacatgatcgtccttgtgcagagtggcattcccatcagaaacatctaagttatttgactggtgatctgtatccttttcatgacaaacaaatccttcctcggcaagtttaacagcacagaaccgaagaaatgcaatagcattgagactggcatcactgctaaatttactgctcgtgaatgtaataagacatttaacacaatcagtaaatgttgtggtttcagtctcagttatgtatggaaaatagtcccgaacaatcttttccatggtttcaaatgccaacagcacaatactttttcgatcatcagcagcagcagcagtaaaaacctgtattaagataaaatattataaattgagtggcaatgcagggatgttcctctagttatttcttcagaaccactccctccggattgataatacttgtcgttttggacaagtgcacggtctccaaaaagtaactttggcaactattttctattataatatatataggaatatcaacaaatatatgattttactgaagtactttttaagactaatctacacatatggtttccatatttttaagataaatattttagaaattatttatagtcaaagattttaaagtttgactttgccctattcaaaacgactaatattatcaacccgga

SEQ ID NO: 66105 - DNA, 2681 bp, Oryza sativa
ttaaagcgggtctagataacatgaatcttatgaatcttgtgtgtttggactggcagctggttgttcttcatttgtctggttcactctcggaatccatccatagtatagtatggtcgccttgtagagttgtagattggcttcaactgcagccacaagagggttcctcagcacgtaattaactcttcgataagaagataaaattaccacacaagcaaatgcgcacctaaccaaaacaaaccttaccatttgtggctaatattttggtaagatgttgtttagtttggtaccttaccaaattttggtatggttttgtgagtggaatgttctacaattgcccaattttggtagagtttggtaaggttgcaatggtaaaataatgttaagtttgttatcttactaaaacttggcaatggcaaatgtttggtaaggtttattttagcaattaagtgaattagctagaaatttgtgatttacaggtgcaaatcaaatttccgccaaatcttgtgaattttggtaaggttaattttggcaacaaactaaacaaacccttattgtaagaggaaaaaatagaaccatgttgatatctcatccctttgcaacgcatggggcctgtgactagtagaagaaaatggataatgtgaagctaaagggcctacatgttggtaacaaatatatgcataaaatgatagtaataatgggttagcgataattttctttaattcaaatcccattgcaacgtacgggcaatatgatatttattgttgtaaactttgatgatttgatgctttatccgttatcactttgattatattaacacatgtgacaataacatatgggaccatccaagtgtgtgacagtgggccaggatatcaaataatcaaaacctcatttttttctctctctctctctctctcacttattaccacccagtgtgttgtcactactatactctcagcttgcagcttgaagttgtgagtgctattagccaatagggtcatcaacttttgaggttctgggaggtgatcatttttgctatgctggattagatcaagtggagtaatatttcatctactctcacttttttttccctgctttggttcatatctaatcttctcttctcatttccgctccgttttccgtacttacacgctgggaatgtccgattccgaacacagccttaaagttccgtaatttatgctggcaatggggacctttgataagacctgagaaaaaaaaatagcattggagatctatccatggcaaacatgttttttgccatgtctgtgtctgcaaacaagttgtcacacctgatcttgtgtatacactgtcatggatccacttgcatgacagttttcaatcacgttttggtgtttgtgacctgatggggttatagtgaattatttggagaatctaatgcattatgatttttatttgaaaggaaataatttcccggaaggtttactcaattccagcctcagtttgttcagcccaaaaaagaaaaaaaaacagagcaccattaaaaattagcatcacttatgtttatcagcatccaaccaaattaagcacccccaaccctcgtcgaggatttatcaatcaaattattgtgcaatattacaacactcatggatagcctaaaaaggctctttgcctgcctaagctttagaggctaaagcttatttcagcataatgtcacaaacactcaaacaataaattggtaaaagaagatcgaaatacagcattacaccacataaatattgattatctaaggctggttagagggaaattccgcagaggattctccataagcagttcagtttccctgttaaaaaaaagcaagtgtacattaaaaaaaaatgagaaaggaacagaacctctggaaacataatataagctgaactattcttactgcttgaggtttctgcttgttgcttgcctaagcttcagaatagatggttttgtactctttggcacttggggaactggttccctgaaataatcaaaggaaggtatataaaaattatacgtttttacagttactctttttaaagaactattcaaaactgttaacttaagggcacagtagcatactcggcgcattcgtcatctacgaagacttcaatggagcttacacgagtcggctgaactgctgccctcgatccaaccttctgaggaatctgttgttcagtgcaatactatcatcagttcattgatcattactgaaccgataaacctcgagacatgtcgcaaaaagggaccttttgaagaattctagtggcttaggggagaaaaaaaaaaccttgtgtgatgtccatttagcaggcctcatgttattttctttgttccgatctgcttgtgatccaagggtctgccaggccgtgttgttgctcctggttctagcaaggccatgactaggtaacgaattctcatctgtgtaaactgcaagtggcctattgacatcaactctgcaaatttgcaacagtatcaacaccagtaaaaaaattccaggttcatctagatttctttatactgattgcatgcgtataacaagtaataacctttgcagagttttcaccaggtgagagttttctgcatgctggcctcctgccacatcaaaatgcaacattagttcacccagccaggcacttgaaattgatgttaatcataccatcacagcaaactta

SEQ ID NO: 66106 - DNA, 6026 bp, Oryza sativa
gaatatggaagactatacaccttgcagtcaaacaaatgcataaatcgtatgctttaggtattaaggtataggtagagtggcaagaaaagtcatatccctccaaaaacaaatagagaaggtaaaagttttcagctacaacggttcataagcttactccaaattagtttaatgcattttagttactataattcatagaactaaaacagtaaatggggatatgtaagactatatgtttgttgactaaaaatccgaagaaaacagacttcaaatctagaacaggaattctttgtcaaaggctatatggaaatttagaaggaacttatctattatcactaaaaaataatctactagcagactagcactgaagaaaatccgcaacctttctcatatctgaagaaactaaactaccaatcccccataaaattctcacctggcaataccaaggttaaaaatctcattagctttctttagcttgttcttggactccattaccgacgcataggacaagtagtaattggtatggctctgaccaatctggttggcctccaggaacctgaatatcacctcggaatcagcacaattccccgcctgcatacagattaagatcaagccaaactggatgtcaaaaggaaaccaaaccaatccaatccaatccaaccaatccacctcagaaccaatcctgaattcatgaaactcacatattccagccacactttgaggtagcggagatcgttcttgtagcggtcgtcgtgccagaaggcacgcacgcactgctcgtagatcaccaccaacccggagcaatccccgcctgtcggaaacgactcctgaacccatttgatgcagctgcgtgtggattaagcagacaaaggcatgccatgagcagcaagcttgcggaaaccgcagagaaatcgccgacatggcaaatctttcggctcaacctactactactagtatacgaatcaatgaaacaaaggggaaattgcttactctatccatggttggagcggatcctcgccgctgtattcgtcgattgcctcgatcattttcctgaatcagtagatcaatcaaacgtaggacgaaaaaaaaaagattaccagagacccgcccccaaatcaagaaatccagagcaaaccaaacccaagaaccgagagacgcgggtgacgggagcggcggcggtacctccgggcggcgaggagggcggcgcgctgggcggggtcggcgtgcgccttgagggcgcggttgaggaggcccacgttgcggccgcgcttcagcggccgcacgttctccttgaacgtctcccactccgcgcacggcgcagccggcggggcgtcgccgcaccccatcagcatcagagtctccttgtcgagcgccaccaccgcctcttccgccgccgccgccgccgtcgtcgccatcgccgccgccatgtgttcgtccgggcgccgctccggagccgaccgtttgggaggagagatattcaaattggaagagatttttgaccgttgagctgaggcggatgctgctgctgctcgggtttatataaggtgaaaaagaattgggcttttcatgagttgggcttggaaagtttatgtgggcctaaaattgttggatcttgattgcgtcagcactcacacggcagagtcactatgaagaaattcagtctcagccctgttcagcttgtcagctaattagccgataaattcatagattaattcaatatactgtagattatgaagttaattaattatttggttagaaaaggttatcgaaacaatgctattgtagaaagatttttgagaaatcatactgttaaaattgtggcccgtcaattcgccgtgatgaatgagttttgttttttttatgttaatgctggagtatatgtgtttgtgcaaacattacgcagaagtttgtgatgatcagttgatcttcacatgaacagatttagtttcttaaatcacatgaaacacaaattgttcagcttttttccccaagaccagttgcgtagttcttaaaagcataactcaaacttgaggcaaaggcgcaaagcttcatgcttgctgaactttctgttttgccacgattaaatttcagttaaactgatagcactctttcatattgcacaaaaagaactccaaacaagtgctctaaatgttcaaacttccataataaacgatataatatgtctttgctcttccattacaattggttacatatctagcaggaagcagtaacaggtaacttaattggactatgaacaggcaacgaacacgcatagaatctcacagccttctcggtggctgcatctgtgaaggatccacaaggccttccaacacaacaagctgatccagcagcgcaaacttttcatcctcgagaacgctggcttcctcttcagcctggctcaattgcttgtccagctcaccgttctcatcctccagcagcaggtacttcttccgtaacgctctgtattcatcagctggaccgaactctggcaccgaatcgggggttccccaatcagattgcggagccgaatggcgaggttcattcttgaaggttatcttaggggctttcttggtcttgccggatgtgagtggaacctccctccgcagcagctcaggttcagcttttatttggctgggaggcaaggggcgggaaacgacctttctcttgtgcgtcttcggggttgcgaattcatctcgtggcatacctcttgggtcttgcattccctccggtcactcctccctgaacaatgcaactcaagtgagaaattttactaaagcataatcataaacatataattcattctcaaaacaatatagcaggcaattcaataggatagatcagcacttagcactatgtggaatactactacttaaggtgctcctcaagcaaatctaattatcagagtgtgcaaacacacaaactatttttttcagaatgtaagatattatccccattcaagataatgacttggttcttgctcctggtcatggagttcgatgctagtgcacattgcgaaagggattcgactctagcgcaaacatatgccaccatattatctttgccaactccgtaaccctaatagcaacaggggtggatccaacttgggacatgggggttgagttgaattgaacccccaaactgttactactagttgtattaagagaggtttagggctctcaaattaaggaggaggagaagagctccttccagatctagaagagaagctactagggttaacgaacgcaagcaaaattccagacataagtagtcccggtggggtgggagagagagatgaatcagaaagaggatgcggatggatactcaccaggatcccctcccctcccctgctctgctcgatcgccgcccctcccccgcgactcgtcttggcggcggcgcgaggagcggaggagacaacgagacggggagagatttctctttcttttacgcgatactcgactactccacctttatctcgacattctcctgccctcgccggagatcctgggcttcgccgccgatctggagtcgccgccgcggtgggagatcgagccggagaggaggacgatgacgacgacgaggaggagctccagttggttacggacttgcggtggtgagaggtggagtgcttgatgggccgagagatcgcgtgggccgcacgtaatccaatccgcttcggattggggcctcacaaggccttatcgggccgggccgagtcaacggttgggcgctcttactctagcgatcattcattccacctagtaacagaaaaggagagaaccgagcaagcgtcgccaggtgagcgagcagcccgctcgggttcgatcctgggatcgcaactcacgtgtctcacaggggtttttctccgtttccccgggggtatacacgcgtgcacgtttagtgggactggacacgtatgtgcgtgtgtcgtggactgcacgtttcccgtgcactgaggcccagaggcccaatctcattcctagcgtgagcgtgtgttagggacaagtgtgtgcatgtgtcgtggactgcacgtttcccatatactgaggcccaatctcattcctagcgtgtgttagggacacgtgtgtgcgtgtgtcgtggtatgagtgcaatctcattcctagcgtgcgtgtgtgcgtgtgtcgtggtatgagtgcaatctcatttctagcgtgtgtatgcgttctgagttgtacccttctaaaaaaataaaaaaagtaacagaaagggacaaaacggcaaacctcatgcttcctgctggagtaattttgttttttcttttttgctcctactggagtaattttgttttggttttttgcgatgaaacacggtttttgcttgggttttcaaaggggtggatgaatatatctactcagtaatgaatgaaacgtatggctatatgaagatacaggctcaagaatttatggctaacatcaaactgttgaggaataaaatagtgcatttatatagtgtttgatttaatttaattaatatgccttcttgcaaaatgacacaaatgccctgtagcctgtactattggtctattgcattgatatttttttaagcatagagctatatttttctttgttttagtaacatgattgaaattcaaataaagttgtttttttaccaaaattcaatagagttatatgattgataattgatcaccaaaaggtaagactacgcatgaaaagaactatataacatggtgttctctccacaaaagggcaaccatatttgtcctctatgatggttttcgaccattgctttccaatatagtattcgacaaaattataaaaattaaaaaaatagacgtacaaggatgcgccccaacatctaattaaatgatacgcatcgatccacgccgtaaacttttatatgcggcccaatataggttacactggcccagtacttagatcagtcggttctgtgtgcgcctatatatatgcatgtgatctaaagcatttgccgcatacggaagactcgaacgcataactagtctactatgttgccaacgccaccaaccttgatggtggctcctctctcttctttggtgtactcctcatcgtgtcgcacaagagaagagggctaatccccctaagcgcgtcttgttatagcggatagattcatgagatatcccgtggtggtggtggcggcggcggtggtactggaccgatccccatgggacgaaaagtctcttctaatcattatataatcctggcttactactcggcgcaacgcttatgaggtatgttttttacaggttaggggtgtctgtttgttgaattttgtcttccctagaaaactttgccgaatggcaacatctcatctgattccatattatcgggttgaggatggtgatttaagagatcctgcagttggttccgtgtgtcgtatatgtttatctatacttctaagtttcaacatatttttttgtatggtttaattttaattctttgtgatcacaggaagatgcaaggtacacatatgtgttcagttcagtggtgagtggtttccttcatctatgatttgattttgatggcccttgtggtttgtgtgggttgtgccatggctagttttgacaattaaccctggtggtacctctcttaatctctttgcctagtgattagggtcacattgatgaattccagtacaaaaatggatacataaaaatcgagaaacacacggagagagagagagagagagagagagagaggctacccctccctcctgcatctcgtgccatccgtctatagaaacaatcgcattatgctaaaacgctcgcgtccgtagtgtgtgtaaacccagccgccagccactgtcctcccgtgtttatcatttcatttccctttcaatccccccctcctcccccaatctcatcaagaagaagaaaaaaaaatatggagcaatcttgaatcgaatctggcacagatcctcactctcccgatcgatcgattctccgacgagcaagcagtggtaaccgaaggtatgtgtttgtagtcgcttggcagcaagatcgagcaatggtttgt

SEQ ID NO: 66107 - DNA, 7188 bp, Oryza sativa
ggccaccgccaccgggtggtccaggtgcggaggtcgtcgtaccacaacgtggtgcgcgtgtcggagctggagcgcacgctggacctgacgcgggtgcagacctacgtcatcaaccgcgacagggtcgtcttcctcaacgagcgcccgcaggcgccgcgcaacggccggtgcgccgccgccgccgccgtggcgtgcgccgcctgcgaggcgtgcggccgcggcctcctcgacgtcgccttccgcttctgctccctcggctgcaaggtcagagctccggccgccggccgccggccacgctcctttccttttccggccgtctccgccaccgtctttgccgtttttgggcctcgtccgaggagacgcgtctcgtatcatcagtgggttttgcgcttcatctggaccgttggattgggaaccaacggcccagatagatctagacgtgaggaagaaatgggaacgtccgtatgctgggccggtcagtcttgcatgggcctactcagcccaattaggaaattagcagctctctctttttttttttgggaaaaattcaaatctcccttttcaatttacttccacgcagtatgctccctatatagagcatcaccaacagtctatacctatctgattcccaaaattgattttaaaggaatttagttcaaaaaacagctccaacagatctcttactctcctacgagtttgttttggagttcccttttcccgatttctcgctccgtttatatacaggcgcgcggtctcgtgaaagtcgctcccaatctcacactcccgcctctctcctaccgttccagcgtgtgagagatagcgatctttctgcacgtggaaaaaaacagaattttctgttcgtagtttcagaagggtccacttttaagttttttcacttcctatttttattttaggaaacccaaaaataattttttggggagattatagataatctgttggtgatgttctaaacaattctctttaagttttctcacctctgtctagtttacgttgattcttcgtcatgtttagagatttctcacatcctgtgaatcttgagcatggtgagcgaagtttctcaatgtcttccttaaaaaaaagtttctcaatgtcttctcttattgggaatgggatttaatatacctttttcatatattatgtgatcgattgtcatttgtcgtgttttatcgtcacacaagctgtttaatttaaacatgcatgaaaaagtggaaggtggagggagaccgagggacacacacctttggtggcaaagaacaacttaacataccacaatggtcaatgaaagcccacggagtgtggagaaagtgttgatggaggttgaaagagaaaaatgaacttgtagggagtatttaattttgtacaaaattaaattgtaggggtgtaggggtatttagattttcctctctcttttttccatttttcattcaggcatactcaacaaaaccatgaagctagtgctaatcaattcaacacaccatcgaactcatatctttctctactctctagtgaaagagatttcttccatcaaatgaaagcatctccaacattgaaactcgaatttccatatacttttctgattatcaacacaccatcgaagttgcgtttagccgtcgtagtagtttcctagctgaagtttttgttttgctttttttttgtccttcccctacataggcatacctggccgattgtattgtataagaaaaactcttttttcttctattgacgtgcaattcatttatgcgttcatgaaaaaagattattaattctgatcacttctgattaactaactgaatcaccactctaatccatactactgaataatcttatctatctcctgttgatgtcagctgaaatgcatggaatcggatcctaccctgacattcaccatcgatcccaacaacatcccagagccacagatttcagggccacaggaagacgaggaagaagacgacgacgaagaagacgagccgttctacccaaccaaggcgaacgctgctcagagcaaggccgcgggcggcggcggctgccggccgccgccgccgccgtccgcgtcgtcgtcgcgacctaggagaggaggacgccgggtggctagaggcgacaaggaagaggatcaggaggccgccgccaacatcctcgccttcgccgccgccgcggcgcggtcggtgccggccgcctccgccgccgaccccaacagctaccggcggcgcgctaggaagggcgcgcaccgcgcgccggagcggtcgccgttcttctgatgacgatggcggtggcggaggagatgctcgccgtcgtcgtcgtcgtcgtcgtcgttgcatgctggtggtggtggtagctgcatgcgaggtctgaatcacccgatttttattttaattttttttacagagaatgggaacttggttggttaaattttctgtggtgaaattcgcttgcatgcatgtatgctagctacattttgattaatggtgggtaagaatctagacattttgatgacatttatcctcgagaatttgaatttcccgtgtgactgtgctatgttatgtatatcttagagcggaattgtatttgttgcacaactctgtttttgtctctacattaaaagtacatgtgttccatattcatttgtagaaaccaaaaacactaaaccgttttggttgaagggggaatagtgttagtattttttttccccaaaatttgctaaatctattatgtagtaatataatggatagatacgatgatgtgatagttctgtctcgtggggataattcaaaatacttcttttttttaagataacggctctaggtatgttgtgcagtgtagtcaaatttcttgatttcctatatgcatataattttttttctgcttgattgcatgctatagacctatagtattagttgggcaaaagaaagaatctattcttcctaattaagcagctagctacaagccaccatctaccttttgtttcctaagaaaaaacaacacaagattgtgccttttattaaatactccctctggttctataataattgacgttttggataaggttgaggttaaacttttataactttgaccatcaataactttaaaaatatctaatttaaagaaactagaaaaacatatatagatttgtctttcaaaacactataataaaagtaaacatgcatttatttattgtatatattactagcaaaaatgcccgtgcgttgcaacgggtaaaattttttattgataatatatgtttttcatgcataatcatgtcaatgacaatgtttctattttaatgagcggctttttttataaacattgtttttttttcttgcgcgattttctcaatccatttttcagaaatggcgcatttctttataacaaatttttcctagcatgttttatttttgcttattttactgacaaagaaaaccatatttttctcccttttatgcttttcttttctcgtatgtttttttgcctattttctcgcacgttttttttcttgttattttcgaatgttcttttttacttttttttccaatacagtagaatgtatgacgaaataaagccatgtagtagatggcaaaaaattgatggatcctatccgactcaagtgtctatcaatttagcttttttctaacagttttttcagagcgatttattttttagtagacggtgtttttttcgcgcggttttttaaaaccaaacttttagaaatggcacgttttttctagcagttttttttcctcgcatgttgtttttaaaatatttttaccgatgatggaaataatttttctcgcgcatttttttattgaagatggaagacctttttagcgtgttttttacgctttttttctgacttttgcctcacgggttttttgaaccgtttttattttctcattcattttttctttttaaatagttcgattagattagagatagagaagagatatatactggttagaactcggattttgtttcaccctttccatttttttcttgtgtgtattttttattttatacgaaccatttttttcgccactttcttaggaaatcggacgaactttttttagatgttttttcatttttttttcgtttttaaaggaattgtatctagctttttttcaccactttttttttttgccttttctatgaatcaattttttttccattcggatctacagtttttttcgccacttaggggaaaaatacttttattcttgttgtttttctttattttctttttttaaggctttcctttttcttttttctttttttttgagaaacacagtacgtacgcaggcgctcacaacgtgcgcacactcacccctatgaacgcacacacgcacaccctaccgctatgagcacatctgaaagactgagcctttttctttttatgcacctttctgcctttgttatctctcttttattatttttttaataaaaatgacctcaagtaccttattgcaagatattagggactcaaatgtaaatataaaaattacagggactcaaatgcaaaaagtacaaacccaaaaattaaaatcatataaaaatggaatgatctcgacttgtaggtttcatttttgcaaacagatcttcaatccggcacatcaattttttcaccaatctagagtcgaactttttttttggtttatgagagggaatcggatataggagtcggactttttattttatttttttcgctaatcagcccaaacgaaaacggatgggagtttgtttcctatttttgtggaatcggacaaatttttttcttttaccgcgtcgatggaatttttttttgatcggataacttttggttttttttcccttttttctgatcggacttctggtttttttggttttttttgccctttttttttggatcggacttccttttttttgtccctttttttatggataactttggttttttttttgccttttttctggatcggacttctttttttcgcactttttttttgcccggtttttttatcggataaacctggttttttccatccgttttttttgttttttttcgcccttattttctggaccggacttcttttttttgtccggtttatttatcggacaaacctggttttttctgcccggttttcacccggtttttttgacggacgatggaggtacctcttattttttaagtagtagagataatagaaaaataaggtcaaagatatatcttgtagagcgtgtcattgtccaaagcgttaattaaaatgaaaccgaagggagtagagcagaagaaaagccaccttctacttagatacacactcttctatttgaaaatatacacaagcatttctagttatgtacctgtattttataacggagagaatagtagggcttgcttcatgccgaagaatttattgaattctagacgatgacacaattgatttggacagtgctaccaaattccctgggaggcacgtccgcacgtacgcatgcagtagcatatgcccacttgcccaggctgaaatatacaccagattaattatcagtatttgttcgctgtcacagtttgcaacacggaatattaggcgcataatattttattaggcaaaacgtttgattaagattgctgtaactatggtaaacacctttgattaagaggatgtttggttgatgcctaaccttgatataactaagtttagactagctgtggcatggtggaataagcgtggtttagaaataatttgtcacaagtacggtatgcttagctctaaatttgagaacatgacgtgtggattccaaagttaagaaagtgtggtataatatatacaattgcggcagcgaaacaaatacatgcctaaaaaattgtggcatggctaaagtttggcgtggcaaagtgtggcaaccaactaaacaacccctaagattgttgtaactatggtaaaccactcctcaatagttctgctttgtagtgatattttttccattaagaagtcaagcagttaagtttgtccctagataagctcggtaagtagcacttgtttgaccatgtttacttacttgaatatatagaaaggcagctatttcagtcagcaacgaaaaagatacgcatgatgttgcagcattactcgatcggtctccatcactaactgatatgatcatgactggatgaccggccaagtaatcaggttattaattaattacagtagctgtttaggttctgatcagccagctgaaactaaaaggtcaatttcctgcatgcatgatcggtaatcagtactgtacactatagtggattagtccaaaaggccggcgctctggatagaacttagtttgatcttttccaagataggagtaattctagctaaaagaaaaagatcttttccaggatgtgatttgtctgtagaactgtataacaagctgcatgcgaatgtactgtgtcggaggggcgacggcaacgaattgaaagctaggattacgaggaagtaggtacgaggaagaaacccaaaaaaaaaaaaaaatcgcgaacacggaacccagaataatctttcgtgtaggagcgttatttagagcttacccctccgtaaaaaaaaaagataaaatcatacctacaatcctacacacatgtgtgtccaagttcgatcgtaggtatgaatttgttttttttttacggagcagtagcttggataattcttttctccacgaacaagattcggattatattgtaggggattggaagaattagtttcgtgctaaagttggaacacccttgagtgacaacaagcacgctcaaggaaggtacatatggttctcttgacatttaaaacttcgagtctcttgataaatctattgagatatgaaattaagagaatggtatccttttcagagtatatatcttcctattatggaagattttaaggaggtacaactactctaaaaagatctaattccttttagcaattaagaccgtgaaacagaattagaactacctgacttgtactccctccgtttcaggttataaaacgttttgactttgatcaaagtcaaattgctttaagtataattaaatttatagaaaaaagtagtaacattttcaacccaagacaaatttactataaaaatatatttaattattgatttgatgaaactaatttagtattataaatattattatatttggctataaatttagtcaaatttgaaaca

SEQ ID NO: 66108 - DNA, 4468 bp, Oryza sativa
tgaaatggagagagtaatactgaaactaactaataaactaatagcttactcttaagaaaaaagctaatagtagttactctttcgtttaaaaatatagcaacctaataagacatacgtcttatgtcccaaataaatcaatcctatgaataaacatgaacacgcgatttattttgatagtacaaaggaagtatccatatatatgtaggtcagtgcagaaggttctaatgttgaaaacctaatttctaatttcgtccgggcttttcaaaattagcgaacggacgaggcaagaacgcggcagcgaacgcgacacggtagaacaagttccgagttccgacgcgacgcgccgttggcgcaggaaaagtccggtcaccccaccccactctctcgcttgggccgcccgcaacagcaaaccagcctagcgcccgcgctgacgcccgcagggctgcatcgccagtcgccacgcgggacggacagagtcactgccaggtgggcccccagtagaggcggggagcggccccgcgagctactggcaggtgggccccgccgttacttcactagaaggcgggttcgcattctgtgggaggggagcgtccgagcgtgtggtcgccgctgctgctgctgccgtcttcgtatgtttttttttttttttagccgcggaatcgtcagagctcaggcgctcacaccgtcacacctgacctgacacaaacgagtccacggcttttgtgttgacttgtctcacgtttttttgccttctggtcccttcacaagtgccattttgtggagccagacaccaaacaagaaggtcaaactgctggtgcttttctttcctcaattgcttctagaagcagtggggctgtcccgtacggctcagatatggctgccaagcaacgcgcatctgcgatatcgaatcagtgaaaattgtctacagtaatatagctacagtagtcgtggctgataggtagaaccggacccatatgttagcggcttctaccgcagctgcagtactgcataggatccatgtccgtatcgaacacatgatagtagtagctgtgacactgtagctaatacaggcagtcgagcagccgtgtagtagtgttggagtacattaactaatagcaagttaagaagatgttcatcttgttatcaaaattaatcctaccaagttttggtttctatccaaatttgacaaggtaacaatctaacattgataaattaatttatctccattaccaaattctggtaattttagaatcttcctctcacgcaaatttggcaatgataacaaaccaaacttaatttacacctttcaaccttaacaaatattaacaatgccaaaattcagcattaccaaaatttaaatttggtgcggttgatttagacatcaaagtgaagaaccctaagtgtatagtgctctatattaatagttacgtactttttccatctcaaaataactttttttagtctcgtttgtttaaaacaaggtaaaagaaaaaaaatcacatgtaaagtatattgaagataatctgatttgcagataagggtagatatgagataaatgtgaacatatttttaagaaaagttagagttcaaaaaacgaagttattttagagagtatggactagtaatccatcactaatcactcttaaaaaatatcgtctcgttccatgagcagggctattagtctcataacttacatctacatcatccagtcgactaaccacaatacttgaccaaaaaagtaaagaaaattattttctccataatttcccaagaatcaaggggcttaaacgaaacaaactcatcactttccccatttcgcactctatatatacaccatccatccattttcagtctacgcatccaacctccgaactagcaatagaaaattccaacattttcgccaacattaattcccatgggattgaagctttcttgcatcagccggcgacgcggctcgccggtgccggcgccggccagggtcatcgccgccgacggctcgctcaaggagctccatgcggccgcctctcccgccgtcgccgacgtgctccgcggcgagggcgagtccttcttcgtgtgcaactccgacacgctctacttcaacgagcagccgccggcgatggcgccgggggaggcgctccggccggggcagatatacttcgtgctcccggcggcgatgctcgggcagccgctgtccaccgccgacatggccgcgctggcggtgcgcgcgagcgccgcgctcgctgccgtcaaggcgccgcgccgccgaggggctcgccgcggcggcgacaggaagatgaagacggtgcgcgtcacgccgctgcgggacgagggcctcgacggcggcgacgtcctgctccacgagaagctcaacgagcggactctgggtgagttcccggcgtcgtggagcccgccgaagagcggcggcgagaagctcgccgcggcggcgcggtcgcggttgaagcgcgtgctgagcatcatccaagaggatgcataaatattcaattttttccacttcttttttggggaaacaattttttttcagaagctcgaagcccaatacatgcttaaagctttaattaatacttgctctgtttcagaatgtttcagaatgtttgacaccgttagactttttattacgtgtttgaccattcgtcttattaaaaaaatttaagtaattatttattcttttcatatcatttgattcattgttaaatatattttcatgtacatatatagttttacatattttacaaattattttgaataagacaaacggtcaaacatgtgctaaaaagtcaacggtgtcaaacattttgaaacggatggagtatgtttaattagtagatttagaaagaaaagaatactggggaaaaagattcatggatgaatcaccctcttgtatatacgacttcaatctgtagttgcaaaactacaaaaatgtaaaaaaaaagttgatctttgtacaatttttcctgatgtacatttcccagactctgattttctgctggttacatagaaagatggagaattaaggaattaattcaggctgtgtagaacagaagctacatggtgccagttagtgtcattttcctcgcgatcacagtcgaactttgtattatcctgacatcatttgcaataattgtgaaataagtgaaccccttgataatcgaaatgttcttaccaaatttccagtctgccttttactccaatccactccactcgttagacaattcccaacccagaaactattaattagttttcatatttgccatatcatatagatattatacatagaaactatatatatataatggatggtttcttaaaataaaattctcatccaatcatctcccttctctcttcttttatccacatattctcttgttttcattctttatacttgtgtagagatggtttcttgcataagaaatggtttcttcacctctttatctctctcattaaaatattatggggcggagggagtaactacctgttctaaaatatacgcaagcatttctagttatatgtttggacaagtgtattttgaaactgagagaatattatggcttgcttcatgccgaagaattgattgaattctagacgatgacaattgatttggacagtgctaccaaattccccacttgtcaggctgaaatatacactagattaattatcagtatgttttcgttgtcacagtatgcagcacggaatattaggcgtatcatattttattaggcaaacgtttgattaagattgctgtaactatggtaaacaaatttgattaagatttttgtaactatggtaaaccattcctcaatactcctactttgtagggacaatttttccattaagaagtcaagcagttaatttgtccctagataagctcgggaagtagcacttgtttgactgtgtacttgaatagaaaggcagctatttcagtcagcgacgaaaaagatacgcaggatgttgcagcattactcgatcggtctccatcactaactgatatgatcatgactgatcgaccggccggccaagtaatcaggttattgattagtactacagtactatactcactcacaacaaggtcaatttcctgcatgatcggtaatcagtactgtacactatagtggattagtccaaaaggccggcgctctggatagaacttagtttgatcttttccaagataggagtaattctagctaaaagaaaaagatattttacaagatgtgatttgtctgtagaactgtataacaagctgcatccgaatgtgtgtcggaggggcgaaggcaacgagttgaaagctactccctccgtcaaaaaccaacctctgagaagatatgatccctcctaatacaatgaatatggataaaaggcagattcgttgtactggaaggagatctctcctatgttggcttttttttggacggagggaataggaatataggcgatggagacgtaagtaggtaca

SEQ ID NO: 66109 - DNA, 2102 bp, Oryza sativa
tgggtgagttcccggcgtcgtggagcccgccgaagagcggcggcgagaagctcgccgcggcggcgcgttcgcggctgaagcgcgtgctgagcatcatccaagaggacgccgagtgaagatagatgaagattcagctttttgtcccccttctttttaggggaaacaattttttcgtattttttttcagaagcttagagcttaacacaagtttaaagctttaattaatttgttcaatactagactagatttagaagggaaaaaaatacccggggagaagagatccatgcatgatcaccccttgtaaatactacttcaatctgtagatacaatcatacaaacctacaagaatatataaaagttgattttgtatttttatgtacatttcccagctgctatagattgcagttaatggaaactttcaatctcctgacgcactgcaataatcgtgcaatcagtaaaacactgacgatcgaaatgctgctactaacttttcagtctacccaataagaaactcaaacttcaattccactgcaaaaaggggattaaacagggtaattaacacctactgacatgcttagcatattaatcctccaatcctatgcatattaacacctacggtcatctctcagttgcttctagtttgggatgcggtgcttcctacctagctcttatcgggcgttgaggatcgtttcgtttggtgttggacgagtgatcagtgttacttggcgcgctcagcataacaggcattcttctttggctagcactcatttgcctgtgccaacctgctctggcacgcgaaaggccatgccaaatgcaaattctttcttcggtttgcatatcagcagcgttgctggacagctgatctttttcaaaagcgtggtattgatagccactatgtctgtcccttttgcgctcaggagtttgagacggcgaaccacattctcctcgactgtgtgttcccttgacagacctaacaccatgttttgtcacctgagggctggactgccctcctctccggtggcaatttgcttaaggactggtggtcgtctggtaggacttgcttacctaagcatcttcgcgcatgcttcgactccctagtcctactgatctcttggcagctgtggaagtaacgaaactctagggttttcgactcggccctttcctcggtttctgtgtttatagagtctatccactcggaaggttgtctgtggttttccgcaggcattacagcttttgagggtttgctaggagtgtagtgtggctccgtcctacctctcgtttgtttggagtagcctttgtttcgcaatagttttttcctttccttttaccttttggtttttttctttcttcacccccaacataggcctgtgtggccaattgcgttgtgtaacaaaaactctttttattctaacatattgatgtataactattttgcgcgttcgaaaaaaaaatcctccaatccagcccttaaaatcctaaaccaaatatagcctaaggtactaggaaaaatgtaagcaatttactcatgttgcagttataaattaactggctcggactcatttacaatgggcaaattgaacaggtttttattttctttttgcaataattttgcaatttagtcatttacacacacaattttcatgatttactgcataatatgatactatgatcatgcagtaaataatgaccttaaatattatcaaatgtagtagatactccaaccatcaagatttaaatccaggtacacataatattaagcacacccggttatgctattaataggaatttagcgaggtcatgaatttgacattagcttctgtctctttgcgcaagtgttagaatacgtttttgcagatgtgggtgaaaataacacagtattttaccaggttaccacctcatgagaatctccagtataacgataggtccatcagtttgataaggacagtttggtctcaactcccttttaattttattatccttgcattttttacattctccagggaagaaaaatgcactagaagattatattctactccttttcagatgccgtatgcatcggtgctctctatttcccgacgagataagtaaaagaatcggtcaaa

SEQ ID NO: 66110 - DNA, 1418 bp, Oryza sativa
ctaattccaaatgtgcatcgaggtaggtcgacgacatggatgatcctgtggagaaaaatagtggcactgatcagcttctgaaccttaactaattcagtttgtctcctcttttgtcctctgtagattgcatgattaaaactaagcaggtagcaaatgagtgaaaatagagagacggacaaaaggagagtatgaaagcttggattggtggtgtttggttggtgatcttctcaacttatcagcatttttctgcacccaacactctgaaataggaaatggttgcatgactgaccactgacattttttttaatataagaaggtagagcctatctaatagtcatttcattgaaagaaatgataagttataaagtttcatgaataaggggaaaatgattaaaggaagaggaaaggataaagagaaaaggagatagacttaccactgactcgggagaatactggaaaaattcagcatcaagtgtgggaataaacaagcatacgcgcttgtgtacctgcaatcagagactcgtaattagagccagctgcaaatatattttaaggagataaatcaggagagagaaaagtagcgggctacagatttgtagctagctgtagcacggactccaagtcgcagtatgtctatgacaggtgggactatatattaatagtgtggtatgtaactattatataaatgagctattagattggctctagatgaattggagctagtagttagctatactattgaacttgctcttagccaattggtcagtgtgtcatgtagttaattaatctagattaagatgtagcttgttcataattaagatgagagatactctaaaatcaagtgttctcaggtacaaagagtaggaccatcagactgaccaaaacttgtgaagacatgcctgcatcaattagcaaaagttctttaaaaatttcagttaggactgatgctgtctgaaaatctgtatacacacgaaagattagaagattaatctgtatgcacacatcatggatacgtacgcgtgatccgtcgacttacctgtcgaagcaaacgtgatagtcttgcttcttgaattgaaaagcatgattttacacaaagttgattatacaagttgatcagatacaagttgattagataagccatgggagtagtagttaagcactgttggtatggaaatggaattagcatgctctaagtcactttgcccaagttgcccaacaaccaacggggtgtgaaatgagaagtgacccattgttgaaatgaatccaaatgttagacaatgcaaaaggtgttataagatacaggattttcttcttgtttttttccctttgatttcagggaagacgaatgcacatgcacacacattataacgtaaataggccacacgcctatggacataagtatgattctaaactatgtt

SEQ ID NO: 66111 - DNA, 8468 bp, Oryza sativa
ccaacacgtataatatgaaaccataacggacgaagtcatacagacatgaattcacaatcaaatttattttctcaagataaaatgattttctaattgcatgggttgtcattaatgagtccaaattaataaatgcctaggtatggggtatggctatttcctctgcattaagtcatctcctttcctttttttttctttcaaaggcgtaaaattaaaactatcagcatattagttctctgccctacgaaattattagtactgccaaaatcagggtaaactatggcactactaaagaattggtaaggtaaagttatctaatgtatgtttggattgtgaccaatataaagccaaatttaatattgtggtgaataaacttctagaatgaaccaaataaaatatgggcactacgaattggttgacctcaaccaaaactagcacatttagtattaaagttataaaaaaattggtaacgcacatttaccatgtctatacgcctatagacatatagaggtttagccacaccaattcttactagaaaaagtgatttagctacaataaggttttttaatccagatgtgtcaattaataaagaaaaaaatatcctcaatgaaaattcatcagtgccctatcagtcccggcaaatccttaattaattaattatgcatcatctattttgttttgaataatggaaagacacccggtccaaccctttgcttttgccactctataaatacatcttcttcatccttaatccacctgcaaaataaaaaattcagactcaactctccttaatctcatcaaaaacacacacaaaagcacacgaaaatttcaatgggatcgaagctttcgtgcatctaccggccggagagtgacatcgtcgtcgagtcggaagctccggcgccgccgccgccgccggcgagggtgatcgcggccgacggctcgctgagggagctgccggcctctccctgcgtcgcggtggtctccgacgtgctcggcggcggcgacgacgcggcgtccttcttcgtgtgcaactccgacgcgctctacttcgacgaccgcccgccggcgctgtcccccggcgagccgctccggccgggggagctctacttcgtgctgcccagggcgatgctcggccggccgctgtccagcgccgacatgggcaggctcgccgtccgcgcgagcctggcgctcgtcggcgagaggccacagcggcggcggcgacaccggcaaggcggcggcaagaagcagaagaagaaggtgcacgtcatgccggcgcaagcgcaaagcagagacgacggcgacggcgacgtcgacggcgtgttcaacgagaagctgaacgagcagacgctcggcgtgttcgccgtgttcctgagtccggcgagaggcgccgcgccggcggcggcggcggcggcgaggtctccgctgaagagggcgttgagcttagtagaagaggaggcatagtagtgaggcagtaggaagtagtagtaggaatccgtttcttgttttgcgcaaagtagaatgaaccagtatatcatcctcaagtttggttgtactcacaaacaaaaaaaaaagagaggaagaaacaggacgaattttgaagtaaactaggccttgtttagttccaaactttttctttaaactttcaatttttctatcacattaaaactttactacacacataaatttttaacttttccatcacatcgtttcaatttcaaccaaacttctaattttgacgtgaactaaacagacccaaagatgaatgaattccttagctcaaaggaaatcctctctccgtttgcatatacttgacactgaagtacgattcatctcgaatcactcatgatttttaggggatcataagtcctcaaaatgatgatatattatcaagcatgttgcatcttaggcttgttccatacttggcttgcatcataggcttgttcaaacctttctcctgcgcacataaaacaacaaaacatgataactcattagcacataattaattaattattagctaaaaaagttaaacaatgaattaatatgatttttcaaagcaattttcctctatatttttatttttattaaaagaagtagagtttttcagtttaggaaggcgcatgtgcgtgaaaaatagtacggagtagtagattagaagttagaaaagcttagctgaaaacacacccttaaccgtgaaagtttctcctatagtagtctaaccatttaaggactattaaggctcaacgttaaaatgacgaaagtcaacattgcaacgcaaatgtaaacggaagcggtttggaacaaactttgtaaggccttgtagtttgatgaaacccatatcccggcccatctcgggagtattatttgggaagagattaagctaagtaagcatgtggttcaatcaacaataaccagagttagttagctgaatcttggtgggggaatcatttagtctaacccgctaaatcaccctatcaagtgttcttttcccctgattgtgctatcttaaaatgcattgctttcgattatacaacatcacggagatattaaaaaaaaaacaaattcaacccacacgctgaggtataaaggaatcaaattcagcagatgaacaataatggtactattcatatctagatttgtctttctcttttttcccaatgcatagtcactatactatacattatcattttttaaaatatttgtataagtatttatattaaacttttaaaaaaacaaaatatacacgagtgaaaattccctcaagagatttgaatccattccgtaaattcaaacgaaagaatcaaagaagtactagtactagtctcaaaaataatctaatcctaactacagatctggatatatgcgtatgcaggttcgtagatagggcgtgtgcaggttcgtagataggatttgtttttagacggagtagtaggtcggcttgtaaattgtaagccttgtttggtataaaagcccacgcactggcccatctctagagaacagggatgagcaattcgatggtataggcaatcatatttgtccccaaatttgcgaaaacttatacagaatcagtcaaaaccacctataatgactcaaaacttatacaattcgatcgtactccttctcagtcaagcatgtcaagttgtcgctgctgctcgaggacagtttttattcgcaccatcaattgcaacacaaatactattttcagctacaaattcaaaactcaatttgaaaaattccgatcttttcgcatcgatttgaatcgaatttgccaccgatttggttcgttttgctacctcccaatcagcgacgacccggagttgccgtgatccgaggggttccagtccaccgtggagccgtacaccgccgcgagcgagacgaacacctcgtccatggccggccgcgcggcgggctgcctcgccacgcaccgcgccgccagcgacgccacggccatggccaggtcgagcgggtagtcgccgccaagccgcgggtccatgaacgcgcgcacgttgctccccgcgtcctcgccgccgccgtcgacgagcgcctccgccgcggactcccacagcagcagcgcctcgccgttctcgccgtcgccggaggacgccgcctccttgccggagaggagctcgaggaggacgacgccgaaggcgaacacgtcgagcttgggcgtgatgaggccgtgctcgaggtactccggggagaggtagccctgggtgcccacgacgtggcgcgtcagctgcgcggcggcggcggcggcgccgtcgcccgcggggagcgcgcgggctagcccgaagctggacatcttgccgtggaggtcggcgtcgaggaggatgttgctgctcttgatgttcttgtgcacacatggcgggttggtgtagtggtggaggtagttgagcccgtcggcgacgtcgaacgccacctgcacgcgctgcctccaccccaggcgccggtggcggcgtcgccgccgtggagccagtcgctgagcgcgccgttctcggcgtactcgaagacgaggtaggtgtcgccgcggtggacgcagaggccggagaggcggatcaggctgcagtggttcacgcgcttcaggatgccgacctcgccgctcacgtcgccggaaacacgcttcaccgccgccgcatcgccgttgaacacgccgcggtacacggcggtgccgggcaccctccgctcctccgagaaccccgccgtggccttctccagctccgagtacttgtacaccgttagcgactccaacgcctcgcgcacttcgctcgccatcagcgacctcgccgcggacagcgacgacatcgaggttgccgtcgtcgtctgcttccccgatgccagggcgccgtactccgccgaagaggacagtcgccgaccaccttccccggacgaacactttcttccccaacgccgcgtcgccgccggagacagaagaacagcaagccaaagacacccgccaacgcaagaacgccgcaaccgacgcctaccccaacggcgactcccttcccgctgcccgacccaccaggcggcggctgcgcccgcggcggcgcgggcgcggggggcggcggcgcctgggccggcggcgcgagcatgtccggcgtgggcgcgttcttgagcgggaccagcagcgtggtgaaggggtatatgatggagctctcggtgagcgtgttggcgtcgagcacctcctgcgcgtcgacgcggaaccgcgcggcgatggcggagacggtgtcgccccaggtgacgaggtaggtgaccatgtgcttgacgcccgcggcggcctgcggcggcgaggggcaggcgcagcggagcgggacggtgaggttgtcgccggcgacgaggccgcggctgtcgtggaggggattctgcgcgatgagagcctggcacgtcgagaggccctggtaggtgaggttggcgatgatgaagtaggtctcgacgccggtgtcgcggatggtgtgggaggcgttgtgctggtagtagccgcccggggagcagccgcacggcacgggcgcgagcacgaggcggtcggcggcgacgggggcgaccgggtcgacggcgttggagtcggcgacggcggcggcggcgacgttgaggaggtaggagatggagacagcggaggcgtagaggggcggggaggagcggaacaccaggtacgcgtcgcagggcgccgcggcggcggcggaggcggaggtggcgttgcaggtgtagccgagggtggagctcgcgttggtggcgtagcaggcgttctgctggttcgcctcgtactcctgctgcgccctcgccgcgacggcgaggaggagggcgacgacgacgagcgagagcccggcgccgccgcggcggattcggcgtggagtttccgccatcggcgaggtcgggggcggattggtctccgtctccgtctccggcgaggccttgtaattaagtggttgttggctgctgtcctccgctggtttagctggagacaagttgggtcaacggtgacgagtcaaactagtggcacatttttctatgtggggatgcagcgacggatctttgataaacttttcataaattttaccacgcggagtactcctattagtcatgaaatcgatgagtacttgcctaaacgtgtcgcatccggtacgtcgtgagctagtaataaccggcatagttttagaagttgatttaaaggattttttttgtctttctttttaattctcatttaggtaagaataaaagtacataaatgataaatcatacccccactatcacaaaatgtaactatatttttagatagtgctaaattagacattttaaaattaactattaataacaaaaaaaatataaaaaagattgatcaggtaaaaagtatctttatccttatccttacacaaggatggttcatcaaagtagtatctcgaaaatcgtgtaaaagttttaaaaggccatattttaggacataggaattgtatatttcaaattattttctgttttttaaattacgcgtcgtcaggtcattattagccgagtagtaaaacttgtttggaaataaacccgtggaactttatcactgtgggttccatttgtcactgcaacttcgcaaagcaacacaagaccaaatgggcgagcccatagtacatgggaaatggtcaaagaaccgaagggctagcgagtagtacgggggaaatggtcaacacaaagaccgtcccgttatcagtgggacacgcagcaacacggggatgatgggtttccacaggccactccagtccagtcacgtcgtgtgtgtttagttcacgctaaaattaaaggtttgattaaaattgaaacgatgtgatagaaaagttcgaagtttatgtgtgtagaaaagttttagtgtgatagaaaagttaaaagttgaaagaggaaatttggaactaaactcggtcatcgcccattttttccgagcgaattcaggttgcttcacgggacgcgcaagcgcaaccgcggaccatgctggattcgttcctttgtctgactgttagacttaaatgaagatggttgctaatattctctctatcctgaaatataataaattttaaagagatatgatacgtactataaatctaaacacattttagtaatatgaatttaaacacataccataaatctagacacatcctaatagtatgtatatgtcacattcctctaaaatttcttgggtgtgttttgctgcactccttgagctgcggtgcagctatctttcacagtaatgtgtgtcagcgtaacagttgtatggctgcattgcaatgactacaatcgtgcacccgaacgggacccttatattttgaaagatgaagtatgttagtccgaggacaattcgtccacgttttagtcatcacgtcgggtggaacattatgggccagcatatttgcaaactaaaaataatttatggataaaatttttatgtatgtgttcttagcgagctaaaagcaaaaactgaaaaataaacttcgatgaaaaaaccctcaaaatcaactctaattttaaaattaaaaatttaaattttagcagataagtataagtataagcgaaaagataagtaatagattagtgaagttcctttcagtcacagcaaatatgttagtgaagtgctaatcggtcaaccaagcactcgagcatactttggggctggtctagctcacgaacgttcgagatgagcggatttcacgaacggttttcatggcataacaatctcttcctgcctaattacgtgattagtatttgtttcttctgttaataaccaaatccatgccgccactatttgtacttacgagatttgtttgattggattatatttttttcgggaaaatatccggtgtggcatgatcatcattttttatttatattaagattaaagtgtacgggcagcccttaaacttataagggtgtatcatttaggtccctaaactttcaaaatgtatatccaaatcccagaacttgttatagtgtgtcatatgggtcctaaatcgccagaaccacttcaggatcctatgcggcgttgatgtggcatgccacacggacatgacgtgggattattttgactgacaaataggatccatttaatttttttattttttcttttttcttctcttttttccctttattatctttttctttgtgaccttgagcagaagaaaggaaaaaaagaagaataagaagaaaacgaaaaagaaaaagaaaaagaaagaagaaaaaaaaagaaaagaacacgtcacatccatgtggcatgccatatcagcgccacatagtatcctagaggggatgtgtcgatttgggacctagatgatacactttgacaagttctgggacctggatatacattttgagagtttagagatttatatgacacaactctacaagattaaggatcgccaatgcactttactcttatattaaagttaatacactaaattatctaataattgcaaatataaattctatagaaagtttatatacataaagtctacatagaaacttttttatatataaaatttatatattgaaagtttttatatataaagtctacataaaaattttatatatgcaaagtctatatattgggcttcatatatataaagttcatatatgtagaaagtcccaaaaaaattcatattaaaaagttccgttaataaaactagaaagagactaacaaaaaaacaaatatgaaaaaaaagtgaaagaaacaaaaaaatgttgatacgtatataggaggatcacgtgaaaagagaaaaacggaaaattgggaacagaacaatacagcttcctcgcgcatcctctactcctcgtggcgcgtcctctagtcctcttcgtccatatccattcacaagattcctgctgagcgaatgttcgctcactagtctttccgtacttatttgtgtccattcatttatctctgtttctgataaagttattggagatgtcgccatcgtcaaagtatacgaaattgatccgtggtgacctgg

SEQ ID NO: 66112 - DNA, 797 bp, Oryza sativa
cccccttgccgccctccgcgaccccccttctgtgctgcgggggggccgcctgcaaatgggcggcgagggggcatggaattttgcaggcggcccccttgctgccctgggggagggcgatttttgcctctccccctataaagcccagtccctcctctgtgaaatttcattatattcactaaaaatccaaaaaaaacaaaagagagagaggggaaggcagcagaaggggagcggcgaagccctgctggttcgctcaattcatcacaggtatgctcccatacatcttttgtgcatttgtactaatatgttatgtttgagtatatatgttgcgttttagttttagttccatatattttagcacatctgtagcacacagcacatatgtgtagatccagagcatagaatataatagtatgaattgagacatagacagtagtgttaattgtaagatgtagtttagtttgatctggagaatgtaacgtaattttagaaatttagagaacaatattgtagagaatgtaacttagggcgtagtacagaaatgcgaggttaacgcagttattgttttcatcaggcacaatgtcaagtaaggtcacatttcagatagttcacggtgaaggaaatattagatttggtccagatggtgttgatctgtcagattttgtaatgacatctaagggcatcgataggcctgcggagagaacatttcagtcaatttatagttggttgttgagaggatttagaatagaccaagaagtctacacaatgtcagtgtcagttgtagtgagtcgtgcaacaga

SEQ ID NO: 66113 - DNA, 8823 bp, Oryza sativa
attggcttagcctggctaatccacagtggctgaggtagggcatgagctgagcatcgagcaaaatatttgtcgctttaatatttccatgaacaactggaggagagcacgtcgaatgcatgaatctgcataagcttcaaaatttcaggaaagcttccagtatatgtctaaaaattgacatcagttcagcagaacaatttacagaaagccattaacactatgaggatgtgtataccctgcagtacaaaacaaacagctagatgatttggtaggaatctaagtccacaaaaatgtacttactccaaagcataggcaactccaagagcaatcttcatccgagctttccatgacaaagccctggaccttgtggctgctgaaaacaaaatatcatcaagagagccattttctgcatattcatatagaagtgcacagtgcccaaactcgacacagtagcccacaagcgcagagatattggggtgcttcaaattggacattttcccaagcatgtctatgagctcatcttgttccgataatgacagatctaccatgttgatcttcttgatagccaggagctgcatgtacgaggataaatacatgttatacatataaaacacagatgtaaaataatctgtagaaaaaatatgcgcctttactatttagcaaatgataaatttgataaatcacatatttttttctaatattgatttcgggaagttgcaatgagactaggaattgcatcctcctcgtgcattgaattttaaagcttatcgagagatcaagagaaaaaaaatgtcaacgatgcaagacaagttttattgccgataagaaaaggaaaacggccagttgatgaacaaaaagtagtagtaaataaacttaatacaccaactaaaggaaaattcagtattaggacactgaaacacgtagtagaaattagattcgagagcttgttctaaagtaacaaaccaatagtattttccaacagggtactaacaatatgatacctggccaccaggaaaatcacctctgtaaacttggccagtgaaaccttcaccaataaagcattctttactgaagttcctggtagctgctaagatgtcaacagcttgaaactgttttgcagttagaaagtttttggatgtcttggcccaaacttttgttttcatagctctttcaggcttaatgacgtcactagaggaagcctcacagtcattcataagagaattccaagagtacaagacctcatttgctttagggactgtaaaatgatatgtatgaatttcagtgatatgaaagaatgtaagtctatccaataatgcaacatgcaggaatggagaacaagtatatatatacatgattggatattacatacagatcctaacataaggatgaatattaagtgatgaacaagaatatatagaatatgtctagccatcaactacaattgcataagccggttatgcttaaactaataaagttccagtgctacctttttccacattggcaggtggagatttggcattgttagcggtgctcttaggactgtatgtgcagcttttcagaaccaagccaacaatgaggagcacaaaagctgtaccagtaacagtagctattgcagcagctgtcactcgagagtgtgacttcctgtgctgattatggttgtacatagaagaatggcttaaggaaggcttcaaaggttcgggcttgtgtttcaaattttccttaactgctggtggaggtggggacataggtggtggaggtgaagatggaggtggatgtggagttggtggtgaatgagcactcctggtaaatgagggagatgcacgtttgaaacctggttgaaactggttcccatcaatcctggaatgttagattagccacttatttcaactagatatgaagtcaaggcaacatgtatgcataaatatcctacggaaagaaacgtgggttattaagcagaaccgaatacctcaactcaggaatggactcaaaagttcctggcacataaccactgaagctattgttttcaatgttgctgcaaccagttgataattgtcaggaaggatgagaataaacaaatatagagaaggataaaatacagttgaatttcttacagggatgataatggaaggtctgccaacaaaataacagatcctgtgaactcattatgctgtaaataactgtaaaaccaaaacaaaatgaaccttttatattctagcatatttttgtgcatgaaatcgttaagaacgcacatcattcttacaggtgatgaaggttcttcaatgagctaaacgacgttggcaagtcaccactgaaagagttgaatgataaatccctgaagttgaatacgaacaaaaatgaggtacagactacagtgggtgaaagatcgaattactcgaagatatatagctaaatttgcatggagaattatagtagaattgcaagaaggtccaaaggaactactctagcatcaaagtgtgtgcccatattaacaggtcaaatgagcttgagccttgaagattgttttttaagaaaccataaagcaaataaatgcaaaaatagaaacaaacagactgtaaaaacttatgtatcaaatgatccatgtgatttatgtgagtgcaacgaaacatgcatttttgtggggtggctaagaaaacatgcagttattcacaataatggagggggaaatctaggaaacacaaatgtatgcagttaagcatggctgaagcttctcttgtacatgcaaatattaaataatgtttgggctgcaagaattcgcatgtcgttgcaggctacagtgcaagaaataattcatttattcaagaggataaagaaattagaatctgggagcactacattgttcctaagctttccatgttgacaaaaacatcaccaattattccagagagcttattgtggctgaggttcctgcagcaaagattaattacaggccagttatttgattctgcaaccagagttcactatagaaaattaggaagtgctccaattgccaaaaatgcactcacagatatttcagagtgtgcaaccatggtagtgacggtggtatactcccctcaaactggttggctgcgaaatttctacaggagcacaacatatggcgattatgtcaaccatagttcatatttgatatttaacccagccaaaagggggataaccgaaatacaaagagaacatacaggtattccacacttgggggcaaattgcgcgggatttcaccagcaatgttattgaagctcacatccctacggtcgtcatgattcagcgaagcaaagaaattaaagactggactaagaacagcagaatcatgatatgctaacagattatcacaaactttctggtcaaaagctcacagtattttcagagagtaaaacttgagcagctccagaccaagccacccgccaactcctagcccactaatatttctgtgtacgagtgaaagaagagcaaaatattcaactcagttaataatccctgcaaagttgcaggtgaaactgatcaggaagttaagaataactgaagaattacaaagcgacaatggacgaatccctgcaaaggactccatgccatggccgttgttcaccaccgcggccacaggggtcaccgccctgagatgtccacccagaaagctgccatggagaatccaatgttcgatataattcccaaagccctaaagctgtagaacaaccagaaacaacagaaaattaaacataaggcagcgaagtcatacacaaacatgaagacggcatgacacgcaggaattgaacaaaggtaactacgatacggtcacaatagcatgcacactcttgttgtggcacacaatcacatacatcgatgtggacaggatcagatcagaaccaacacgaacactaataccaaatgggagcaagcatagatattcatcatgagactgtgcaaactactgcacacgcactgggcaaactcatgctcgcgcaatcaccgaatcacgagtacgcgtgcggcgtgcgcgcgatggctagctgcgccgtcaaaccagcacagacccagccctcgcaagcaagcgcgcgagctcggagtagaggcatcaaacggtaactgctcgatcgctacagattaggggttgagtagactcaccatcggaggggtcggtgaaccctgatacggggcgaacgcggcgcacagcaccgccgcggcgaggaggaggcgaggcagcgccgccgccgccattccgatgcctccgcggctcagcgcgccccctcccccccaaaatccagcgccgccgccgatcgccacgaaatccagaccaaatcgagcgatccgcgcacgaaatcgccgacgacgccaaccggaacgttctcgaactttcccaaaaccccccgcgctcgcgcgcttgctcccgacgccgccgctcccccagatccgcgcgcccccggccgtctcccgatcgggccgagcaatccgcccgcgaattggaggaacccaccggttgggggggaggatcgaatctccccgagcggccggccggagaagccacggggattcgcgaggagggtttagggtttttcaaaagtttgggaggattctcgctttgggagggaagaagcatggggtggggaggaggagagggcggtcacgtgaggggcgcgtgagaggccgttacggcggcgggaaatggaggagagaacgaggaactattttggggagcagcaaaattcttccggaatcaaaaacatctctatctgaataatttggtttctcgttcagatttcgaaaaacagaagttacaaaatctagaaaatcaacgaaaagtaaaaggcttgtttttcctcgtttagattctcacaatatgatgaattgccaccagctacttttagaatctaaaaatttcttccatcagaaaaaaaaatgaatctaaaaatttcctaaacgaattatgagaggtttgttataggaacttccggctgttacagaaacttcggctgtgttctgcccataagctttcaactcatcatcctccctcgtttatcgtgtgcatgttttttaaattgttaaacggtgtgtgttttataaaatgtttttataaaaaagttgtttttaaagatcatgttaatctaatttttttagttttgtatagctttttttttgcggggatagttttgtatagctagtacttaataaatcctaagttaacctattgtctcatgtatactttgtatcaaattatcaattgttgtttagtctaatatatgttataactaggataaagaaaatgtaattggagttcacatttgccatgtgcttgtgaaatttgtttatttaaggtgcttgcaaaatcatatttatcaatgtacgtcaaacattcgagccatgaatactagttgtgtccaaataaagggcagataattgatgtcatggcatggaaggttattggcggttttatgtcgcgacacattgtggatatgctgcactattaacagatgattatacgcttcgacatatagaaaaaggataaatataaaaccaatgatgccatgtgtttgtcttttctaattgaatattattggacaattaatgagaaaggcgtgtccgagatataagggtaaccacaatatttatttaccaacttgatagtaacgtgggtctcaatatccgacaatagttgttattagcaggtttcataatgtttagtgctgaagtggtaattaagatggggttcacatttaatgctacttgagaagattgttatgcatacacgagcaaatagtatattttaatggtttattgctagtagtaagcatactactcggttataactaccatctctaccacaatgtatcttaccaggtaagaagctagcattaattgcttattacccattttatcctcatattgtggttactctaacaacaccaaatggttttgtccaagaataaatctacagtgcgtggctttactatatatactttacctttaccaatctatatcatcatggtaactcaccttttatccaagctgctagggatatcaaaagcatcagcaaagatgcgatagggtgcataggtgttgattctaggattacgggtctgcttattttcactcggctatatatttatcgaagctaatggttatgaggttaaagtgacggcattagcgagacgcgacacgtggcaacgataatctgtatttagtaaaattgggtgtcggtatggattgtctttttgacaatattattatccggtgctttctttaaaggtggagtcatctaatattagaactttgcagtggagtgaaaaaaccatttctggattttctactttattcttaggggcaattgtattcttgcccctactttcatttgcaattgtgattttacccttactttttaaactttgtgattttgccctcactttttgacgttgaatggtctgtttgcccctggtttaaacgtctgttaggtggactcagattaaatgagtttaagaaaataagaaattgacttgcaaaatgtaaaaagacatctctatcccaaacctttcaacctaagccactgctgactcctccgtccccgattcctaaccctcgcgagcggtggcggcacacgcgggcaagcgagagcgaggagcgcgcggtcgtcgcggaggagcgcggggtgaagcaggctgggccggcgccaaatggcgatgtcaagctgagctagcccgtcgccgtccgccgtggtggtcactgggctcgtcggcatcggcctcggctatagtacccgaaccgctgcacagcagatgatcgagtacatacgtactgttgcatatgcgtagctagctaggctgccttgccaccattagcatggccgcgaggagctcgcctgaggcatgatggtgacaaggaggagaagaacagcaaggagaggaggagaggaacatttgagttttattgtcttttactttttcttctttgtcactccccctttagtttttatttttcttactgccttggactattggttggttcctaaactggacaggaccaacaaagctattctgttgttgaaagaaagagatgagagtagtgtttcttgtttgcatattcataaatcccttgactgttaaaatgattaaacatgcagggcaagttcatacgtcaggcattgaggcattgaattcatacctcagtccatagtgtttcttaattaataaatcccttgattttttttaaacatatgctggagaatcgcatttcttgtgtagttacaaagttggatttcgttgttaaaataattaagcatgcagggcaagttcatacctccgttttctactgtaatcgtgaaacacagccaaaacacaaagtcctcacaagccaaatctgcaagggcatagatgtccttttacctgtcagttaacaccattaaagtcctcctgacggaacaggggcatacctgagcttcagttcaaaatagtgagggtaaaatcacaaagttaaaaatacaagggtaaaatcacaattgcagttgtaaatagggacaagaacacaattacctcttattcttatgattgtatcgggtcgacatgctccacccaatggaggtaagtaaggaaagtaagctccctccagttataatgccctgcaaatttagcaacatattagtgctattgttaagatgtaccaaaaataaaatacaaccatttgtgggcaagagaaaacagataacattagcagagcaaaaaatggcatcccatttcactgcagtaaaaaaaaaaacagagagaaacggaatagcagaggctactacagggcaccgcacagtgcagcggccagcagtgcagtacaccactgcagagtgcagacgaaggcaagcgtggctgcaaccgcaagcagcaaaagcaaaaccccggaagcttcccccaaaatctctctctccctctccccactataaatcctcccctctcgtcgatcgccatggctcccatgctctcgatcgcctcccgctcgccctcgccggcgttgattgcacctcacgcctccgcccgcgccaccggtcttcgtgctccgttcgccggcaaccgcattgtggggtgggggtggggggatcaaaccaaatcaggtacggatcgtaatcgcgcatcgatctgtgtcgtcctgttcctgcgcgtccgctccggcgagcccacgcaggcgccgcgggatccccctgctgcggtaggcggcggcggctgctacgtccggctgccggcgccgccgcgagaccgggacgcggttttggtaagcacgatccatttctttctcccccgaattccgacccgctcgtttggttgattggtttcgattcggtcgtgcggcctcgggtcacgtacatttacttctactacgagcaagcctaataatacagccgacttgttggttataaggttctgtgtagcattctctcagcctacccatataatagttagctccttacaattaatacagggctcacatgtctctctcgtagagtttcttggttcctgtgtctaagccggctgtaagtttatagcccgcttctcctctctctcctctcttttctcctccacctcaatatttaaccggcttatagtctactattatacttgctctactacgaccatagcagtacaagcgtgcagttttggagtttattaaactttaaagttggagtagttgtactactatccgaaacgtaattagtaagcgcaagtcaattctactatcggacaagtaattacgtttcggttagtagttttttaatatatctctcgtttaatgcgagtagcggcttataagacaaagacatgtgtacaagcggcgataaataactataga

SEQ ID NO: 66114 - DNA, 4032 bp, Oryza sativa
tttaactttttttttgatcaaagggggttaaccctccatttccattaaaagaaatgtcacagtttacagcagaaaaaaaaaacagacttaatttaacatttgtctcagttcttcagcaattgaaagttgtttcgtctggagttgggataattttactagttttacaaaggattattctgtgggacttgaatatattaacttgcggttttgagtttgtgccgtgtgatgtcgattgaagtgtggattggtcctttctttcttgaatatgttgccatctgcttttgaaatgttggcactcttgacaaattgacaaagaaaatattaggcttgtttgctaatcatttcttattttcttgtagttgtatgtagtcgacggttccagaaaactgagtagctgacaggtgctgcctttttcttgttgcaggatttatttctcaaagactaccatttcagattactgaagttgggcgatctgcataactagcacggtgccacggtttttgagaagaagaacgagcaatggttcgacaggtacctggtttaagttctttctttcagctgtttgcctggacacttcattgcattgggtcgatgttctgggctgtcaagaactctgctgcctgaacaatgatgttttttttgtttatctagttagtttgcatgtgaaaatatcattagtttattcatatttatattgaatttttattagacatatttactgcatttctttagctttgctattacatttacttcatttgttgagcagatatgcataagctagattcttctatctaaaaatatgtataagctggacagcccccaaatacatagccttgagtagaaaacaatactatatctcaaaatataagattcatagtatcagctatgcctataccatacacatcaaattcactgtatcataaaaaacgagatttggagggagaggcgttcctccaacaattaaataagaaattgtgagcgtgttggggattgaacacgggattttggggttaaaaccacacatcccttgcgctgcattatcaagtgcatctcaaattcactgtatcatagtctacctgtaattgctgagcatttgcaaattagaaccttgaacataagtcaagtgttataattctttccttcagctgttggtattgttattgattttgttacctgaataacgatgcctttcattgtaactctccctttcctttttccagtatcacgtttgcttgttcactctacttctctgcttcatccctatcactgctttggcggaatccgatatcaagaatttatttgctctgaggaaagcaatcgctgttggaaaaggcttcctccacaactggtttgagctagaaactcctccatgcaactggtcaggtatatcatgcgtggggcttactgttgtggccatagacctgtcatctacgccactctacgtcgattttccatcacagatcattgcattccagtcactcgttcggctcaatgtaagcgggtgcgggttttccggtgagcttccagaagccatggtgaatctgcagcatctccagcacctagatttgagtgataatcagcttggtggccctctacctgcctcattatttgacttgaagatgctgaaagttatggtgcttgacaacaacatgttctctggacaactaagccctgccattgctcaccttcagcagctcaccgtgctatccatatccacgaattccttctctggaggcctccctccagagctaggcagtctgaagaacctggagtacctcgacattcacacaaatgcatttagtggatcaataccggcatctttcagtaatctatctcggctcttgtaccttgatgcaaacaataacaatctcaccggatcaatattcccgggaataagagcgttagtcaaccttgtcaagctcgatttatcgtcaaatggtttggtgggggcaatccccaaggagctttgtcaactgaaaaatctgcaaagtttaatcctatcagacaatgagttaactggaagcatcccagaagagattggtaatctgaagcagcttgaagtactcaatctcctcaaatgcaatctcatggacaccgtccctttgtcgatcggcaatctcgaaatcttggaagggctttatatatcattcaacagcttcagtggtgagcttccagcatctgttggtgagctacgcaatctgaggcagctgatggcgaagagtgcagggttcactgggagcataccgaaagaactcggcaattgcaagaagcttactactctagttctgtccggcaataacttcactggcactatacctgaagaacttgcagatttagttgccgttgtcttgtttgatgtggaaggaaacagactctcaggccacattcctgattggattcagaactggagtaatgtttcatctatatcgcttgcgcagaacatgttcgacggacctctaccgggtcttccattacatctggttagtttctctgcagaatccaaccggctgtcaggatctatccctgccaagatatgtcaaggcacctttctgcagatacttagattgaatgataacaatctgaccgggagtatcgatgagacatttaagggatgcaagaaccttactgagctaagcttgctagataaccatctccacggagagataccagaatacttagctttgctaccactggtgtcacttgatttgtcacataacaatttcacagggatgatccctgacaggttatgggaatcatcaaccatcttggacatctctctcagtgataaccagctaactggcatgatcacagagagcattggtaagctcttgagcttgcaatcgttgagcatcgacagaaactacttgcaaggacctctccctcgatcgatcggcgctctaaggaatctgacagcactgtctctcagtggcaacatgctatctgaggacattccaatacagctcttcaactgcagaaaccttgtcacattggacttgagctgtaacaatctgacagggcacatccccaaggccatatctcacttgacaaagctcaacaccttggtcctgtcccggaatcggctgtcaggcgctatcccttctgagctatgcgtggctttctcgcgcgagtcccattctgaattggagtacgtgcaacacattggattgattgatctgtcgcggaacagattgactggtcacatcccgagagcaatcaacaattgttctatactggtagagctacacctgcaagacaacttgttaagtggcactatacctgtggaacttgctgagctgagaaacataacaaccattgatctatcttccaatgcattggttggacctgtccttccatggcctgtaccattggcaagcctccaaggccttcttctgtctaacaacagactcagtggctccattccttctggcattggcaacattcttccccagatcacaatgctggacttatcgggtaacgcgcttaccggcactcttccattggatctactctgcaaagagagcctaaaccacctggatgtcagtgacaacaacatctctggacaaatcccattttcctgtcatgaggacaaagaatccccaatcccactgatcttcttcaatgcaagcagcaaccatttctcagggagcctggatgaatcgatctccaacttcacaaagctgacctatcttgatctccacaacaacagcctcactggaagattgccatcagcaatagcaagggtcacttctttgtactatcttgacctatcaagcaatgatttcagtggcaccatcccttgtggtatctgcggtatgtttggcctgaccttcgcaaacttctccggtaaccgcgacggtggcactttcaccttggcagattgtgctgctgaagaaggcggggtttgcgccgctaaccgtgtcgatcgaaagatgccggatcatccgttccatgtactggaagcaaccatttgttgcattgcaacggccattgtcattgtgctggtggtgatcctggtggtttatctgagacgac

SEQ ID NO: 66115 - DNA, 6811 bp, Oryza sativa
ccgcacgtcatccaccgcgacgtcaagtccagcaacgtcctcctaggcgagggcctccagccgcgggtgtccgacttcggcctcgcgcggatcatcagcgcgtgcgagacccacgtcagcaccgtcctcgccggcacgctcggctacatcccgccggagtacgcgctggcgatgcggtgcaccgccaagggcgacgtgtacagcttcggcgtcgtcatgctggagctgctcacggggcggccgccgacgtggtcgtcggcggaggtgacggcggagggtgacgacgagcgcggcggcggcgggagcctcgtcgggtgggtgcggtggatggcggcgcgcgggcgtggcggcgaggtgttcgacgcttgcctgccggtgtccggcgcggagcgggagcagatggcgcgggtgctcgacgtcgcccgcgactgcaccgccgacgagccgtggaggaggccgaccatggcggaggtggccaggagggtgggggcgatcgaggcgatggagtacgggcctctggtggtggcagtgtccagtggcgagccgccggcgatgccatgatcttgctgctgctatactgtatactgtagtgcatcatgctcctttttgtgaattaaggtgttttgatctcatcttatatgcggacacagagatgcagcagaaactcaattttttaacaagttcatacctcacaggcatttcatcaaacacctgttatgcgtgcaaccaacccgctcattataacctcatctttttttttaatgcttatccttataagttaatatttaaaattttcaaccttaaatttgaatttcattttaggttttttcatcgatgtttacatcagttgcacttgcagcacaaccaaacaatttggcggtgtttcatgcaaaacaaggtgataatattaattgagttttagttattacaaacttaaaaaatggattaatctaatattttagaacaactcttatatagaaagttttcgtacgaaacgcaccgtttagcagtttgaaaattgtgccacgagtatttaaattttcatccacttgttatagaataaactaacgggaccaaatgtaattccatccatcccacctgcggtttctcccatctacaagggctaaccttctgagcgcgctccatctctctctctcataacagacaactttcattatccagattggaaaccaagcccaacagcacaaacacaaagtcttaatactccgtacaagaacaagaacataacacgacttcattgggaataagcgaaacgacatatttgtaaacgaaaaataatttacgaataaaactttcatatatgtgatcttagcgatataaaagcaaagactgaaaaataaacttcgttgaaataacccaaaatcaaatctaaatttaaggttgaaaaattaaatttaggctgataaacataagcataagcgaaaatatgagaccgcacgaaccttctaccttctcttgacagtcttttatcatgctataatgcaccacatgtaccccttatgccaaaattagctctaaaattatatttagtgatttaaagtttgaatgccactgacaagccaacaagtaaactacagagcaaattaatatggtgcaatctgtcatcttccaatgttgacatcctcttgcttggctagtaaccacgttttagggcttggtccggagagcttaaaattatgggaagcagctagttggtagcttctgagaatctacaaaacttgggttttccaacttatgacttatagttcattttctaaattttacaattacaacttttcaaaatctaaaccaaaagctagactgcttggggagcttctgattatagaagaagctgcagcagcttgaaattgcctccaccttgacagctcggttctgctaaaagaccgctcctgcaatcgaaccaataaaaaaccggtgaacatgccagtttttccttgaaccagtggcgggtatttaagtatcgaaccggtttttatttttcctatggcattatgacaggatgaatttattatgttaccacatcacatttattttttttaatgttatgaccatgtaataataaatataatggtttatttatgcatattttcaccaatttgtgatggttatatattaaaaataatacaaattaaatgtaatattaataaataaaaaaccagcggtcgaaccgttgacccggtggttcgtccggtgaaccaatggctagagcggatcgaccctcggaccggtttttttactatgcctcaaacatgttcttagaaaccaaagaaacactacttgtatacaatgacaatccctcgattccgatgtatagctggacaataacgactctttttattcaccatggtttggaacgaaaactttggttcgaaccaaagcatctcggaatataattccgtttttttatgttccgaaatccgaatgggaccgaatcaccgcgagttctgacgcaactgataagtgataaccaaccaaccaaccaaccaaatgtttgaaccaaaatcgggaagcccggcaaaatcctcccaaattcggcaaattcccagacctcgtgccctacctcaaaatagcgagcgggaatcaaaaccacacctgaattctcaaaccacaacacacacacacaaacagttggtccatagccctatactcactgacatgtggaccccacttaaataaaccccacgagcccactgaagtactgaaccagacgcgtaggagtactctcaaacacaacccgcacgcccgtcgtcccgctcactgacatacgggccccacgaagctctagaaaaaaaatccctagccaccgacctccactccaccttccccacagccactgacaagctggccccacccaaaagcgaaattaatctcccccgagccgcaaggattctcctcgggaaggcaggggctttcaaatccgcgcctcccctctcctcctccgccggctgcttcccccccacgaaatttcgcccaaaattttccctctcgcgctcgcgctcgcttcgccgatcggggctcgagtcgaggccgccggggcgagcgcgttggggattcggagatctggggggaggggattagggtttgggagcgccaggtcggtccccgatggcggagggcagcagcggcggcggcgggaggcagcagcagcagggggttgcggagcggcggctgctccggtcgcggtacctcgccgtgaagaatctcatcagcggtagggggctcgccgtgggggtggggtttggtttggttttgggtgtgcgggggtgtgtgatttgagctgtttgtgctgtgtgttttgtccgccgcagatgagaaggatgacatggcgagggcgggctccgacacgttcgccgccatcatcacgcaggtggactgcctgcacgagctcggtatacgaaatcctccccccctttcgcctttgctaaaccgtgtgtttttctgcagtttgatgtggttatccttgccttggactcgctgtttccgatttgtattgcatttgagtcacagattagaaagacatcgtgatatttgaaccttatgcttaggctgttagtactagctgctgaagtggctgctggagcacttgttgcaggttcagaaaaaagaagaaggcatattagcaagttgttcatctgcattgtatgtgtagtgaatctcagcaggatctcaaaacattggttggtcttcagataactgatatagcattattgcgaactacttctggtttattctactgttgacattttacttcaaattgctactcgaacatcagagcatcagcatgattgcatttagtttcgttggttgttctcccatgctaatgttgatgtaattactcagttcctatcttctacaagaccaatgctttgtaatttgcctgcatgattgcatttcttggcaaaacttggtgtttattgccatgttaatattagaagttcagaactcactgtcgcattccaaaattagtactagtacttcgaatagctgcttatgatatattttactggtttggatcatttaagcataagtgctatatgaagtacacaaaatgatggcatccttctacaatgcagtgcagaggcctagggagcaaatagctgatgcagaaactctgttggacattgcaaacactttggtaacatccgttaggtctcagtcaagtgaaggaatcactccctctgatttcgtaacagccatgctgaagaaatttgggcaatcagggggccttgattctgaggctgcctcattgcgctggggggatgttgggctttctgtgtcccatgtcttcagggctgcacctggatgctgcactatgtaatgaagctctcttccgtctttatatatgcgcatcatttcttgctttctataattctatccgcctggcaaatgacttaaacaactcaaatctgaatctttacaggcttggacccatgaatacagaagtaaaacaacggaaggctgtggttgccaatagaaaacggactgcgaggccaacggaaaatgctcgtcctgaacaggtagccaactaggcaactagccatatgctattctatattacaaagggtatgatagataccaacaaaaccataatagccatctgtgcatttctttcatcatggtattcattttttccctccattagtctctgaggtagttaacaggtctggtgctattgttcatgccataacaggtctggtgctattgttcatgtcattagctggaacttaacatatctatcttactgattccattttgtaattgtattgcttacatgttcaaaaccatagaacgtttctttaaaggaacatctggaacagaaacatttatattccttgtccactatcaagtttcttgtccgtgcatctggcagactgatcttttttacggcaatttattttgtttatacctggatgcaatcactgggcttgtatactgttccatggcttactctgaatagcacattgatatgatgctaccttgtatgcagcttgctgaatctttggagggagtaaagacagacactgataggaatgtgtctgtcatatttgatatcctgaggaggaataaaagggcaaggctggagaacattgttttgaacaggcgttcttttgcccaaactgttgagaacgtttttgcactgtccttcctagttaaagatggcagggtggcaataaacatagatgacaacgggcatcatatagtctgtaagacccttttccgctgccctcatttgtttccttaaatgatatgacaagatgccgcttctttagtgacatgtctaagataattctattggtcctatgcagatcctagaaatgctcctgctgctagtgcgatagcctcaggagaagtctcctacagccattttgttttcagatttgatttcaaagactggaaggtatgttagtagttctttttgttgataaaccttcagatttttgactttgattaatcaacttcaactgtagaactgtacaaaattcaacttcaagatctgatatatagaattattcttaagttttaccaccccattttgggatactggttttctcaggagtgagtgccctttgtcttcatttatctgataccaatccattttgttgctgtacattaggcctaagctagagcttaagctaggaagaaaaatccttgtgttgatttttgttttggccagctcctctataaaatgacaatttttttcgcacgccttttctctttttatttacagttctgggcatcaactaatctacaattggccctcttttttgtcatccatttccagcttatgcaagaagtcgttccggacggggaagaactgatgccacacaggaaccccgagaacatcccctgcgccgaagatcatgaccaggctgatccaccggagctatgcgcgcaaagaacacctatcaggaagctcacccggaaccggggcctggtgatgcagcaggaccagatggtggtcgcggagacgcccgaggagaagcagccaacctccaagcggaggcgcctcttcagagaccaacaatcttgaagcgaaaccccccctgccctgctcgtcggctgctgtagtttttagcactttagcgtgtgcgcctacctgctctcgtgttgtatgtagagggagagatctattataagttataatagcccgctgtggttttgcctagtgtctgtacaacagtcgggcgacatagctcatctcgtgctagctcgtgtaacagcttagatgtaactaatgttcttcttttaactctattagaatttagatcaggcagcttcgatttttccaaagatcggtggaattgtactcttgtagtgtgacgaaagatcgctagaatttgctccttagaggaatgtagcaccagtggctgctgcaatccttccgaggttttacaaggagcaccagtggatacagcaatctttctggagtgctttgattgccaggtacgcaagttagccttgacccataattctgagctacgactaaaaagattatctaaccaacatggtaatagtttcacattgaggtagaaaaatgaaagtgaagacacattggggtagaaaaatgaaagtgaaaacacatcgaggtacgaggtagcagtttagcaacaggaagcgcagacagcagatcatccttgtttgggtagttccaacaatcaacgagactgctcactttgccagagaaacagtcacagtagcattaattttatgaaaagcatagtaatcatcaaccacagtaggctttaacatcgcaggagaaaagggataacataatcacataaccaggcgt

SEQ ID NO: 66116 - DNA, 3330 bp, Oryza sativa
agatgcatcaacactgatcttgcctgtggccgaagcgccaaagcttgctggagtggacatggcagggctaggcattggtggaggtgcaaagtgaccagtgggccttggtcccattgggggaggcatcgagctatccatcaacataggcttgccgagctccctctcaccgtgcgcaaagtggcacttatccccccatttgcatccctctgcagtgttatacttgttgcacaggcgagtcttaacagtgggtgttggtggcccatcaggaacagcatttcccattggcattcttcctggaggcggcgcaatagctggaccaccaagattggtcatctttgcaacagcttggtagccaccagggaagtggtggaggaagtggcaaccctcaccaaaggggcaaccagaggtactgcacaataagaatatcatgagtgcaagcaaaaagatgctgcaaataatgtcctaattgaagaactacaccaaaagatttcattgtaaatgcaactgatgtttacttggaagattctaatatgtgaactttaataggtcaacatctcataaacaatgattggaaatgatattaacaagtgaagaacaaatgttaagatgcagtatggactggaggagatttctggaaccaccaccacatttaaaaacaacatggcagtaaactacattctaaatgttgagcttgacaatgggtgctaataagagatgtagaccatatgcacaaattttggtaatgactcataacatcataagcttgatagaaaataatttcaggagcaactatttacggaagtatagattcaaaccatacagtagtaaaatttatccctgcatgtagcaaatgttaggataaatattatatgttacaaaggacataagtggcaggatttcaaaatgtgagttcagttgcagttcccaagtcatgtattcaatcttcttttctcaatttgagcagatgaagctgcatcatgatattactgacaggttgttcatctgacaaggagttacatatccttaattccttatactgttgcatctttcacaggttcaaagtgatttcgcgcaactgtgcgcattccaattttactccagtgagtgtttcttaagcttggattaggtacaacctgtatcacaatctttacttgattcatgtgttagcaacaatacaattcttttaggaaaaaaaacagaagcaaaattttaatgaaataaccatgcataataaatgttaccaggtggagttcattttaagttggattataacctgaaaaatttggtgcatggcttcgatttgcttcctacaccggtttgaaatgactccgattctgttgcatcaaattaattatgcgttccaagttaatagttgttgatttgctaatctttggtacacaagagaacattaatactccttttaactacttttacgttcctactgcaaaaacagtgcaaaaataccgcattaattgaagcagctactacactctttatcaactacccacagcttccctccaagtttttaaaacccataattaattcaaagtacgccttgaaatgaagaacacggagcaacgagaccaccagatctggtttaagcagaccaaccaatctgaaaaagaaaaacacatgccaactcggcgaatcttggaagaaaaactacaaaaacattagctcgcctttacgaaacgagagtcacatccgctcttagtctctctctctctctctctctttccaaacctacaaaccctagcagaataagcagcaaaagggcacgaatcggggaggctcctcgatctaactacgcagcgaggaaaccaaatctcgccgcggcgggagagagggggatgcgattcgggaagacgagagcaaaggtcgggcacgggaaaggggaggagagggttgcgactcacctcgcgcgcgcttcccgccggcgccgttcgcaccgtcgggcttgcccctcttgcggccgccgacttccatctctcggctcccccacacccgcgcccgcgctcgcgctcgcgcacgccgcctcggagctcggctagggtttccggctcgtcgcggcggcggcggcgggtagaaggcggaagggattgggtgggcgagaggaggtgagagatgtggagtttggaagagagtggtgtgatgtgttgggccgcgcgatgtggagtggagtggtgtggtgggctttgtgccttcgtggctggatcaaagcatcgccaactcactgttcttggaaaaagaatataaatgaactgcaccccaatcttgcaaattgaaataaaaatcattttctcggatttaaggtcccattcgtttccaatgaaattatttgagtgaataataagaagttagggcacaaataataaaaacatatattaatatgtgattagttaagttttagttattttaatattgcaatataaatttatttgatattttaaaataatttttatataaaagattttttttataaaacacacctttttacagtttaaaaaaattgctaacaaaaccggaacagaatattaccccctccgtatcctatgtatccaggttcattgctagaattgaattctttgtaggacagcagtaatcagatttattgttagaattatttttttttaggacagagtattaatcatcaatagaagtgaactgagcctgataacttcccagtgcaatcgaaaatcaatttctgggtttttttcttgacaacgttccacttattgccctatactgcataataattttgcaacaaaatgtcaaataacttaaaaaatactccacgttaaacacctttttattttgcaacaaaataatatcccacgtatggtcaattaacctcgtaaatcgaaaatctagggtttaagtctaatgaaagataacaatcggcctgtcgaaaagtctgatgggccaagcgtaacaaacggccctttaaaaatttaattgatgctttggttggggtgcaccaggcccgggcagcagtgcaacgactgggcgacgcgcgagggccccagtggctagccactgtggtgggccctccctcacaaaaaataaatttaacatcgaagtgggcacatggcccacatatcagatattaaactgataagaacagatactacacttgatcttagccaaaaggccgagaaaggtatgagttgctctcctgctctgggcctcctcttatacacgctcctccgccccgcctcgctcagaatccgcgaggtggtactaacattgagaacgaaaccgtatcagctcctccctctctcctgctgcgttgtttggttgggcccgcgtctcttggtgggccgcgcagaa

SEQ ID NO: 66117 - DNA, 2176 bp, Oryza sativa
agaggtacagggactaaatagtctagatttctatagtcattatgtaggaatgtgcttcattacaagagtttgatgcttttatgatttattttttaggatggcggcttttctgcagattttaagttagatttttagcttagtttgactttgtgaaatttaaacgtgcatcactctatatcttgctgttggatgtaagtctgtacctctttcctatccagggtattcgttttaggggtctctcgattccagagtgccagaaagtgctgccgacagcagttaaagatggggagcctttgcctgagggtctactttggcttcttttgaccggaaaggtttggcttcttttgtttaactgtttttcttgtaaacttggttttcctgttcttatttttgtcggcatttagctgctagtgtggactgataggtatttgtttgtttcaggtgccaaccaaagagcaagttgatgctctatcaaaggaattggctagtcgttcgagtgttccaggtctgcaattgtctcttctggtttattgcattattgtttgctcaattagtaaaaaaacctagatgagttttatgtcattatcttatttcccttttcttagaagataaaaaatatagtcacggatacatacagagattatggagtttttgttcctacgaagctttattctgcaagtaccataaacacaccaagtttcttgtataatgttcccccagatggttctttagttagtcaatttgaaaataaattgaagctactgcattatgaatttctgatagtaatctgagcttttaaggttaaactcttcaattgcctgaaaatatgaaatgttgttaacttaagcctatattcttaagtgtatttgatttattattatttttttttgctgggcaagtgtagttgaaatttgaaaggcaactgtagaaagttttttttttgggactgttccatgatgttctctattgacttcagttttcttaatcctgcctttgataatgatatagctcatttaagtattcatctgtgataagttgatttgagtttttgtatactcaatcattggaaaaatatgtctcagggctgcattacaaatttgtgcttctgtaaacatacggcatgttacccacttacctacttggcacttattcgattgacttatgatacggatgcaggtcatgtgtatgaggcaatcgatgctcttcctgtaactgctcatccgatgacccagtttaccacaggagtgatggcacttcaggtaaaccttgtagcatatatcactcatctgaaataaatacatattctgttgccacttatttgaaggtatatttattttggagatggtgcatgtaaaaaagacaatcatttaaaaaaaatccattgataaaaccctcttattttgctgtttgtaattctttctaggtctccacacttaattaatttgccttttctattttaattcttatttgcaggtggagagtgagtttcaaaaagcctatgacaaaggaatgtcaaaatcaaagtatgcttgggatttatactgcctccaaaattgcattagttgttgaatggattttccatgtactgacctggtgctattttaataggttctgggagcctacctatgaagattgcttaaatttgatagctcgccttccagcagtggcttcatatgtttaccggaggtagctttttatcaattcattcaccatctttacttaccaggcaatctgtaaaaattttcaactgcaatagcaataatgccgttttctggttctctgaaggatattcaagggagggaaaactatagcagctgataatgcactggattatgcagcaaatttttcacacatgcttgggtttgatgatcccaaaatgcttgagttgatgcgactatatataacaatccacacgtaattcattccatccttgttttagtttctatttatttctaaaagacttggtttgatttctttttcctttcacctgtgttcttccagtgatcatgaaggtggaaacgtcagtgctcatactggacatctggtaatttttgtatttctggtttcaatgcagtttttttcttgttagcattgccactattgttgtaaacctgccaatggatcatttctggctgctacatcatccttgtgcctttttacatatgttacacttttg

SEQ ID NO: 66118 - DNA, 1633 bp, Oryza sativa
tatgggcactgacctcttcattccgtgctcatgatattcaattacaggttggaagtgctctgtcagacccttatctttcttttgcagctgcactgaatggtttagctggaccgttgcacggcctggctaatcaggtatgctcagtttgttgtactggatcttctctgccacatcctgctaaacaaggattcactgcattgcatactcaaaatatgtcgcagattatctttggaagaaggaacataatgttccttccatttttaaattgatattttagtgtgtgtgtgtgaactaaccatagttcacatccaatgcaggaagtgttgttgtggatcaaatctgtaataggtgagactggtagtgacgttacaactgatcaactcaaagagtatgtgtggaagacactaaaaagtggaaaggtagcttatctccgtgttatatttctatttgatgaggaagtgcatatcatcatgttttaactgaaatgaaaactcaactttctgagagttcattgctaagcagtggttctaagtttgttatgttatattggatctgttttctttagctacttatattatacaaacaaatgatttctaatgatctggaataaacattctctttttgttgaactctaactgaaaaattcacagatagtatgccatgacacattcattcgtaggttgttcctggctttggtcatggagttctacgtaagaccgatccacggtatacatgtcagagggagtttgctttgaagtacttgcctgaggatccacttttccaactggttagtctaaattctagctgcatggctctcttcagtcccactgtctcaataggatttatatcgacctatcctctttcaggtctccaagttgtatgaagttgtgcctcctatcctcactgagcttggcaaggtaatgctactagattgatcaataattattgctcctttaattacggctccttcagtttacttccatctcattggctaagaaataagaacatccttcacattttcaggtcaaaaacccatggcctaatgttgatgctcacagcggagttctactgaaccactttggattatctgaagctcggtatgtttatctgtattggttaaacaatctaatgccatgtctaatttaatcttgaacttatgatagagtagcaaatctaactttagaacgagtacttaagaaaacttctctaactgcgcaggtattacactgttcttttcggagtttcaaggagcattggaataggatctcaggtatctctcactttccactttctacctcatttctttggatcttctctgcattttgtactacaatgcagaggatccttcttcattctatcaaccaattctttcacattatctgtgtcgcagctcatttgggaccgtgctcttggcctgccgctcgaaagaccgaagagtgtcaccatggagtggctggagaaccactgcaagaaggttgctgcttgaagctacacacgcctacacggctgcgtttttttttttttttttttactctttgagcatctttgatgctaataactgagcataaactcgaaagagttagccgcattttacccttttttcccccgggccaataaacaagaggaagatgct

SEQ ID NO: 66119 - DNA, 8197 bp, Oryza sativa
  unsure (1)..(8197): unsure at all n locations
atatcaagaagtcaatataagcctcgaaattcaatgtggttatctcaggaattttcgtggcgccctacctgaacacccactatgtcagataaagactgctctatagccttccgttccttttcaagttgtacttgtgcgttggcagacgcctctttgagcaaatcattggctgaaagaccatttgtgcaagaagattctgnntacaagncancancntanantntntnaanggtgnananaaganntnctttnntncnacananaantantatagncnacgnngntnantnntntnngncnannncnaattnnccaatttnttttttnttncttctcggcgcattacttnnatgcaccctgaagctgttacaacactcactaatcattgatatctgaacagttatgtgcacaccagcatatgttttgccaataatacaagtatacaacaatcaatgtgatggaatcacagaagcagtctaagtaagtgccaagcacatgtattagagagcagagctggtaccttcttccttgctgatgttgatagaagaatcagtctcgctggcacttatatcaacctgggactgtgcagaaatagctgcttgccctgcagctacagcaacatctgaaccaacaatggctgacaagaacgcaacctgggaaaacaatgctattagtcagtttgccgcatcaattgttacccatattcaaaaacctgctacataagaaaagcacatagcaactattgacttgaatataggattaactgtgatgttccagccgaagtgacattcttagataatagatgtcacgtctctcagttagaatttacaaatatagttttcttggcaactatggttgcaagcttgcacgttgcagtctttgttccaagtataagctacaagtgtatcgcataatcaagaagtcaagatataacaacaattaacttcaaatggataattactgatacagacctgggccatgattggattgctagcatcagccagtggcgtgaggcgtagtcgttttgagatatgtgatccagattcttcattgagatcacaatcattcccaaactgaattttgtcctccttgggtcccatgaactgttccccaaaaggtaatcgggtgaatctagcaatgcagtccttttctgatcgactaccaacatgatgagaaacctttttccagtcttccccataatgcaggacggcctcaagaaggtgaagagtttctttatctgtccaatctgattttgcgtcctcagtaatttcaattcgcttgaagtctgccgaagtaagacctggccggtaattggcacggacatagcatctagcacagaggcttatatctgcctggtcataagcagaatttaaggagtttagtagtgtttccaattaaaagatacaaggaattaatgagactttcaaaatacaccaggatgatatatgacgacagtatctcaactgacgtataaagtttgcgtgactagcaatgaacttcccagacttaaaagtgtcactaagttattataatcgtttgcaaatacttttcttaatggtaattggtaaaacacgactgcaaagagtatacttgttcaaaatgagttactggccacctccttaacaagcaatggacaaatgagctgtcgtgcacgcttttgtgagagactggcgcttgcatgctagatcaccgcagcaagcagcaaagttgtgcttgattgtccttggccacaagaaagaaggcaaagagataagttggttgctagtattatctaacatgctctgttaggcagtcaatccatatagttggaatttattgcctctggtaaactttgctaggaaggtgcctaagaaaataccaaacaaaataacaaaggttgcaagaacacggatacccagaactgcctttcacagggaacaagactattgttggtttcaagaacaactgctcagagccgcagatatccccttttctcaatacccaaaccacatcatggagtttcaacaaaacataggtaaagccaaatggactgttgttccggtaagaagggcaagctctgaactgaataagtgcaatctggaaatatttgcactcttactgtctaattgaaaccatgagttttacaaacctaaagacctcaatttgtgtagaaatttgcagcacacatgtttgattaccctctcaatttataatttcataagaaactaaacacaatagttaccaaaacaaagtatatatcagactatttgtcaacaactttgtctgctcatctgtcctgcccttcctacgggacatgccaaaactagctaaaccaaatcattgcagccgaaaacatctccacacccaccaaatatatttgtttacaaatgcgtaaactcataactgcaaaagaagagaccctttgttccattccataagaaactaaacatctgaatatttacaacactgcgcagtaggtgggaggcttggatgctcccaccacccaagttcaaatactcttaagcttaactttggtgtttctttcttttctactaattagataccaaggtttttgctgcttctttcttttctactaattagataccaagttctgccttggtatcctcttttttttttccattcgaaaaaatatttaccacttcccgtatcaacagccaagcgctgtcatagcttatcagaaataattcgtgaaaaacagctaagataattctacagtggtaaacgatgcatacacattgacaaacttgtaatacaactgtacacagcactgcataaataactcatccgcaaatcaaaacaagagcaaatcactcaccttctcacaagagaaataagcaagcccgcacacggtgcggcacccggtgcaaagcttactgggcattgttgccccaatcggcaaagaggactgcgataacgctgcctcctctttcttatctctcccctgcttcgctcccgacggcgaagctccatagtttatcagcccccattcctcaaggaagtcgaacacgcgacgcacggagccgacatctccgacgagcccacgcctggcctcggtgagcgtcagccgccgccccggccgcgcccggaacctcctcacgagggtgtcacggtagtacttgtaagcctccgggcccctggacccggacgccgccgccgcctccccttcgaagaactccggcatgaggcggcgctcggtctcgtggatggagtcgtaggagaaccacgctggcgaagagggaagctagggtttcaggtctcagttcagcctcgtcacaacaaggtgggggcgatggagggggttacctgaatagctcgggatggtgatggtgcagggcgactcctcggccgcggcggcggcggcggcggcggcaggggcgggggcggcggcggaggcggctgaggaagccgaggtggatggcggcggaggggcctccgtcttgacggtgcctgccgtcgaggggggctgggagaacggcgcccccgaggacggcggctgcggcggagcgagaggcatggagttcgccgtcgccgtagtcgccgccgccgccgcctcggccgccggcgctggcatcgacggcgtggccatgagagctcgagacagccgcgtctcgtgttcgtcttgggcttcacccgcagtggagcctatcaagccgcggcccaccaagaggattgggcccaaccgaccaacgcggcagagagcgggagggcggtttcgtggtctcggtttagtaccacctcgccgattctgagcgggaggaggcggggagcgggtataagaagacgaccgggggctgagataagattaatgtatgttctgatcttattcttgaataagttcagaacatactggaataagttcactttgagtccctcaactttatatcgagtttaatatcggatatgtgggccatgttcgcatggcctgcttctgtatccaaatatttttttatggggaaaggcccattagtggttctgccactagggcccttgcgcgttgccgaggtgttgcactgctgcccgggccggcgcaccccaaccaaaactcagttccaatgtttgtaattactagaaaattccaatgtttgtaattactagaaaaaatacggtgaagtttattttaatcttattgttattaagatgaaatttaacatggttaactgagtatatggtttagttaagatgaaatttaacgtgggatactatatagagagaattacactttggaccaatttttattaccttgcttacatattggaccgggtataggtaaatattttcacttagggctagattttgttaccaaattttgcatttgaggctattggtccacatgtcagtaaccaacacatcatcttcttcctgagcagtcttccaggctttattccgtgcatgtctccagtgagcttatttcgtcctcacacagacaagctcctcttccccaatctctagccacctcgaactgcactccgctacttgacaagcctgagcacataggctttgaactaccaaaaatttgaactcatggtttgatgtcaggagcatggagaaagagacggggctggagtttgaggcgatggagaatataagggattgacggagctcgagttaaaggtggtggagttggactgttggagctcgagctcaagcagcagaggaggtatagctcgagctttgaggcagaaaaagagttgaagctcgagttgggaataatggaggaggcaaagcttgatattggggagcatggagatcgaaacctgcgaggagaccttattctttctttttttccaagcatcagcaagaagagctttgtatgtatgggcatggcaaagcttgagctcgacctgccttgctctgactcagtggttcacagtggctcttggaggagagacgcaggagagagaagctagaggttgaaagtaaaataccccctccttccctaaatatttgacgccgttgatttttttaaatatgtttaaccgttcgtcttatccaaaaacttttgtggaatgtgtaaaactatatatatacataaaagtatatttaacaataaatcaaatgataggaaaataattaataattacttaaattttttgaataagacgaacggtcaaacatatttaaaaaagtcaatggcgtcaaacattttgggatagagggaatattttgcaaagatatctagcccaaagtaaaaaaatggatgtttaacccttgtccaacttgtaactttggtaaatgcaattcactcaatatatatatatttaaaaaaacatgagctgcagttaggtgtccgatcgtcttaagttaacatgcgagtttttttaaacatatttcttatatgattcctttggtattatcaaaagtgaacgatcttaaaactgactcaaatatggatatctatttccaaaagcaaacgaacgtaaaaaccgactcatatatggatgacgtaccaaaataccggtaaaaacattttagtttttataatagtagagataaagagtagcaataatgcccgtgctttgccatgggataaaaaagaattatagataaaagcgttgccatgtgtacttttctttaaaaactgaacaaaatgaaatctttgattgaactcagcaatgattatgcaagacaaatgataactatatgtatgtgttatctatggcaacatatcatatacacacaggtcctcacgtgtacacacgtgcacaccaactaaaaaatatcaccaaaaaatctagaaaaaatcatacacatactttcaattgtattacacctagggttaaaatcttaacgtcaaattcattatattttagccgtaacaaaaaaaacaaaaaatctaaccgttttaaggttgcaattttgtcagaattttatcttttttgttattctctatgtagaataaatttgaagatgcgactttgcacgtaaatgtaatactattgaaagtacatgtatgaattttcctagaattttttttgataatttttaattggtgtatacggtgtgtacacgcgagggcttgtgtgcataggatacgctcccgttatctataacatatcaaaagaaaacaattaacctccgtgtgctttcattatgtccatgaatgccaaattgtctagctaagattttgtaatttacaaaaggcatttaaatttaaattgacaaatagaatctggactccacctcaccactacccctccccccctcccccaaaaaaaaaatctacaggtcatctaaggctgagttgaactacaacttcaaacaattttctcgatttccttcagcacaactgctaagggcacctacaaaagtagagaccggtatgatctctacgttaattagatgctatcatgttacaatagttaagataatacggtctctaatcattaatgtaccaaaatactttcttactagttatcttttctttattagactcaatgcaacgaaaaatttcctaataaatgctaagagtcgactctatgccgttgtcatgcgtagcaaccatctttctatttccttcttcctctctcttccacgtcactaaatatgtttgcatgacaataaagagagaccgctaataaaaactattgtatatgccttaagggcagtcccaaccctccacctaggatggtgtctatggcattaactacattgccatgtaggacttttagcttatgtggcactatattaattaagagagagagtaaagagagaaagaaactgggtctcatgcaagacatagcttcaacatgagaacctatgcactagacactatcaagttttgtattgggagagaatagtgtcttcataatagatgaagaatgaatatgattggtagagaagagagatgatgtatttattaatggcccactttaagaaaccataggttgtagagtgtagtttctattgtgatgtggcaccatagacactgcttacggatactatgggttgggactaccctaaacggtggttttgtggacgagccaaccagttgctgctaagttgcaatttggagttgtcagcctaagaaccactccttgccaatggaaaggagacttgtctaccggtgcacaacgaattcataaaagggtcatcgtcgggaaagcctactaaattatgaacgctcaacctcaccaaaaataggatctgtatgaggaagaaaaataagatcacatggctcattttcaacttcacaaagtcatttttcatcaataagcagttatgactaactgaataaaaaaactaaagctccaagttatttatctagctcattttgtacctgagtttgttttagttcttttagctctattgttatagcataagaagagcagccctcaggattctatttacaatagaaagtattaaagaacagtgcattgtttcagcattttagattaactggcagtacctctttattctccacggctcctgatctttcatttagcaaaactatatgatatatttggttcggaaagcttcagaaatataacaattgttaagactgataagttggttcaacccggcaaatatttaacacaatgggtgctatgagaatctgagttgctgtccctatataaagttttatattacatcctaatgctctcacctagttctgcaaatactttaacctgcatgtaattggtaatcaaacagaaaacaatccaaggcaaaaaggaggataatctttgtaccatacaattttccagatcacaagttctacctatgaaaccaagaatattcagaaacaccatcgtatatcatactcctacatgaatgcagcttctgtttcgaacattacaagctccgctgaaattggctgttgttctgagtccagatgactgtgaaaagacacagaggattcaatacaaagagcaaagagcattttcatgaacaaccgtcaaccctctccaacgagctcctcatgcacatacaaattcaagacctcagcgtcgatggaagtaggcggcggcacctcgatcgcactgtggctccgtttgagaagaagattgcgtcggctcgcgtcagcggccgttgccgaggccgcgagaggagggcgatgcggttgcatgagggatctgtacttatggatacagctgcatgtattctctcagccaagtcaaactcagtatgtatgagagatgcgtgccaggctaggaggacatgagcaaccaaacacactctttctgattctcttgcgata

SEQ ID NO: 66120 - DNA, 1379 bp, Oryza sativa
atcggtgagtacggaattgtcttcaaattttataattggtaactgatatatcgtagtttagttacaatgtaattacatttcgattatactatagttatagttacaatgccctttttttagatattttatttttaggttcactaataaattaggtcaatggattgattgacttaggttgtatgaaacagataaagtggtttacaattatttgatatgtcatcagataattcaattgagatatcagaaattttttgaattggtttgttcgtttccttttgcagaaaatctgctaaagataaagataaagataaatattaattgtttcacgtaaaatgaggtagtaataacgtgtgattaattgagttttaattattacaaacttgaaaaatggattaatatgatattttagaacaactttcacatataaagttttcgcacaaatatcccgtttagcaatttgaaaagcatagccaccagtatatatttttgttggagaaaagaacatggtatatacttttgtcggctatgcattgcattgcattctgatttctgacatggagatgataattgcctggcttataaactgtcataactgatatgcacttcattagatcaaattctgtaagtatagttgatatgtcttttcatgcacactccaattgaacaaactgaattccctaatccacgagatgctaacaagtaaccacatatatatatgagacgtaagaaaaagtaaagaaaaactacgagatcccaacgttgtcagttgtcacgtcaggctcacgagaagctccggcttttattttctgacccttatgaaaactaaagcaaagccgtgaccgccggcatggagtccgccgtcgccggcaacgacggcgccgcgatctgggttcgaggcggccgcgtctcgtgctccaacaaggccgatgctgagagtagaggcccatctaatacattggcccacccagaaggcttcggcccaacatgccacggagcagagagcaagaacagcttcgtctcttcggtttagtaccacctcgcggattctgaggggagggaaggaggaggagcgggtataagaggagggcctgggtaacaatgcaactcatacctttctcggccttttggctaagatcaagtgtagtatctgttcttatcagtttaatatctgatatgtgggccatgtgcccacttcgatattaaatttattttttgtgggggagggcctatcacagtggcttgccactggggccctcgcgcgtcgcccaggcgttgcactgctgcccgggcctggcgcaccccaaccaaagcatcaattaaatttttaccatacaatccgaagctgcagtttcagtgaaagccttttgaagtatattgat

SEQ ID NO: 66121 - DNA, 7753 bp, Oryza sativa
tctcgtcaagttgtcagcaacctagctctctcccctcctctctagttactccggctttgtttcgttttgcagcaacttttaggaagatcagttgtcattgagatactttgttgactatgcaagtaatgcatgcagtgtattctgatttctggtaacttgactgctagacttacataataactagagaaaatagttttgatgcacactaattaactagagaaaaactactgggcaattgaacgtcccaaaccatgagatccttaccacgtatgtgacctaaattaaagtaaacaaagctaccatcaaatatattgtcaggatcatgacaaactccagctatcagtctaccaccaatatcgtcaagctttcccagcattcagtttccactcttcagtaaaagcaagcaatgatcagtgttcatttaccagtctccaaagcaaggtaggcagcatttagcatgtcattacaagaaaaaccatggtgctactgactaaaagttacagaactaaagatggcaacaatgttttaagtgggatggtcaatggagatcatcatggcattgcagccaacacatatgaccgatcacaacgttttaccaccaccaccaccaccacttgacatgagtgaggcggcagcagcgcctgcagtcgggacgattccagtcgaattgcctggtttagagagatgcagaagcctgcagtgtgttttgcagtcaaaagtgagaaaattcgtttatgccagtctagtaataatcttgagatagctaaggaacacttagttacttacggtgctagatattcacagaacgaagtgacggctgaaacgacatcgttgtaattgtcagcagcagcaggggccgtgatttccactagctgtattgcaggagtgattggcacagcttcgttggtagcatggagttttgtcatcttgctaacagaggtaacggtcacagttatctgggcacctcggtggaaacgaaatgcaaatcctcccttcagaacttcatgatctaacttgtaccctataccgtagaagtaacgcaatacattgttgctggctttgctctctacaattgaccgcacaaggactgagatttgctctgcaccagcacctctcatggcacctccaacatgtcttatggtcctacatgaatactactggattcagaatatcatcaaatatcacaaaaatgtaaattttagcagctgaaagaaaagttaccaggatggcgtggactgagctaagtcacacaataaacgaacctctgatgggacaactcctgtatgattggaagatgtatatgagtaacaatggcatatgatcagaataatgaaaaagttgcaaactgacctagatttggcccacttttaagacagagctcatgcactctgacacgttcttttgggacaccagagaggccctggagaagaacctcaagagcatcaacatgctgcataacaagaagatcaaccaaaagttacactgatgtcaaagcaatgaaaactaaaaaaggttaaatggtgttctaagcacaagacattgacatgtgtatataaattaatccctttattgtaaaattacaaaccatataagtgatatgattcctccaattgtatataaaatagaaccatatcaacatattgaaaagagaatcaaaaaaagtctgcaagtggcagaagtagtgccctcagagtggagaaacatggttgaccatatagtggtcagcatgatcaactgtatactttttttttattatcctgaagggaagtgttgatatgctgacaagaggaagctataagagactaacaaaaggtcatatagagacaatggatcgacgacaaagtcttaatgctggcatgaattattattctctattccctgatgtgtttcgttcaagaaaaaagaaattctctatggacataaagttccaatactacttcatgctatatggagtgaaaaaataactttgttcctaagtaggactattgagatgtaatttgacattggggctatgcagttgatagatttgctacctgggatagcttaagtgttacctttcaaaaggttttatcacaattacatttacagaggtctgttttcaggcaattgacacctccaacaacaaaaatgctatcttaaatcaagtgatagaaagttcatttagtaaacgtcgaaattctacattccaactcctttggataaggttactacaaagcgaaaggccaaataaccttatgccaaaaattaaataaaattcagaattctagatacaacatacaagtaaggagcgcaaatgtcagatcagcaaacttgactagtaccgatttcccagaaaggcctaccatcatacaaaaatcaagaatccatgaagaacatcacatctaccatcactccggcttatgttacgggccatgtatgattttccgggtaaaagttcaaattggtcatgttttacagcataaacagacaaatcagtttcatatgaacaaaaatgcatcgttgcatagctacagatcactcattctcggaagaaactaccgttcacttcaacaaccgctcacacagtcaccactcatacaagtctactggcgaagtgagaaagaagaacaataacctgggtctcgatgatcccctgcaccacgcactccatcaaccccaccgcttctcgctaccacaatccctgcaagagagacaaaccctgaaaccacgctgcggaatttcgtcgaacagctacctcgcagcaacaaaaattcacccccacctttaacctaacagcaataatccgcggcgcggcgggggctgaggcgtcgggaagtgagccgatccgaggcgcaagagctccccccacctcgcaaaccccgcgtccccgaacactcccctctccgccactgaccgctcgccgtcctccgccgcctcctcctcctgcagcgatggagacgagaagaaagaattccgagaaaccgaggggggtaaagtgataaaatgcctcacccccgcgcgaagggtcgcggcgtttttgcatctaggcccctggaagaatctgaaatttcagtcatacccttcctctgacttctcctcttcctcttcctcccccacgcgctcgtctcgtcttcctctcgaattcccattttcttccacctcctcctcgtctcgaggtctcagatccaatggccgcgacggcgacggcgacgaccaccgcgtagagcgcgtgagagtctgcgtggacggctaactatggcctcgccggcgggggcaatcggcggcgcgtcgccgtcggggcgggtgctgggccctgcgctggaccggatcatcaagaacgcggcgtggcggaagcactcgggcctcgtggcggccgccaaggcggcgctcgacctgctctcctcgtcggcgtacgcgtcggcgtcggcgccgtcgccgccgtcgctgctgctcgggttgccggcggccgccgcggacgcgtgcatccacgcgctcctcctcgcgctcgagtcggcgtcccccaaggtcgccgacccggcgctcgactgcgtcgccaagttgctctaccaccgcctcctcgtcggtgatctcggcggtggcggcggcgacgacgactccccgtcctccaagctgctcgccgccgtgctctcctgcggcgcgctcgccgacgacgccatggagctctccaccctccgcgtcctcgtggccgccgcgcggtgcccctccgtcgccatccgcggggaagggctcggccagatgctcaagacctgctacaacatatacctcagtagcagcagcggcgccaaccagctctgcgctaagctggcgctggcgcaggtgctggtgatcgtgttcgcgcgcgtggaggtggactccatggatgtgcgcgtgcgcacggtgtcgatcaccgacatgatggacatgtctgaccgcaacctgaatgactccagcattgtccatgcggcgcagagcttcataaacgagacgatggagggaagcgatgtccctgagccggggtccccggttgagccggccgagacggatgggaaggaggatgttgtcatgagcaagatcagggaggatgggttgacactgttcaagaacctgtgcaagctgtccatgaagttctcgacgccggataatcccgaagatcaggtcctgctgcgcgggaaggtgttgtctcttgagttgctcaagatggttatcgacaatgctggggcattctggagaacgaatgaaaagtatgatatgatactcattattgtcttacttctgtgcattttaacagctcaacttgctgtgttgcctatctatataaatattgttgttgcagtgatttagaagaatgcagatggcttaaatgactaagggaaggaaggcataaaatgttcagtatagtaattgatatggaggcttcatgtttgcctagtagtaactcagaaattatggatacacatttttctgatactaatacattattttcacaatccaggcacgctttactattatctgcttggatgtgtcaacattttggctatatttttttaatgtattatgatggatgaaaatttttctagggaaaaaagtgcagagtttaatctatggtggtagatacatgtttacgtgacctactattctgtatttgaattgccattggttcttttaaaatgtttcaaatgatgtcctgatgataatctgcatttgtatgttgttctcttaatttgtttaagtctcttcactaactaaaaaaagaaaataattaatgagctaacaatacactggaaagggaataaaaacatgaagtgttgatttatgagctccagatgtaacatgatggccaggagagggcacaagcatcacgatattttatttataacattaggagtgactgaactttattccgttctttttttccttcaaaatatgctcatccatctaatttgctatgctgaaaaatatgattattgttcaccaagcttcctgcaagtatacggttacaatttaaaaccttttatgtttagggtattccataaagagcattctgtttactctgactccaatgggtaataaaactcttatactgaagtgttcttttctcttttttttttcaatgcaggtaccttggagcaatcaagcagtatctttgtttgtccttgttgaagaacagtgccttgtcagcaatgagtatttaccaactgttatgctccatatttttgggtttgctgtcaagatttagatctgggctgaaagaggaaattggaatattttttcccatgcttgttctgagggttcttgagaatgtccatcaacctagctttctgcagaaaatgactgtactaaaccttttggagaagatctgtaaagactcccaggttattattgatgtctttgtgaactatgattgtgatgttgatgcaccaaatatctttgaaaggtatgtagttttgttcttgatgaatggcaaccttaagttttgttgtcacagattattagcagcaggtatgcatctatttagtggcctgtaagtgctgcatgagaatcgatgcattgaagctgattacagttctgcaaaaattaagttcactctctcttcatcatagttaaaacaaccctttaattccacagatctttgcaggattgtcaatgggcttttaaagactgctctaggggttcctcctggatctgcaacaacattaacccctgcacaagaccagacatttcggattgagtcagtcaagtgtcttgcaaccataataaaatcaatgggttcatggatggaccaacagctgaaaattggtgaattttcacccaaaccttctgaaatatctttaaattcgatagacattcctaacatccttgttggagaagatgggggtgctgttgattatgaactgcaaacagactctggtaacccagacctatctgacgcttcctcacttgagcagcgtcgtacttataaaatagaacttcaggtatgttaatatttgcatgctttctatttaaattaactccaatgttagacattttataaagggttaacatttggtttactgaactgcaaaattccttctgcagaaaggaatttccttgtttaacaggaagccttccaagggtattgattttctcattaaaagcaagaaaataggtcattccccagaagatgttgcttctttcttgagagatactgctggtttaaacgcaacaatgatcggggactatttgggtgaaagagatgaattccctatcaaagtaatgcatgcatatgcagatgcactgaacttcgaaggtatggactttggtgaagccattaggtattacttgcgaggtttcaggttgcctggagaagcgcaaaaaattgatcgaatcatggaaaagtttgctgaacgatactgcaaatgcaatccaaattcttttaccagtgcagatactgcatatgttcttgcttattctgtaattatgctcaataccgatgctcataatacgatggtcaaagataaggttagctatatcactgatcccctctgttatatgtcaataacagaagttttgatcattaaatggattttcgttacgcagatgtcgaagtctgatttcattcgcaataaccgaggaattgatgatgggaaggatttgctgaacattatctgagtacattgtatgatcaaattgtcaaaaatgagataaaaatgagtgctgattcgtcagttccacaaagcaagcagcctagtagtgtaattaagctcttaggcttggataacattatcaaccttgtcaactggaaacaggctgaagacaaggcacttggagcaaacgacttactcattaagaacatacaggagaaattcaaagcaaagagtgggaaatcagagtaagagagagttactcatagacaaataacttgcgtcagctaacactttataataattaaagctcttgtattcgcagatctatatttcatgttattactgattctaccattttaagattcatgatggaggtttgttgggcccctatgatggctgcattcagtgtgacacttgaccaaagtgatgataaggctgccacatcacagtgtttgcaaggattcagatctgcagtgcatgtaaccgctgtaatgtgtatgcagacacagcgagatgcctttgtgacatctgttgccaaattcacttacctccattgtgctgcggacatgaaacaaaagaatgtggatgctgtgaaggtaggaacttagaaaagccaaacttggttctcttttgttttcttgaaataaaaaatgattctcatgatttaaatgcaaatgcacacatactattgcattttcctattgatattatgtagacaaaattcccaagcttatatggtcccttggtctatttatggtgaggacacttagatggcttcacagtacattagagcttgaactattcaaagcatttacacttgtactggattaaaatacttgattctattttttgtcaaaaccatatcgactaatatatatatctatatttgttagacatagtcctattcgtcaatattagaacaagtaatgatgtgtgttttcttaatgtctttttacaggctataatatccatcgcaattgaagatggtgactatttgcaggattcctgggagcatgtactaacatgtctttcacggtttgagcatctacatctccttggagagggggcacctactgatgcttcatttttgacagtgcctctggttgagtcagaagataaaacacagaagtcaagtagcactacagcttcga

SEQ ID NO: 66122 - DNA, 1174 bp, Oryza sativa
ccttttggaatcaatttgaccaaattttactatctttattgaccaaagtgtaaaacggagaatttttgagggggctaagtgcgaaaagtgcaggaaaaaaatgggcgattttttttttatttataggcgaggaacaatcgctcgctcggtcgccttccccttcttcctcctctccgggagcgctttgaacaatcgctctctctctctctccctccccgattcgattcaattcgcgacgcctccgtgaaattctccaaagcgtaagtgcatttcatctctcccggttgcgatcctgttcgccgtaggctgtaggattcctgggcgggtggttgtgtagatggatttttttatgtggaatttcggtgggttttttttctattggattttggttttctacgcgggggattacgaattgtggatccgttgtagtttcgagagatttaatttgctttttttaattattatttttttcggtttgggaggaattgtttggaatcgatgtggcgatctgttcctccgcgcgtgcgcgtggtggtgtttaattatttttttgcgggattttggttgattttgggatgtattatgttctgacgaaatcgtttacttcgttgtttgtttgcgcagcagcttgccctgtagccgcgtgctccggccatggcgttcttcaggggcctgaccgcggtgtcgaggcttcgatccgcgtggtgagccatccaacatcttgcatgcctattttctggcgatgcgtttgcatttatgtgcgctgaaaaattgttcgttgctttgtgttgtcaggcacaggaggccaccacgcttggtggtgtgcgatggctgcagatgcagagcgcatctgatcttgtaagtcaattagtttttgttcgttcgtgctaaatgtgtggttgaaactaccagttactatgtgccatctgtggctaggctcgaaagtggggaatgtgctctgaaaaaagatgtttgattgtgtttctaaatattatatgcaggatctcaagtcccagctgcaggaattgattcctgaacaacaggtttgttactttctagcacgtctaataattcacacaaagttggaaagtatatggcatccagttctttatctaccctttttgctttactgctttagcctgtagtgatatcatcttcttgcttcatgcgatat

SEQ ID NO: 66123 - DNA, 5370 bp, Oryza sativa
  unsure (1)..(5370): unsure at all n locations
atcagatcaacagaggctcatcataccacaccatcctcaattttaagtcaaccaatctcatattatttgcaattgactgaaaccttgcatgaattaattatttttgtctctcttttccttatggctatcaagcaaccatcagtgaccaactgcagtcccattttaagtatttaacatttaagaaacattaagtacagtaaaatgggagattgagattaacatcttttgaataatagtgccaaatataagctcatcctcctaccagttgtactaaaaaaatttgactgccaataaccaatacgctaactactaaaaaaattcatccagtatgtgaagcttctaaatttttccacaaacacactccaaaatcctattctataactaagtcccaagaaaacctaaaataccaagaaaaatactaagaaagagaatagattaatgcatctagaaatgaatcataacagattgctagaagtgattcgctattgattgttcagagggcaacgagtatgaaatatagctaaccaacctggtcctctgtgttttcagatgtcatggcatggtcacagcaagcagaacaaccagctatggtggaggattgatcagagtcgtttatatgatcctcaagcacaacactggaatgaaaaggtgccacatgtatagaaatacaaatctgaaatattaagtaaccatggggaaaaaatggctcactcattggggaagcatgatatattgcagattccttcaaccaaaaaagccgaaaccaccaaatacaaaacaaattttgagacattacccaaatgcattggctctgaagtgaaatgataggcatgttactgcagatttattcgcggcaaaagagtttcaactttccaatcacccctccacaaacccactccaaaaccctattctataactaagccccaagaaaacctaaaataccaagtaaagtactaagaaagagaatagattaatgcatctggaaatgaatcataacagattgctagaagtgattctctattgattgttcagagggcaacgagtatgaaatatggctaaccaacctggtcctctgtgttttcggatgtcgtggcatggtcacagcaagcagagcaaccagctaaggtggaggattgatcagagtcatttatatgatcctcaggcacaacactggaatgaaaagcccagtcaaaaaaacactagaatgaaaaggtgccacatgtatagaaatacatatctgaaatagtaagttatcatggggaaaaaatggctcactcattgggtaattgcagatttttgatgggatgtctccatctctaaagcagcttctagtattagtgcaagactgcttcactatggaagacatataatcctttgaataagcattgtagtccctttctttacttggcactgcatgagacaccttgatgtgagtttatggaaattgttcacaatttttttataaaaaaagaaatctctaaatgctatacaaatgggagaacctatggcaatgagcatagtgttgatattaggttccaatgttgtgattgcaatgtcccatttttcgaactttcttctanagttcacctagaaaaaaagatctgatcagtacttcaatcccagctgatgagttcttttagatggaatggatgcaggttctgtagaacatcataaacatggcaagattagggtctctcaaaatttcatcaccaacagtggcattagagcacctggtaaattggtataatagttaggttgctccattgcattaataaaaaaatgaaaatcactgtcaatgttgatgtgcaacaattcatggtgtataggggaaaaaacgagattaactattcctcatggcaaccttaaaagaacaactcacacaaacctgcacatcctttgtaagctcctgtgccaagagtttagtagtcaccgtcgccaccgccgtctctggtgccatgagttgctcgctgctggtcattggccttgtacattgacggcaacgcggctgccgatgaagcgactacctgtgacccagagggcacagatgggagggaaggggaaggcattggtgcggcgtacggtggatgcccctgctgctgctggtggtgaagtggcttcttaacgcagtctgttggcgacggcgacagtgagggcgacgccgacgaccatggcgacgccgatgagtggtgggctggggtgtccttgtggagatgagaagcagatctggcgccgggaggacgaagaccgcgcccgcctcaacccccactccctccgccgtctccccctcgagttgatgcgtccggaacctcgcggcagtcccgccgccaggattgggccctcagcttttcgcgccgcctgtgatgcagccgtcggcgctccgacctcgtcgttgacggatgccggaggcggagacggctgcactcggtgacggcggtcggagacggcgacgcaatggcgccagcggcgcagggcgacggggacgatgatggcgacgacgcgagggggatgcggaagcagaggcgcttggagacggtgacgcgacgacagcggctgcgtaggcggaggcaatggcgcgaggggaaggcggaggcgagggtgggggaggagacggcggagggagagggaaagggagaaggagagagtgggggaagagagggcggaggggagacggacggcggcagctcggccggcgatggggacggcgggaggcggaggtggcagcgcgatggggaggcggcggcgggggtggaggcggcggcgcgaggcgacggggacggcgtgagggggaggcggaggcggcagtgcttggtagcggcgcgagagagggagagcaagcggctagggtttgaggggtctgcgctagtgggagtattttttcgaaaaagcccctcgtcttccacatatcacaacgaagcccctgtccgcgattttttctcttcaaacacaggacgcgaggggcctatacctgattacgaagaaccggagggctttttcgcaaaaatccaacctcgcactgtagctactgtagcaaaatccgacgtggacacgcccagcgtccgccccttccgccacacttaatagtttctaatgaaccatggcatatagaataatcaattcattatcagagacatggcaatccatttgtacataagcctaagagttagattatggatgtcattggttctgggtttcttataaatcggtgcaccagaaatatcttcacagaatatgtttttctcaaaaccggaagttgccttccaaaaatcgactctacaggattcggggaaaccgagaagtgtgctcaatccactacataaaagattaaactctttacggaaaagtcaaaaagtaacaccaccctctgcttctctaagtgtgcagagaaactgtatagttagtagacaagagcctaagtgtgcacagaaactgtatagttagtagacaagagccaagctcgtctaccgttgcaaaggcgtgccaacccatggttctccaaatgacactaaaatctacatccatacttgttttccggagtagctttggatcgtacgctcggttgtgagcgaatgatcggtccttcagcatctggtaggcttgtttctctcgtctgtcaacgatatcgaggtcgttgtcggtcaggagctgtggtacagcgtcagtgttctccattgacacgtcggcagatgcccgatcgctcgactggttggatcgggagccggatcccttgagcaagtgggagagccgtctcctcatgactgcacaaaggcaagaatacaaagcgaactcgagcaggggttagcacaagacaatatacccgccagttaactttgcaccaaaagcaacttgctaatgcgagaatggaggattttaactatgaggctgttggctgttgttaatgacagactttatgccaccaatacctgcataaatcaaggaaataaaacatccaacatagtgatagggttaaattctgacatattccacgagtgttggtgtatatttgtatgcaggtaataaaccaccaaagttggaccaaaaatagacttgagtgaagaataattcctatccataccaagagtgggccaaaaactaccagaaaacatcttcaaatgggctttccactcacagaaatggatagaggacgcagagaaggagcaacaggccgaagatgggctctgtcgagccagacctgggtttggtcgaacccatggttcggccaaccactaccacagccgttcgaactggggcttcgcgtggatggtctagatgagctcctaaatgacggttggagggcagaagtgtcttttcgcgttccataaccatcatacctgttggtgataagccctagaggcaatcatagagatgattgtatcacatactatatttacatatttatccgatattgttccttgaaatagataactcattattggttaatgaatatgtgattctttcatgagactctttatgttgtatgctactattttggatgaagcacaaagaacaactcgcactaaggtaataaagttgtttaaagtccaatggaatcaccatacagaggaccaagcaacctggaaacgggaagattatttacaattggaattcccgtatctttttgaagactcctaagcaaatctcgggatgagatttatttaaggtgggtaggtttgtaacatcctcaaattttaaactaaaatttgactgcatcatgctggcttttgactatattagcaaaattaaaatcattgttatttgaactctttttattcttaattttggttcaagtattatttctttagaactcttttaacctaccctaattatttcctttaccctaaaccttagtgaatgttggcggatgttaaatgcagattctataccgacaacatctgcataaagttcagataataaaacatccaatatagtgataggtgcttaatctcacatattccacaagtgttcgtgtatatgtatatgcaggtgtcggtgacatggggccgggggtatcgtgactagaggcttgggtagccgcggtcacccacgtggcctgaccccctcggggggggggggggggtcgggcccgagggtgacgtggccacccctccctctgtctccccaaggggtcgggccgctcccgtttcggccccgagggctggggcgcccccgtttcggccccgagggctgcgacgccccgaccccctgtggttttggcgccacgtgtgtgagttaggtgagcacagcggggctcacctaaccgcatttataacaggttggacgagcgcgccacgccgcatttaatgcggcgcagcgcacgcttatccggtctgtgaccagtcgcggtgtgtgaccggtcacagaccggtcagatcg

SEQ ID NO: 66124 - DNA, 11168 bp, Oryza sativa
ggccccaccatcaccgaaaaatacgacggaagcgtcaaccccgccgagtttctccagatctacacgaccgggatcgaggccgccgggggtgacgacagggtcatggcgaatttcttccccatggccctgaagggtcaggcgtggggttggctaatgaacttgccacccgcgtcggtccactcttggaaggatttgtgccagcagttcaccatgaacttccagggcatatatccgcgcccaggcgaagaagcggacttgcatgcggtacagcgaagggacgatgagtctcttcactcgtacattcagcggttctgtcaagtccgcaacaccataccgtgcatccccgcacacggggtgatctacgcgttcagggggggcgtacggcgcaaccgcatgctcgagaagatcgcctccaaggagccccagaccaccgcgcagctttttgagctcgcggaccgtgtggctcaaaaggaggaggcctggacctggaactcctccgattctggtgtggcagcttcggccgcccccgggtccgccgctcggtcagggcggcgggacaggaggaggaagaaggggtcggcccgttccgacgacgagggtcacgtcctcgccgtcgagggcgcttcgcgggccccccgaaaggggaggcctgtgagcgacaaaaagaaggaggccggcgctcccagcagggagcgcccgaccggcaagtggtgtaccgtgcacaacacctccctccacgacctcgcggactgccgcgcggtcaaaagtttggctgagcggacgaggaagtgggaggaggagaagaagcaggagcgctgtgagggcaaaaccccggcggctcccaccggcaaccggcgaggtgaggccaagcagaaggccaccgccgaggacatcgacgatggcgacgatgacctggggttccaggagcctgaggccaccgtcgccaccgtcgatgggggagcgtgcgctcacgcttctcgccggagcctcaaggacatgaagcgagagcttctggccgcggcccctacccatgaggcgacgcggcgggcgcggtggtcggaggttgccctcaccttcgaccagaccgaccacccgccgtgcgttgcccggggaggacagatcgcgatggtggtttcccccaccgtttgcaatgtgaagttggggcgtgtcctcatagacgggggtgcagccctcaacatcctttcccccgcagcctttgacgccatcaaggccccggggatggtgctccggccgtcccagccgatcatcggtgtgacgccggggcacacctggccgctgggtcatatcgacctcccggtcaccttcggtggttccgccaacttccgcacggagcgggtggacttcgatgtggcggacctcagtctaccctacaacgcggtcctagggaggcccgcgttggtgaagttcatggcggcggtccactacgcctatctccagatgaagatgccgggccccggtggccccatcaccgtccatggcgacctcaaagtcgcgcttgcttgtatggagcagcgcgcggaccacctcgccgcggcgtccaagcccgcgggtggcgacgagaggctcagcacctccgtcccggccgccccaaggcagcggatggtcacgtgcgacgaggtcccggtcaaggaggttgccctgggcgacggctcgtccaagaccacacgaatcggtggtcttctggacgacaaataggaagacgcgctcgtctccttcctgcgggcaaacgccgacgtcttcgcctggagaccggcagacatgccaggggtccccagggaggtgattgagcaccgtctcgccgtgcggccgggcgcaaggccggtccggcagaaagtgcggcggcaggccccggaacgtcaagccttcatccgcgaggaggtggcgcgacttctggaggccggattcatccgtgaggtcatccatctggagtggctggcgaacccggtcgttgttcccaaggccaacggcaagcttcggatgtgcatcgactacaccgaccttaacaaggcatgtcctaaggacccttaccccctgccacgcatagatcagattgtcgactccaccgcggggtgcgaccttttgtgttttctagatgcatactctggttatcatcagattcgcatggctagggaggatgaggaaaaaactgcattcattacccccataggaacttattgttatacgacaatgcctttcgggttaaagaatgcaggtcctacttttcagcgtactactcgaatttctttgggtagccagataggaagcaatgttgaggcctatgttgatgacttggttgtgaagacgcgcaaccaagagaccttactctcggatctagcggaaactttcggaagtctccgctccacccgcataaagctgaaccccgataagtgcgtgttcggcgtgcctgcgggcaagcttctcgggttcttggtctctgcccgaggcatcgaggccaaccccgagaagatacgagctatagagcggatgcgcccccccagcaagcttagggatgtgcagtgcgtcaccggctgcatggccgccctaagtcggttcatatcgaggctgggagagaaggcgctacccctatttaagctcctcaaacgctccgggccgtttacctggacggaggaggctgagcaggccttcactcagttgaaggcgtacctcagttctcccccagtcctggtcgccccggagccagatgagccgttgctactctacctggcggcaaccccgcaggtggtcagcgcggcgttggtcgtggagcgcgacgaggacaaccctcactccgcgcatccccaccctgtgtcgactcgacccgggagagagcagggaggagaggcccccgagccgaacggcggcccaaggcccccgacggtcggagctggccctccgcctgcttgtccgacggtgccaggcgcccccgacccccaggatggccccggggccactgcgggaaggctgcgcctgtcgccctctgaccccgaggtcatcggcacagaagccgagtgcgccccgcgtggcctctcggacgaagagcgccctggagatgcggcccctggcgaagaggattggccccgccgaaaggtgcagcggcccgtatacttcgttagcgaggccctccgggacgccaagacccgataccctcaggcccagaagatgctttacgctattctgatggcttcgaggaagttgcgccattatttccaggcccatcgggtcacggtggttacgtcttacctcctcggccaaatcttgcataaccgagaaggtactggacgggtggtgagatgggcaatcgaactctctgaattcgatttgcgctttgaaccacgccacgcgatcaagagctaggccctcgccgactttgtggcggagtggaccccagctcccgagcccgtctccgcccccgaggccagctcgggcccctcgcagctgcctcacaccgcctactgggtgatacagttcgacggttccctgtctcttcagggcgccggtgcgggggtcacgttgacctcgccgagcggagacgtcctcagatacctggtccgcctcgattttcgggcgaccaacaatatggcagagtacgagggactccttgcggggctcagagtggcagctggactggggatccgccgcctcctggtgttaggcgactcccagttagtcgttaaccaggtctgtaaggagtaccagtgctctgacccgcagatggacgcttacgtgcgccaggtgcggcatatggagcgccatttcgacgggatagagcttcggcacgtgcccagacgggataacgcggtcgccgacgaactctcaaggctcgcttcctcgcgagcccagaccccaccgggcgcctttgaggaaaggcttgcccagccgtcggcgcgacccgaccccctaggggagacggacgcgcctgaacggcccccgaggcccgtcggagtccaggcctcggggcccgaggggagcgctcccagctcccctagattgattgcttggatcactgagatccaggcgtacctcgcagataagactctacccgaggaccgcgaagggagtgaacgcgtccggcgcatctccaagcgctacgtgctggtggaagggaccctctatcggcgcgcggctaacggagtcctcctgaagtgcattcctcgggaacaaggcgtcgagcttctcgccgatgtccatgaaggcgagtgtggagcccactccgcctcacgcaccttggttggcaaggcctttcgccagggtttctattggccgacggctctcaacgatgcggtcgacctgatccggcggtgcagggcgtgccagttccacgccaggcaaacccatcggccggcccaggccctgcagaccatacctctttcgtggccgtttgctgtctgggggctcgatatcctgggtccgttcaggcgggccccgggcgggttcgagtatttgtatgtcgctgtcgacaagttcactaagtggcccgaggcttatccggtcatcaagatcgataagcactccgcgcttaaattcatcaggggcatcactgttcggtttggggtgcccaaccgtatcattacggataatggcacccagttcactagtgagctcttcggtgactactgcgaagacatgggcatcaagctctgcttcgcctaccccgcccaccctagaagcaatggccaagtggagcgcgccaatgcggaaatcctcaagggcctcaaaaccaagaccttcaacatcctcaagaagcacggcgactcgtggatcgaggagctgccagcggtgctctgggcgaaccgaaccacgccaagccgagcaaccggggaaacgcctttcttcctcgtctacggcgcggaggtggtcctcccatctgagctcaccctgaggtcccctcgggtcaccatgtattgcgaggctgatcaagatcagcttcaccgagacgacctcgactatttggaagagcgaaggcggcgcgcggcgcgcgctaccagcagagcctgcggcgctaccatcagtgccacgtccgggcccgatcactctgcgtcgacgacctcgtcctacgccgcgtccaaacgcgtgccggactgagcaagctctcaccaatgtgggagggtccgtatcgagtgatcggcgtcccccggccgggctccattcggctggccacgggcgacggcacagagctgcctaacccgtgaaacatcgaacaccttcgtcgcttctacccctagtgggggtcgggtgtcatgtctcgggctcgggccaaccccgcacccccccgggcgtgcagggttggccgggggctaccacatgcatatacttatcttttttctcttccgtatttcaataaaagcattttcgatttcctgaggactgtgtctgtgccatcgtttccttttgaagaatcttggcttgaattagcacgctcgtgctcgaccctgccctcggtggcccgggccggctaaaatcgccaaatggggcccagaaccgagccgtttcccggggcgtggtgaactccgggggggaatcggcaaaggcccacaatcgggtcatccataaccctcggtcaccgctctcccggcctggccagtctcgacacgtggatctccccaggcactagccccgacccgcgccgtttgaggctgggacctgggcactagcccttgttcaagccaagacacagaaggaccgcggcacagaccatcctcgtcttatacacacaacaaacagaactgacgcagaaatttcctctttacttgattgcagattaaatcagtctatacaaaaagggggcccgaaggcctcggaagaagaaggaaaagttattaagattggcggggccttgggggctcactccgacgcgcccgggtcgccggcctcgtcgtcgctgtcgtccgcactgtcgtcaccgccctcctcgtcgaagtcgagggcgaacgcgagccgaggggccgtaccctcaaagctgtggacgatgtggtcggcggaatcccggacctgcgcgcgcgcgccgtcctcggttccgggagggaaatcttccagtgctgcccacggggagaagtcagggtccctggcctggtagcttgccagtacgagctccaccgccccccgggcgaggtccctcgaggatgacttgatcgtctcctcgagctcctcggggagccgctcgagggccccggccatctctgagaggcgctgggcgaggcccccctggttggcggtgtacttcgcgtaccgcccgccccagaggcccgcctgctgcccgaagcatgccgggccctacctcgctcgccaagcggagggcctcgacctccccggcggacgagtccagcgcgccctgcagctcggcgatggtgtgttcggcggctgcgaggcgggcggctaggtcgccgtggcccgcggccgccccgccgctgtgcgctctcgcgtccagctccttcgcccgcgcctcgagctcagcggcccgctgatccagtgcggccctctcggcgcgggcgccttccagattgcggcgcgcctgctcctcccgcgctgcctcgcggaggaacaggctgttcgccagtcgctgcgccgcgggctcggcctcttcgagagttcgcccccgctcggtgagcgcgtcctcgcggaggcggagtgcggactcctctttagcgcaggcggcctcgcggtccgccaggtttctctccttcgcgtccagggcgcgggcgcgctcctccagcgctgtggcgcgagcctcaagggcctcttcgcgctgccgggacgccgccttgttctccgccgcccgccgttcccgggcagcggcggcgtcaaggactccccgggcagcgtcgagcttctcctctagctccgccgcccggctcccgtattggaggcggaggtcgtcccgcgcctcgtcgagcacggcggtggcgatgagggcagtctcccgctcctcctccacctccctggcgatctccgccaggtccctacgacgggcctcgagctgtgaggcgtgccggcggtgtgccttgcggcccgcctccaccatggcctccaccgagcgccgcccctcctcgacgtgcgcccacgccgcgtcgagctccgcccgctccgcatgcagggcctccatctgggcacttaacccgtccagcaccgtgctgttcgcggcggccaaggcctgcaggaggggctccgcgctcagtggggcagcggaaggcagaggggagagccgcctcagtgtgggtgccgcgcggctcggcccgccgatcgacgtgccggactcgggggcgtcccccgaacctggctcgtcccaagcgtcgcccgaggggtcgggcccgagcggcgcgcccgcggcctcgtcgtgggtggcctcggaagtcggcgtcgcctcgggcggagtcgggtcgggggtttggcaggccgcctggcgtgcgcgcgccgcctctgcctcccggacggactccccggcccggcggagtctagcctcctcccgagcggcctcctcagcctggcgaacccggacggcctcctgggcagcctcctcggcttcccggaggcggtccgcggcttctcgccggtcagcttcccgcctccgggcctccgcggtcgccgtctcctcggcctcagaccggctggacttggaatggcggggagggcgcgacgggatctcgcttaggcagaagaaaaaccagaagacaaaaagaaacgggtgagtgaaaactcgccttgaaaactcgcggtgggcgcggggacgaacctgcggggatgtcggctaaacgaccacctcgggggcgagatgaggctctcccggcatggctcggtccccccatcttgcggagccgtttcttctttcgctccccctcgggctgcggcgtcgacacagcaccctccgggcgcctgctgctggcacgcaccgccccgccccctcggggaggagatgggggaggggtaccctcctgcttcctcttcccccgggcgtcggtagggcggatacccccgggcccccgtcgcggggcccagaagcacgaccccctcccggggtagattgttccctcctgcggctcccgcccgcgccatcgtggcctcggggggcccgctcccccgacgccccgaccacctacatgatggccaggatcttggcgcgctctggatcgcagcagatggggaggaccccttgggggatgagggatgcctccacggagctgagattcagcacccgttggaccaccatcctgaagtcctcagggtccaagtcccatttgcgcccctggtgggtcctcacgtagtcctcgggcccggtgtacacccaggcgccccgggcgcgccgctggagcagcgcgatccggcgatgaaggtagtcaccgaacaccatggcccccgtgagcccctgggatcgcagacccgccaggcggtcaagaacggcgtcgtagccgtctcccagatctaccgtcgcccgccagctggaggcctgcgccgggggctggctcggaagtcggaggcgcgcttcgtcggcgaggggggtgtagaaccaatcgctcttccagtcatcccactttttgcggaggacgcagagaatgtagcggttcagcacctgcccccgcggctggaagtagcagccaccgactaccgtcggcggcgacaccggctgtacggtgaagaaccaccggaacagccggagagatgggcgcaccccaataaacatctcgcacaggtgcgcgaagatggccaacgtcattatcgcgttgggggtgaggtgcgccatctggagatcataaaactccagaatatccatgaaaaaaatagagaatggcgggaccagccccgccattgcgaaagagaggaagaagacggaccgccccgggtagtgtggtgtcgggcgtccctcgcccagcgcgaccacctcccggccggtggcggattctggcatgaatcggcgcggcagcccggcctgcctctcgctcacgatgcgggaaggcggcagcacgctaccgtcgagcggtgcggagctccgtgccatgacgccggcggaggaggagcttgagagcgagcgagtgcggcaagggtagggcacaggaaacgaagagttagagcacaagtggcgaaggcaagggggagagtggcgagaggaaaggaacgaatcccttcctcgacgtctttacacccttgccaatgctatacccggcttctcgcgcccacgcctccactaacccactcgctcgtttgcggcgcacgcggcagatgtgcggccgtggcggttgagatggggcagatcgtgcgcgcattaactacgctcgccaaccgtgaaaagcgccatcatcatgtctccaggcgaaacgaaccggctcgtcccgattcgcgcgctgctcgagtaatgtagcagtcttaaagaagccgctcattattgtcggtcggttttcccttgctgatgcgcgcgatttgcgaccgctgggtttctgcccgcctgtagggaccggccccacctgtcaccgggcctaaggagtggcgtcacgcccgagcgcttccctcgaggggggcgatcgccctggcgtaacgccgggggctactgtcggtgacatggggccaggggtatcgtgactagaggcttgggtagccgcggtcacccacgtggcctgaccccctcggggggggggggggtcgggcccgagggtgacgtggccacccctccctctgtctccccgaggggtcgggccgctcccgtttcggccctgagggctggggcgcccccgtttcggccccgagggctgcgacgccccgaccccctgtggttttggcgccacgtgtgtgagttaggtgagcactgcggggctcacctaaccgcatttataacaggttggacgagcgcgccacgccgcatttaatgcgacgcagcgcacgcttatccggtccgtgaccagtcgcggtgtgtgaccggtcacagaccggtcagatcacgggttaggtggcaacaggcggcctgtcacacgcctcgccccgtcccgtcggaatgatgagagcttcctggctctcgtccctagccggagccggcgtgctaactcctggagttggtatgtcagtcccggtcagaaccattccaggcttcagcgcaagtatggcaaggaagtcgctggccattaaatgaaggttgaaatgggcgtccaccggaaaagcgggcgagcggggcaggaggcgtgtgctctgcttgtcagaggtcacttccggctgtagactagccctcattgtaaaaagcatgtttcctttcttaggcagctggaggcccttgtggtgacccctgaccagataaaaaggaggcccaggcctaggaaagggggggactctggagagaaaagagaaaagaaaaaaagaaaggggactctggagggaggagaaaaaaggggaatgggtgctagaccctgaactctggctcgctctccagctctctgtattccttcacgcacagatccactagaacacaggagtagggtgttacacttcccagcggcccgaacctatctacgtcgcccgtgtcttgtgcacttcctctctcgcggacgttcctcagatcgagggcaaagaacctcacttagcgcccccggccgaaccggcaaaggggggcctgcgcggtctcccggtgaggagccccacgctccgtcatctggcgcgccaggtagggggcgcgcgtgtctttttaagccctcgtcctctttcgtgtgcaccaagcttctcccgctcagcctaatggccgaacgggcagtggcgcacagcctctctccgaacgctagcggtgacgacggggagcagaacccgcgccgtcgggctcgcaccccaccgtccccctctcactgaaatcttgggcggggggaggcgctcggggaggtcgaaggaaccgcgacttcaccgcccgcgggcgacgggggaggacggcgagacggggcgtgtcgccgcctcgtctacggcgatggcggcacgccccagggcgcgctccaggctgcgggcgcgctcctgcgtcacccgcccgtcgtccccgatccagagactccagcccgacgttggctggatgacgtggccgacttggtcatggcggcgcagcagcgcctaggcgccggcgggcggtcctccgccaccgaggcctctggcgctgccgccgccggctccatgtcgtcgaggcggagggcgcggcg

SEQ ID NO: 66125 - DNA, 1951 bp, Oryza sativa
gacccctgaccagataaaaagggtgcccaggcctaagagggggggactctggagagaaaagagaaaagaaaaaaagaaaggggactctggagggaggagaaaaaaggggaatgggtgctagaccctgaactctggctcgctctccagctctctgtattccttcacgcacagatccaccagaacacaggagtagggtgttacgcttcccagcggcccgaacctgtctacgtcgcccgtgtcttgtgcacttcctctctcgcggacgttcctcagatcgagggcgaagaacctcacttagcgcccccggccgaaccggcaaaggggggcctgcgcggtctcccggtgaggacccccatgctccgtcagcaggtgataaacctcgatgttgggaggaaatctagactaaagtgaggagaattatgtatccatacaaggatgggttatgaacttcatcaaaatacccgagagtcaacccaaaatcctgagaaataggtagagaaggtcaggggggaagatgcgcaaagagccaggccagatgggcctagctgtaacgccccgattttcgttgggattaaaaatcattaaataatgtattttccagaaattaaataaaagttaaagcaatttaatcaagtgaaatattgagggaattaaaaatttcctttaaaaatcattgggcgagaatattttgtaatattctttgtgccctaaatattctctgaaattttgccgtgaattttcggagctcaagaagtaattataataatacaaagttcatttaatcaatttaaataaaaagaaaataaaataatcttccccttcctcccttttgggctcggcccaaattctttcccccttcacctccggcccggccgccctcctccctcctttgggccgccggcccagctcctcccctccctctccctcaagtcctcttttcctcccctaaccggccccctcttgctttggccgacaggtgggacccacggcccctcctcctccttcctctggctagccggctgcaaccgccatggccgcccgagccgccccacgtcaccgctttccccgcccacctcctccaccctgcaccactcctgcccgaccgtgggacctcgtcacccacgaccccgctcccctcccccactccgtcccgcgaaaaaccgccgccaccacccccaagacgccgccccactccccctcgaaatccgccgctccccggccctctcctcgcccccttgagctgtaaaatcaatcctcgtggcctcctcttcctttttccccgttttcccgagtcccccacgccctctaccgagctctccacgtcgatccccatcgccgccgctcgccggcgatctccagccgcgcgccgccgctgctcccgccgtcgccgcgcctcatcgcgtgtgccatcagcttcgccatcccgcgccgcacgccggcctccactcggtttccttcaaccgccatcggaaccacctccccaccatgtaacctctctccgccgcttgccgccgaactccggccgcctctcctcgccacgctagccaccgccaagccgcaccaccgccagtgtcggcttcgccgctccaagcagagcaccggccactgcctcgttccaccaatccgtggccgagtcatcacctccaccacccacccaagccgttaccatcctccgccactccggtcgtcgcctccggccacacctcactgctctcagccaccccgcggccgccattagctttaccaccgcgagggcaagctcggccgcccatccatttttcccctccaccaccagaaccaccttcctgccataccaccctaccggccgcctttttccgcctccggtcgccgttcggcttcaccctggctgccgccgcaacgcatcgccggcttcgccgcgtcccgctcttccccgtccgccgcccgatcgccgccttccgccgccgggagc

SEQ ID NO: 66126 - DNA, 2853 bp, Oryza sativa
ccgccctctgtggtcggtcgggccagccccggctgtgcccgtgcccggccaccgctctcctcagccgcccgatcggcttgggccgatctgggccgtccatcccgtggacgggcggtggaccgcccttgtggtcccggtccatggtggaccgagcccccttgagccactgatgcctgggacccgcctgtcggcgccggccccctctcttgctaacgtcagcggcagtccttttcctttgtgaaaatatttaataattgcgcaataatttggtaataattatagatattaatttaatggctcaaaaccttctaaaattcatatctaattcattcgaactccgaattgagccattcaacttgcaaaattcatctaaaattgagctctacatgtttgtttactttttatataccgttttcttggtttttattagagtttttccttgttttgcgtgccagcgtgtagttctcgtcgtttcggaagtccgcggtcacgaggaaaagagttcggaagatcaaagtgaagaagcaaggcaagtcacacattcccctttagcatgttgatcccaatttacaaatgttttactatttgcaaataaatatgcgtgttttgctaattacatgggatcagggtttacctatctgctcgcttgtgccatatttacttgatatatgtcctttgtcaacattgggtaataaatcgactagctcatgttacttatgtgacctagctagaactatatgcttagccatgcttaattaccactagctcagttgatgggataattacaatattagaccttttagtatcagaatgagctgcgtgctcgagacatctggccatgcttcatggtcataattatccaactaaaatgcgactgaagggtgggctgtgggtgcatggttttgctagtcgcacccatggcaattaaggaccggttcacgggaaaccctggaagaatttctcgtacttaccacaagccagcgtgggcaacggctgggcttgtagtgtagctttcctctagccgacgcatccaggcaagggtgggtgtgatggagcggggcgggccctgcgacggcctctgtcgcttccggattcacctaggcacgagaggggattgcccgctgccttgcgaggagtgggggtgaaacctgaggtgtggtgtgcttggctagagagggttatgcgaaggatcctgtcacgacctctttccggtatgtcgtggtggcatgtcggcgcacggaaacgtgtcgtggggctgtgtcttgtgggtacagttgtacacctctgatcagagtaaaactattcgaatagccgtgcccgcggttatgggcggtcgaccagattcaccgtgattagtcccaccttaatgaatcgactcaatgcactgtagttcaggtgggttggttgggcctgttcatcgtggtgtagcgttgatcagtggagatttaatattaccttaattactcaacagttttagtattttgctcaataaaatgttttacaactgcctttatgcaaatagccacaaaccgtccttgtgtccccttgcacgtctgcatcgttggtgtggcttgctgagtacggtggttgtactcagtcttgctattattcccccttttcagaagtgtagtgcttctgagctgaagacgaggttagaagaccaaggctcagaccccagtcgagttttgcctgtggagtggagctgaagccccgctaggatcgcctttttccactgctgctgcttttgtttcggtgtgaggactaagtgcatcttctgtaagtattttacgctttatttacgtttggaactgtatattacttattgttttgtgtaccctggctggtcctggacagggatttaatacacaaaatagtctggaaatttgggctaaatttctgggcgtgacactagcccaggttcagccgaggttcggccgaaccacaatctcagccatccaggctggggtttggcgtggacggtcttgatcatctcctgatggcggttgcggggcatttccgacaattcgcattgtataaccgtcatacctacccctaaatagggtcgccaatgatcgccttggtcaattggaggctgctcaaattgacaccaactccaagttttcctcctcattggagaggtcccttgtggctgtgaacacttctcttgcaggtatcttgaatacattggagagaatgagcaaagatggtcatgatggatcggctaggcgcaaccacaatggccatgatgctaatagcagcatcgcagcaagggaagaactagagtacgctgctgacaccgagcatgatgaggaggtacttggtcgtcaacgaagacaacagtgccggtagcgccatggcatgggcgctccaccacggcgggaggcacgtgataatgatgattctttaggcaagatcaagtttaccattccttgctttgatggaaaatatgaccctgatgcatatcttacttgggagttagccattgatcagaaatttgcttgccatgattttcctgagaataaacgtgttagggttgctactagtgagttcactgattttgcatccatttagtggagtgaatttgtttgttccaatccaaataacactccccaaacctgggatgcaatgaaaagattcatgcgatctagatttgttccttcatatcatgcacgtgatttgttgcataaattgcaacaacttagacaagaaaacaaatctgtagaagagtattatcaagctttgcaaacaggaatgctttgctgtggattggtggaaaatgatgatgctggtatggatagattcatgggtgggctgaaccgagaaattcaggacattctagcctccaaagaatat

SEQ ID NO: 66127 - DNA, 741 bp, Oryza sativa
aacaaactctacaccatgcccgagtgaacccacaagaggggttgctgctacatcttccaagagctcatcatcagtggcattatcaggaaggacaagagatattcagtgcctacgctgcaagggctttggtcacgtgcgcaaggactggccaagcactcgtgtaatgatcgtgagagctgatggtgggtactcctccgctagtgatttagatgaagaaacctatgctttgcttgcaactaacaatgcaggggaaggcgacgcgccccaccaagatgaggaacacattggggccgaggctgcagaggactatgagagcctcgtggtgcagcgagtgctaagcgcataaatggaaggggctgaacagaatcagcgccacaccttgtttcaaaccaagtgtgtgatcaaggaacgctcttgtcgcatgatcatagatggatgaagctgcaataatttagtgctgaaatggtgaagaaacttgcattgagcacacagccacatccgcagccctactatattcaatggcttaatagcagcggcaaggtaaaggtaacacgattggtaagagtacattttgccattggttcttatcatgattcaatcaactatgatgttgtgtctatgcaagcttgttctatgttattacgtaggccatggcagtttgataaagattccttacactttggcaaatccaatcaatactcctttgtgcataatggaaaaaaacttgtgttacatcctatg

SEQ ID NO: 66128 - DNA, 1215 bp, Oryza sativa
ccgcagggaattgaagtagatcaagccaaggttgaagccatacatagctggccggttccaacaactatcacacaagtgagaagctttctaggacttgctgggttctatcgccgctttgtgaaggattttagcaccattgcagccccactacatgagcttaccaagagaaatgtgacattcacttggtctgcagcacaaaggaatgcattcgacactttgaaagataagttaacacacgctcctttactccaacttcctgatttcaacaaaacttttgagcttgaatgtgatgctagtgggattggattgggtggtgtgttgttacaagaagacaaacctgtagcatatttcagcgagaaattgagtgggcctagtttgaattattctacttatgataaggaattgtttgctctagtgcgaacattggaaacatgacatcattatttatggcccaaagaatttgttatacactctgatcatgaatctttgaaacacattcgaagtcaagcaaaacttaaccgtaggcatgctaaatgggttgaatttattgaattttttccatatgtcatcaaacataagaagggaaaagaaaatgtcattgctgatgctttgtctagacgttacacaatgctatcccaacttgacttcaaaatttttggcttgtaaacaataaaagagcaatatgcgcacgatgatgattttaaagatgtgttgttaaattgcaaggagggaaggacttggaacaaatttgttctcaccaatgggtttgtgtttagagctaataagttatgcattccagctagctccgtgcgtatgctattattgcaggaagcacatggtggagggctgatgggaaactttggtgtgaagaagacgaaggatatccttactgatcatttcttttggcccaagatgaggagagacgtggagaggttcgttgctcactgcacaacatgccaaaaagctaagtcacgccttaaccctcatagtttgtatatgcctttgcatgttcctagtgtgccttgggaggatatttctatggactttgttttagggctgcctagaacaaagaaggggagggacagtatctttgttgttgtagatagattttctaagatggcgcatttcataccttgtcataagagtgatgatgctacacatgttgctgatttgttctttcatgaaactgttcgctggcatggagtgccaaacacc

SEQ ID NO: 66129 - DNA, 11597 bp, Oryza sativa
ttggttgcatttgagaaaggataggtgccatgagctgtttccttatcatcttgttcttgcttgttcttcgattgcttacaggttcaaggttgttcttggcacggcaagaacagcaacaacgtggagtcggtgtaccggttgctaaggcgcagcacccctgtggtagttgtagtcggaccgccaacgtcgtgccctcccccaaatcgaagtttatcctcctctcatcaaaagatcgggaacccccgttgctgcatcacctctaccacccctgccatacccaatttccgagctcatcaatggcgttgatggcgcccgagctcatcgacatcttgtgaccctataagtaggaccccaatcccttccttgtccatcatcgatcatcaccaaccataaccccacaaccccaaagctctgctttaccaatccatctcatcaaccatcctcgcccgccggtcgaacaccttgtgcgcgagcgacttcacaccactccatccaccctctaccctaaccaacccatagaacacctatattcaaccatgttctagcatactaaagcctaaccgaagctctgcgtcgacacctcgtcacaccgagccgagcactgccgcccctgctctgctctgttcttcgctgccgagaggtttttccggtcgcaatccgtcgtttcaacctatctcggggagttcttccattttaaccatcgacatactccttagattccattttcgtaattggttagcactaacatcaccctcttgactgccgacgtgagctcgaccaccgccaatggaggcgcaagtcagcaagtatcttccataccttgccgaacgtcggcaagctacttaaatccttctagacacctcatagatgctctaggaaccttccctgagccatgcctaactctcaccaccccgatcaccttctcagctcatccatgtcaccgccaccctagccgctaggttactcacacaccaaattaacccctccggcgccgctcgccgtcgccggggaaccctatctacctcccctcctcggccgcaacacctttccccctttattactgccataatccctaaccctagcgccgccggccgtaaatggggaacagttggaggttgaagaagagaagagagggagagactgatcggtgggacccacacacaataccatttaacatttaatttgattttcaaactttagaagcccatatattttaaaatatagattcatttccagtgaaacttgaaccaaaattcttctaaaatcattctctatcttttgagaccacttttgctatttttatattttattttatttttacctatttttggattttatttgaatcccttttgaatttgaattttacatgtttaacccttggtcttgaggaatcttatgacacattagataatatcagtcaatctcaggacatcgagcaaggcaagttactatacacattttgatcgtttaagcctatattttacaagttatttatttataacctttctactcaatactctactttcacatgcataattcaaccatagaaacccagataatttagtattgcttattttgcttacaatctggttaaaatgttttatacttagattgggacaggacatacgaattggatgatttccggatggctagtactgtctcgatcgatataagttgtcaccaggtacttatgtcaaacgaacgggtgcgaccgcagtttctagaatggggactgacctagtcattatgttaattagcaatgtggtacctctgtatagtggctcttattgttaagtccttgagcaggaggcaactgtcacaccctgaagttcttctcccaagccaaaattgaatttataattggtctcgagaaaataccggtgtaaaagcaagagtgaaaccctaaataaattaatgcaaataataatcggaattggcatgtggaatttttcttgagctctacatgtcgaaatgtgctaacaagatttttagtggaattttcatagctctagaaataattttaaccaatcaaaaatgagcacaagcaatatttaatcccaagaaaattcatttcctcctttttctttttctttttccccttattctttttcgaatgggccgccggcccattctcttcctcctccccctccccgctgggccgaccgaaggccacgacccagctgagccggccgcccgagcccctcctctctcccggggtcaccgacaggtggggcccacctgtcgggcccgtctcccacctccagccgcgccgccgcatcccgcaaccgccgccacccctcgctcccacgtctcctaggccacgtcgcccacgtcgccgctcatgcccgccttccccgcgcccactccctctctctcccgcccgcgcccgcgctcgagacggccgggattcaatttttgaatcccgcctctctctcctccccacctctccccactccgccggcaaaatcgcggtcaccccggccacgatcgacccccgcgggcctatataaaggttccccgttccctcctctctctttttcgttttgcaaccatccgttcacgtgccctccatcgccctagcgccgtcgtcctcttttccgccgccgccgacaccgctccggccgccgctaccgtcgcaagccgctgcgccgagccgcgccgtagacgtcgtcgcgttcgccgtcgtgcgggccacctcgtccacccctctcctgtcagattccgccgccggaactcactccgcgccgtgcgccggtgagcactgccatggccgccgccttcggccggcgtcctcgccctcttccattttcctctccatctctaaccccttgcaccgtgttcgctaggtggttccggagcttgtcctgtcgccgtcatcgccctccgtcgcttgccgtcgtcaatcgccgtcggtgagacacctcctcccctctccccttcctctctctctctcccgcgccacttagccgccgcgccaccacctagccgcttagccgccactatcgccgtccgcgccgtcgcaccgccgccgctcatcacgccgccatcggtcgccgccgtctgccgccgccgccccgcgttagcgccgccgtgcgccatggccgccgggccggcttgagccgcccgagcgcgccggccgcgtgctccccgccgccatccgatctaccctcgggtagatcggggccgtcggttcggccgcccgcgtggcgtgccacatggctgccacgtgtgcgccacgtcggcgccacgtggtgcgccgcctccttccccggtccgtggacccggtccaccgtggaccgccacccgagtcactgccatgtggggcccgcatgtcggcgccgtccctcccttgttgacgtcagccctgggatatattgcgcaataaatcaattaaggatttttctgtttaaagtaaaaacacagtgaatcttctaaaattcatatctaattcatccgagcttcgtttaagcctattcaagtcgcagtaaatcaagaaaaatgcatagaatccattaaaaatgattttgttctctgtttcagtagtcttatagcatgtttgtattgtttgctttgtatgtcgcttagattccggctctcctcacgctccggtgtactttgaaatagtcgccgaggttcctccagcagcagagcgaggcaagtcatgcttgtcacttgaacatgttgatcctatattgcaaatgctctatcgttttcctttaaaaactgcatcgttttataatgttactatgggatctttacctactgttacagccatgctatttttgtaccatgctcctttgttagcttggggatataacatgactagatattggactagggattgcttagccatgcttagttcaactaacacacaatggggaaaatacattattgagttgatatcaattctattttaaaataatgttggttaatgccaccgctccggtgttggttaattaaaatatattaaatggtgggttgtgggtgcatggttttgatggtcgcgcccatggcaattaaggaccggttcacgggatgccctggaagaacttatcgtacttaccacaagccattgtgggcaacggctgggcttgtagtgtagctttcctctagatgacgcatccaggcaagggtgggcgtgatggagcgggacgggccctgcgacggcctctgtccttccggattcacctaggcacgagaggggactgcccgttgcccgctggggacgggggtgaaacctgaggtgtggtgtgcttggctagagggggttatgcgaagggtcctgtcacggcctcttttcggtatgtcgtggtggcatgtcagcgcacggtaacatgtcgtggggctgtgtcttgtgggtacagttgtacacctctgatcagagtaaaactattcgaatagccgtgcccgcggttacgggcggtcaaccagattcaccgtgattagtctcacccctagttagctaatgaactggtgtagttcaggtggttggttgggcctgttgcaacgtggtgtagcgttggacagtgattggttaatactgattaattactacaactgttttactgctttgaactaccgtctttaaatgcccgctttatgcaaatgaacctttctagccataccttgattataccctgcatcataccccctattttggtatgacttgctgagtacggtggttgtactcagccttactctattttccccaaaaccccggagtttgagtacgtgtcagatggtggcttctccgaggagtaggcttcgtccgtgccgtcgaggatgcctgtggagtggtgttcccgctgcagttcaagttaaggcttagctccatttatcttttaattttccgctgcatttatgtaagacttttataatgtttgtaagacgttgatctgtatgtcaactttatcgtttgtgtaccccggccggtcctagacgggggttttaatgcacattctgcttggaattctattcgggaatttctgggcgtgacaagttggtatcagagccaaccttgaccgtaggacaatccttttcattgcatgtgttctttgcaattggatttgttccgggaaaattgggatctgttcttgtggttcaagggaaaaatcttggtcgctcatttaatgtgagatttgtcaaattaggtcagtctagggttttagtaaaattatttgaaatttattcgacagtcagtcgggatttgatgggaggaatgcattaggtcctaactcaggaatatgggttgctaggtatttatgctcttattattattattagtatgtatctaatttctcattattttatcgctatgtaagtccgtcttatttattcgctctcatgcaaaaatgatctatttgagttttaattgacaaaattctgctctcatttgttcattttaattgagttttttttactgctttatttaaattggatttgagcatgcattgatcctacccctttgtcttctctagatggccgaccaccaacccaaccaccgcggagacggcatggatgattttgtggctgagttggctcgcatgaccttggtggtgggctaccccaacgcgccggagtactcgaccgttccgccgctcagtggcgagcttccccaccgtgttcgtctggaggttcattgctatttgggcaccagcctcgctaacatggtggttgaggcatctggaggcaccgcagatcacgcctatcaggaggcagcatacctaatgatggccaggcttcgtgatcaccacagctacatcttctgcaacacggcgtaccgtttccaccctcgccgagcaagtggcaacgatatcagcaccttccgcccgacagtcggcgagaacgacaccaccttcggccacatgtgcgccgtgatgaggggaatggacaggatgcactctgacctgcacaaggcatccaaagccttgaatgatgggaagcttgtgaggatcatagctctgaaggatgagatagcacgcctgaagaaggagaacgctcagttgaagggtctcccagcgccaggaggagtccggatccgcaccacgccccgcaagtcgacgactacacccgtacgcattcagcttgcacacagggacccacctcctcccgcagtgtcacgctatgaaaatcgcctattttaaaagcttacaagttaaacactaataacctaggaaaaatttcaacataaaattgagctagataaaatttcattaaatactttgcttgtttatctattttctagatttttctgggaattatttgagcaaggaaagtatttttaataaatgaaacatcatttcgcgaattattttaattggaaaagtttttaaaatcgtctcctaagccgttgggctgatttcagcccaacatctctctccctcgcgcgcgtgctgtgcagcccaagccggcccaagtcgagctgcccttttctttccctgttctgttctcagtccatccgaaagtctaatttgcttccctttgcactgttcattttcaacctcaggacagccgaactgagaccgagtgggctcggtttttcccctccaaatccgacctctcttgtgttttcctaaaattagttgaggggaaattatctcctccttatcctcttcctttcccctaaagtctcggagattaattttgcccggataaaccgaatcgaattcgttttcgagtttatctctccaaactaaccctcggattttccagctcaaatcctctcatttggagtccgatctctctagtccaagcctatataaagcatccccttgtcgtcctcttccgtttgcctcaagtcccaagccgagccgtcgcccgtagcgccgccgccgagtagctctagcgccgccgccgccgacgccgctccatccgcgtggcgccgccgctagcgtcgtcgccgtcgccgtccgtcgccgccaccgggttcgcacggtggaggagcaccccgtccgccccttcgcagctgccaaagaccaccggagcgccgtcgccgtcggggacccgagccgagccgtcgtcggacctcgtcgccggccgtcgttcgtcgtcgtccatcgttgttctttgcacggtgagttcgcgtcgtcgtcctcttcgtgttggtgtcctcggatagcccggccgagctcactatcaccggtggcagcgtcgtccagtgctaggccggcgatgacgtcatcgtgacgtcataaatcctttatttaattcgtaataattttctgtattagatgaaaatcgattaaacttcggaaattcataactaaatcatcgtaactcggattcgagtggttcaagttgctaaattcatctaaaatcgagatctacatgttaaaaatatccacatatactgtttatgcttatttttgtactgttttgttgattttgtttatttgctttagtttccgacgttccggaggagagcgtttacgttgaggaaggttcagaagcgtttgcggaagcttaaggcaagtcacacagatcccaaacaaccctttgagcatgttgaacccgtttaaagctaatgttttatttcaacttatgcattattttcgaatgtcatcgggtggtgagcctttcccaattaattaatggccgaaaatgactttatttttcctatgggttataatttgattagctagaaccttatatattggtttggttcagctaaatgctatatgtataattgcttagccatgcttagaaacattagctcattaatgggatgaatcatactacattattaattatggttatatctaatggtagctcacgatggttaatcttgttatgataattaattgataattaaaagctgattaaaggtgggttgtgagcatatggttttgatggttgtgctcatgacaattaaggaccgattcgcgagctactgttgtgaaacattaatcgtgccaaccacaagccaacgtgggcaacggctttaccttttgtatagcatggttcattacggggtgccagactgtgaagcggcgagaagtccgtaggggtcgctggggagtccattgcctctggttttgagggggagattatgatccaggaatggcgcactgtggtgagttgtgttgtgtgagaggtattgtcacggttcctttccaaggtatcgtggtggtatcgaggcgcatggtaacatattgtggagctgtatcttgtgggtatagtggtacatctctggccagagtaaaactattcgaatagccgtgcccgcgattatgggtgagtttaacaatgtttttcgtgattagtatcgcactactcattaatgataatactgtgataattaatttgactcttggtttggaatggtatattcctggtatggaggtttgatctgtacaaccggggttggttgttcagatgaggttgggcctatgcaacacgggtgtgttgtatagtgtttatttaatattgcttaattactcaactgttttactattctcaaatgtttattaattgttgttgatgcaaataagctatataatgtcatcctttgttatcctatgcacttgcatatttgctgtgtggctttttaagtatgtcatatgctcattcttgcaatattcattcatcagaggaggagtacttcaatgaaggtgatgatcaggaggattaggctttgttcgggtcaagttgcttgtggagtggagtcgccatagctgtttagtcttttgtttttatttccgctgcgtagaattttattctttcgagaggaattgtccacctctgtaataattatttaatttgcgaatattaattaattgtttaatagtactctattatcaatttgttattgtgtgcctcggctgattcctggacgaggatttaacacacatgtaagcgtttggaattttggatagaaattccaggcgtgacacgtagctcctccagcacctcccgcagttcccgcagcgctcgcagctccagctccggttccggctcccgttccagtgtcagctccggcgtccgctctctccttctctccagcgtcagccgccaggggtccagccagtggcaacggaggttggttgcctgctactcccagtggcagccgcgaccacagcagcagcagttccagtagctccgagccggacagcggcaagacgtatctgccagactccaggagccgctcagagggacccggcgacgagcaggaggacgccttctactccaccaaccgcaggagccgttccgagcattaggctcgttttcccttagtttatcgactgcttagtaattgcctgttagtttgtgtgtctaggtttgttcgcttgtgggtcagtcgacggtcgacatcatgtgcctatgatgtggctgtcttaataaggattttgcttgctgttttaagtgttttaattcagatcagaacaattgcagtttaaattcctctataataaagcttagttcctgagcatctgtttttcttcttttccaccccctccgtctgctcttccttcagatggtcaacatcaggaatggcagccgcgcagccggtgagggcagcaatggcgaagagcacaccgacagtggatatcccaacagcgcctctggcaatggtccgccaccgctcccagagaacccgacgcttgcacaagtgatggcccatcagactcagatgatggcggccatgatgcagcagatgctgcagcagcaccagcagatgcaccagaggatgtagcagcaagtcgaacagtagcagcagcagtttggtccccctccccctcagtccaagctgccgaagtttctacgcgtcaggccacccaccttctctagcaccaccaaccccatggaggcgaatgattggtccatgccatagagaagaagctcaatcttctgcagtgcaatgatcagaagaaggtcacctacgccacacaccagctccagggtccctcgtcagcttggtgggacaatcacatggctacccgtccgccaggtacggaggtcacttgggcggagttctgtcgcagcttcaggaaggcacaggtgccagacggggtcgtggcacaaaagaagagagaattctaggcactccaccagggcaacagggcagtaactgagtacctccatgagttcaatcgccaagcgcgatatgcaccggaggatgtccgcactgacgcggagaagcaggagaagttcctagcaggcctggatgacgagctgaccaaccagttgatctctagggattacgctgacttcgagaagctggtagacaaggcaatccgccaggaggatcagcgcaacaaaatggacaggaagagaaaggcagcgcagttccggtccaaccaaggaagtcaccagcgaccgcgcttcactcccggacagcagggtggacctaccaccatgattgtccaccagtatcgcccgttcaactcaagtagcttccaccaggtcgccagtggcagccagaaccacccgggaggtcagcccaaccgcagtgcagctccgcgcccaccaatggccacagcacaggcagctccatcagtccaagccaagaaggagactggagtaaagccagggtcctgcttcaactgtggcgagcatggccactttgctgacaagtgcccgaagctaaggcgtgctgggccaaggtttgcccaagctcgtgtcaaccacgcgtccgcggaagaggcgcaagcagcactagaggtcgtactgggtacgtttcctgtcaactcaatttatgcaacagtacttttcgattctggtgcaacgcattcattcatttcaaagaagtttattggggaacatgggctaataagagaagagcttagtacaccaatacgggttcatacccccgggaatagttccacctcggtttaattcagcccttctgtaacaatagaaatccaaatatcaccatttctagccaacctcgtccttctcgaatccaaagacctagatgtcattcttgggatggattggctgaccaagttcaagggtatcattgattgtgcgaatcgcacggtcaccttgaccaatgagagaggggaaacagtggtgtacaagtcaccagtcgcactgaagcagggaatctccttaaatcagattgaggtggagaattcggtggtcaccgcggagaaaagttcgaggaaattggaagatatccccatagtctgcgagtattcagaggtgttccctgaggacctcactaccatgccacccaagagagagattgaattccggattgatttggcaccggggactgctccaatttacaagagaccgtacagaatggcagccaatgagctggcagaggtcaagaagcaggttgatgagcaactgcagaaagggtacattcgaccaagtacttcaccttggggtgctccggtcatttttgtggagaagaaggacaagacgaagagaatgtgcgtcgattatcgcgcactcaatgaggtcacaatcaagaacaaataccctttgccacggattgatgatctgtttgatcagctgaaaggagccaaggtgttttccaaaatagacctacgatcaggttaccaccagttgaggattcgggaagaggatattcccaagacagctttcaccactcggtatgggttgtatgagtgcacggttatgtcttttgg

SEQ ID NO: 66130 - DNA, 7923 bp, Oryza sativa
ccttaaaaatctggaggcattacctgattggcgatcgctgtgaagtatatacggaacacaagagtttgaaatatatcttcacccaacctgacctgaatctccgacagcgaagatggttggagttaatcaaagattatgacatgagcattcactaccatccgggcaaagccaatgtggtggcagatgcattgagcaggaagagctactgcaatgctttgtgcactgagggcatgtgtaaggaattgcagcaggagcttaaacatctcaacttgggaatcgtagaacacgggtttgtggctgctctagaggcacggcctacgctcgtggatcaagtcagagcagctcatgtaaatatcctgagatagctgaactgaaaaagaatatgagggtcggaaaagcccgggatttccacgaagatgaacatggcacaatctggttgggagaaagattgtgcgtacctgatgacaaagagctgaaagatctgatactcaccgaggctcaccagactcagtactccattcatccaggtagtaccaagatgtaccaagatctcaaagagaaattttggtgggccagtatgagaagagaaatcgctgaattcgtcgcactctgcgatgtttgtcagcgagtcaaagcagaacataagaggcccgcaggactgcttcaacctcttcagatcccggaatggaaatgggaagagattgggatggatttcatcacaggtttgcccaggacatcatctagccacgattcaatttgggtagtcatggatcgactcaccaaagttgctcatttcataccagtgcacgctacttatacaggcaaaaggttggtagagctctatctctcaagaatcatgtgtttggatggagtacccaaaaagatagtatctgatcgagggaggtagttcacctcaaaattttggcagaagttgcaagaagaattgggtacccgtttgaatttcagcacagcttaccatccgttgacagatggccagaccgagagcgtcaatcagattttggaggatatgttgcgagcctgtgcgcttgattttggaggagcttgggataaaagtctgccttatgcggagttctcctacaacaacaattaccaggctagtctgcaaatggcaccgttcgaagcgttgtatggccggaagtgccgcacacctctcttctgggatcaaacaggcaaacgtcaactgtttggaacagaagtgctaacggaagcagaggagaaagtcagaaccatcagagagaggctgagaattgcacaatctcgacagaagagctacgcagacaaccgccgaagggagctcacttttgaagcaggggattatgtgtaccttcgtgttactccgctccggggagtacaccgtttctagatgaaaggcaagttggcaccacgcttcgtgggaccatacaaaatttttgaacgaagaggagaagttgcctatcagctagaacttccatccaacatggtcggtatccatgacgtattccacgtgtcccagttaaagaagtgtttgacggtacccgaagaacaagccgattcggaacacattgacattcaagaagatctgacatatgtggagaagccagttcacatccttgagaccagtgaaaggaggactaggaacaaggtcaccaggttctgcagggttcagtggagccaccactcagaagaagaagcaacctgggaaaaggaagatgagttgaaggccgcccatccgcacctcttcaccagctcttccgaatctcggggtcgagattccgtttaagggggtaggtttgtcacaccctgaagttcttctcccaagccaaaattgaatttacaattggtctcgagaaaataccggtgtaaaagcaagagtgaaaccctaaataaattaatgcaaataataatcggaattggcatgtggagtttttcttgagttctacatgtcgaaatgtgctaacaagatttttagtggaattttcagagctctagaaataattttaaccaattaaaaatgagcacaagcaatatttaatcccaggaaaattcatttcctcctttttctttttctttttcgaatgggccgccggcccattctcttcctcctccccatccctgctaggccggccgaaggccacggcccagctaagccggccgcccgagcccctcctctctcccggggtcgccgacaggtggggcccacctatcgggcccgtctcccacctccaatcagtgccgccgcccctcgctcctacgtctcccgggccacatcgcccacgtcgctgctcgcgcccgccttccccgcgcccactccctctctctccctcccgcgcccgcactcgagacggccgggattcaatttttgaatcccacctctctctcctccccacctctccccactccgctggcgaaatcgcggtcaccccggccacgatcgacccctgtgggcctatataaaggttccccattccctcctctctttttcgttttgcaaccatccgttcccgtgccctccatagccctagcaccgtcgccctcttttccgccgccgccgccaccgctctggccgccgctagccgtctctagccgctgcaccgagccacgccgtagacgccatcgcgttcgccgtcgtgcgggccaccctatccacccctctcctgtcggattccgccgctggaacccactccgcgccgtgcgccaccgccatggccgccgccttcggccggcgtcctcgcctcttccatcttcctctccctctctaacccctttcaccgtgttcgctaggtggttcaggagctcgtcccgtcgccggcatcgccatctgtcgctcgccgtcgtcaatcgccgtcggtgagacacctcctccccttcctctctctctctctctctctctctcccgcaccgcttagccgctgcgccgccgcctagccacttagccgccgctagcgccgcccgcgctgtcgcgccgccgccgctagccgtcggtcgccgtcgtctgccaccgccgccccgcggtagcgccgccgtgcgccatggccgccgggccggcttgagccgcccgtgcgcgccgaacgtgcgctcccctccgccatctgatctaccctcgggtagatcggggccgtcggttcggccacccgcgtggcgtgccacgtggccgccacgtgtgcgccacgtcggcgccacgtcagcgccacgtggtgcgctgcctccttccgcggtccgtggacccggtccaccgcggaccgccacccgagtcactgccatgtggggcccgcatgttggcgccgcccccctttgttgacgtcagccctgggatatattgcgcaataaatcaattaaggattttttctgtttgtagtaaaaacacagtgaatcttctaaaattcatatctaattcatccgagctccgtttaagcccattcaagtctcagtaaatcaagaaaaatgcatagaatccattaaaaatgattttgttctctgtttcagtagtcttatagcatgtttgtattgtttgctttgtatgtcgcttagattccggctctcctcacgctccggtgtactttgaaatagtcgccgaggttcctccagcagcagagcgaggcaagtcatgcttgtcacttgaacatgttgatcctatattgcaaatgctctatcgttttcctttaaaaactgcatcgttttataatgttactatgggatctttacctactgttacagccatgctatttctgtaccatgctcctttgttagcttggggatataacatgactagatattggactagggattacttagccatgcttagttcaactaacacacaatggggaaaatacattattgagttgatatcagattctagtaataatgttggttaatgccaccgctccggtgttggttaattaaaatatattaaatggtgggttgtgggtgcatggttttgatggtcgcgcccatagcaattaaggaccggttcgcgggatgccctagaagaacttatcgtacttaccacaagccattgtgggcaacggctgggcttgtagtgtagctttcctctagttgacgcatacaggcaagggtgggcatgatggagcgggacgggccctgcgacggcctctgtcgcttccggattcacctaggcacgagaggggactgcccgttgcccgctggggatgggggtgaaacctgaggtgtggtgtgcttggctagagggggttatgtgaagggtcctgtcacggcctctttccggtatgtcgtggtggcatgtcagtgcacggtaacatgtcgtggggctgtgtcttgtgggtacagttgtacacctctgatcagagtaaaactattcgaatagccgtgcccgcggttacgggcggtcaaccagattcaccgtgattagtctcacccctagttagctaatgaactggtgtagttcaggtggttggttgggcttgttgcaacgtggtgtagcgttggacagtgattggttaatactgattaattactacaactgttttactgctttgaactaccgtctttaaatgcccgctttatgcaaatgaacctttctagccataccttgattataccctgcatcataccccctattccggtatgacttgctgagtacggtggttgtactcagccttactctattttccccaaaaccccagagtttgagtacatgtcagatggtggcttctccgaggagtaggcttcgtccgtgccgtcgaggatgcctgtggagtggcgttcccgctgcagttcaagtcaaggcttagctccatttatcttttaattttccgctgcatttatgtaagacttttataatgtttgtaagacgtggatctgtatgtcaactttgtcgtttgtgtaccccggctggtcctggatgggggttttaatgcacattctgcttagaattctattcgggaatttctgggcatgacagcaactatagccacgaagggcaattttttccattaccatgtacaggtaaatggtctatgatactcgagtataattatgattataattctaaaccctgattgagatgacgtgtaatggataaggcttaactcggtgctcagtctagtcctgaataaaaggacacggatagagatggatgaagtcgttgcgacgatggatatctctgaggcaaatgaaagctacacgagctacggctcggcagtcgagatgtctaggcaaatgaaggctacacgggccggtgtccgttagtcgagatgccatggcactggactagtacgcgggtggtctcacccctatgtgtgtggcgcacccggtctaggtcctgttgctaggggctcaatcctaacctgcctgtctcgggataccggccgtaggcagggttgggtcggttcttttgttcatggctaggatgggtgaagggttattgtgggtatttcttaacgacattgctggaaatataattcccaacaatggcgcagaaatacttctggtatattatgtttacagagttcatccgcaagcgcacggatataccattatagcatttcacccaagagtattccaagggtatcgtatttattttatcctgtgggaagatcatgtagagagagcttgactaataatttatatattacttgtgataatcatattctaaacaggggttaagataatccaaggatagagtaacagacaagcatgaactactcattctcataataactcatctaagctaagtggaaagaaaagagaaaggaaatctattcctatacttctattatacatagtatacatatattctagttaactgatatactagctaataccctatatccgatgccctcttggtacttcgagaagccacccctgactgccgagttccttacgacagcccgtcatgaccattcaaccggggctaaatacggaggaataccctccccaggaaattaacttaggattatataccggcgcggaggaatacctgtactgagctgtcaccatcagcggcccacctctcatctgcaatatataacctcaaataatgatatcccgtaatctagacaccacgtctaaactaccagatactactctaatatcatcgtcatgagatagagtaattgcataagcaaacattatacccgcaccaaagcatctcccaaataagctagccgtatattcagtgtaacatgaacataatgtaaaattggcattcatatactcggaaagtgtttcaataccataaatgtataaagaagagtattctaataaaagtacaatgcttacaaaagaaaagagaagagctcttccgaaggcttccggacttgatttctactctattcctattccaccagctagatactactaaactaaacttgacagaaatgagaaagctattgcttgaggtctatgagtgaagtgagaatggcaactccttatatagcctcacaatgacggttgtgacggttggaatggtcggaaataccctccaaccgtcattgggggctaatccacaccgtccaggcgaagccttggatcggatggcgctgaggagggttcggccgaacctggggtcggcccaatccagcccaatttcggcaggcggcctcctctgttgcttctattcgctgacttgtcaattttggcccaattcttcgtatcaattctgagttcttggcctattcatacgtaagtctggttctcgacatcgtccgattgatttgtcatctatgttgatgtcgattctcctccactttattgtcattctctgcaaaaggttaatatacctaatactagtggaagtttattattctaacagatatatgcattgcaaacatcactagttctcctctattttagtaatattgacggttgaaactgatcgataacgaccgtcaacaaaaccccccaagcttgaacctttgctcgtcccgagtgaaggacgaaaggaaacaaagacttggttgttgatcatgagttgctactatgctgcatatctcaaagatataggtgcaaggtatatgtactctctctcggattaaataatctttggcacgatggcttacccttacccctgattcccacgagacactgcttctccttgtcttgggtggttgaaagacagaacagcaatttagagtaccaatcacccaatctttatttaactctcattccggaagttttcaatgattttgctaaagaaagccaagtttctcaaatgattcgctcagtctgtctaagtgtatcaatatgaattcctcaccaaatgttgcctttttgattcctactctaaggtttggtatgtggagctcggtagggatcaaacatggcatacttgcattcacatttattactaagtcaaaaacttagactaaagcagataactaaacatactcaagatcaagatcgtgcaaaatgtgtgtgtagtatatggtggaaatggtatatgaggaaagataaaagaaaaatgcttcccctttgtgcttactttcttctcccaaaatccttcttttattgattaggagagagcatagctacatatttttttttaacatcatgctcatgcttgatggagcataactttattttttttatattttttcatgaccatgcctttccctccttttctttctcttttttttttcaaaaggacttttctctttaggggaagaaagcacatgaaagcatggagaatttattttggtggtaatatggaaatggaatggaatattgcttagctcccagtgtaggagtttagcatgtgcatatatgtgggtgtatgatcttgatcatagagcatgagaagtaactacacaagtcacaagagtttgacaaagttcattggaatgacaagtaaccaaaatgtatatggtttaatcatgatagcatattttttggctctggtaggaatttatatcaaatgaggaactttcaattttatcattttgaaaa

SEQ ID NO: 66131 - DNA, 6522 bp, Oryza sativa
cccccaagcttggctttcgctcagggtccttgatgcggattgaacccctgaaaacgaaagtacgcctgaaggtcatcgtgttgttgctgcatcatattgttgatgttggcgaactgagcatcagcagattgttgccattcttacgtttgagctatgtgttccgtgaagttgtactggatctcccctgtctgcatatcaagggtgtccattctcctagtgatttcacctaagtcccaacaagaggaactcgagcgccattcacttggagatggaggcacaccacttgatctgggaggttgattgtccccccattggatgtcatgaggcgcatgccaccggtcctcactggcacttgcccaggttgagactccaatgctatggcgtggagcttgggtccatccgggtgcatccccggttggtgcccaacctgcctcatacatctgcacgggtgtcaaggatgatgaactttctcgtttcatcattgtcatgttgcgcgtctccctgtatgttccacctgcacgaggtttttctatggtctacaggggaatggttagttcatggcagttgtacaaatgataccccgcatttggcaatgggatttcatttgtacaaccggggaaaaagtataccaaagatccatctattccatgtttcagaatatgcccttgcactagataagcctcatcaatacgcggacgagcagctgagataaaaataatttggtcgctaatgacacctagcccttttgctatccgagtaatcagagaagtgcactcaacaggagcagagaactttatactttctaaccattgtcttatcatacatttcacaggaacaattttgatctttctaaccatgatgataatcaattcatctcccctaatgggtctcatatcacctctaagaaacaaagtcatagcaatcaatttgtgcatgagtctaattgtaggattatggatatcatttgttctagatttcttgcaaattggagcaccagaaatatcttcccaaaacctatttgtctcgaacctagaaattcctttctggagatcgattttacatgaatcgtgaaaaccaagaagtgtacttaagcctttccatgtaagtgtgaactccttatggaaaaacaaaacgaaataccatattctatttctttcaaagtgcacagaaattgcaaagtaagcaaacgagaaccaggctcatctaccacagcaaatctctgccaaccaaccgctttccaaatagaacgaaattcaacatccatacctatctttttcagcagctccggtgcgtgtcagcatactcccggtcgctcagcatatagtagacttgtctctcccgatcactgacaaggtcgaggtcggtgtcgttcaggagtcgtcgcggaacttcggcatcctccatcgaaacatcagctgatgaacgagtactagactcgtcatgatgacttgatgaagagccggatcccttgaatagacgagacagtcgcctcctcattctgtacaatgaagcaagaacggactaactcgacgggggttaggaatgacaagagtttcacccgccagttagtttcaccaaagcaacttgtataaatgcaactaagtgatttgaatttgagggaaactatcaaagcttgaatgagcttgagagcaaactttggagagggaatgaaaatgtgttgaaatggggtacagtcccctctcccggccggttaacatacccgaattctaggattaagaaatttccatcaaaactagttgaaaggaaagttcttcaattttgtgaaccaaaaatttccattttaaatctaggtgaagttgatctaactcttgcgtgaataaaattttagaataaattaaaactttttcatcttcaacctaggactagatgcaactcaagtgaaagcatggatacttgcataaaacatgttttgacttgagtctttcttgtgcatttagatttttggttggcattgcatactaggactcatgagcataaataaaagataaagtttcactaatcaaacctacaaccacacttgagcaataattataaagacatgaaaatgaggttaaatagtatcactatagattaagagtagtctaaataaatttcttacaactatttagatgcatctaagatttggaaatgtccatataaagaaaagaccttgctaattatctaaaataattcgtgcaagataaaattatggaaaaattcatgtaggctctacttaatacatgcaactcactgtaattttggtataatttaataactaaatttgatacctaaaataaatcggtcaaaccagtcaaacagtaggttaattataatccttaatcggctaaaaacctaccctcaataaatgtgcattaaactgcatgaaagtgtatagggaaataatttattcaaatattaggttaattatcatgaataaatataatttttgcagaatttatcttctcttctaagcctcttaaaaattcaaactggtttccaatgagtctatcttctcctaattttttgaacaatctatccataattttttagtacaaccaaataaaatggaaactaggtacattcatctgcctccaataaaatccatgtgaactcatatgcaataaaaattaatctataaattaacaaagaagggagaagaaataaaatcaagaaaaattcctggaatttgcctgagacctgtgtcggctgtgcccacctgcttctggacccaaacttctcatcctcacctaatttgctccgacctgggcccacttgacggtgtcacaagctagctccaactctgtgcataacttttccaccaatctaaagacccacaatgaacgagagagagtgatcggctctgggcgtgcgcgacgcgtggccgagacgtggcaacgccgagccgagcctccttctcttcccagccacatcgcccatcctcactcctcactccagtgccgaccaaaccgagagaacaagctctagctgctttcctcgccttcgatctcaccgccggctgtgatgaagacgacgctcgtcctcgcctacgagtcttcgccaaccctatctcttccacgttccatactcacctcaccatacggaaaatttctccttttgatttcatcctctctcgtgcagcggatcgacgggaacgccgacgtgccctcaagagctccagagcgcgctccaaacgtcgctgtggtggcatcgtcgccgtcgccaccgatctggaccaagccgggccatgccatcgcgccatcgtcttcgcctcgtactcctctccatttcccctcaagaaccacgaagaatggtgctacgagtgtggagatcggccaccgtcttcttcacctccggttgccgtcgccattgtcgtttccgcctcctccggtgagccattgctcgattactcgcgcacacaccatctctctggcctcactaacctcatggacacatttgcacgatagttcttggtgccgattgagccgtcgccgttcacccgggaggttcttgccgtcgccaagccgttctgcaagccaccgctgccgccaagaccacggcaaccttcgctagactcatggcgagcattcttgaggctttagtgtcgcattcatgcactttattcatctagatccagcccctaaagtcacatgcaccaccacccgaaaccatctttcgctcggacccgccgccggcgctactccgatgtccactaatcgagaaaagtagaggaatggaatcgtgagagagttctcttcattttatatttttacctcaaccccaaacgagccaccaatcgcctccggtgaacctgagatcgagctcagccatggctgctctgcctctgtagaagacgaggacctcattttgagaatttaaacaactataaggtttattgtacaatctttccactcaatgacatatatatgggcctaggactgcggattgattcttaaaaactgtaagggtctttctgcatattcgcaaatcactgacagtggaccccctggagataaaatctgagactatacaagagagaaacctagaacttgtaaaatccatataaaatcaaataaagcttattttgagatgattcaaatttctttgaactcactagattatgaactttaaagttatgaaataaaaacttgcactcacagtacaaatttagcctctaaaattcatctaagataaatcatacataaagcatatacaaatttataaaatgcatacaaaatacatttcaactcattttagagcaaacttagtttctaaagatccaccaacatgttctctaaaaacaaagtgaaataaaacatatacacactttacatcaaatgcctctaaaactattacctttaaaatgactagttttagattagctgaactttagaagtttatataaaattcatctcagatcctttttgagtaaacacaagttctatagcatcatagagctatgcacttcaatgttatgtatattaatataaaaagtacgagttcatccataattctgcaatccttcgcgtgggacccacctggtcatctggcccaaagaaacagcaccatatctcgcgcacgaaaaaaaggaaactactcatacgaaaaaaaaagaacgggaaaaaaaaagaacgggaacacgatctaacctctgcaatccccacgccgccgcctcctcattccttcccgaaccgtcgcacatcgacgctccgccgctcctccatcccctcccgctccatcgcgccgccgcaacgccagattcatcgccgcctcatcggcgctgagagcgagggtatcgttgcccctcccctccccatcagtcgccgcgccaccgccccatcgatctccgcccggccgccaccaatctcgcagcgccaacagtcgccgggtccccgtcgccacgcgcagctgtcgttgaagcgagcgccgtcgcatcgatctcctccgcccctctctatcagtcgtcgtgccgtcgaagccatcttcaccgacgctggctcgattgaggcacagcccttgctgaccgacagcgtcgcccgccgctgacatcttcaccatcaccgacctcctccttcggaacccccaaaatttccggggccccaaaccccctttttccgggggttttccccaaaatttggggggtggggtctctgtgtccgcccgttggatcaccaccaccgtgagttcggagtttgtttgtttttagggctgttcactttaatgccattttcaaccttaccaatttttggtaaagtttacaaaaaaaaaagtagctacatttattttgctgccaaattttagtaactatataagaaattctaccaaaattttggtaaattttggcaaattttggtaactatgccaaaattttgttttggcatcaaagtgaacaggccctttcctttgttttcgtctgctcaggtgaccagctcttcaaacgcttcctattgctatatctgtgacatattgattggtttgggctttaataaacaaatgcaggcaaagaaaactctggatttttctggtgcgtgtgaggattgctttggcaagagctttgtttatgaatccaaccatccttttgcttgatgagccaacaaaccatcttggtgagtcttctaaaggaaatctaagggaaatatgataactttaggaaaatatgatgactttgattattcaatttgatttaatcgacatataaaatgggatcttaatgtactgctgctccctcttgcctttgttatgagcttcttttcacatatggatctatcagtactctaagtattataaaatcagttctaatccatgtggggtattacatgggtagatatggcatgacggaagacgtggatgtggctctggcggtcgattgggtggcaacgaggatgaaccacagctgcgactgcgcccatgcacaaccacaaccaactagctaaggtacaactacaagtcctgcgagcaactaaccaccatgacgcaattccgtttgggcggtgctccatgtggctttccagtagatttgatccccaaattgatatgatgtagcatcaaatgctgtgaatacactttgtgagttttgcctttgatcaagacgaactcctgattatagcgtcctaagccccacatggtgcgtgtcggcatccctttgtcaatttctaggccaaaaattggtgaaaggtttgtcaagtggtctacttttgattggaagcgtggctacttaattacttatatcaatgttgtttatgtatgactgatgctctacagatacagtttgtgttatctaatataactattttttttcttttattttggatagatgtggaaatgaagcttagtaatttttatatttttgttctgtgaaggaaatagaaataatacatgttgtttttcacgatcattttgcattgaaactgaaataaactgacgacatcctttgtttacatcagacgacatctttctaaaagattatttgtttatgttgttattgcacttgtcatacatgttagactaaaatcaggcctcaaattt

SEQ ID NO: 66132 - DNA, 1548 bp, Oryza sativa
atttatggtttggtagggaacaactgtattgttccgcgtgaggggacgactgcaatgttccgcctcatgtacaacgttgagtgccacataggaagcgactgtaccggcttgcctatggcgttatattggtaaagaccccccccccccccaatataatgacattaagattctagacttagtgtggaacaacactcatcgtgctcatgcaaggattggacaagacttaatgtaaaagcctcgttgtgacctctagacgcactcaatgtgtgtagagtatggtggtaccgacgggtaccggataaactagagcgattcacatcatgtgggtaaatctgtacaaactctgcagagtctaaaaactaatcgattagccgtgctcgtggttacgagcggcatgtggatatgtattgagtatagtcttgtgtttattcttctaaatgctgaaatttaccttcaaattatattgagatttgagaatgatctccttgctgccatggatggcaatgaggtgaatatttatacatgattaatgcctactttaatgcccatatgctaagtactagcttgctgaaatttatttgaaagcaaatctgacttagaaatgttttatgcaaacaaaacttgctttatgctaaaaagaaccatattatgcctttcttgattatatgccttgcaagtagggtgttaggcttgtcttggtgcttgccagtatattatttctattaatgtactgactcttgctcttgaattaaccttttgcttgcaggttttagatttagtccttgagtgatgcgggtatcgtctgcttcttctaggacttgaacttaatggggtaaacccctagtcggtatgcttctggattgggtagacaagcttccgttgttctatatatttatttggctactagagccatacctgaactcttccgaagacttccggactcttgatttctactctattcctattccaccagctagatactactaaactaaacttgacagaaatgagaaagctattgcttgagatctgtgagtgaagtgagaatggcaactccttatatagcctcacaatgacggttgtgacggttggaatggtcggaaataccctctaaccgtcattgggggctaatccataccgtccaggcgaagccctggatcggatggcgctgaggagggttcggctgaactccctggttcggccgaacctggggccggcccaatccagcccaatttcggctagcggcctcctctgttgcttctattcgctgacttgtgaattttggcccaattctttgtatcaattctgagttcttggcccattcatacataagtctggttctcgacatcgtccgattgatttgtcgtctgtgttgatgtcgattctcctccactttattgtcattctctgcaaaaggttagtatacataatactagtggaaatttattattctaacatatatatgcattgcaagcatcactagttcccctctattttagtaatattgacggtcaaaactgatcgataacgaccgtcaagggctgcaggaat

SEQ ID NO: 66133 - DNA, 1240 bp, Oryza sativa
  unsure (1)..(1240): unsure at all n locations
ttttatttgaatgtaatttgctcaatgatttatgtggttaaagaaaaatatctaggggggggggccccccccaaaatttgggttttttttttgggggttttttttttncctttccaggaaagtccaggagttggagccatgcaaacatgcatcatgctaatgtcgtcctgagcttccagattaggccctgctgtattgatcaatatattcaggtcagttgaggctctaaattaattctgatgataatttttattctgctgtatttgacgggcctcatgcatctgaagatctggattactgtggccgaattcgtgttctgattttggggtgtaaaatactgaaatcaataccgctgtccttgctttcatggggggtatttggtgatttggttacttcgattacatcgagttggaatgtcaatgctctctgaacctcgaatttattactgggttaccgcattagattattggcttcgcaagctgggccttgtgcaaatgatcctgcgtgaaatatgcacataatttgcttccccagacgagtttctgctaactattctatagatcatttgcataacccagcagccagctgtttctctcttcttccttttttcccctctgaacatgtttacttaggtcaatttccagacattgaaatgtcttgcaagattaaaattcaaggttactccgctcattctgttttgagagagttcaaggctagaagagtaaagttagtaagcaaataaaaatgatgcaaagaatatacttgatcagagctaagaatgctctcataagtcataagtctgaactcccagaaataaaacgtcaagctcttcgaaacatgatatatgccatttaaaccttaagtgcccctttcagttttaagagtagaagccatgtcttcttggatttcttttgattttctgccaaatggatcgtctcctttctagagatctaaaatagacttgcacaaaagcatgttgtgtatgctccccaattcttctccttcaactacacaaaaacacagaagataagcttattaatgaagagcggagtgtgcctgtttaaattttacctggaactaatatgaaatgaaataagcagcaataaaacgtgacagggatttatcattgcattgaaatgctacctcacagtgttacatgattatgatgtttctttcttctttcttttccttttggcatgataaaatgaaaacaggatagaagttggtttaattatgaaaa

SEQ ID NO: 66134 - DNA, 3086 bp, Oryza sativa
caactactaggtagtggcagctcatgatatcacacatgctcaggcttttaaccaaactcttacaagttcttaccaaagcaagcggaatggtgatatacaccaactcaaccaagcaccccgatagaggttggatgtatcgatgccttggccaaacacttgctatacggctgcaatctattctatggagctctgggtaggcttaaatacgtagcaaaggaatagcaaatgctcaaataagagaatgcaaagttgaataattgttcaaagtcaagcaccgtgctggtcctaggctagaacgtgctagagacgcgatcctagacacaaacaataccacaagataacaccagaaacaactcaagcacactctgatatattaaattcagctcaaagatacaactatttttttcttcttttccttctttctttctttctttcttttttttctcttttctttctttcttctctgtatttttggtgcagcttttctttttttttcttttttttatgcacctttctgccttttctctccttttttaaattttttttaacaaaacggcttaaggacctcaatgcaaaattacagggactcaaacataaatatgaaaattacagggactcgattgtaaaagtccacaccaaaatttaaaattatacaaaaatggaattcacaaattatctcggttatgtttttccaaacagatctcaaaaccgacataaaacagaatttctcaaattatttgacacgactcagaactgagagataacgtgatttggagagggaggagggagtccgactaataagtctgggcagagaggtgcgactgggcatgtgtgggacttggactcaatggaaaccggaaacacggtttggaaactgtgcgctaaaacaagaaatcaaccgttctccaaatatccaatctaatataatcttctccttccatctttctcacccgcacatcacaggcgcatcatcacggatacaaccacgcaacagaaaacctagatacaactcaacaactccaaaaccgaccgacagaaacttctaaagctagaaaaatgaaaccgtggcagcgagccgattccgtttccgtaggtcccgaagacaacaagaacacggcggcggcgataacagtggaacaaaacgtgaccagaactcgaaactctaaatgaactagacgctaagaccagcaacacgacgtgacgatgcaacgcaaaattcaacaaagcaaaaactgaaaagaacaatgcaatggcacaatatggctaggtaaatgataaaaaaaaattgtatggctattttctggttatgggtagataaaaactcaccgagcaacgaaagctctgataccacctgatgaaccctgagctccactcgagacactcaaggctgttgttggcccaatctttcggtgagttgatgataactatgatttggaagaaacgttgacgacccgactacaaccgtacgagatgttgttgtgttgcgtcttagcgatcgatacacctctctgtgggttgttgatcttgccggtgcagatcaaccttattcctgcaagcaaatcgaagaaacaagcaagaacaagataaaagcaatctgaattgcagataggaattgaacacaaatgataagttggggttccgtaacgagtaaaccggcgatctaatcgatcacgggattacacggcaaagtagcaaagctaacctttaatctaaacaaaacccaagaaactctaaaggggtacgtagctaattataatggtggaaggatgaccaaaggaaccctagggtcatgttccacctagttggggcgcaccccacatgggccccacttgggccgaggtccctaacgaagttacatgcccataggcccatgacaagtgacgtagcaccttgtttctttgattgcggccaactgagactgagtttggtaatgaggctggatccgttggaaacaggactcctagacctttccatcaagtattaacgggcccaaaacggagttcgtatgcaaatttggcggctgtttgaagtcagcattgtagcaggtggccgaatcagattccagcacttggaggacttgatcttgatatcatcttgttcatccatgatgtgagcaatggttgtatctatagtagccatggtcacatcaccgttggactatacaaaatgcctacagtattccctcctatttggcaaggaatggtatgaggagaagtattaacccgaattactttagaagagaactccttctctttcaaccattcgttgctcatgattgtggttaactccccaacggttactccaagatattcatcttcgattggatcgggaggtggagtaagaatatgtggcttctttttgttgaaataattcagggtgtttccataatcttcatgaaaatcgtccctgaagtcaggagcacatcctggagttcgaatttctttgctctccggtgttgatggcttgggagaggattctttaattgaatctacagatatggaaaggtcagactcaggttcgactaaagatgggtcctcacgacttgacacagatgccttttggaggggttcagaatatttctcaacaaaggaagtattttccaagattcgatctaggatttccgtgccttcagatggggtgttatgaaaaaacgactctccagcagtgatgttaagatggaatgcagactccttatctaagcctgtatgaaaatgttgtaacaacacataatcgggtatagacaagttaggcgtagattgtactaataaagtaaatctggcccaagctattgattgattctttttcaatctgccgaaaactgaggatatgtacctgaagagatgtaatatgggttacatggaagaaggcgaggcataacctatctcacaacataatctagttaccgtttacattcccaacgatgtatgtgtaccattgcttcgctccctcttaaagagagaaccgaatcaatttctaccgtatgatttcttgtgtcatgtcttgaatcatgaggcatgaacacaattcctcaaactctcgcagatgatggtagggattctcttgatctaagccagggctgcaggaat

SEQ ID NO: 66135 - DNA, 10832 bp, Oryza sativa
cacccctaggagctgataattgatagataggtttgtgctccatggtagagaagtgtttacaggaaggcttctctaaaggtatccgggtagaggtagaagaaagaaaattaaaaagatacgataatgaacaaggttcggagataaacaacaaccgttcctcggcaacggcgccagaaatgcttgttggtatttcttacagtcacagataaaatctgcaagcacacggatataccgctgtagcacttcaccctgaagtattccaaggtattgaatttccacagggaacgcgtgtgcttaactcttctccaggttcatccaaggacacaaggcataaataggcaaaggggtagagaggatttgctagtgaggaacaaggtcttaagaaagcttaagtttaatcctatcgtaataatttaggcactggcttgctcgcttttaccaaatcacgctctactccatacctggacagggagaactatagagatctcgagggctgtcaccacttgtaataccttgtatattaaaagatatttaggtttttagtttgggttgcttgttaaaataaagatgttaatagaaataaataaaagagcagtttccatgtaagtgagccaactcagcttgggtctaggcccacgagcccaacccactcccttgcccatatgtaaaaaccctggaggaaggagggttggaggaaaccgaaccctagctccccagcctccaatggcgcccccttcctcccctcctcctgtgcgtgagttcgcatctctctcccctctacaacaaattgccctcatagatctcaaatctaataacctggatcaagaagtgaagtggaaaaaaggaacgaggagaaggagaggagtaaaaggaggggttagaatggagtctcccctattgtctcctcacaagttcttatgttttttaaaagaaagcactctggaggaggcacgggacatttactatttgccatccttccaaatgtcatatatccaaatgccactccctcgaaatttcatatgcccatataccacttcctcaaaatttcattttcatttaccatctggtccccactaaaactctcccgtgtgccactattttcatttttcttgtccatatgatgttactttttttgttttcaccactatttgatatggaagatgtggcaaaaagacctaaatgtcattggggtttggccccattgaaaatgttctcccttccactccctgacatttaacaaagcaaacagcaagagggagagggagagagagagacggacaacgacatgagcctcagccacttaattgacgctaatgcgtcctctcggcgacgctgcaccaccactccgcctgtaacgccccaattttcgattgggattaaaaatcattaaataatgtattccagaaattatattaaaagttaaagcaatttaatcaagtgaattattgaggaaattaaaatttcctttaaaaatcatggccggaaacatttttgtaatattctctgtgccctaatgtactctttggaatttctcgtgaattttcggagctcaagaagtaatttaaaatcacaaagttcaattaatcaattaaattaaatggaaaaccaattaaaaatcccctccttcacttttcactttgggcctcttccggcccaaagtcctgcttttcctccctcgtggctcatcccgtcctccttccttccctccttcctttcgggccgacctctctaccttggcccctgtctcccaagtctattttttctccctcctccctcctctccccgagccatcaacaggtggggcccacctatcggggtcatcccctacctccggccggtcccaaccgccgccatgccgccccattccgccgctaaatccgccaccactcgcccccattcccgagtccaaacggcgtggacgcggtctgccccacgtcctccacctccttccctattttccccaattttcggcgacggaatcgagcccacctcctccacgtcagcacccccactttgccggccgttgccggttgattccgccccgatcggccacgatctccgcatccgaagctataaaatctctccccgcgctcccctcgtatgtttcccctcctccccaagctcctcgcgccccctcccgctctcttcacggcgagtccgtgcgccgccgcttgccggagctctctagccagcttcttcgccggcttcttcgcaccccgaccttcgctctattttcccccaccaccaccgaaacgctgcttccactgccaaaccgagccgccactgccatccgccgcccccgcccgacaaccacctgcgccctagccaccgccgcgccacgccgctagcaccaccggctgccccgccgcaagggcaagcccggctgttgcctcttttcccccaacccgccgccgaaaccaccaccctaaagcaaacccgaaacactgccgcctccactgcctctagccgccgtttgccatcaccacggccaccgctgcgacgcgccgcccgcatcgctggcctcgccgcatcacgcgcttccctggccgccacccagtcgcctccgtccaccaacaggagcgtcatttacaccgtcgtcccacgggcgccgccgccatatccactgtgggacctccctgtgctgctgctcgctgccatcgggcgctcggtgagctccgctgcccccctctttccctcctcgcttccctctactgcctcccgcgcctgccgccacgctggtggtcgccgcctcccggtcggtcggccggctgacgcctctcctgctcacccgtggccgctcgattcacctcgatgaatctgggccgtccacgttgcttgccagtgctgccccggtcggtaccgtcgtggcgccacgtgggcgccacctcctcccggctaggctgccctggccaccacgtggctgccacgtggtgcgcccgcgcctattccacgcgtggacccggtccaccgtgcgcccgccaccttgagtcactgacgggtgggggccgcttgtcggcgccaccccttcccctcggctctcgccataactaatattaattgcgcaataaatttggtttaaattctaagaaattcatttaaatggcttaaaacttttaaaattcataactaattcatatgaactccaaattgggccattcaacttgcaaaattcatctaaaattaagctctacacattttttaactttttatgtactttttactaggtttttgttagagtttttcctcattttgcgttccagcgcgttgattccgccgtttcggaagatcgcaatcgcgaggaaagagttcagaagattattttgaagaagcaaggcaagtcatgcattccccttgagcattttgagcctaatttacaaatgttttattatttgcaaataaaattgcatgtcttgctaattagacatttagtatcatgacgagttgcgtgctctagacacccgaccatgtttcattggtcgtaattatccaactaaagtgcaactgaatggtgggctgtgggcatagttattaagaccggacctgtgattgaaccgttagggcactcggttcactggtttattggttcaaccggtcaaaccgccggtttaatacggttcaaatagatatgtgttataacactagtcacaacatgtggcatagcctggtggttgaaaccctccttgggaacgaggagggtgtaggtttgatcccttaatccagcagctttttcatattttcccaacgggaaaatatgtatgaacagcagctttttcgtattttcccgttgggaaaatatgaaccaactccggttctgcagaaaaccatttcatattttcctttttcgtattttcccaacaatgcagcttctgctcctccacgtaaccggctgaaccaactctaatttttgtccggttctgcagaaaaccttttcatattttcccaacgctgcagcttcttcaactcaacgtgaccggtcgaaccaacttcggtttttgtccggttctgcagaaaaccatttcatattttcctttttcatattttcccaacgctgcagcttctgctcctccacgtgaccagtcgaaccaactctggtttttgtccggttctgcagaaaaccatttcatattttcccaaaaatgcagcttctgtttctccacgtgaccggctgaaccaactccaatttttgtccggttctgtagaaaaccttttcatattttcccaacgctgcagcttctgctcctcaacgtgaccggtcgaaccaacttcggtttttgtccggttctgcagaaaatcggctggttcaattggttttcaccggtccgtttgctcgccaatcttttagctggactggactggccgacgccctggttccggtttttttggtcagaccgccagtccggtctggttctaataactattgctgcaggtgcatggttttacttgtcgcgccatggcaattaaggaccatttcacaggatgacctgtaagaacctatcatagttaccacaagccagcgtaggcaacggctgtacttgtattgtagctttcctctagctgacgcatccaggcaagagtggcgtgatagagtgggacctgtgacggcctttgctgcttccgaattcacctaggcacgagagggggctgcccgctgcctgttgaggagtgggggcgaaacctgaggtgtggtgcgcttggttagaggaggttatgcgaatggccctgtcatggcctctttctggtatgccatggtggcatgacagcgcacagaaacatgtcgtggggctgtgtcttgtgggtacagttgtacacatctgattagagtaaaactattcgaatagttatgcctacggttatgggcggtcaactagattcaccgtgattagtctcacccttaataaattggcttaatgaactggttagttcaggtgggatggttaggcctgttcaacgtggtatagcgttgatcagtggagatttaatattaccttaattaatcaactgttttaccgttttcaactataaatgttttgcaactgcctttatgcaaatagccacgaaccatccttggatccctttgcacgtctgcatcattggtgtggcttgctgagtacggtggttgtactcagccttgctattttcccctttgtgtagtgcttctgagctgaagatgaaattagaggaccaaggctttgaccccagttgagttttgcctgtggagtggagctgaagccccgctaggatcgccttttttccgccgctgcggctttttttcggtgtgaggaataagtgcctcttctgtaagtatttacgctttatttacatttggatatgtgtattaatttgtcattttgtgtaccctagcttgtcctggatagggatttaatacacaaaatagtccggaaatttaggctaaatttctgggcgtgacgccgcctcccctacatcatacaaacatatagtccctccatcccaaaaactcaacctagatggaaatgtgacccattctaatacaataaatctggacatgtgtactaggatgggtcaaatctccacctaagttgagtttttcgagacagaggcaatatatgcatgccgctagttttgtctacatcatcgtcatggaacacgactccacagtcaagtgacaaagccgaagatcaacaacaacaacaacaatatgccttggttgtggtggcagcaaaaagcagggcagcggcaggctcaagtatcgagggtgaggcgacaagctttagacaatgccaaccctaatagctctctacttttctccctcccttcctttatcttgctttatcttggtggccttttctcccttttttgcatgtgctttgctcttctcaactcgatcggatcgaatgaggagggaagagacttataagtgagccgaaaggcattttggtcttttcatcttatccttcacattggactggatgaaattgaaaatctacgccagtgagaaaaggaaaaataatgacacgcgcgagttgtagtgagaccggatgacaaatagaaataaaaataaagtagagtggattttgggaaaaaaattcttttcgtgtgagtggcaaatagttgaatatttcgggggccactgcccaccatgtattccttggcagtgctccgcgagtgatcagccggtgtcctcgcttctctcctcgccacttcccctattcggtcaggcacatctccccaccccccaacaatcatcgaggaagaagagggagggacgacgatgtcgatgccggaggcggggcgctcggagagggacgggcgggagcaggacgacgactacgagcagcagcaggccagggtgctcatggcactgatgcagggcttctgcgccgcacgctaccggaaggccgacaacatcccgtgccccatcgtccaggttccttcctctttccccgcccatgttcttcttcctccttgatgtgatcaatccgtttgttctcgtgctgccgattcggtgatggatgcgtccgcgggatgtcggaggtcaggtttcggctgatcgatctgacaccggataatccaaggaggttgagttctttcgggcgctatttgagtggatttcttgttaactggtgcaaatctggggaactggatggaaagaaaaaaaacagactgcctttctttttttttattctcgcgatgaaggacaggatgattgattcaccgtttatcctaactttagcaccgttgattgtccgtgtcgcgaatggagaaactacactgattaattggaaattgggaaactcgattgtgctaatacgagctctccaattcaattgaatgcaaggaaaagccaatcaagtagcaacatattgcttcttttaccgtatttttgcttgaagaatgcattactatggtaaagctttttccatctatttgatagaatatctttgacatattcgtaggggctatacttgggatctgttggggcagcaatgaacaaggatgctttaaagagcttgaacataacccatatcttgattgttgccagatcattaaatccagcctttgcagctgaatttaactacaagaagattgaaggtaaccacatgccagcttggtttatcagattaagttgcttgcaccatataaatttagaatgtgttgcttgcaccataaccacattacagtttctcttcataatgaaatgaagtgcagtcctgcgttttcaagaaaaaaaaaagtatgtttggttcaaacaggtctatgtacttgagagatgcatatttatattcctacagctgcatatgtgggtcagcttaaattcaattgatcatggaatggcagcctagcaggcgctcatgtggctttgatgtgccatttttctccagtctcacccgcagcaaagctcatctgtgagaaagccctcccatgctagtttctatccccacacttcccttttctcctcctccagctacaccagcagcaaagctcacctgtgagaaagccctcccatatgcttttttctgtccccacacttttgaagcactatttactccttgttttccatctcttctgccacactcattttacttcctttttctcctacaatataaagccatgattgttttctctctggcgaaccacagtgactgataagtgtgtttctggattaatttttcttcttcacacgtatcctctactttgcctgttgagtgttgagggccccaattctaacgtatcccagtgcctgaggtcactttgtcatggtggttcaatcttaccagctagccagctatgttttgaggaagttgtttggggatgcaacaactaaattagggttgtggcaggatgcagagagagtagagagggtgaggagggatggagggaggaagtcatgtaagtgaagcaatgagccattcaatcatctattgccagtaagaactaagttagaaccgaagtatgcatatttaggagtaataatgcgcatcgcttaagttcacatacctatttgaactctgtgtgcaagtttaagaaatgtgctgcatttacttctaaattatgtacttttcatctgttgtgttgtaagtttaccagacatgttagattatcactcaatctggaaaactgtaatgtcaagagaaatgaaataagcatggagcacttaaacttcttgactgtgtcatggtgtttcaaatacctattgatgtgattataccctcttttttctgttgcccttgtccaaattcccaagcactcctaaatcattatttgtttaccaatatacagtacttgacagcccagacattgatttggcaaagcattttgatgaatgctttagtttcattgatgaatctatcagctctggtggcaatgttctggttcattgctttgctggacggtcaagaaggtaatcattctttttcccaacagtcgtttggtttcaaccatttaaagtgtttgcttctatttaataacaatattatattgattaaatttcatagaactgcaactatttttcaaaaattaatggcatcacgacaataattcattacttcttccgcaagacatttcagaaagagtaaatttggttggtatcataataatagtagcaggttgcaagttatcatcacaaatgtgaagatttgcacaataccatcatgaagtccaaaaaaaaaattggactatggcttagcttttccatggatgaccactgttaacatccagttcaaccttctcctgttcttgcaattttctatcttgtcgcagatgagatcaacaatgaattgtggatgcagccatgctccacctcaatgctttagtgtggatatataattgatccatagtttgctcccttctaaatgaaaagtgagggtgaattggtcatttcacaccctttaacagtcaagagatatattccccaaatttctttgattgttggtggtattttccaaaccctatagtttgtgatggttcacttgcccaagattgcgatggtatacctccttttctgaaaaccgcaaggatagcacatggtctctacataaaaggagctaatggtggtggtgactctgccacccttacacctgttgagtttgtggatcttctgcagacaagtggatgcttgtgcatgtagcttttaataatgttatttgcacattgatgtttgtttcaaattacagatgattttcttcttggtattatataacaaattcgaagtttaaaatttataacatttttatttgaaataaattataattgatgggtatctagctagttctattagaaaactgcaactcaactggaaatgagatcgtttagcaagttggtctcaaacagggccaactcaggttggactttaatgtggtatagcatgtggttatgatggatgggcttgatatgtccggcaacccttctattcatggagttgcaagttatttattaaattctgcactagtattgcagttttttaatgccctgcaaaagtttctgatataacgacatatatcattgcaaactgtgatgattgacaaaataattgcaatttaatgctatttacccaattatttgtataagtaattatatattttttgtatgaacacattgaagttggtggcagcgaaatatcttctcgttttttttatcaagtggagttgcacaaaagttgcttaaaaaaatcaaattaatccattttgttaaaaaactagctaatacttaattaatcacgcgctaatggactgctccgttttccgtgcgtactattccggttgggaacaaggaatagcgaaataacagccttaatcacttatatttttttgtgtgtactcattcagttaagtggcaaggcaatacctagttggtttgtttgatcaagtggaaccttagtttcccaaattctaaaacaagttaaataagatagagctagatagtgtggtattccatacagtgctaagaaactttatcttcttcatcatgggttggttcagaagatgatatttagtatcttggatgcaacaatgtcacccgcagcattgcagtaataataagcatgcactgtttatctaacatgactaagggtttagcagtgtacaagtgatggatgccgtccaataatagtatgccattcaacagaaagtgcaacttgtaatgttttatggcaaatcagtaccaatcaacctaagtactttgtgatgtggactatagtacaaattatatctgaagacctttatgcactaccaaggacaatatgacatacatgcatacaagagctatgatccattttattgtcctttctggattttatgaactgcttgtgtctactcgttttattttcccttcaaagttgatcagttctctcatttgccctcatgaaatctgctccctctccttcattctcaaattttatcttttattttcccttcctccgtcaacataccattagtagatgagtgaaaaacatgattttgaccttgtgtatcattttctatgtaccaaaaaagcttgttgattttggtaaaaaaaaatcttgctggttaattataaataaattagtacattagattttcacggtaaaggttaagatgcatccaagacaaatgaaccaagtaaaagttattttagggctagacttttatacttcaatctagctgttcagaagccaaggttgaaaataaaaaaaaattgaaaatcaatctacaattaagttctaaaattcaaattctggctgtggcttgacaattaatgagcagccaatggcagttaatttcatgcaatatactaattgtaaaggattttgcataaaacttcattgctcaaagtataaaatacactattggtccttaaacatggagtgaggtgtcatg

SEQ ID NO: 66136 - DNA, 1338 bp, Oryza sativa
  unsure (1)..(1338): unsure at all n locations
atgcatctcccggtgtgactttctgggaaagggttanaannccttgggttgggggttggtactcattcttgctcaatctttccctcttcagtaagagaagctttggagaagaagtcctaggtggagtcctggcttataccccagttcagcgcctgtgaagatggagccgtaggcccgctagtccgctgctgtttatttttgattgtcaggcctgaagtgcctttgtaataatgtaaatattatcgatataataaagatgcgtcttttgtatcatgtttgtgtggtgtaccccggcttttctaggacggggattaatacactagcgtttgggaaaaggtatttttccgggcgtgacatcccgagtggattttcctcccctcgtggtgatcgccttaacattttctagggacggtttgggttgccctagaatccgtcccgcttccttatcaggaactagagcagctagctgcgccagctgagtctctatcattttgttaaaactcatctggttttggaaagcaaacttgatgatattcaataatctaagcaccgtgtttacatgactaaagtcggctaacagctaacaaacatctaataatctagagaaacaaacagctaacaacttattctatgtcggcttattataatctaacttatagtaatctggttcaataatctggactggactaacccactcactacattgtatgggataaataatccaggcacacaagagtttcaagacctctttcttgataacttctctcatcgcattgtttagccatctttggggttcccttgacagtgagctctcaagctcaataggtatgcaatgggtgcagagagcgggactaatgcccttgagatcttgaagagagcagctcatgatagagtgatgtttctctaacacagttacaagacgaatggtttcatcctcagaaagcttgtcacttatgatgacaggagcttccttgttgccatgtagaaaagcatagcgaaggccctgaggaagatgttttatttcgatcataggccgtggtggtggtggttctaaggacgacaattcaaaggtttcgcccgattcttcctcttgaatgaaatcggggacatcatattcaagaagagattcagggggctcaaatggaagaacaaccgtcacttcctccgcaaattcatcttcaggaagggcatcggtcaaggcatatcttgaccatgagaatgaaacagaaaactcatcccctcctaatgagaattcgaggcttcctaattacatggtgtcgatgagaagtttcttaattggatgcccgattaggacgtcaatgtcttggatttcaaaag

SEQ ID NO: 66137 - DNA, 3738 bp, Oryza sativa
  unsure (1)..(3738): unsure at all n locations
aacagccaatcaactttccaatatgaatagttgccatgtcatgttagagattctttagttcacatattgtttagtctaaaagagcaaaataatgattgtatgtgttggctaacagaacagatcaagcacgaaaataaactgcttgtcgcaattagttcaccgacataagagcagttttgcagttgtcaccaaaagagtgaaacctataattgtagaattccactgcttcctgtaagtctttccaaattctcattctggagttccttcctcaccactgacacattgctccaatgaccagcatcagcatagaggtttgacaaggctattttggatgctccatggcttgggtcaagctttgacaattcttctgcagccttttctcctaaggctacatttccttgagtccttgcagctgcaaggatacaaccccaggctaccacatcagctttcattggcatcgtcttaataagcagttctgcttcttccaaatacccagctcgacaaagaagatcgaccatgcaaccatagtgcttaatttctggttggattccatattgttgcctcatggactcaaattggcgcttcccctcagctaccatcccagcatgacaacatgcatttaacacaccaaggtatgtgattgagttgggtttaatatgggtggtgctttgcaactgtgaaaacaattccagcgacatgttcacatagccatggatagctaaattacagatgatagaattccaaggagacactgaaattgacttatccttaacatggttaaatagctgaactgcttcagcaatgctaccacactttgcatacacgttaatcagtccagcgctcagtttatcagtaagctggattgatctgctgattatgtagtcatggatccatcttgcttgccccaaggtgccagaattggctactgcagacagagcacttgctaaagtgatctcattaggttcaacaccagcatctagcatcgaacagaatatctgcaaagccatgtttgaattcccactctggacatacccagatatcaatgtactccaagaaatggtgtccctctcaggcatgtcatcgaacagctgccttgcttcatgcactagattccttcttagtaggctagccataagggcattccaggaagctacgtgtgacttgtctgacaatttgaattgcatctgggcatggtcaataaaatcacaagacccgtaataatggatcagggtagcctgtacaaatgcatgagcgtcaaaaccattctttagaatgactgtgtggagttgttgcccttctgagacagcggaatgtcgagaacatgccttgaccaaaccaacaagtatcacctcattggcccttatgcccaccgtacccaccatcgcaacatatgtcctgagagcctgcagtaggaaatccgcacacatatatccatctatcattgtcaaccaagagacctcatccctctctgggatcacaccgaacacctcagcagccatgttaatcattcctgccttgacatagcaattaagcattgtattccaagtgacagtgtttctatctggcattagctcgaatatggaacgggcagaaggaacctgtgacactgctccatatgcatggaccaggttggtggccacgatgacaaatccatcaagcccacgccgcacggcaacgccatgggcagcaccaactggtgctggtgccccgtggtcacaggccatcgccgtgagcacttccgcaagtgtaacctcgttgggctgcacggcctcggtgagcatatcgcggaagacggccagggcgcgctcaggatgaccggagcgcgagagggcggaaatgacagtggtgaacgagaccgcgtccctctgaggcatctccgcgagcaggcactgcgcgcgttcgaggcggcccgcgcgggcgagcgcggagaggagaatgttgtgggcggtggcgtcgcggaggagcgggggtatttcatcgaacaggtggtaggcgaggctgggggcgacgcgggagtagaaggcgaggagggagttgcggacgaaaagattggaggtgagcaggcccgacttggcagcgagcgcgtggagctgctcgccgtggctgaggcgtgcggcggccgacttgagggacgagacgaggaagacggcgagaggtgcgccggcgcgggtggtcatgcgcgactagagatggcaacgcaacggggtgccgttcatccccgggcgggagtgggacgaggccgccgtcaccgagaaccgcgagagcgagcgccgccgcgcttgcgcgtcggaccgtggcgagaaggtgtggggattccggtaagaagagactagttacatttggttgactactgagctgctgcgttgagatggcacagtatgggctgaccaacaaatcgattgaattgcgggcccgttaacggtgaacggtaatggggactgcagtgcagtccctcggttaacgaaaaccgtcagtcctaggcgcaacgtgaagttaaggaattcagggttgagtttgtcacgaaaataaaccaaaccaaaagttagtattcataaattttggcatattttagtattactaaattttggcaatgttagatatgtttagtttgtagcattatatgtttagtttgcagcattatcaaaaattacagtattcgtgccaaaaaaaattactagtatttatgtgagaagaaacttttgaaatgtcaaattttggtagagtgatgatacaatattatgtttagtttgttatcgataacaccaaaaattattagcattaaaacttaaaagtggaagcaaggtgaagagctcttaattcatacttacagaacaaaaattattagggttaaaacttaaaagtggtagcaatgtgaagaagcctttaattcgaacttttacattggttggttgaggagcttataatacaatgtctatcttgacgctcctaaatgtatcgttgagtggtacttcttaaaatatagcaacttctaatatttaaaatttgtcataaaacataataactccaccattattctcttctcggtcaatcacaaactttcaccattcaattttttccacctacatctacttttcaattaatcacaacatccgtttcctcaattagttttatctactttctttatatccggctgttagcattaaagatctgatgtattagattttagacctgcaacgatatatttagcaaattaatttggtcttaatatactatgtattttcaaagcttaataaccacaatgatattccacacagaattttaataactggtgtcttattttactcttaagaaacaatggctatataaaatttacacatgccccaacgacagaccacatttaatatatacataaaatttgcaaccatattattcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 66138 - DNA, 707 bp, Oryza sativa
ccatggtccaacttgtaagcactgatgtattttattcttactaaaataacatttaggttcattagagatatatgaaccatcagtttagtataaaaattgctcctggcaacaaaaataaagtataaaaatagctgctgtgcataaaaagataagggcaaaactatcttttcacccacctaacagtaggttgacggagaactaacggaaagggcaaataaaggataaaagttaagaatgcggagcactagaaggagccaattttacgagggcaaacgatggaagcgatcaacttttaaggacaaataaagaattttctcgtaaggaaaatactctaatagatgttagctttgactgttttatgatggttttcataatgtgtataaattctcaatttcattccactaggtgagatcacccttgattaattacgtgtttcttaatatatagatattttgtaaagaatatttgaattcattaagagcagatgtgtggtgctttttttcttttgtcctactaactaacttctctgaatgtctagtgtcacgattattgttgcatatctgatgaagaagcatcaaatgagccttgagaacgcgttgtcgctagttagaagcaaacgacctcaagtggctctaatgagggattcatgtctcagctggagaactttgagaaatccatgcaaggtaaaattcaaatagctttcttta

SEQ ID NO: 66139 - DNA, 6585 bp, Oryza sativa
  unsure (1)..(6585): unsure at all n locations
nnnnnnnnnnnnnnnnnnnnnnnnnnnnnnnnnnnnnnnnnnnnnnnnnnnnnnnnnncagtagaagtgtagaaccagtgaaatgagaggcttgagagcagaccagttcactgtcaacgtgctttctgcatttaggcccatcagcaaaccatgctctttaggcccatttgtaatcagcaaggcgcttttgatttgaaggaaatgcaatactccaattctatagaatattttcctttatgatcggattgaaaattattgaaccctacaaaattcctgaggtttggaggatttttaagatgaggtcaaatcttatggaaagtttcctaatgtatatttctctcattcaatttttatgttttataattttttttttgttttgcacatatattcctgttaaaattttatattttttctcttcttccgttttctaactatgcgtttgaaagaaaccctaaggccccctttgattcaaaggaaattcataagaattttaaaagatttcattcctataggaatttttcctatatagccctttaaatcaaaggaatgaatcctatgtaatcccatgaaattcctatggaatgcctcttgccatgcaagttttggaggaaatttagcatgaggttctacctcatgttaagaattctttgagtctttatctctcctcaaattcctgtgtttttcttgcggctcaatcaaacggttattcctattattttcctgtgttttacaatcctctgttttacacttgtattcatgtcaaaatcctatgtttttcctattcctccgtttttttattcctgtgattcaaagggccctaatcaggagtttcttttcttccgattcacgttgcatgagctgagcgaacccagaggcaaagccttgataagatggtgccacgtgatcgttaggaaatatattcgttatcttattttgtactggtaccatgagctgttcttgtaatcttgttggtgaatcaagtccagagaacaatgatctgggtgcgattatttggaagaaaattcaaattaagcacgagcttctgacaaaataattacacacagctaactatgatcatgcatctccctgaatatctggaacggagtttatctctgtctaactgcagtacagtacttctcttttgagcatgatggcctttgcttacagtcacattactgtctgcaaggtcagtgaacacagtggacagggcacgcctgcgacaccatcacatgactgcataatcgcctgagctgccccgcatgtgtccgtcacagatctaccacgctggtgatttctctgcactgatccattgctcaatgagccgtgaaaagagaacaagttcagaaagagaaaaggcgcaaatgctcatgccagaagcggtgtcatgtgaaagatttgttgatcttctgaacaaactctttagctcgtacttccatgaatgtccagtgacttgccatctgcatcaccgactcgccgtatcaagatctctatcaagtagggtgcatgcctgaaatgaatcattgtggggaaggaaagactgcaccttgcattgccggagcagtaataaatctgtcgatttgatcctcgcgtgctgcagaaatgacaccgggcgtcgtggctgcacagcagaacagcacaggggaacgcgatcttttcctgaaatcggatccaatgccatggttgattggttgttctactgctaatcatgctttttccctggcaaaaaggaaggaactttttcgtgcatcatggagattcgagggaggcatgctgcatctgcagttccaattggagggagcatcatttgcgtactgtgtttgcgtctggtgtatgcgccttcttttgcttctctgtcctggtggcacctgtgatcttcttggaatcttggtggtggagaagaatcatatcattctgtaaccactcctttcagaggaaagtttcagttctttggtggtgacagtcaggcgaatcgggtcttagttaacagaaaagaagggtccctgctatctctgaagatcgtgcgtccatctgtttcagataccgagtgatgctgcaggatacttcttcgattagtgcatgcttgcacagagcacagtgccatgaggccattcacaatgcgtcatgggtttttcctggacctgagatgccacgttggatggaactgctgctaagcaactccatccagaatgcaaagcttgtactccacagtataagctactaatgggtcccaccaccaaacacttttgctctctctctttggttcagattttgcagcaaggaactcggtaccaactttggtcacacggaccaggcaaagccacgatccccactcttctccctcctccacgtaagccaggaacaacattgccacacgccacatcgccgcattgtaaatggcttgaccgaggctcccttggcaggccgatctagtaatccatggcatggaatcttttgaaccacagttttttgagatacattgtgtggttttaacctcacgatctcatgctcaatccctaacatgctcataatttctttaaaaaaaaatatttgaagagatgtctctccctccaaatctccttttttttatccttaaaccctaaacccaataaattattgtatacacatttcagggcataaaaaccagggttttaaatctcctgttatagctgtttgaaaagagttctagctatttgatctcatatacaatttgatcgctatagctccatttagcccactataactgtttgagaaattaatcgctaaatgtcttagcccgctatttaaaacattgataaaaacacagattttcagaaagcacagtacatatatagcacatgttcttaaagtgttttctaatattcagacaagttcaacgcatcgcgaagaagttaggtgccatcgtccagtacatggtccttaccaggatcagctatgaggagtgggtgctgctcatgacagtgaaggtgatctctgtctgatttctagaattcttattaggcacagcacaagggctctaataggccatggagccaaggaggtagattaccaggaggataagctcacgctacacatcgtaaggaccatgccacctgagatgctcagggcactgtccaccaaacagacggcgtagtcagcatgggaggtgatcaagaccataagtgttggcgtctaacacatacgcgaggcgaaagagcagctgctaatgcaagggattcggcgagatcgagttcaagaatggtgaggcaggtcagtgatttctccatccgcatcaccggtctagccaacaacatccgcgtcttcggtagcaacctccctaaagctgatgtactgaagaaatctctgcagtggccctgatcgaacatctatctcgctggatgagtcattgacatcggggagtatatctcagttgcgatcacgacctaggaaaaatgttcgaggagaacttgtaggggttcttcaccacatcagctttgggggatcgtcgtccaacatgcagatgctatcggcgaggacagttcatgcgtatggagaaatcgtcgatcgcctcgccgtctctcattatatgttgccctttcccctcgcatatatgttgagaggctaagatcaacatgtacggtcatgatagcctcacatgccatttgtatctcccatttggtgtacatacctgagcatctcaggtggcacgacccatgggatggcggccagcgcaggactatcctgctagtagttcacctcctcgtcatcgtcaggctcaacggtctgccgtagcccttattgcctacaagttcaccttcatgagcattgtccactcctcgtagttggcctgataaggaccgggtattgacgttggcacctgactccttcacgaccacgggaggaaaaaaagctcgggctcgtgagctcagctttggcttggctcgagttttgtttgtttggctcggctcgtaagccaaacgagccaagtccaagtctcttttttatctcgttgctgaaatgaatcgagtccaagctggctctcgagccgcttgttttggctcgcgagtctaggccatcatgtgtttatattgattattttattttttatagagttattatttgtcaacttaaaatttatcattaagatttgtaagaattgatatataaacttatttaatttttacatattgatgatttgtttttgctttttttaataataacaaaatatatatgaagaggtgtttcaacaggaaggattgcaagccagctcgagctggcttgaaccaggaaacgagccaagccgaactcaagttttagcttgtttttctaactgagccgagccaagccaaacctagtttgttgcgagccacttcaagctgagccgagcctagctcgtttccacccttattcacgacgcgccgccaggatgatctcttgtgtgcgtgcatcatggttgaggctacagagtgggggccaagggagagaggtatgacgacacatgggtggtgtgcaggaaagccggttggctggtgtagattgtgccgacacggcatcaaggtgcaatttggctcttagagcaagtttaatagtatagtccactactggctccaattcatctataccaattgttacaattgagaccagaaatcacaaacacacacgtgttggaagaatgcaagaacacgcaaagggctattggtgagttgcagtgttttctgttgcattataagaacttaagtgcccctttggattgtaggattgaaaaaacgtagaaatagaaaaaacataggattttaataggaatgcaagtgtaaaacagaggattgcaaaatgcagaaaaaaaaacataggaatgaccgtttgattgaactgcggggaaaacgcatgaattggatgagagagatagactcaaaggaaagttatcaagaggttgaaactcttgctaaattttctctaaaatctctatagaattatccattccataggaatttcaaaggattggatatgattcaatcctttatttcaaagggcatcataggaaattttcttataggattgaaattctccaaaatacctttttcctctaattcaaatgagccctaaatagactacatgctaactgtttctctaggcgttccaggccacgcaacctacaattctgatatgcttaccatgccctccaacttgaccgctccatcatatcgccgagggcatgtgatgcacacaatgttgcctaggactcgggactattttgacgtgctccatgaactcgcttgggtaagaggctatcgacacgacacaacgaccaaacctaatcttactttttgattgtttcaatgagaaaattattgaaagggaaaataagaattctagaaatcagacagcgatcgtgctcaacgggaaaaaaaacagagaataagtagtaggattgattcatcacccagtgtttatgagcatcttctattctgaacttttctgaacattgctgggcctaatcaacgcgggccgtgaatttaggtgatctcaccggcaatttagcacgcctatctttaaccttcaccttcatgcatggctttactttcactggttcacaactagatcacatgcaaatcgatctaacagaaaagctaatctttctgttgcctgaatccagatagccttatccatgatctatatatctgtcacttcagagagtgttcgtttcaccacaattctatcgctcccgcgaagcacggtgtgcctcgccgtgcgattgattcagtcattcaggccatgttctagagattttgtaggatctccattgctacatatgcctccaaggtcttgacatgcattgatgcatacctaaaggtcttgacaatgtatgtgcagctcatgattgacaaagcctgcatgcttgatgaagatgacgccatactgtctctgtaaaaaaaaacccaactttttttatacaaatttggatataacataggtctagttgatttttttttagactgagggaatatgtctcttacataacatatcttgaatgctgataattttaatcagcaaaatgttcttttcactaccctctgctagtatattttaagcttgtggttgtgctcacatatactgaactgattgaatctggccctgcaagctacaataactaaaatgtgcatgacaagatttgcgacccttgtatttaggcaattaactgccctttcgactcatcaatggtcaagtgacatactgacatatactagatatttgataaatgaaagcaaatacaataccctcattccattaaaaagtaataaaataaaataaaataaaatcaacaccataccctcacagcccactagtccacagagaacatctcgccagttgcatcattggtcattatcaacatcgtttctatttggtagaaaatttttacactaacttgcattacagcattggtgaatcatctttgatggcagtatcgatcatcatttacagattaacataaagcaacttgcagtaataagtaagatcacaaacaaagttgactatttttcgacgcaacttccgtgatgtcatatatgggtgcttaattcaataggaatgtgcaatatatagaagttcata

SEQ ID NO: 66140 - DNA, 6741 bp, Oryza sativa
aaagacaaccagagttctacatggaaacgacaaggactactcggattgtatccatattggtttccctagttctacttggataaggggacacctatgggtataaatacaagacccaccatggaggatcaacacctaacacaatcgacatagaagcctacatacgccaagacacgccgccggatgtcgacttcagggataagcacgctagtaccctacggtgtctccggatactgttaggagagacgaaagcgctatctctgatctcgccgggcacggattcgaggaggaaggctaccctgttgtcgactacgagtcagatcgtcagaccgccatgtcgacaacagttatataggctaccccacatattgtactggtgtgattatcatgaataagagcaataccggcttcggccaataggatgtagggctattacctgacagctcagcggcccgaacctgtataaaaatcctcgtctccatctcttttacctcagtctcgcgtatatcctagcaccaatgatccccatactgtccaaatactgtagtcgagacatcaaacgtcgacagtggcgcgccaggtagggggattttggtgcttcaggatttcgacgagttgggtttaagagatggactctccgacaacaagctactcgacgacttcggctgtggggagatccaacctatccaagtacatcttccgacgagatcggaaccatcgtcatcaataattcgatctctcgagatcgaccaagctttgaagacgtcaccgacgcggagaacggcattttgatgttatccatcatgaagcctcggccagatcgactacctcgagtggatattcgccgacgacggcatcgagtccgatatcagggtctttgttgactcatatcagactcggttatcctgggtagaagcagcagatcgcaaccgaccatgacgacagacgagataacaggaagctatggccaaatttcctgcccactcgtgcgttgccacgtcaccaaccggtcgacgtcctgacgtcaggaggcgtatcagatgtccctgtacagagcctaacacctatgcatacaatacacatacatgtctacccggacatgcatgtacgcgtgtgcatatatattggtacgtacagtgctgttgcatatgctttgaccacacgaggtcgtcacaacattaacacaggtaattagtggattgattttttaaattgatctactaattccgtagatatatccggcatatatctacacaggtatgcaataatttatatgcaatttaccgtacctatttttccagtctatacaatattgtcagatctataatttattacgtttacctagagcatgttttttatacaatatctgttgcgcgagtgtccccgatgttaaatcgactacaatttaatgctgggggctcgctctattttcttccgtataaatcatgcttgcttacggtttacataatccctgacatttacatttgctcgttatatcctgatgatactagaagatccatgcagtttttgagtacatactcgatatcctctgctatatgtcttgccttctagaaaataattttcaggaacaactgagcactcgagtaggttgtggtcgagtacactccattatcgagaacattctcgacaaatgcggagttatcgcacccaacctactaaggaagaccgacgacctatctcatagcaccggccatcactggacaactcgagaaaaggttgttaacggataattcctcgcaaacgccgtcggcttgatcacccgatatgattgcgagcggacatccggatatgctataagttgggtatatgagtcatgctggccacatgatatgcacatgtaataaaccaactttagcgcccctataggtgattaagagactcctactcctggttctcgaaccagtaaaacgtagtgatctttctcgcctcactttaagtggtcgagttacgactactgcctggtcctcgactagcgatgtcccactacttccactttaagtggtcgagttacgactactgtctggtcctcgaccagcgatgtagcgtctctcccactacttccactttaagtgatcgagttacgactactgcctagtcctcgaccagcgatgtagcgtctctcccactacttccacttcaagtggtcgagttacaactactgcctggtcctcgaccagcgatgtagcgtttctcccactatttccacttcaagtggtcgagttacgactactgcctggtcctcgaccagcggtgtagcgatttctcctactacctctacttcaacaaagttgatagcaggtacacaatatcggcaagtgttttacccagagatcccttaccacaacgacacctagcgttgaaacatatcctactgtccctttacgccgtcttgacaaggcctccgaggaacctaagggatcttcggctggggacgcccagagccaataaggccttgtcggatcctgtagagacgaaagaccatgtaagatctggtcatgtaagagttctcgccgtgcgtattaaccaagccgtgtaatcggaaattaactttccaacttcatggctgggggctaggatcagtgcttgttcaaccaaggcaggtcaagggtccaacagccttatcatccgagaacgattctccgacgacaaggctgggggctagggagagtgtatgactctacaaactgactgatcgaagtcggtaagagagaagacgctcatacacaaaacattggtcggtaaatttaattcatttttaatttaccatacatattataacatgttaccctttgagcattcgctcgggggctctttatatttgatattcttttctgagtattgatttcaggaaaattctattcgacattgtggaagactacatgtctctatggttctacaccaagatcgactaaggcgagtacaaccaatgttgacaaggctccgtcgcagactctacgccttctcgatcgctcaagaatggttgctggatctcgacaaggaatatggaatgaagaaatggtgtacccgccgagataaaatttcttgacttcaatccaaattctcgattacaacaagacgggagacttagtcgtacgttctgtactttctcggtcgacatcagagattgacttagacaaaccctttcggtgcccgcacgaggctaataaaggaagtctaacgttatctctaaactcaccgagaacggtcacatgagctcgataacagttcctccgaagtctgcggttgagaatatgaattcgttcatttgcatcgaagtcgggggctactgtcagggttatggataccacatacctaatagtagttgactaaatctcggtaggatccaccacataccatgtcttatacggaaactgacctcgagggagttccggataaggaaagacaaccagagttctacatggaaacgacaaggactactcggattgtatccatattggtttccctagttctacttggataaggggacacctatgggtataaatacaagacccaccatggaggatcaacacctaacacaatcgacatagaagcctacatacgccaagacacgccgccggatgtcgacttcagggataagcacggctagtaccctacggtgtctccggatactgttaggagagacgaaagcgctatctctgatctcgccgggcacggattcgaggaggaaggctactctgttgtcgactacgagtcagatcgtcagaccgccatgtcgacaacagttagataggctaccccacatattgtactggtgtgattatcatgaataagagcaataccggcttcggccaacaggatgtagggctattacctgacagctcaggggcccgaacctgtataaaaatcttcgtctccatctcttttacctcagtctcgcgtatatcctagcaccaacgatccccatactgtccaaataccgtagtcgagacatcaaacgtcgacaggagtacctttaatttgtgtgtgtgtgtttttttttctattacacatttcaaatgataagctcacatactacatctatcccaaaaataagttcaaacttaatttagaacggagtgagtaccatgtaacagtacacattatgacggtaggttcaacatggaaaaaaaaacacaaccatcctccaaaaaagaaagaaaagaaacaccctaccagcaccatgatcagagtagcttccaaaaataaataaaaagaaaagaacggcaatactgaaattcctgtgaagttcgtacagacaacgtgtactgctgtgcaacacatgttgtccagatccacaagatccctagctccccaccaccattcctccgtttagggcccctttgaatcgtaggaatgaaaaaacagaggaataggaaaaacacaggattctaacatgaatacaattgtaaaacagaggattgcaaaacataggaaaaatacaggaatagccgtttgattggaccacaggaaaaacgcaggaatcagatgagagagatagactcagaggaaatgttccaagaggttagacctcttgctaactttcctccaaaatgtgcataggattacccattccataggaattttaaaggattggataggattcaatcctttgtctcaaaggccttcataggatttttttccataggattgaaatcctccaaaattcctacatttttcctacaaatcaaaggggcccttagatccttgcaaatttcacacggattctacgggccacaagtcccatatcttttgtttgtgccgccccaatttttgattcttctcatttcaattcgccggctggttaattaatcaaatctgcagctccgattgccgtctctctctctctctctctctctctctctctctctctctctctctctctctgtgacgtcgtcgccgccgcggttgtcttcttcctcgcgagcgacgcaaaatagaattcgttgacctttggcaagtcgggtagccgcggcgcagccgcacaaggttctccagttctccccccctctctctttcgtgttcatttttgttttatatctatatacaaacgtacacatatataaaattaatatgccattaaatatgtcacccaataatgcatcaccgatcgatcgatgcagatccaacgcatacgcacgaattgagaaggttcatcctacgtacgcatatactgtatacgagagattaattaattattaactaactaggccgcgaaagcgacggcgatatgtatatatcggtcgttaaacctatatctagctaggctagtgtccctgtcaatgtcaatatggctgcagccaaattattcgatatatatatatatatattcctcttcgatcagaaaaggaaacgcgactgcaatctaggatgaaaattaaagggttttctgcaagcgcgcactagcaactggccgggcaggtgcaatgcactgtccttgtgccgtgatgcattggtgaggtcgatgccgatgtatcggccgcgggcaatgcaaatataattctgcactatagatcagtgccgtttctgtctgtagatacatcggctcgtgtaacttgttcattcaggaataataattttgctctaaattcataaaaaaagtttaatagagataggagtagataagaaatatattctaatagaatctcaagttcaaactcaactataaattttgggtgaatagtaacctaacactgttcatctgaaatctttcatttttgcttctctcaaataaagttgggtgcgtacttgagatttggtgagaatatattttatatgtacacaaaactagagtttttaacacttcaatcattttcacaagatattttcccgataggctatttataactttttgttaggataggagtgatctttacatcatcgtgatcgtgatatcgggtaattttgtatctgacgagatatattgattctcttgtgcgttttgtggatatatcacgcgcggttgtttgagggggagcaagattaattctcaatctagtagcagtaaaatttcttgggtgctgttcaggacatggttttgcattgaggataggcatgctgtgttcagctcatttgttttaacatccacacttgcgtgcctatttggaagtactccctccggttaaaatattcgatgactggaaccagatctttgttaaactcttcaaattttactatagatttctgaaatgattagttcttttttgaaaaaaaaaagagatatgcatagattagctttgatgaatgctatcataaaccttacattttataaactcatttaacagaaaattaatggtcaaaattttcaagtttgacaaatttgtcgtgggcgccaaatatttataactgaattaagcaagttgtattatagttaccgtacaactctgatacatttccaatcgattaggctataccatataatttcagcacactctattaaacactcggatctctctcttttgatccaattaattaactcggtaatttttagcccttaatggagaacactgagatgtttcttttcaccttactagctgatactaatcgatatgcaatgtgtaattatgccaaggtttaattaaatattagagtgtattatgctttgagctatattttattacctaagtttcactttggaccacccttaaacatatcttttcactttgaaccggataaatttgccattgttgcgatttggaccaccatgaacgattttttttggtacaa

SEQ ID NO: 66141 - DNA, 10993 bp, Oryza sativa
gacgagaaaagttatttatggtagtccaaaccacaacaatggtaaatttacctggtccaaattgaaaagatagatttatgggtggtacttcaaaataaaacttaggtaataaaaggtggaccaaagtgtaatttactctaaatattataagccacatcttatcccagtcccctataaccaaacaaaccttcagcattaactaggaatccttgtgtttttaaacttttgatatagaatccttgagttggtagtgttgccaattccacccatccttcctttattttctaaatacatgtatgagctatgctgaagctgacagtataatttgaaacaaactttaatacaactacaaagtttgggcccggtgaatttcttgcaatgacgtaggcgcgatgaaaaagacattatgcagatctagtatatttgtaagtcttgtaataaaaaaggattgaaaaatgctaaattgttttgctaatgacgccaagaattattggccgattgaattcataatggccttcaagccccccacaggccccacaccctggatcgctttcaaattatgacttggtgttgatcaataatttgtgacagttgcatgcacaatgtaggtaatgatcagctaggtcaacctgacgatcacgatttaatttgtatatgcatgtgtcacgacgaattgctcaggacatgtacaagtacaaatacgactatctccagctgtcttaaagtacttaattctatccacgtcacctaatgataaaacattatatgcactgcctataaacactcaacaatactccctccattttgaaaacatttagccttcagagatattttctaaagggtgaatagctaaagtggtcatctaaatttcatgtaagaatcggtttagttcttaatgtttcaatctatccatattagtacttcaagtttttgttttaattcaaatttatccttgaacccacgtaaccaaaataaatgacagttataccccctcattcacatatataagagaaaaaattgcatgcaatgaattctttttatagataattcatagcaatttatgtcaaacaaaaataaattatgtacttgcaagtgtatatgatagccattaggcttaagtttcatgtgcacatgttgaaataattggaagtatatatgcaatgttgtttattcattttggttttcttttttctagtgttgcatgcaaattaaaggcaaaagggatattttctaacagaattgttgactagaaatagccatatggcatattaagtggacccaaggatgattttgatccaaaacaaatacttagattacctatgtggacaaaatgaaacctgaagaatcaaattgagtcttcggtaaaacttgagggactaaattagctttcacccttttctaaatataagtcattttaggattttagacattctcttctttttttcttccatttttctttctcgagacatgatttacttttattgagaaataaaatgggagaggaagatggaggaaaggagagaagcaaatataccatcatgtttttataatgttaagaaaatactaaacagagtcatcatgtttactttgtgtgcataggaaattaggaattaccctgctaatcagagtaacagatgtaaaagttttctcaagttgtggcagaacacaaaactatattaccacttgcaatattttttttctttcgcaattacgtgtgaaaaaaacatacttaccattatatgagaaaatgttagccacacgatctgcacgaccaccttgctagttttctttgccaaacaaaactatccctctcacacatatatgattcatcattttcaattcttttaatggatcatcaatttagtatatataaaaaatgaactggagcactttaattgtatgcccttaattaataaggtcaaataagaattctactactatttaatagtagtataattctatattcttgatcatgttattgaatgataatcggatgtaactattatgcatttcgttcatcacttatttattcctaattttcgttatttgcattatattatgccatgttctagttctggacatgactgttgtgcagaaattacaaacaaacaaacaaaccatgctctagctttgtcataactgtacaggacagtgatttcaaatgttttctgtttgctgagaaaaagttgacaaaatacaccccttcaattatcacagattcggagtactttggtgaaagtgttgtcacatactccctccatcaaaaaatataagagactttggatggatatgatactttataatactacgaatttagatgtgctccatgtccagattcatagtaataaaaagtgttctatccgtccaaaatcctttatattttgaaacggagggagtagctagtaatgcttacaaaaattactttgcagcgatcttacaagatgattcaacaagcaagatgaaatgaaaaaaaaaactcgaaccaccacgaatcaccatcaaaaggtttgactttatccagttttgaaaaattaatgtgttgatgtgattttattccagtctcaacaattcacatttgaaactagaaaaactgaacttatgctatagccgagggaccatatactctctccgtcccataatataaaggattttgggtggatgtgatatatcctagtacaatgaatatgtacagatggtctgttcatatttattatactaggatttgttgcacctacccaattttttgctatattatggaacggagggagtacatgggagaactatatgtatatgaactcgtgctaacatcacagttccctcctttttttttatatcagacggctcacatgctgtttgagtagatagatcacagatgacacccgcaagtctgcaggctaatcctctacagtactactccagttcgtacggcatgagagaccacgaggtcagcacgctactagtaccaaaaacaatctgcattttcgtcagcgatcatctattctgatccatacaaacaacccaaaacaaatataataatgaatggccaactatcataggagagtactgtagaactacctaacatcagcatatgtggctgtcgatcgccatggccgtctgatattcgtggggatcgttttcgatgcctctcgtgattcgagctcactccggttagttcatcgcatctgctgctcgccacatctcaccaatatactaaattctgcagcggccatgcattgatgcttatcctataatttccctttaagaaagcgaaggtttgtgacacggactggtgccattggctgatcggctgtggccacagactcgtagttaattacatggggcgaaacaaagaaaggacagtcccatttcaatagttggttgctgccgattggaacaggtggaatagctacatgatgacagtaacatggactccatgcggtataacttaagaaacagagatgtttatcagtttatgcgagctactcccctcaaatactatgaaagtaggcaccgcttggtgctgcttttttcataaaaagaacattttttaaatgtaattttcgtgaatagctagtcttgttttataggtctttttcttagcaatcgtgaaaataaagctagaataaataaaccctaaattgtagcaaaatttaaaattggatgcaactttttagaagggccgagcaggccttaaagtactattaaatattaatacatgccaaaatatatattgatatttcctacgtgaaaaatggtattataatatttatcgctaaacatttcaatgtatttcggaaaccgtgttaaatcctaaacatgaagaaataataataaatatatttatctatatttctactaaatagatagagatgtgaatgtattatatcgatctcctcatacatgaataagaataattgcttggtcaataatccatagtggactaagtggactattctaaatgctctagattcatatagtaccacatcagctcaatatagaggcccccgcatatccacagtgttaatgcgtttgacctttagcataaatctacaaaaagttaggttttcgaccactttttaggtacaaatttattagagatggtttaagctcaacatgaacaatacatttttgttaatcttaaggttattgatcgtggtgacaccatcaacccccatcgactggaaggggcaagtggctaacagggtttgcaaaaacgtgtagcaagaggcaaggggcaagtttttgaaaccatgttaaccctcacggtaaccgcacggttaccgtgataaccgtcttacggtggggtagcgataaccccacctaaaattgtttggtgaatcctggtgactagtcacatatgccaaacaaattgagttttgaatcctaactcacttgcttaggtactactccctccgtactcataaaggaagtcgtttaggataatgtttaagtcaaaccttgggaatataaatcatgaataactctcgagttgtgagtttgaaaatataaaaattatacgaatagatttgtcttgaaaaatactttcataaaagtatacatatatcacttttcaataaatatttttatagaaaaaagaagtcaaatttatgttttggagaccgtgtcgctgtcctaaacgacttcctttacgagtacggatggagtattatttaaccagagggggcaaaagcacataagaaccaatagaaaatctatcatagatcaatctagcttatgtttgttctattcctagtgtcatgcacccatcgaggcttgaacacataacgttcctccacctctagttaggtacttaggtgtcacaattgcaacttctcgtcatctgacctgatcttctcaagcaaatttttgatcaatgagtcatgtatcttccttatcataactcgtggtgtgttttttatgactggaaaaaactgaaaaaggaagctactttagggcacgtacaatagagacactcgtactagtaatctcaacctgccatataggataatactacacaaaaacctacctacaataaaaaccacttcttactttcttagtatattttatatttcagaactgataatctacgtgtcggctcttatgatatttaatttatattatgatatcaattggagtttgtattatggatcctataataacaaaaaaaaagtacatatatacccttaaaagttaaaatatagcgaacccacctatcaactgagtacccacgtaaattttcaccccaaggttaaagtgaaaaaaataagtaaaaaggagaacgcgatctctcctcatccgccgccgccgcgccccaatcctcctgtgtcgctgcgatggttaactaccactccgatgtggagagcgagcgacgcggttagattctaagcctatccggtccgcgaaaatagaaaaaagaggagggaaagggagaatgaatctgttgcttctctctctctcttttccaccagaccagctgagctgagccaccacctcctcgatatattccccgcaagcccacaccttcctctcaatttctcccattctccactccacacccgtcccgtctgcatctacccgccacttcctcctcctcctccgcctctcagcttctgctcttccttgttctttggcccgcgagctgatatctgcagtttgcaaccgagaagagaaaaaaaacgaaccgggtttttttttaggtaagcgaatcgcgctcaggtttcgtctggtttttgcgttctgttgcagggggtgcgcgacctgttctagtgatcttccctatttcgcgtgctgcttcttgttgatccgtgttgtgcgctgcgcaggtcggcgggcggctaaagaaagaagggagctttttgggtaaaaatttagtcttgtttttttttccttcgctggttggggttggggttttcagggatggggggaaaggaggggctgcgtcaactggcccgattcccatcgctctgaacttgatggatgcatctgtgagtaatcgtatcgtctgcgctgtgcgcatgttccttcttgttgattctcttctatctgtttcttctttcttctcttatctgtgttgttcggggggtgttgtgtgtaggtgaacgccaagaagattagtttctgtgggaacactggtcatagccgctgtggtgaagttcatcgacctgcctggccctgtcgtatgcgggatcactccttgaacagaagcaaccccttcttacttcaggttgttgctaccggcctaatctgtctctaatccctccgctcgagttctgttgccgtatgtggttccttagtttctgtttcctgatgaagttcttgattgatttggtggtgggagacaagaaaattttaagagtagatctcattgaaatttatgttatgtgggttgtgtcctcatttttcaagaactttgcaaactgtgcctgccatgtttggtagcttatgaaaataaaattctgatatgtataaaatgatgccgtctatatttaacaaggtacagtcttgtataattaatctaaaattgttgttgcagtcatgtaaaaatttaggggataatattaccagttgcaaatgtcaaactactggggcgtctcatcgattccttccctgcttatattttggatggaaggatagtcaaactaaggactaatagtattatgctcaggggcagttgacggaaaccatgttattcatcaaagattcgagaagcaatcttgttcacatacctatcaattacacctcctgtacacaactctatcacgttggactagaaagctagaatacattatggaggaagtcattcgaccaattctaactttacccctgtataattgaatctgatccattagatcaaaagtaatggatggctcatatccattatagggtactctaaagaaactataaattttgatgaaatatttctttgtttggcaacgctttgccgtctttattctctacagttcaaccatgctcagaccgtacttatataaataatgctttgtgttaaaattgcaggtctggtttgcgtttccatttaagtataaaaggacctgtatttggcatgggctttaagtagcatttaaaccttcaaagcatagtttgacagcaatatacactacaatcggtgttatacttctgttgaaaaagatggtggatgaggaactgtttgataagagctccaatgatcacagcatcagttctgaggaagaagacatgcttgtcaggagttatagcaatctcaacgtcagctttggataccattgtaattcttatcagtgtttttctctagacactgatgagtatgacatctctcccaacaagaggcttgaaactaataccatgatgacatcacaaaatggatccttcacttgtttgtctggtgctgcgattagtgccaatttcacgctggccaatacaaacatttgcaagggtcttatcggggaagaaattttaccagaactagactctcctaattctttcagaaaaattgtttcatccccatcaatgtcaagattggacttgttatccacctcacaaggcagccctgtatcgactgagagctctatatttgaaatcagtaaaaatatctggaggtccagtgccccaactactgtctcatccaattttctgacaagtacagagataaaaatggctggtggagctgctggagaggatagagtccaagctgtgtgctctgagaagaatggatggttgatttgtggaatatatgatggatttaatggacgagatgcagctgactttttggcagtaactttatatgataatatagtatattacctatatttgttagagtgccggattaaacaagaaaatggtctatatggttcaccagagggctctcttaatggtgttaaaagtgagttaacactggccatgagatttgcagaaaatgaagatgtgaaattttctgaaacatttcgagctggtgtgcttaagtgcctcactactgctgttgagcaagctgaaaatgactttttatgcatggttgaacaagagatggacgatagaccagatttagtatcagttgggtcttgtgttctggttgtgcttctacatggaacagatttgtgcatcttaaatcttggggatagtagagctgtgcttgcttcagtgccgtcttcaggaatggataaattgaaggctgttcaattgactgagatccactcacttgaaaatccattggagtaccaaaaacttttagctgatcatcctaatgagccatcagttgtgatgggtaacaaaataaaggggaagctgaaggttactcgtgcttttggagttggctatctaaaacaggtaacgtactataattttgtttgggaagaaagagcattaatgcatctctgttcttatgattttactaatacacatgctttacatgtcaatttgcagaagaagttgaacgatgcactcatgggaattctccgagttcgtaatttgtgcagcccgccttatgtgtacacaaatcctcacacagttagtcataaagtcacagaggatgatttgtttgttgtgcttggtagtgatggcttatttgatttcttcagcaatgacgaagttgttcagttggtttatcaatttatgcatgataatccaattggtgatcctgcaaagtatctcattgagcaacttttacttaaagcagcgaaggaagcaggtatcatccgaaatatattatcagttttataattttagtattaaaatatgaaatagttagcattaagattcttttgcgctgaaatgcatattccatattattacacccttagacttaattaattaagctctatagtatcttgtagatgcagggacagttaataatctcttttgaaagaaattacacctttgatgatttttatattttgcataattagcatcattgctccatttttggagttatgttgatatcagggacttaactaactcttcaccttttgttcttcctatgttgtgccagctttaacagctgaagaattgatgaggatacctgttgggagcaggagaaagtaccacgatgatgttaccatcattgttatcatccttggaaatgctcaaaggacaatgacagcgtcaacttcactctgaagatgcagaattcatgcaacaagcttatcaactggtaaaaagttttgcggatgttcgcatatgaatgtgttttaggaatctcgtgtgatagttaataaacgaaatgatgtgtatatatccatctggagttttgggagtgaccagcccttttgttagatcaaaaggtggacggcaaatttgtttgtcataattttgcacatgacttaaacactgatgctcttctgtggcattacaatcagaagagcagaatggaatagtctgaagctttcattagctcatgttgttataattgttccttgttttttttaaaaaaaaaaaaactgttagcaatccaagtatgagccatggtgtgggattgcctgttttctcttgttattaatctgaagatattatagatatgtggagatgatccatggaaaggccactcccagaacaaatggaggacttgcaaagttgcaagtactaccaatcaagtagcataccaaatctgaagaaggccatgtggcaatctgaagaagatatcatgtggtggatgatgaatcttggtcacatcacacataacaaatttcacagatctctggtatcaattttgtgattcctgaatcctgatccaccaattccatgtcgccgcaagcaagcagctacctgttttcttttgcagggatagtgaccgggagagctataggttggtccaacctggaacacaccgtttgtcctattcacctacccatgtacaccacgaatccctgagttttaacacatcactcatgacaacgatgtcttaattaaacctaaaaccacaccatcacaggagcaacagacaaaggacagcaagcattctataacacaaaagaccaaggaatggccataggaattggcattgtgaagtcctctcttttaaccatttctccaccaagcatgaagcaattcggccatgccataataatacaggctttttttttttttgcagcgttggcatagactaatagcaggctgcgctttgtaaaaatggttaaaggttaaagcgaccgatgatggcgacctcctcctctctttgacacccatataaacatgcagttttcttcagtgtaactctcacttcttcatctgagtttgtgtcaagtactgtcgatctaatgtgaagtttctttcggtttcgaggttagtttgtactttgtagtagttagttttggtagagttctgggagaggatggaggtattcatccacgaggactacgtgaacaagcgcaacgaggtgaggagggagcagaggaggaagcagctgcagatggagcaggcgctcgccggcgtgtctccgccggcgccggagccccgggagagcccgagagtgccggcgcagtgcctgacactgaccggcgggccgtcgaccacagtcgggtcaccgacggcgagcgcgacggcggcggaagctgccgagacggtgggtcaccgtctctttgactgcctcaagccgtactagcctatgtctatgttacatgtgcaacagtgcaagtgaataaagatggattttatggtgaaaattcagtggatctacttacgcagccttgactgctgcacaggacaaattccaacggtttacattttaggaccaaattgatctatcacatgaacatgtaacattggtgtatcattgaaatgaccaaaaaaaatcaacagcatttgttacatggtgcttgtttgagtatttttcatttaattacatgtgtatatttagttgtgcttgttgctcagaagagcactcggcacagtcgagtgataagttaacaagttcactcacacttaacacaaaacctatctaaaaaaatcatagaacaccatatctaggggcactcgtaacacaaaacctatctaaatttttttttactgt

SEQ ID NO: 66142 - DNA, 62342 bp, Oryza sativa
  unsure (1)..(62342): unsure at all n locations
ttgatttgctcaatcgtgaagacaccaaagaagctgtcatctataactccattgatcacagcataggcaacatcatccacactcactgggggtgcaaggagtaagtcagaagctggcaatgaactcagcggttttgtgaaattttcaacagaggaaagtagcttttctaatggttgtcctacaacatcgagtggtatctcaaaaccatctactttccttttaccataaatgaaaccaggcctcagtacaacacctgattaaaaaaatatagattagaaacatgacaaaaatgtaaagtgagtttttttggaggcataaatatagtctaacctgaggttgggtatttggagaggacttcagattcagcctttctcttaccagtgaagtaacccgagttaagaagaaaggatggaagattgtaatcatgaacagaaattaaaatgaatttggggattcctgcagaagaatacaccaaagaagctatgttacattattttatccgtttcaataaaaaaggaaagagtaggttaacgagacagtggcacagttgtacgagggataagttccagctgtttgaggtatttaatctgtcatagtaatcagtacaacaaatttcctagcaaaattcatttatttcacaacgcgtgccagactaccttcaagtttcaggcttacaaatttatataatttaaactacaataaaatcaaagcatgtgtcagctttacagtaattagaaacttggtaaattgcaaaactaagtaaaagtaggagcctatactttataatagggtgggtacatttgctgcaattttctctctagattctcataatgatagtaccaacatagagtaattcattttgatttgttgacacctcgtagacacattacagtgagttgtcaagtgtggtacttatcagagcatttgagtgaatattttgagttaaaaaatccagttggtttgatttgcatcatacagcacaatatactaccccttcagtcaatttttacacccttcagtcaatttttacaaggcatattttctgatttgacccatgcatagattaagaaatttgtgagattgagaagattatagaagagaatgactaatgtatcattaggttctttcgaaaaataagacaatcttttatgtggttagtcctggtatttttttacagaacagaacgaaataaataatagtagaagagaatagcaacaaaatacatgaacagattataatttgcagatgattgcaaaacaaagaaccctcaaaaaagggtaattttactatcactgaaaacgtaccaggaggtactacattttctagtgtagaatttggtatctccaattacttagtacttcaagttactaaaaaaattagagtagaatttaggtacctcgaggtactttatcaatgactgtaaaatttctccttataaaattcgaaggaaagagtatctttcagtgtgactgctcaaagaaacttaggttaagcatggaattgcataatatgcacctgatgtcatatgcatatgcaaacaaattggcacaccactgtcataatgcggtacttaccaaattcttttgcagcatctactgctgttacatttgcctcaccgtttatccttttcatctgttcttcattaccgaatcctccaagggtagacacaacagcagtggcaccaactaacacttcatcccatcttgcatagaaaacatctcctgcaacatagtaagatgcttaaatgaacagagcagcaaaaaataaacacagtatataaatcacactcttggaaatccaatatagtcatctgactaagtcacaggaacaagatggtaaggtggaattactgaggccataaatcaagtttggtctctgtgagaataatgttaaatccagtaatcatggccaaaacaaagaggcaatgataagtacttaggtgcagagttgtttccaaacaaacaatatatgcatctatcagaactcagcaacaagcagaaagaaatactgtagacatgccatcggccaacaaagcgaaaggtaaaaagaatggcgtaatcataaagttagtaaagtaccacagattctgttacacataatgtacatatttctgtaaaagtattatctctggataaaatctggtgattggcattcttcctgtaagttgcgctataatctacttgataaagccattatttgcaggtcaaagcatcatgacatgtagcatatccagtttcgatcaacaacaaaacactactaggcttggagagtgaacttatgttagtaagctggatccagtaacccagaagatttacataactaaagcatacctgctagccaagtaacttgatcaacccaaggatcagagtaagatggtctccctgacctgccatgaacacacactgtgaagcaaatgtgacagaacgcagatttggtagtcagatatatagtatatacatgttctcttttttttctcggactcacaccaattttcaaagctttgtctaacccccctgatgccaataatcataccctcaataaaaaatgtgtatacaaaactatggtttgtgctgagtatgaagactttaggagctcacactggacagcctacccaagagtcaagaagtcatgcaagaaagaccttcagaaagttaacactgcgagaccaagttggttgatccgattacgaaaataagcaagctaaggtgcgaaatgtgaggtaataagactagactggaagctattggaaacatataggaacatgatgaaaaaaattgcatttctcagtagtgatgacctacacaacatatggtgattggttcaaggtatacgagaaaaggttgtggtacctgctgaggctcacaacctcaatacccttagagacagcagctttgcagatagcagagccaacgaatccactccctcccaacaccacaatctgcaagacatcgagaaacgcttcagaatgttgggggagggagtaaaacggcactacctaacaagcaagatatagaatttcagctgctcaggttcatgccttctcggttttcacatcggcaacgacgtcaatcggagtggagtagtcttctctaatatcagacgcagcgaaattccgcttggtcaccagcctgcggcatcaaagagaaacccgcgtcactgtaaactctagcccaaatttcgcagtgagccagtgaacaaggagacagagggagaaggtgggggggttacctggagaatggggctcgggaggcggtggctggagccacgcggagcgccgcggaagctacagccggggcgcaccggcgaggcgggagggacgggtacgtgctcgggctcgacggcgccggcggccgggcgagcagcggcgagggggacatgtcactcagagtaaacaggtggaggtgctccggcgggggggctcctcctctgcgcgtgagggtgcggcggcgagcggcggcggcggcgcgtcccgcgtgggcggtggttttccacctttttcctgcggcgcgcggctgtgagtgtggggttggaggcttagcccctctctggctgccacgtcgcctgcttgtgtgtttcctgtggctgtggcgtgtggcctctggtgtggcgtggggattgacacggtggattttatttttatttttttggggtggtgaacacaagttccaggcgaagcatccacaccgtccagaactgtttggacggttgtgattcttctgtggtgtaaaacatgtaccccctagcactagcagactgattcagaatttcagattagagctcaataaaagtttttgaaataaacttcaactatatacgctgtgaagttcaagtatagatgtattgagatacttacaagaaagattgacaacgaatgcatactacacattgtaaaatacaattctaacaaatcacaatcgaatcaaatatcttcagtaagaaagaatcgtcagatctcgtgcggctgcctgcacttgaaatcagatgcgatgacaggaacttgtcatccgaaacatctggacttcaacttcactggccagcctggtctttgtgaagagtctacttgctcccacagcgtctctgcgtagatcttctcctcttccttctcttcaggggagcaatcagacagctcaatcacatgctcatcatcttcatcaggtatatcctcgtctgtatcctgtgacaagtccagtactaaatcgttactctgcagaattctagcttcagccatggcctctcgcatggctaacgatgtcgcaggcctatcgcccagcttatattgcggtggagggacgacgaatggcaggacaatgtcattgatctcgtgcctccttccactgatctgctttgacatggcagatggtggaataatgaggatgatgccgagctcatagttgcaaatgtgtagcctcggaccagaagaaacggctctggcttcagtaggatttgcttttggtggaggaagttgttgtccccaggctgctggactgaaattgtgagacccacagtaagtccagccgaatgagtgtctgcctagacgagactcgaagcgtctctgggcaacctgtcatgaactcatgatttaacatgtcactaaacaatgttgcaaagtataaaccatgatattcccccaagatatgtataacatcgtaccttgacatgcataggatgccctatcctctcgtatggatgtgggattgcgtcacgaaatatgccagtagatctcagtctttgccatgttctctgccaaaaggaaagagttactcccactgcaacacagcagctgtgaatgtatcccctgaattagcaatatgcttaacgtcgcttctctaaacagatcaatatagttgcttatcccgatatgcataacatcttaattcactgaactaaagcacacaaggatagtatgcagctttaggcacaaaatggaaaagaagacttggctacaaccttacaagcacatcaagtataacgcacatacaatatgatctctcttattggtaaaatatgcaaatagtaagttacaagaagagaaatctacctcaggaagagaaagcaaatgcctggataactgaattccacaagccccatttttcactctgtcaattgttggaaacaacaaattgatagatggcttctttagctcatggtttgctgtccagcaaccccactaggacaaccaatgaaaattggtaaaagttatgtgcgtgaagaattggtcaaaaaagggcaggggtttattagaataggggatgcttcaataaacagttaaaatttacctctggatcagactcttcggagtccaaatcctgattacatcgtttaccagctgctgaagcaaagcttgcaatgaattgtggattaattgaagtcccaatggatgaagcacctacaaatattttaaatctgaagtaaggaatccctgaatatgacaattgattccagctaagaaaaaaaaatgttttactcactgtagaaaaaatcagtctcaagtgtttcaggccatttgaaatgtgacaacacctgtttgaaccaatggaaaatacagttgacactcgattaatgcaagtaaatagaacaggcggtatggattatctcacaatagagctagcaattagtatgaatttggattatcccaatcaccttcaaactactgctagtggtctttttttttcaggctcagtacaaagctagggaggttaacaacaaaaaaattctatgaggcacgactgccccctggtttgcattcgcctaattgggaactaatttggaattgcagagctcctctcaaagttaaacttttcgcatggttactagtccgcaatcgtctgtccacaaagggaaatttgctgaagaaaaccattgttcaggacggaaaatgtgacatctgcaatcaggaggaagaaacagctaatcatatgtgcttttcatgtccgttcgctcaagctttctgggcgatgattaacgttcaaccgcaagttcaagacgttaggcacttccatcgtttgggcccaagttcaagagtgccggcgcttcactgccaggttttcttcctgctttgcatgtgggctatttggaaccaccgacatgacgtcgttttcagcgagaaaagcccctccatctgatcctgcctgcaacgttgcataagcgaggcagctctttgggcggagaacttaaaggatgaagatcgttatgtaatatctgtttggaaacaaattttctcctcccccttacaatctctcaatttattgtaatgaacttatttcctcttaatgcaatgacaaattcaggtggggaatctctccccccccggtgatttagtcaaaaaaaaaaacaaataatatggtagaataatcatctcaaagaactgtaattcagtttacgcatagcataatttatcaaatcaaggtcatatattgcccatataaaattgcaaacctcttctaatcgccaaagtccaagggaccgctttaaggatgctactaatgagcacagaagaggaaaatgttcatcctggatcagtcttgaaatttgagaaaactctggaccctgaattttatgactgtaagatatgcatggacaatttcacagtagtactcttgacttatgaaaaggcatccgtaagaatcttttacatacctttgatacatagagaagcaactgcacttttgtgttagttgctccatatgcagcttccagggcttctctggggtagataaatccagaaaatgtgaagaaccccaagtcactgaggggagatacccactttgcaacctctctaggcaggaaaccaagatggactgaatctatttcagggcattggacatggttatttgctaccataacagaaaatcccaagtatttgtttgccacatgaaccatgcaacacaatatttttggaggtgagtttgtttagcaaaagatgtaaaccttgaggtgtacatagtacataccttcctcggtaaatttatccagatcagcaactaggacactcacagcattagcatctgcaggtatatttgtattcctcttcaagatcacttctgtagttccatgcatgttcacatggcatttactaagaagtacagacagggctttcagtttagaaccagcatcagatggtatatgaaaccgatgggacagaccaactacggatgtttggacagaaccaagaaacatcctatgtgccgatttggtgtgtaatatctgttttctctgcataaataatggatagtggctagtaagataatagggctggattagaactatttcaagaaagaacagcagtagtgtctagtttagattaggaatataatccacttagccatagtatatttgcctgataatctttgcaaattatagttagtaacttagtatgttaagatgcttagtgaaatggcttcagtaaaaggagggaacaacaaatgctatctgaaataagacttactgaaaggcaataattggactccagatagtgaggattgcgtgcatatatccctggaacggaagcaatgaggtatccagcagctccttcaaaattatacttggctatctcatttatccaatatgattggctaggaacttcattgataaggaatgctatgaatgaaactaattgagtagcgaaatctgattttgattcctcaactttactaaaaagagctgaataatctgtggatgtcctacaagggaaatcttgccaccacaccgtgtttgttatgagatgccactgcacaaagcataatttactttcaccgagaataacagcagaaatcaccacaaacagaacaaacaattaaagagtgcatcagaaatgcagaacctgcctaggtgcgaactgaattctagtaacaagcacattcatggagtacagaaagataccgacctgcctaggtactaagttagctgaagtgacaatgacacgcatgctgtctttcctctgtagcactaagagctttggatggtggcatgccactccttgcttcttcctatcctttccaaatgctatctcctctgggaattgggggtaacttgaggggaaaattaacattagcatcagtgtttcattatcatgcatgtttcgcagaagcatgagatatatatacagacaactactgaacaaaacacaaggttgctacttacactaatagtaggttaggataacttccgaaaggggcagcggttctactttcgcgactcgcactccagcacctctccttgttgtggcatgctatcgtcaccggcaggttctgtggaaccttacagtaatccagaaaccttaggccatacacaaatttgtattcccatcaataattcaatcatatatctctcaatgttgcaagcaaaggaagatatacaagcagagagaagacgcaccaggaaacatcggaggtgaatgttgcgataaatactcgctccaagctatccatgggatgcagaagctgtggaagtgtcactccactccgttgctccaccctcatatcagacccaataccaatgaggcgattcaggaagaatgtgctcccatctgaatagcaaccctcattctcattgtgctgctgctctgtgttctcattgctgtattccttctgctctgtattgccatcgcaggaccccttgctccgttgaatcaattcatcagtttcattttttgcaattgctgaatcagtgcagtgctccaatttcccctggccaagattacagtcttctcgcagtaaaccctccacggcaacagggtcaattggagcattcaggttcaggggcaagaaaacatcttcttctctcgcctttttcaccctaacatcatcgctgccgttctccacacaatgtgaatccctcaagaaagagagaggatcatgactctccgagatcgccctcagccgcttccggagcgactcggcccgcagcacaagaacctccccgcagggctccgccgccgccaatttgggccgttcgcaggagacgaatttctccaccaagaatccatacctggtgccacggcggagtagcgagacctcgtcgccgacggccagatcggccgggcacccaccgcggaggaggggccggccgttgacgcgcacggcgtcggcgctggaggagcggtgggtgaggcggagggcgcagcccgatgtgctgaggaggagggcccgccgtcgccggccgtggcggcggcgaggggaggcgaggaggcggaggcgggggccgcggcggcgggagagggagagggagtagaggcggtcggagcggaggaggaggaggagtggcgcggcggggcagaggaggcggaggtggaagtagcccaggcctccgccggaagtggaggggtggtggtcgtcgtggcggttctccggcggcggctccgcctccatgggaagggaggggaggaggagatgacggcgagggcgggaattgggtcctgaatttatgtatttttcccgccatttatttccatacgagcacttcaagaattcaagttttcttctctttctgaaacagaatcgactattgactcactcaagggatctgattgtaaatattagaaaacaatgggttaaatgtgtgataaatgtaggggtttctgtgcaagaatgccagtttaatctgcgtcttctgatggaaggaagcggagtcctccttcccatggaagatttccaggtccagtgaaggcggtcagcctgcagatgatgaaattctgcaaaggcactcaaatatatgcagatgataaaaaaggcacatgcaagaagttcaaaaagaaagagaattcaacctccaagaatgctttctataaataaacactctcttattcctatatgcacacaagcattacagtatacgtattcacattacagtttacacttcgcattacagtttacactatctgctgtgagcatgtgataaattgcaagtggtttgctctctggtattgcattgaagatgattaaattaccatggtactagcatatacagttcgggctctgaagaaatagcatatctcatgttcagcagaaagaaatgctatatgttggtatatctacttgtgccaaacagcatatctgtcaccagaggccgccagcttccactctgggccgctcgggcaccaggagccgtccccgatcttcatgcacaacttatcgtcaacgattgcagagtacagatctgagctggcctccaagattttgactgcggagcggctatgtatgtcctggcatttcctgatctccatctgagtacagaacatttgaaacttagtgctggcagctgccaaagatatgcaattgagcactaaggattcaggacaataccagttttgcaattccaccatggaaggaatcatctttgccatagaaatgatcgtagaacaccgtggggatgccaggatgagtaagtatataagcatatccctgagataccatatgtttatcaacatgttcgaacacaaaagaatgaggccaagaatgcctgatcataaaatatatatattccagtatcaatataagcgcatatctccaagattaacgaactgagttaaaagcttttcctattgacatcaagttgtttttataggggctgttctatgttgccatggccgttacaatgtacatcaacctttataagaacatagtcatcatcgtaatggtaattagttttgtaattcaatcgcagggtacaagtcataaatgaagcaatcaaaattcttacaacatacctccatgatatgatcagatgggaatggccaatgaccctgcaatcatgagaatttaattagttctgtttgctagcccatcttcaccatttccaagcaaatattagcacggttaagcttatcttgagcatagaaggaagataaagtaattgttatacctgagtggatcctgtgtcatgattttcaacaaatgtgactgatctcgaaggccaccagcccatgacaccaggcggctttccttcagggtcacgcaaacgccacaactcacctttgacagcttcctgaaaacaacagtaaactgatcaaactaacctgtagacatttaccccaaaaaaggaatagaacaattttctatttctaacctgaagaataccctttgttgtgaaatcaaatgcagcacaaagtcctccagtgctatccatccaattgataattctctgcctgtgtttatctgctaaaaaataattgttcagtttatggaaaaaaaatatacgccaaatgtccatatcaaagtaaagcaaggagcatttttcatggttgagaaaactgtttcgaaatttgtatatggtctaaaccatatgctaactacacagactcaatctaatgtaactgtcatgcattcacaaaagatatctaagtcccttgcttcatctcgacaatagcacaaggagtagaaagcaacaaaagaggaaaccatgacagtggttaataattcaaaaatcacaaaacttcacacgggcagtactgtaaattacagaagtaaaaaaaatcagcatgctagtgttcacagttgtcaatcaaggaacatacgcttaggctagatacagcatcactatggcataagcaatcagtagcaatgtcattacaaatctcttaccctgattgtagttcaaacggtaatcaggggggctatattcacagctatcccagtattcccccaccgcaaaaagaggctttgattgctcaatgtattctttcacaaacttcgctgcataactgcactaaacagaaaattgtggctgatcagcatgttttaacaaagcaatttggaggtcccctatcacagatgatgttaacctatcgagttgactatttaccctttcgtgaaatcaaagcggaaatcttgaaaaccaatgctttctcgaagccagatcaaccagtcaataatatccttccgtacaaatggctgtgtatggtctatgttgggaaccccatcgaagttatcaccggtactttcgttgccctggtaataaagttgtagagacattgataatagtttattaacaaaacatggccattaagatacgatgcaattatgaggctgagaacaataggattacattgcataaaaacaagtcgattacctttccaccagaacaagatgtaacagcatgttcatcccatgatactgggataccatcataacgattatacatcccattcgatccttgagtagtcccaactcgatggttaataacaacatctgccatagctcttacattgtgttctttcattttccgaagcaatgcttgtaggtcatggagggaaccataacaagagtcgaggcagtacaggttctgcggcagatagcctgtcagaataaagggaccagatattcagaccacttgtttctgtaactagctacgagtgacacaatacattgttgactagcttaccttctggagataatgactgtgttggtggaggcagccacgctgatgtaaaccccgattgtgctaggtcaacaactttttcctccaaattgctccaccagttgtgcttatgggattcccagttaaaagcctgacagagtgagcgaaaataacaacataatcagaattgttcattccttttttgggttagggaaggcattagtcaggtagtccaatgatctacagaacaagaccagaagataaacaagccttaccaaactccacctggattatgagttatgacaatacataaataacaactccgcaataattgcacaagtcagttgacaaactactagtatgtatgtggtttccttctgtgcttgcagaacacatatatggtgattccacaatctaatttgtcagctccggcaaatttgatccatagcatgaaagcaaaaggtgtgcctagacagattttcacctggaacaggatttcccttccgtgcttgataattccacctgtcgaggaaatgccacattagaaaaccacatttctatcagatattcagataatcgactgaaatagtagggtgcaactttgtaactttgtaagtagaaacgaggaactaggcaactgagaattggtaggtaaagatgtgagccctgcgtatttaccattacgagcggcctgctcttcaaaattttcatccgaaacctgcaccgtttgtcatttcagggaaatcagaacaaagctcaaactcatcagtaaagaacagcacacacaatatgatctcaggaaacccactccgccgaactcaccatctggcccattcaaaaccacacaaccaaagccaacgcgcgacgacgcgagcgacgaaagcgccctagtagcaagcggctacataagtagctgaacggccgccgccgccgccgggagcgcgagggcacgcggagcgaggcgccgccgatgcctgccagaccagtgggcgcgcgcgcccaccggcatccgccccgcaaaaccagacggccgccgccccgcgcgcgtggcggcaaaaagaggaggtggtctcgcccacgccgatcggataggatagggttccggccaccagccgcgctacccaccccctcccctagggtgagggccccccgccgccggtggattggatggtggggattccgacgagcgaatcggcggcgatttgctgcttcctctcgtttcttcaggcgagaatttgttcttcccggtcgttgccttgatcttggctgcggagcctgcgtggagtgggagtgggaggaaggaatcgaattgctcagcttcttctcctgcaatcgcccatggagatttctggaatttgttctctcgggaacgacgagagagaccaccagagaggaaatgggccgtgacaatacgggccagatgccggcccacagtagtttatatgggcctttttccattgtgcatccatcacaaaattcggtttttttttgtgctacaaatcggttcaagtcagaccgcttgaacttcagtgtgtgaaacacacaatgcgaactactccagctcacaatttcccaatcaacccttgtaaatccaattcataattttcaatgaacagaaaattgaaaaggaccctaaacgtataccacaggaacactcatggtctcctccttgctcctttactggttttccgttaatcttccttgtatcaatggcgttcgacagcgacaggtgaccttcatggcttcaagtgttctaaacttcgaatttgtgattgtttgtgtgcgctttttaacctaagccttgaagctttcggaaaggtgaagtgaaggagaaaataaagcagaaagtaaagagaaagatagtagtgcagttgccgaatgccaatggcaacatccacaatactcctacaaaattcttactactaacaaagctctcaaccatttgattctagttggaagttatagaaaagctagattcaatcttaatatgccacatcagcattaataagaagtttgtaactttttttttggtacgtgtagctttttccttgcatggatatactcatataccttcgttaacctcagcgaattgggcctggtttaccttcctatgggtgccaggtttgtcatggtccatcagttgcaaacatgcttgcgctagtagtttcttactgacaacttctctttttcgtttctattctttttccatttttatggtttatttaacagcattggaatttggacagcaaacagcagcctcatgccaaacttctccaaatgcgtgtgtgttttatccgtttaggagaccgtgaagctttcagaaagggaaagtgagttgagagaagctaaagatattgcaatcctggacaagaggcactgttcacttgtaacttgttcagtcaacacagtagcagcaaaagatggagccaggagatctcggccggaccaatggcagcacgcatgcatgcacagcttttgcacctttttttccggaagctgaccaaagctatacccactggccagcaatggcgtcccggctgctcgctctagggccactcagccactgccaccggcaacaatggcatccatccttgaacccatccatggccatgggaccctctacacttttgcctcctcctcctccacttgctagctgtatagctttacactacatggtggacacctttagcttcaccttgcaaaactctctccatcatcaaatagaggaattgaaaaaaagggagagagcgagaagaattgagttccttccatccaaaatggatccgtctatccatactactgatgccaacaaagcacaaaggtgacactgatatgatattctcatctgtctagatacaacacacatctccatcatcgccctcactaagattgatagtactactagctagtagctgcctgcgtagtataggtaggtagatagaaaggttcgagcagcaaaacagcacaggttagccaaaggcaatgtgtaaagataaagaagaccaccatggatacatatgatgcggtttcatttccctgtggtggtggatggtgaccggtgtggccggcatgcacctctccgccctccggcgcatcgatcaatatatattcagtaattcagatatctgtagcttttcagtgggggcatatgcatgatcgaaagcatccacaaggttggaaaaagacgcatggaatcatggaagggatgagatcgatcgatcgatccgtctcagacacactcacggatatatatttatcgatcgatcacacagtctctcgcttttagcagcagcgagccagcgacttttggcctcaaacgcaggatttgttgccattttttttttgggggtcagaggagtcgagtcatggtgtgcagtgtgctccaccacgacacagagaggttctcggttctcctctcttttttttatctttttttttccctttggatgcatgtcgagttctcatctcatctcattcatagcatcgcatgtcatggcatgaaagatgcgggagagagagacctaaataaagatcacatcaggaaacgcgcttttttcttcaggctttgtcaagcaagtggagcgttgctagtagcagtatgtggcgcgcacagtttggtcctaaaactcccactcgtgttgcatccaccatcattgtgcatttgattcgtggcgtgctgtccggactcgttggacgtcgtgagttagctcgatgcataattgcatatgaatgcctcaatacttgtagaaaaaaaaactactccattcatcccaaaataagtactttctccatcctaaaatatatcaagttttgtttggatgagtactagaatacatctcatccaaacaaaagttattatattttgggacgaagggagtatatactcctaaaattagaggagtgcatttattttggagcgagagtagctagtaatgatctctactactccatcttttcatacgtttgatctttttttagtcaaatcttgttaactttgatcaagtttatagaaaaattttagcaacatctcaaatatcaatctagtttcactaaatctaacatagaatatattttggtaatattttgttttgtgttaaaaatactactatatttttctataaacttagtccaacttaaagaaatttgactagaaaaaaacttaaacgacttataatataaaatagaggaaatgcttaggaggctttatctgtaacggttcaaaataaaattcagtaaagttttgttgatggttttttgcgctggtcacgacgacaatgaaataatcggtgcgtgcatagtcactaaccgtattaatcttgagagacttttaatcaaggggatattaacttggctggcaggaccgatttagattaatttggggtaaaatgtgaataaaacggaaggtttccaaaacaaaacaatgaacggattctaattcatgaaggacggacgatttacagcataaaccaatgaagatgcactaactcgggctaaaactagagcaaaatatactagtatgaaaaaaaagaacaattcgatcgatttattatgtgtgggttgattggttgccattataaagggtttgggcttgcaacactgagcctctccaccttctagtggtttagaactcaattatgactaaaaaaacctcattccaatggtttacaaaaaaaatgactaagagcctaagttaaaaaatatagaaattgctttaattatactatgagacgaagtctgcggctgatatcacgcgatctatgccagttagagcaggtacaatagcaggctataaactagctataaccacatatcaagaagaaaaaagaagagagagaagaaagtgggctacagatttgtagccagctacaacacggactccaatacgttatatgtgtataagaggtgggaccaaatattaatggtgtagtatattttatagttaactattgtataaatgggctattagattagttatagatgatttagagctagtagttggctatattattaaacttgctcacagaccgccatgcagtttatttatcaaaccggccatcatgtctgattggtctgcttggtcagaccgatcccatactgacggtcctcaaaattgtacatgttatagtataaattaatttatctcaatatcaaatttggtcgtcaacatgttcaaaaaaattgctactccttataagtcgtttgactttttttttcctactcaaatctctataagtttggccaagtttataaaaaaaaaattagcaccatctacaacacgaaattagtttcagccaaactaatatttcatatattttgataatatgttcattttgtgtaaaaaaaatattgcttgattttttttctataaatttaatcaaatctaaataagtttaactatgaaaaaaagtgaaaacgactcataaaattaaatagaggaagtattcaaatggtcgaatattgttgattaaccacatttcgtaacttagtttatcaacgttcaaatcctaatgtacataaatatggttttatacatcatttgttggtgcatagggtcggaagtttatagttttgttttctagaatttaaccacaattcacaatggcaaccgtttaattagggaactcgaaaccgtttcaaactcacatgctaggcaaaactcaaaacgtttttattgagaccgtcttagggcagtcacaaccctccatttaggatggtgtctatggcattaactatattgtcatgtaggacttttagcttatgtggcactatattaattaagagagagagtgaagagaggaagaaactgggtctcatgcaagacacagcttcaacacaagaaactatacactagacactatcaagttttgcattgggagataatggtgtcttcataatagatgaagaataaatatgattggtaaagaagagagatgatgtatttattaatggtccactttaagaaaccatgggttgtagagtgtagtttctattgtgtgtcttattgatatggcaccatagacactaattatggacactatgggttgggactgcccttattagggatgaagcgtttcgtgtttgggacatccatttctgtagcggggggattcttctagaatcagagaatgcgcgtactcgtgatcatgcagaagttcccaaagcctcttcccaatgcctgtattccactttccatcgccacctttggagatctcaacatgattctgattccatccacttatatttatttttttagagaaggatccacttatatttattacccagactcttcctttttttcccccacctgatcgagcaatacaatcatggattcccctccccatgaaagttacgccaattcgcttcccgccgcgacacgatcgatcgattccaatcggataatccatcagccatcatcgcccaggacgcagacggattcgccatttctgccggtgaaaaccgaaagtgaaggggggcaacaaaaagaaaaaaaaacgccactcacgcctcgctcgccgccgctgcttttcgcggccgaccagacaagctcgatcgaccgatcctctctcgcgctataggccctgtttgaatacaaggatatttttttttagcccttccttaaatagtccaaatagtccaaaaggatctaaaagaatgagttatttggaaataacccaccaaaaaaactattacacccaagaggtgctaattggagctatttcgggtggagctgaaaaagtgtcttttctcttcctctttcttcatgggaagctgcattaaaggccgaatagatctcaaaataactctgggatccaaacaaataagagctattttattgaagggctattttcttgtgctaaaaaatagcttttaaaataattcttgactagttctccaaacatggtcatgagcttagctgcaatgatcatggttgaaacgcaaggaatcgtcgaggccatcatcacaagttggcgtgagaacaatctcatgtggtttctatcactgggaaaaaggggaagagggaaaaaagcgcacggacgattctgctcctgcggatcgtgttcttgcctagaattcggccatatcgccagcgaatagcaggcgactttttcacgaggaagcaaacgagcttttcttttttcacgggagaaaatatgtcccgatgactcgacgagagcaaccccccaaaaaaagcacggatcgacgcaggtggatgctttgataggatggatagcacacgcaaaatttttcaacggcccatcaagaatcccaaccaaggaattgtgcgaggcccacattccaagcacttttcctcctcttttctttgcggggaaaagcgtgcacaacctctttttccaggcactgcatttctgggattcttcaggacgacctccaactagagtactctattcgttgcttccgcacaagtttttttacacctctttttaggttgtcatcagtgcctaatccctgattaatcccactgtctaacaaaaggttgctactgctgataatagtctcccataatgggcactagctaattatagctgctatattctattctactccaccttctttagtttagtactctgtagtacagtttggtgttttattgtgtgatctctaggtaaagctaggggagatgcaaattgtgttgtgcatccaaattccaatgatgtggacttcacaagattgtactactaataacatattcccatcatgccttttcttttttccaagtccactgtaggctttcttccaataaaacaacatacggtccacttcagagaaagagtatcagtagcaactaaaataacattggagatggagctggcaacttgggttagattaagctagagggaaccatatcttaagatcgaatctattgtcacgtgtttgctcagcgtaactacaaaggtgacaaggcaacaaagtgctcgggtttataattgactactcctttgataggactattatatctggattcttggacgcattagtgagtccatatcttacaggttggagatccactaccctgcctaaaacgtaattgaacacagatggcctgcgtgaaagtagggaaaagcaggaacttagtggaattcttcggtacaatcaaaaacatgtgaattggtgaaaatatatgatataatgtgggagtatccgttaacttcagcgagaaagaaaagcggaactgcactgatccttcaaaggaaatttcggcaagaggcttgtaaccacatttttactccagttttcacattcggggccaaagggagtttccattagtttacgtgaaagaacagcagtgaccagtgacaactgcggcgacaaaaggcagtacgcaaaagagaaccacaggcagtggccagtgatgacaaagttcagtgcaggcgaacaaaagaaggcaaaaacaatagagcgggccggccagaagatctcgtttgctcgatgactgtacccgatcgagttgtgagctgggtgcgtactgcacagttaatgcccgtcgtgcgcgaaaatcggcgtagagataagctaaaacttttttaagctcatgtttagacgctaatttagaatattaaatatagactaataaaaaaactaattttataaatgagagctaatccgtgagacgaattttttaagcctaattaatccataattatcaaaagtttattgtagcatcacattttcaaaatcatagcgtaattagacttaaaagattcgtctcacgaattagtccaaggttatagaatgagttttgtaattaggtggtgtttggatccagggacttaactttagtccctctatttagacattaatttagagtattaaatatagactacttacaaaactaattacataaatgaaacctaattcgcgtgacaaattttttaagcctaattaatctataattagagaatgtttactgtagcatcacataggctaatcatgtattaattaggctcaatagattcgtatcgcgaattagtccaagattatggatgggttttattaatagtctacgtttaatatttataattaatttccaaacatccgatgtgatagggacttaaaagttttagtcccatctaaacagggtcttagtgtatctttaatacttcaaattaatatcaaacatccgatttaacagggacttgatccgatttaacagggacttgaaataagtataggaagaaagctactcctactcctcctagtagtagtagtactagcagcgtgtatgaccagtaggagtacgtgatacacgtcatagactagcgtagcagtagccgaaagggcgaaaagctactcctactagtaggagtgtacgactgctgcggctagagtagcttgcgagccgatagcgtcgatcccgtcccaagtttccaaggtgtacatacgttgaacgtttcttgccgctgctgccttgatgcgtcacgcatcacaagggacaagatgcaaaagcaaatgcaaaggatggaaaagctagcaaagcgaagcaaagctatagcccagctccgacttccaaagacgttcttgaaggtctcgctttccatctctctacccctctcatccccgtcgtcagttctggaatcgtacatgttttatttacataaacccctcttgtcactgatctactagtgcgatcagtacacgtaactttctccgaaaacgccagggcttggcttaagcgacggcagagaaaggttagtagatcgagtaatgcagaggagagtaggcaggcgtagacagagataaggcttaaaagtactccaaacaagtctatcttctcgtcatgtggaggcaactgctacccgtaatctagtctaatctaatccctcatctgctgccgtttcacgcgcaactactacgacagcctgcaactgcaaaacgaaagttgcatgcccaggcgcgcacacacaaaggatgccatatgctgctttcagctctcgtctctttcgctctcgctggcagcgcggcaggcgcgttcggcgttccacgcacacatcagacgcgacgcgacgcagtcacccacttgtgctcgtttcagttccgcgaccaagcatcatgcgtgcacacacgtgatcgctaggcctcaaactttctcaaaatctcgacatctcaccataatccctgttaccacaagtaaaagcgaccacggatcgaattagccacacggtaaaatttgccaccgtttccgtcgagtccgtcacatggggagcttccggacaaagtcaaatttgtaccgacagagatttgtaccacatgtacctgcatgccatttatgcgctgtgggcaagcagtggccgtgcatgcagctgcagtgcacagtacaacgaacaggttgtgtttatttcagtgtgtaaagtttagattttggttgaaattgaagatgatgtgaaaaaagactaaagtttagatcaaactttggattaaacacagcccaagtaatccctcacgcatatacggatcacccgggttcggccgatgcgatcacacgatgccgaggcgcccagtatttacgtggggtgggggcacacagcgcaagactagtcaagatcacggctcaaccacaagcacggcatgacaacattggcgctgcaccgcagcagtgcagctaccactactagtatgatatcttctacaccggggcgctgtacgagtagatttttgtgcgacagtaatattctcggcttgcagcatcttttcacatggaaaaggaatagtgcaaaccagccaaaaaggtacacacaagattggagtgctacagtacagtgtcgacactgcttttcttttaaggctagacctggtgcatgcatgtatttcatcgagaatacaatcgggggttttctttaccacaaaaaagttggggctaatcatgtagaagggggtgaagggttatggacagcaaagtagggttagctgattacattgacaggtaaacctacaggtaataacaaatgaggatttaacctaaactagatgcaactttgtgggtgacttctactggcgtgcaacaaaagctcagtgtccgccaagatccatgggtggggtgacgcacgtgccgtgccgccgtggcgcgccagagcggccgagaggttgggggaagacgacgacgacgacgaggagcttggccacgcgcgacgcgggccaggctggctctcaggacagcaggacatggagcgaggcgttcttggtggccgcgcacaccgggcaggcgtcgacggcggcctcgcagccgcggcacaggcagaggtgccggcacgggagcagcagcatggacgcctcgccggcgccgcacgccttgcagagcgcggcggcgggggtcttggacgccgcgtcatccgcgccggcgttgtcgccaccgcacggggtctcgtagcagcaggactgcgcgtcctcggcgtcgccctcggcgccaccggcgccggccgcgccggcaacggcaagggcggcgcagggtgactggaggagctgatccagggtggcgcggagccccgcggcgacggcctcgtggctcttggcgacgctgagccacgcctgcccctcggcggtcatctggcgcagcctctcctcgagctccatgttgcggcaccgcgcgcgctcgagctcggcctccgcggcacggagacgcccggccgcggcgcgctcgacggtggacaccaccgcccgtacgtgacgccggcgagcctcctcgagccccgcacgcatccgctcgctctgcatagccaacatagacgtcgatcgagtcagacacccgcgcatcacggcgaaccgatcgaacgctcgatcaaaatctcgaacaaggccgtacctcgagtcgcacgagcgcgtcgatctcgacaccctgatgatagagctgagacaggagcccctgcgagaggccggcggcattgccagccctcccgctggtggacgcggcgccgcaacccaccgccctgctctgcacatccccgggaaagacaaggccatggggcggaagaaccatgcgctgctgctgcgccgccgccgccgccatcaacgccccggccgactcatccgcatccaggcgcgccctcttcctcggcacgaatccgtatcccgcgccgttattgtcgttgcaggtaagctcgctccggggaaggtcgctcagcaccgtgtgccctatcccagccgcggccgccgccggagtcgccggcgcgcacccgccgtggtcgtccaagaacaaagaacccgccgccgtcgcaccctccagagccctgcacaggccacaccaatatcagaccacgccatcgatcaaaaccaaccgaggtgtcgatcgatcgaacgaagcgtttacctgaggccatagaggtcgtgggggaaggaggcgtgggagaggtactgcgcctgcacggccatggaagagagagggagcggtggaaggagggaaggaatggcgatggtgagttgggtggggggaggagtggaaatggaaaacggatggagtcgtggaggcagatgggttagggggagggagggttatatttatacggcggtgaggcgtggatggaagacacgttgggaggtggggtggcctgcgaggggacaaaagctgtctgcctcgttttattttggacgtgggggaggcaagcagcagcaagcaacccaacggatggatggctatggcccccactctggcctatcgctttctctctctcttttttcctcggcttcaataatggtcatcgtttacggtggaaatcttttggctcttttccctttctttttccctgttcggtttttgttgcctggtgcgggggtggtgattgattcgtccggtgtgacgtgagatgtggagagtggggctgctgctgctcgctgccttgtggtggtggtggtggtccctctcggtggagtactattaaaggtggcccactcgcctctgggaggttgacgctactctattttccgcttttctttatttatgctcgctatcttcagcgcctaggctgttgggggaggtaatttatgaaccacccaagtcctaaccgatcgatttatatccggttcaacgtgtattgtggggataaactagacgtcctaggaagaaatcatgccatcccagaaagatctagtctaccactgcatttataaatttttatattgtttggtgtttacctgaaccaattattaatgcaagattgtctacttgagcagtggactaaagcataggaaccgtatattactctcttttctccagattcgatgcagtttcagcggcccaagccaaggagatgccgagaggcacagcacagcagacgtccccacgcacacacaacctaacctaacccatctcatccatcgtgggcagaccattgattgccgggccgcatcgtccatgcttgctcggcgcccgggtttgaatacgtctcccgaaacgccaagtgcgtgatcacgatggccccccggacccggatctggactagtttggccgcaccaacgtgacatcaactcattactccccgaagcaaagggcgttggctcacaaatgatactccttttatcaatgtacggttacacgctactttatcgtcgtacggttacgctacagccctcaagggggccttttgattccgtttcaaccgggcggtttgtttactggagaggctttctttttaagatccgcgagtcgtacggacgtttaaatattgttactactacaaccaccgaggttaataaaaaccgtcaccataggcttcctcggtcaccggcacaggcaggatgcgtgcgtacggcgtcatttacgtcggcccccctgcgcggctgcgccctctttggtccgtctcgcacggtgcggtctcgtttgtcctcgcacgcttgatggctcgtaccgaccgtgctgcaccatcgcgctcgctcaggccggacggacgggcagggcaggtcatggaccacggccgtggcaccgcacgcacgtgatgcggttggttcagctcggcgcgcgcggatgccaccaccctgtacacatgaccgtctctctctctctctctctccacaccaccgccaccaccgcgcccgcgcattaacgtcgccaaacgggaacagcgtgacgagcggcaggccgcagggcggggaacgtagtactgcctcctcctggccactgtcgctcgccggctggccaccagtagaagcagtacgtgccaccgggcgcgtcgggcgcgcggccggtggcccgggcctcctctgccctaccgcgacaccgccgcaacaatcacgagctcagaaagcggcattaaacagccgtgcactgcacacaacatgcgtccaccgccaggcgcgcgccagctgctcgcgtcaggtaaaactgctcctacgggcactacatagccgtggacgattaaaatggatcgagtccacgcaactcaatgtgcatgtatcggcgctcctcctctccactcataagtggctgatcgcatcgcgtgcatgcatgcatgcatcgcagggcccccccgaccggtcgcgatcccgcccataatgccgcaccatccttaataagagcactgatgcgttaggactagcgctagtatggatagcagcagcagcagtaccattgctggtgccggacctgccgggcagcctcggaaagcactgagccacacccagccacccatccatccgtcccggccgtatggatctcgcagtatcaatcaatatgttacgatatgatggatggctcgtacggggcgcgtaaatgggaacagtagtagtcgtagcatggtggatggtctccgtactgcaaccacgtctgttcgaggcgtaaggtcgccatgatcaagattcgtgtgcagctaagcgagaagaagggcccgcgtcgccagagacacgtagcgctggtgcacgcacgttaatgctacgctacggtactgatctctcgggccgtgggaacagtgcgattccccgttccttccttatcgcctgctcccatgccgggcacagttgtccagccggcggacgggtcacacgcacccacatccacatgcgtgccctgcctctgcatacttacgcatgacgcgcccgatccagcctacagtgcgtctactcgctcatgctatcactactgctgcacacagtgggttaaattgacacgtcccatcaatacacctccctgctccgtttcggggcgcgtacgttcgttacgttgtggcgcgtgacaccgccgcgcgctcgatggtagtatagtgtggaccttgcgagccgggcgcgcaacgctacgcaaccatcaccaccatgggatgctacgagttgttgctacggccaaggatgagtaccaccaccgccaccagcagcagctgaagtctgggccagagcctatacgcgcggtacgcgagctggtgtagctagtgggaggcgctgcacggtgcgcggcgccggtgggcgcggtactagcgccacggcgcggcgtctgcgcgctctcctgtgtgcttgtgtcgcgtggtccacggccggggccactggctcgcctgtgggaaataaggtgggtgcagttcacagaataacatgccacggtgcggtgctggacggttgcgactgcgacgagtccggcactgtgcggtgtcgaacgggcctactagcaggagcgcattgaaagtccctgtgtaccgtcaaagcggtacggcaacagtgtgctgatgatctgataaagttgcgcactgtgtttatagatgaagtcgctgaatcagggtgtgtttagttcacgataaaattgaaagcttagttgaaattggaacgatgtgatagaaaagtttgaagtttatgtatgtagaaaagttttgatgtgataaaaaagttaaaagtttcaaaaaaaagtttggaactaaacaagcccttagatcagcccacaatactccatgcaagatgagcagcctatgacaattattgctttgtcaaataaaaataactataaacacctgatgtgataacaaagttaggatctctttgaatcatatgaatgaaaaaacagagaaatgagaaaaaatgttggattaaataggaatgcgggtgaaaaacagaggattgcaaaacgcagaaaaaacacatgaatgaccgtttgattgaatcgtaggaaaaacgcgggaatcggatgagagggatagactcaaagaaaagtttccaagaggttgaagtttttgctaaatttcctttaaaatctctataggattatccattacatacgaatttcaaatgataggataggattaagtccttttgtttcaaaaggcttgaatggaaatttttttataggattgtaatcctccaaatttctatgttttttccccaaaatctactgagcccttaaggagaagagaaggaaattcaaaggaatcgggtctcatacaaaatctacctcatgcacaactccaaaatggtagatccagccaaaaatacaataggacaggctacaattttcttgtcatgggctcctgtacaccgtgacctcaatgtagcataaattttttttcctcgtctatttaaatatatgtataactggccttccaaggtttcgaataatcgatacaatgtggctttggagtgaacaaacatagatagatttgtaacatagccaatcctgaatttatatttttttcgtacaaaaagatattacgaaatgtagtacttttaaagggaaaagaatcaaacgattggcttggtgagagaatagagaactggaattattctatactccctccgtactcacaaaggaagtcgtttaggacaatgtttaagtcaaaccttgtgaatataaatcatgaataactctcaagttgttaagtttgaatatgtaaaaattatatgaatagatttgtcttgaaaaatactttcataaaagtatacatatatcacctttcaatgaatatttttatagaaacaataagtcaaagttgtattttgtagaccgtatcgatgtcctaaacgacttcctttgtgagtatggagggagtactaattagtgagggcagcataagcatatactagtattactccctccgtttatttgccttttcactttgatcaattttctaggtgatacttctccactacagttactaacggtgacgtttttattttgcccttcgaggtacaataataagatttaagcatatgcaataaaaacctctagaatatttttttcaaacaataaaatcagcgtatccaaccctaagggcattttgagtgaaaaaagatagaaacaatctcaggggactaaaacttccggtctcaagtaactgaggttcaagactgctttctctgtctgaaaacaacgaaagtggacctgaagttcccgtgcttacgacttgtaatttcagtagatttgacttcgatgctaatgatttcaagtaacgcctattcatccttctctatgcgatattaagctcctttcaagagcgagtataacgtattgtcacaggcacagatatccagattgcgagacagtaattaacgagcttccactagtaatggtgtagtgtgatcatctcgagattgaagtcgagctctcacacctcgagcactatcttgaggtggctttatgaggacgatggccttgtggggttgtgcaccatttgtggcggccactgtggccgccatatcaagaacattattagcaatgagcgcagggacgccattgaaggagtgcaaacaaagacgagaaatacaggtgtggatagcactcaaagacaccatgcggtagatagagatagaggcagaagaagataggaggataaatgtctgacatgtgggcccaaatagatttatttcaatctattatgcaatattgatgattggatgtacacacggctaaaatgacttaagatgacataggacaaaatcacatactatgtttcatccggaggcaattcgctcggttttaggggtgtttggatatggggctaaaattttttagtccctgtcacatcggatgtgtaggacactaatttggagtattaaacatagactaagaaaaactaactaatttcataaatgagtgctaatccgcgagatgatttttttaagcttaattaatacataattagcaaatgttaactgtagcatcacatatgctaatcataaattaattagactcaatatattcatcttgtcaattagtccaaggttatggaatgagttttataattaatctatgtttaatactctaaattaacatctaaacatctaatgtgatagggactaaaatttagtccctatgaaccaaacagggccttagaagtttagtggtatcaaatatcttatagtattaggggctgatcggtttagctgggctatggttgcacagccgcaacgctgcagcccttctagcctaatttcgcttgctgactcctgcagagctgctactgcctgtttcgaacgaacccttagagttaagagaggtaaggctgcgttcgtttatgttagataagttgaggaaacaactcgtttttcgcgcgcacgcttcccaaactactaaatgatgtgttttttgtaaaaaattttctataggaaagttgcttaaaaaatcatattaatccatttttgaaatttaaaatagtttatactcaattaatcatgcgctaatgactcacctcgttttacgtatcttctcaatcccctatctctcaaactcacccaaatcatgcttttatgataatttagacggaaaatccgattgaaccatttatttattaagcatatgcttaatagtacgttatgcaaaacttattaagcatatctttgatgtttagcattaacaaccctaatgagtgtactgtgtacaacgcagtataagtgcacctagccggtctccccacacagccctttcggtaggatcgtccgtacatggcacagcactttttaggatgctgcatgctgtgcaagcaactgcaaatctctgcaattattgcagcgttacactgtactacaccaccactgaccacccccatatcccaatccatccatccagcaaccagcattactgctctccctgtcactttggcagacgagatccacagcatgatgagatagccatgcaatgcatgaacttgtaccacgacgtgtgtgtgtatatcgatcgttgtttgctgctttgttgcgtgtcgtttggtcgaggtagcgatagtagcgctgctccttctctcctctcctccgtcctcgttgctcttgctggtggcagtggcaggttgccaactttctcgcttttgcctgcgactgcgaggcgagggctcgcagttttttgcagggagtatagagaggtggagggaggagtagcagcagcgtgcagcagggcccaggattgtgggggaacagtcagccttggtcagaccatgcatcagatgctgctgtttctgctgcagctgctgggattgatggctccatggggcaggcacaggcgcacagctactagtcgcaacaagttttgcgctgtacgagcgtgctctactactagtagtagtactgcttctccttacgcatcatatgcatgcatgctaacgctgtgctgttccacggcaagcacggtactagtactactaccactcctgtccacaggggcagtgagaggcggtatgggcttgcttgcgtagtcgcgccaggcatgagctgactcggctttatatactacagtatgtatgctgtagagatctggatcgtgcctgcccggacccgacgcattccggcaagacccgttaatcatgctcgggtcagtgtctgccatgagccgtatggctagcatcttgttagctggatactaactatgcctcaagataaaaataccttcccctttaatcgtagaaataaaaaaactaaggaataagaaaaaatataggattaattagggcctctttgaatcgcatgaacaagaaaacgtaggaatagtaaaaacgtaggattttgataggaatgtaagtgtaaaatagaggattgcaaaacacaggaaaaacacaggaatgaccgtttgattggaccgcaggaaaaacacatgaattagaaaagagataaagactcaaaggaaagttttcatgagcttctacctcatgttagaattccttcaaaacttgcattgcattaggtattccataggaatttcataggattccataagatccattccttagattcaaagggctatataggaaaaattactataggaatgaaatcctctaaaattcctatgaatttcctttgaatcaaagggggctttagtgtgtaatgagtcgcatatttgaattttaagcattaaggtacaatgggctgtaactttataaaatgtatagataagggacattttagtcttttcttaatttttaaaggattgtttggttgccacccatattttgtcataatttttcacgcctaatatttagcaaatttaactaacttagataagtgtttggctccaaccataattatgtaaaggtcttcttctggcaaattactagtaggtcccatgcatgcagtaacaaaagatgcgcactgtacgttggcctttctgcaggcgattttgccaccgtttcccggagcacgggagcacggcgttcaccaccgttcgttcagccaggccatgcctgtcgcgcacagctacagacatgtttcatccacactactgttccccgatgctctccccggccggtgcacgcatcatgtggcggtgggtggatgatgcccgatcgatctgatcgatgagatgagattgcaggggcgcgatggatgttactgatcgatcggatcgagctagctagagattcgtcgctacgctactcgtcgcgcgcgatcgaagagagcaacgggcaccatcttagcggtggtggtgggagctagcagccgatcgagtgccggcacgccgcgctatcgggtagtcagggtcaaacgaacacacaagggctataggataggataggagagggacacatcacgcactcgtcgcgcgtgcatggggccggtatagcgcgcgccgtgcctccgccgcagcgtggccgccgcgctccccgtagcaacagtggactagtagctcgctggtggagtggtggtgactggcgagtgacagccactggtgtgccgtgccggccagccgtgcagattgctcgccgagggaggcatgcactggcacgcgccacgtacgggcccaggcccagcgaccgcatatgctggtgtgtcaccacgggcttaaccaaccagagcagtataagcatgggtatgatacgtacagatccgtttatgatggttgcatttccccgggaggtaaaaaccgcggggttcatcggcgttgcctgcccagcgctacctttctcgcatagtcgtatgacgctgtgctgctcgcgtcagggctaaagataacgctggcaggcagtagtacacgttaaacatctggaacacgaagagaagagtattaataatctgaaaaggggaccagagaaaaaaaaaacccacgcaggtttttgagactcggcaatgacaaacacaatatttttttctccggaaattaatgatttgctagtggtacctgccaacttcatccatgtataatctttttttttaacgactcgcactagacggtgcgaggttatattgatagagcagaaaaaaattacaagattacaaccctgtaaggtcgtaaccaggaaaaaagaaaattataccaccacccacacaccgacagcgccaacacacagatccaggagaaggctagcaccggaccggctgccgctaagcgtgaccgaccatcgctaggccaacaacagaacactgccgagatcatccaaaacccgacccatacaatcaacacaaagccaactctatccaagacttcaggattcagggagagagggtgagagagaagatggaacacctctcccccctaggcccttcgacgtggccaacttgtagaaactaggacgccgccataagaggatgagaatctagagtgtgcttgcaccaattgctcagggggtttcggcaaggggacgcctagacgacgtctccaacgagagaagcgacggaacaccgccaccgtcatctgtcaaggtttcaaagagagccgaaactgagctttcgctcggcagccatccttgaggggcgagacggcacgacaacgccctcaggaggggaatgacgctcgaacgtcatcgatgcttgtccggccaaggccgggctgggttttcacctgccatccaccacctgtcgatctaccacacatgtaccattgctccatcgccatccaaaacctccgccggagcgtgggcaccactgcaccggcaccccccgccggccagtctctgcgcgctgccatcagtcgcgcctcaccgggccactggcctctcctcccaccgcaccggccactgcctccacgcgcgggcagcctcgtcgcgccgcaccggcacctcgaccgcacctccacgcaccacggtcgcctccgctgccaccggccgagcctcacttgcctctgctctcgccagtcgcacctcctgcacgcgctgcctccgccgccgccggccgaccagccagccagccgacgctcctcctcccgccagcgccgtaccagccggctcattcccgcgcctccacctcagcgcctgcgcctccgctttcgcacagctgcgccaccgtctccgcacggccatgccatgccgcctttgcctccgtacggccacgccacagcctcgccctcgccagctctgcacagccgcaccccgccgcctcgccgcctgggggtcggggctcggcctcctactctggatccggatagaaggggaccggatctgggcaccccgccgcccccgcgcgcgccgccgccggctcggggcagccctcgcgccagatccgcgcagcagactccggatccggcagcgccgcctcgccatgtcgtttgcgctcgccgtcgcccaacgccgctgtcatcgccccgaagataggtcagggctgagggctaacgccgcgacctcgggggagaaggccccgccaccgccgtccttgcggccgcggcacggtttccggcggcccgctcgggcagcggcgaggcagaaggagggcagcgaggggtggtgctgcggcggcggctgagtcgcctcccatgtcgcccctgccctgggtccagttgcaaaactgacattcgaaattgcagttccacatccctgtataatctaagtcacttacgtaataggggacattgccaatatcattaacatcgaagacttatatgcaaaattttttttgaaaatgatctacttttatttaaaaagatatttaaaattagatcctcagtgcgagtattattggtgccaagggtctatttgtaaatacaatttgttataaataggttatttttttaaaaaaaatatgtccacggtgctaaagttattggcgtcatcatgttagaccatggcttaataatgttggcgcggcgaaaatgattatttttcaaataactttttctatatctgtctataaaataagttttttaaatggtctaaaatataaaaaatcgtgtgagatggtaacagtaatttcgggcggcccggaacgacaatgaggctttctgaatttttatactggagtagtatttaagtcctataggcatttttttttctccgatcctttacaacaaactatcgacgggttataccttcccacggtatttatagagtatatggaacgttagaatcaagatatacacaagattgtatcaagtagacaagagacaaaaagttatatcgattcaaatctcaagatgacttgcagtttatatgtattgctagcaggattcacatggattacaatgaaggacaaagaagcgacttgatctaatccatcgactagaacccaccgaggacgactcagcaagatttaatcggtgactaagactccccgagaacgactcagaaagatttaatcggcgactaggacttcggcttcctccgaattgtatctcaatgtggctctggttatggctgtaattcgatgctcttctccacgagggaggtcttatatttatagcgatgatcattttttttccaagtagaatccgaagaattaggccaaaatatagactaagaagatcttatctaataggattctaacgcatttttccgagaatacagttttcttctaaatttacagtgttgctttaattaaaagataacttctcgtatatcattagatatataatacttttatatagtacgataaagtatctgaaatatctttcgtataaaatataagggtatgtcttatcggtatatttcgagcttatgcgatgactttgtgaccatggtatagcagtacatccaaatattactccatctatcacgttgacgtgcaggtgcaacaggcacagcttgacgatgcgacatgaagcgtacgctagcgacacggagcatatcacgtttcggaccccaaatagtattcggcgttgtacgcgtggtttccgacgccgtacgtgccggaacctatcgctagcttgtacagtactactccagtacatttaccggctactcgtactgccacggagtaatactgagtttgtatctaaacttcagtactttttcatcatattatctttaattttaaccaaaatctaaactgtactttttcatcatattatctttaattttaaccaaaatctaaactttacgttgaactgaacacagatgaagcaaaggaaagaaaagatcgtgcctagtttaatctagaaggcgagagggagtgaattaaagcaacaacatgtgttaatcattttcttaatatgtcagtttaaggtgactaattaatccaaccgggacggccgggtcgaagagttaattattaccagtactagtagcagaagagagcagatggacgtgtcgatcatgtgataagtggtgatgtatcctcgcggcgaaagtgatcggcgaacaaagcgtacgtgacgcgtgcgaccgcggaaaattcgtcacgtcgttttcggcgggcgtcgctacctgccgctctccgctggtcgctgtatgtttttgcttgtccggtgccatttatgccccgtaggtggtggctgcttaagcttgcagataacaacaaaaatggcttctatccttgacaccgaggttgatcggtcgcttccttcgcttctagtggcccgaatcttgcgtttcagctacaacagcgactcttcaaagagctactggaaagaagaaaaacatcgcgtcgatggacgattctcctacttaataaaatagataaatagcaagaaggcaacataaaaaaagaaagctactactctttgtctctaaaataagaggccacaaaaatatcataacctttatgaatgcataaacaaaacggaaaggatatatagtaatggttggatggctaaattgagaaaagaaaagaaaataaaatggtattaacaagtttaatagaccgtacatattaaaacacactatttgtgggataaatctaaaagttatagacacttttttaatgagggaataggatattgttgattgagacaaacaaaagcatgtgaaattacatagtacactttatcttccaaaataaaaaaatgtaaagctgtgggatcagtagtacaaaggcagttggtgtatgccaagaccccgcagtaattttctgaccgtgcaggaaataaatttggtccctgtaaagtcccagccaaaaattactcccctactgtatcccaagccagccatggcctggccattggccaacccccacctcatcgtgtcgtgttgcggtgtggccgtagccatttccaacaaccttttcgcttgtccgaaagcacaagtgggggcgggcgcaggccgtgggcccccagcttggctcccatttcccggtactgattcctgaaagccaccacacacgcgcacctgcacgccgcatcgccatctctccctttcccccgtggacaaacccctccggtgggcccccaacccggatccggccgtgcgacgcgcgcgagaggatattatcgttgggcccacacgacaccctgtattatctctctctctctctctcccgatttccccatacgaaggccaaaaccgtaacgattcatttctgatgtggtcgttccggttacacgtagggtgcatgcaaaatcgcaatccatggtttgtgtattttttccgtctcaaaatataacaattttaactctcaagatttatcctaaaatataacttctccaccaacattctcttttcaaccaatcacaactctccaccactcacttttcctacctatctccactactcaatctatcacaactctccaccattcacttttatctacttttttaataaccgtgtctaactttaaaacttcttatattctaagacggatggaatattatatttcctggttgaaatgaacctgataatgggtggaaataattgtactccgtagtaattcttgttgttcccctgcagtaaaaagaaaaaaaaaatctttgtctattgtttttcctactcacgtatacgttcacgtaagaaggggacattgccgtgtgtatctcgctggccgtagagcacgacgagatggtattaaatgcgtcctgatcccgtacgttcagaagcggacataggcatccggatcctttagctggtgacacatggattcgcggctcctctgctttgttcttgagcgagagtccccggccggcccacggctcgctcaacttgcaaggtcgcacaactcacaagcgttgcctgcgcagctaccgttgttgctaataagatactactcctacgactccatgtctccatatgtgtagacggctactagaattatcaatcgtgtcttgcttatcctaacagaagttgctttgccaactctctctgaaaaatctcttcagagatcagaaagctgtatgatcgaatatgttgtactctgtttttagttgcaataaatttctggttctaaaaaaaaatcgtggcctagccgacgacgatgcactgtgcgcgcggcaaacaaaagcgtacgggtgggggcatggggagatcgatcgatcgacctgctgcggactgcactgcagtgcacgtcatcacgtgggtaagctggtccttggacagtggccgctgtttgcatgatgtgcacatgccgtcgttcccgagttgtttgctaatcacggagcggttaggatctaatcagaaccactacaacgccatgataaagtggacgaattgattagcatgcgtgatgtagatcctacgtacataccggccccaccacacactcgtagagtaatcaaaatctggtagtagtaacagtcaaggtatcacaaaggttttgcatgggtgacaattctgatgaaaaatactcgatgaagacaagatccatccacccatcaatatgcctgccaagccaaggcaggattgatagttgtactagtcgtttgatagggcaacttgcggggtgcaatcgtgcatgccaccttatagtacgtgacaccaaccgtacgtttgttgcgtccgatcgagccaaaccagcagcacatatccctgcacaatgacgatgccagcccggccaccacgatcgatcgatcgagtcagatcactcatcgacgacaccgatgcccgcccgccgcgcggatctatcgagccttgtcgtacgcggcccaagtggccgggtcgccaaccacgccgcacgcgacgcgcgcggccaacgcctacatgggcctgaaaacgtacagcgacacgcgcgtacgcgtacgatcggtgccgacgccgactcctcacgacgacgcgcgcgcggagacgccacgacgtgcacggatcgaatcgcgcgcgcttcagaattttttttttcactgtgcgctggcgccgaacacagtgtcgatgaatggcttcacttacattttcaaccaatcacccaggcatgaatatccatgatttgggtttttctaagcaatcagaaccccgaagtggggaagaattttgacttttaaagctgtactagcgaacactgtacaagatcacgaattacgcaccgaacatgcatcagaccctgcctgctgtccatgcatgtgattggccatcggtcggaaggcaaagaccgaccacgtgctgcaaacagtccaaaggccggcttctctctcgatctcattgcatgcttgcatgcatgattcctgcaactttcgcttctctctttttctttttccttcctgtaacaatgatggagtaaacagtaacacagtcccgaccggagtcacgtttctgctgggagggagggaaagagatcgacaaagcagtgactggcggcttggcttcacgtcgatcgaccgatcgcatctccatctgttcagtgttctctcttctcatgcaaacctgtaaagcaggagagcagctagcagcggctagctataggcgactggcgagcagcagcttacgtaccctttgcgttgattgaattgagtcggtggccagcaatgaacgcttagcgcgcgtccgtttctctagcgtagtacagtctacagttttgcccgtgccgatcgatcgatggatgcaaaagcttagctctcgccaagatcgccgtactaatgctgcttgctgtgcgcctgtgcgtgcatgtgtgttgctactgcaaatcaaaagggtaccgcaccactacgtactgcatgatgaatgatgatccatgcatgcgagtcatgcgacaatgtctatcgtcgacaattaggctgctttgagtactgatgacactgaatacctatcgatcaatcgatccagatgtttccatctctctgatttcacgagcctcgctaacatgacgacagtctgtatccaggagtagtatttggctatttgcagctcgccatgagtgtgtgtttgcagcacgtacagttctctgatgataatggaagcggttgaaggatatgataacttcgcatgcgtacgtcctgacgtgtcatgtgatgggcagggttttttggtcgttggtcattaccgttttcttatggtgtaatacaagtcaatgtagtattgtacaccctgtctgtgccatgatatccctgatatggacggtaccactggacagctccattactcatctcgatcaccacacgtttctcattttcagcccatccatcatgcaactctactccagctagtactagtagctactagcatatggagtatatgatatgatccactgctgagtgctcgttatttttagccttggaccacttcgtacaaggaaagttaattcagcatcatgtgaaagtgccccggcaggccagcattgtccacacactgtagtactaaacattgcaagtagtgtctagtgcatgcatgagtgcacccttctcaatcagcgatccacatatctctcgacacgtccagctaagatctgagatatatcatcttctcatttcagggccaccccaccatcaatccaaactccattcaatatgcagagtttgtccctatgcaggggcataggagaaatagccaaaccattatatttgattagtccagccttgcctttttaggtgcccccatatgtgtatgcgtctccatctcgcaaatttgcatagtaatcaaaatggtccaggaccaacaaaatggtccaaccaagcaagcaagcgatcgagtaagcagggaacaaccagcccatgtgtgccacagattctatcaactagtgccggccttgaagatccgtacggctttcgacgttgagattgaatgaaagtatgatacaacttgtccccgcaataacttaatctgggagcaccgatcatgtgcgtgcaattccctatgccacaagctaagctgatgcttaatcgtatttgtgttagtagcggtattattgtattatgtgtttattttagagtattttacggtacaatatactgctagtatatactgaaagtatatatgatctaacagtgtacattgatttgatttttttaaattagattgcagtgtaaagtttgaaagggtaattttgtcttttcttcgttattctattatcaaatcgtgctatcgtcacgtgctttgtcatcaaatgactctcagaatgctcctcccttagtgcacgataagatttagaaccaggtactcctaattagattcaatttaaaccaaaaattactaaagtgttattttatttcctataaaattcctaacatgctcttctacatactgccagtatatactgatagtatattgtaccgtaaaaattctcttattttattcttatagcgtgctgatggagacaacgactgcagttacgccaatggatcaagcaggccaaaatagacgtgcccctaatcatgttttagggcctgtacggtttagagaaattttaactcataggaataaaaaagtgaagaaatacaaagatatgtacacattaattcatagatatttttcaaaagatttaagtggatgaaaattttcctttgtgttttctcaatacaacttataaggaaaggaaaaaatcctttagtttttacatactacctctgtcccataaaaaataaatttttaggaaattaagaatatattagtgggatagataaataactacaataaccctatttaataagcacagtacatgcacatattccatatataaacttgattaaaagttatgtcaagacaatgagttagagatgggatgaaagaaaagaagattacaagaaaatataatcagtttattggatcccatattaagtagaaatacaaattttattggataaatgttcaaaggtagaaattcaatttttatgggacagaggtagtacttcattcctacaaatcaaatgacatttatagaaattaattcttaataatacaaatcctttatttttcccttcagaccgaataaaccgcatattattctccctgtagtactatgattaacaagtgaccccgatgcaaattgcgatggcggcaaattgagcagagcatccatggtggcgtgcatgcatttgactgggaacacatgggttctcaatttctctctggttttgcgagacctgcactagctacaaaattcgtggctgctccgtcatctaacaaacgtaactctccaattaatcgtagtgctattggcgtacttggtaatatatatcaactaccactagacaattcatctggattaacaaccacaaatagctaaattaaatggtttaaaacatgttttcagatttgtttcggtagcgttaattttcggtaggcttgacagcgaagattctcccagtaacaaccgtttgtttttagaaactggtaaatttttttcgcgaacgcttaaaaagattgcacgttggtatattagaggaaatcaaagtttttgttacgcaacacaattggccggacggtcattgcctgaggacaaggaacaaagagaaaaacaaaaagactgctaaggtaaaagaaaaactactactaaaatgttgtttctataaagagggaaggtggtggcgaagccccactacactctcaacaagccctcaaaagtagcggtgctaatagaagactacagacgacctttctaaatgatggactcttaaaccttgtaaaatatttatgggcttatgttgaccctgtttatacgcaaatgtaatgagatcaatttgtgtggtccatatgtttgtgatgccttatgacttgaataaagtagccacgctagtagtttaccggcgatattaaagaagagtacgctttggttgactgcttgtgcagttgtgcatacgaatgtacggaagatatgatgaatctttttaattgtaagggcaagtgggcaaaaccacaaggcccggaatggattgagatttggttagcttatctttgggggtataattaatttcataatatattgccgaaattctgggtaaactcataaaaaattgtgtcaagagcgcgggttgacgggtgttgatgcttacgccgctctctgcagcccatgatgcctcgacatgtcagcttagttcttgagggattaattgtgtctataatgcgagtagtgacaagtgatacggcatcatcatttggctgaataagccaaactgtatataataaaactttagcgatctaaaaataaaagctgaaaataaatttagatgaaaaaaactctaaaatcaacttcaaatttaaggataaaaaatttaatttttagctgataagtataattaatataagtgaaaaaatgaggctgtataaatctttagattattgtgggtatcattgagcgtgggtaacatgtgtcatcacaatattgcagctcgctggtggtgagcctagatacctgtctgagatagcgggattgaagtctattgtgtacatcctgaacatgataattttaaagtaaattgcgcccgcggtacataaacttgtaaggtgggtgcaatttagtgtaaaaacttaaaaaactctcatttcggtacacaaacttgcgtagtgcgtgcgaaccaaggccaagacatgacttcatcaccaatcttattgagttggcttgagattaggatgccacatcagcgcatacacacgttatgggggcgcgagctggctacacatatttgcaaataacccctcatacatctttcaattcctccgaatcttcttttgtgttgtagcccacgatgatgcccatgctagagatcagtttcacgatagcctacctccaattgagttagcaacaaaaggagataaatcaggagattgatatttggatcaaggtggaaggctgcgaattggatccaggcggtagggcttttctgggagacaacacaccggccacgtttagggcagcggtggcaggacgttgccgccggcgctgaggcaacatggtgccagggctgcgaagtgaaggtgcacgatctcatgtatacagtgagtactttagtttatcaggtcaaaaatgagattgtctttctcaattccaatttttgtagagatttcttcctcttattgtcgatttattaggtattgcaaacaagaaggactattagttgttttaatttatgccaggagctagttcatggtacacaaaagctgtaatttttgttgacatttatggtatagaagtgatcacgacaaatttgtatttttggagagcaatttgatcattaatgtactgctagtttctgttgttaactatgctttcttcctggatatacccttaaacatggatatacccttaaacatctgaacctaaagtaaactgttctgacgatgaataattatctgtacacaacatatgtagattacgaagatgaagaattcagcattgagatgcaccacggaggcttttttatgggaaatggtgtaaaccgggcttatgttgatggtagagtaaactggtttgaccattgtgagtcagattcttggtcactgttgtgggttgatgatttcattgaagaactaggatatgagaaatctgataacaccaaaatttattggttgcttcctggcaaacaattaagtgatgggttgagaagggttaagtgtgatgcagacactaatagtatggtcgctcttgtacctagggtccgatcatttgttttgtatgcagatcatcaagacatagttgacgctattgacttatatgatgtggcaattattggttcagattctttgcgtactgttgtgaaaccaagtaaaataattagggctaagagtgatggtggggagttgattgtagataaacgtgctaccgacgctaaaattgatgatgaagaggagtcaagaactgaagatccaaattttgttgatagtgattatgagattgatcatggggatgatgacttgtttgataattgtgttgaagggaaaattgagttagcgcataataaagaggagggttcagactatgtttcatctgaagatgaaaggttgatgatgccagatatttctgaagaagaagaagaaaaaatcaagttcagttttaagagttttagggctaatgtagacatggagacacctgagtttaaggttagcataatgtttgcagatgttgtagagcttaggaaagcaatagatcaatatactataaagaaccaagttgctattaagaagacacggaataccaaaacaagaattgaagctaagtgtgctgaaggttgtccatggatgttgtctnatntatggataatagagtcaaatgcttagtggtaagggaatatatagagaagcacacctgctctaaacagtgggagatcaaggccgtcacagctaagtatcttgcaaaaaggtacattgaagaatttagagataatgacaaaatgacactgatgagctttgctaagaaaattcagaaggaactccacttaacaccatctaggcacaagctaggtagagctagaaggatggctatgagggccatatatggagatgaaatatctcagtacaaccaattatgggactatggacaagaattgagaacctctaacccagggagctcattctacctgaacctacattttggttgcttccatactttgtatatgtcattcgatgcttgcaagagagggtttatgtttgggtgtagacctatcatttgtcttgatggatgccatattaaaacaaaatttggtggccatatcctaactgctgttggtatggacccaaatgactgtatttttcccattgcaattgcagtagttgaagttgagagcttgaaaagctggagttggtttcttgacactctaaaaaaggaccttggcattgagaatacatctgcatggacagtgatgactgataggcagaaggtatgactttgtctgatttttttcataatatacataactcacattttagttcctaactataattctttataattcgtttccaggggcttgttccagctgtgagaagggagttttctgatgctgaacaaagattctgtgtgaggcatctatatcaaaattttcaagtgttacataaaggggagacactaaagaaccaactttgggctattgcaagatctagcactgtgcccgagtggaatgccaatatggaaaagatgaaggcattaagtagtgaagcttataagtaccttgaagaaattcctccaaaccaatggtgtcgagcctttttcagtgactttccgaagtgtgatatccttcttaacaataactcagaagtgtttaacaagtacattcttgatgccagagagatgcctattttgtctatgcttgagaggattagaaatcagatcatgaacaggttgtacaccaagcaaaaagaactagaaaggaattggccatgtggcatctgcccaaaaataaaacggaaggtcgagaaaaatacagagatggctaatacatgctatgtttttcctgctgggatgggagcatttcaggttagcgacataggatctcaatacattgttgaacttaatgtaaagagatgtgactgtaggaggtggcagctcactgggattccttgtaaccatgccatttcctgtctaagacatgaaaggatcaagccagaggatgtagtgtcattttgctattcaaccaggtgctatgaacaagcttatagctacaacataatgccactgagagatagtatccactgggagaagatgcagggtatagaggtgaagccaccagtatatgagaagaaagtggggaggccaaagaaaactaggagaaaacagccccaagaactagagggtgggactaaaatttcaaagcatggagtagagatgcattgtagctactgcaaaaatggtggtcacaacaaaactagttgtaaaaagaggaaggctgacttaaaacttcagaagcaacctatacagcaaatggcgacttcatcaattgttgatgaagaagagcttgtcatcacttgggtaatatttatacttattttgcttgtttatttgtttatctccactaactatgaattttaaactcattgtatatttgtttcaggaacctgtcatcactcaggtactattgatgctcattttgcttgtgtatatatttagctgcactaacaaggaattttaaacagaacatatatttgtttcaggaaatgcacctgctcagcataccccagaaaaattctaactatctgagttcatctgtggtggaagcttttattaaggaggtgacagtccttcattaagttctcaaagaaaaaacaatccttcattaagctagcattttgtcagctaatagcaaccatcataaaattagtacataatcttttacaggctgctagcaaacatcaagaaagggtgccagagtctgctttcattgctactaataggagagaaggggttcaaccaccactaaccacatcaaccaaacaagggagggccacattgaggaagagaagtgcagcacccaagaagaaaaactctcccaagaaaaagaaacagtagtttatactatgcattcataaagttggttccatgttatcgattttgagatacattactagtgcacaatcaaattcatgccaagttatgcatttagttttcattcaagttattcactgaattttattcaggatctcagtttctgttcaaaatatgcactcacgtgtttcattgtgttcagattttgtcacaatgtgtacaattaagcattacattccttgctgcttcagtggacttaatgttcatgctgttaatctgacggcacaatggcttaattccttgctgcttccatgtctgcactgaagcattggagctaggcttcaaagttgctatatgaattgtcagagtctgagataactgatgttggcctaaagcaaggcactcaaatgcctaccgcagcatcaacttctaagctctcctactaaacttgacctcctcgccatctgtcactatagtcagtctcggcaatactgttgcagctactgtcgtcagacttgacctacccgttgtagccaccgtcggactcgactccccccacggcgtagctgtcaggctcgactcccatcactacagccaccgcggattcgaccttcccagctccccgccgctatgaacacctctcagattcgtttcacttaaaaattatacatgatcgaaataccaaacaatagaaggggttttctgataaaatagggccattgcttacgagcaggcaaacatgtccttcttacgtgaatgcttagttggcggtctactcatcatccaactcagcaaaattagatttgctattctatttagtcatagtctgcacgcacctatacaagtttgtgcaccaaaacgagagttttgcaagtttttacactaaattgcacctacctaacaagtttgtgtaccgtgggcgcaatttactcatttttttttcaaagagtgtgattccgggatatagggccgatgcacttgctggctaatcaaggccatgtacaacgactcgacgagcaatagataaatggaaattatctaagcatgtagttgtttgaggaagcataggacgggaaggtttacattaccgcggggtacggtaatagaaaaaccgcggtaacctccttaaatttaaataaattaaaaagtaatttgaatttttgatgaattttgtacggtttcgtatagtttttcacggttaccgcgcggtaaccgtgcttaccgccgggacgtggtaaccccggccccggcggtttgggaaatcctggactgggctaggcaatatctaataatttgagaccctgatactaacttataatttactaactttcatgggtcttttaggtgggtgttattttcagggccatgaaaattaaacaagcatgttttagctagatctcattgaaggagggagattttctttttgtggaaaaaaaaggataagaatgttcttaattttattacttagaagttagaacgttgtcttggattaaatgtaaaattggagggcccaaattagcaaagtactaatggtgtgttcaattcctgaaaaaagttgaaagtttgaagaaagttgggagtgtgaaaaaaaaagttgaaagtttatgtgtgtatgaaagtttttgatgtgatatgatgtgatggaaagttgggaataggggagaaactaaacacggccttatgatcgtgcacactgcacttgattacgtagtagtacaaccctagctaggccaggtgtacatactacaacaaaaaaataattttcattgatacccctttagactgtatgggcagttcacaatgaaatccgccatcgcagtattcttagggttacacaccgacactggctgtctatacaaacaaatatctaagaggcagatgatttaaaacatttgtatttggaagtaaccccatttccacatgtagtagtattagatggacgtctttagatatgttatctaatatggagaatgtaatctaatatggagaggttttgatagcatatctattgaacattgtaatagagaagcaaaacaaagttgctcatgaattggccagggtagcttttagtaggaaagagtattgtacttgggttgatgaacctcctgcttatattctatgcactttgacaaacgatgtaccaatgtgtaatgatcaataaagctagctgaatggcattcccttaaaaaaaatatgggtgtctttagaagtaggtatttttcatacgttaacttaggtcacccaactgtgaaatagtttttacatatgatcatgttaaataagaaggttgcacgagaaaattgtttctaaaaatagtgatgttaagctggtcgcatatgaaagttatttccacatggcatagatgatttattgcccgcctatgaaaatgcgccattttcatttattttttgttacaggaggttggccaaaccacctttgcaaatgtattttacagctgtaaaaatatcgtttttatataggagcgacgaaaaagatataaaaaaatttgggagcaacggcccctctagaatatatagttgcttcttttaaagttaaggatcataaacagagatgatcttatccttccattagacagctggagtatctaagcatctactccgtactgaactagatatgcatatcctaattaacgtcatacatttgtacgatggaacaacagacgtgcagtagacatctactccctccgtcccataatgttgcaacctaggatgggatccagattcgtagtcctaggatgggtctcatcccattatgggacggagggagtaaatatctaatatgaaggacccattcgtacaagatcagcacgggaaaaacattgcccaagatttttgtttccgcctagtaaggttgtgctgagcgatcaacgatgaaccgtggccatccatatatgtcgcgatcgtacggcccagagtggccctagaagtctacagcccggcgaatacacgcagggacggatcgatcgatcctctccctgtatggtaccacgggttgacggtgctacaggatgctagctacagtctgagaatcgcgatggcagagagaagagaggtcaatcaacattgttttcatgatcgacacatcaactttgagtctttgacactaattaatcaagagagttttttcaagcggattttgaatttttgatagagatttgatggcacaggacaccgatccattttcaggctaatcaaatcagcccgggcgcactggatgggcacagtaacgcgcagtacgtataccccagtgcctctctcgctgctgcatctgcacgccggcggcgacgacgactgagctacaggcctgcagctagctagctgcgcccgctgttccgatggctccacttcagcgtggctaatcacgacttctccgaccaccaccactcgtacggtttgccgcgcctgtgcctgtacttgtgtacacgcaccagaacaaattaagtgaaccacgcatcgatccaacgtgccagcccggggcagaaggtccacgccataggtagctagctaggctggtactccctacgtacttgtactgttacgccattgccaaggaaaaaaaaagatatggccttatttagttcgcgaaaagaaaatttgtaggtgtcacatgtgggttaccgtagtatttatggctaatcattgactaattacgctaaaaagattcgtctcacgatttccatgcaaaccgtgcaattagttttttcattttatctatatttaatgttccatacatatatctaaatattcgatgtgacgtttttagggaaaaaaaagaaactaaacaaggcctaaggctgtgtttaagatgcaggggtgtaaagttttggcgtgtcacatcgaataaacagacacacatttgaagtattaaacgtagtctaataacaaaacaaattacagaatccgcctgtaaaccgcaagatgaatttattaagcataattaatccgtcatttgcaaatgtctactgtagcaccacattgtcaaatcatagcgcaagtaggcttagaagtttcgtcttgcaatttatacgcaatctgtgtaattagttatttttttcgtttatatttaattctcatatgtgtccaaacattcgatatgacatgttgtaaaattttgccaggggatctaaacatgccctaagccctaaggtgatgtttagttcccaaacaaaaactttttaccctgttacatcgaatgtttagacacatacatgaagtattaaatacagaaaaaaaaactacttacacagattttgtgtaaattacgagacgaattttttaatcctaattgtgccatgatttgacaatgtggtgctacaataaataatttctaatgacagattaattaggcttaataaatttgtcttgtgatttataagcggaatatgtaatttgttttgttattagactatgtttaatatttcagatgtgtgtccatatatttaatgtgacacgtaaaatcttttcacccgtgaactaaacagcctaagaggagcagcattgcatgggcacgacggcgacccgacgcagtcgacagcaacccggccggccggatagtacgtacgcaccgatccatcgccattagcaatccggcataccatctttttaacgtgaaatgtcgacgagaactggtgccactagtgggctggatatcttgtctcgtcgtcgtccaatttccctgtgcatgatggccgcctcgagatatataaaaactgagagtgcttgaagattttcagttcccctggagaggtcgagatcaagggggctgtagagcagtggtgtgagcttgggtagcactatcaatccgttgtctcatcttaaagaaatggtctcgaatttctaattaaatagatctggcgactgattgggctctcctaaagtgtaggctagcctcacatggcgagtgctatttgatagctgggaccggtttgcaaaccaagttagccaagctaccaggagtagcttgcagaatagttctgcccccaacaagttgttactgatgatcgatatggtttggcacttgcttccgtctaagattaagcagcggcagtgaagcgtgcatgatagcttcctgcttagagagcttctggcagatataatttacatcggactatctgaaaatcgagactgagctaatgagtaagaagtcagaagctgaaaagaatattagcctttttaaatactcatcagttggctctccatgtcagaatctaaaacttcatttggtatagtagtatcatgcaagggaaggtacaggcttgtggaatgatcatgtgggcatgtggtgattacgtgtatgatgctaacgagttaaccatttccatttgggtggttgcaggcgtcagtctgtttgattgttgctatttcaatttctatctgatgcttaaaattagttaactactagttgagtcttcagtcatcgggcgcatatacaggacggatcaagtatacagctcaacccccttgaagatgaccgactgaccaacaactgaaaattggcgtgtatatatattgaagtctgccgtatgaccgtatggattgactgaaagtctgaaactattatttagtgccgttagcattacaaatttttgcccaaatagaagatatggaaccttctgccgacagcactgttgcgatgcatggtgtgctttcaagtccaaatgtgtgcacacatgcatggtgtgctttcaaatccaatgcacataatattgctttgtttatgttggaaatgttagcacttatgtgattattttaattcctcatatgggagtagacgagtagtaatcaagacaatggcagaattgaagcggatgaatcaagacatgcatgaagacatcttgcatgaagcgattctgctaaggcatgcatgaagcgatcgagctagtatcgcaaaaggcacataccataagcttaattgattcgtctcatcacataatttgccacgaataaagtggatgaagatgctaaggctgtgttcgggcatccttattcccaaccggaacagttagtgggttataacattataataagagaggatacctctccatcctaaaaaagaccaatcctcattcattgctaggattaattctttttacggagtagtacggtactatctctgtattttaatgtatgacgacattgactttttatcaacgtttatccattcgtcttattcagtttattttgcaaatataaaaatattaaatagaatatttgatgataaatcaagttataataaaataaataataattacatttttttaagtaagacgaatggtcaatcgtatcttaaaaaatcaatgacgtcttacattaaaatactgaggaagtattaacatcaagcgacctctcacttgtcatgcgtgagccggccagatcatttggtactttatttggaattttcatttgtaccaagcacaaaactctaacatgttatacacgcataatttgcaaaataatatgaaaccgtttctttatttatttttgtttttcataagcctcgaaaaattcctagcaatatgggatttgaaggcactgggtggagcaatgttccaactgtacttctctaatttgtggttgttttctctgaccgtgaataagtcgacgtctctgatccatatgtgatcagcatagtttaaagataagaaaccattgcattggtggagtggactaagtttgttgggccttaacttaatttagtggtgcaattagtgttaatttaagattaggcctgaacatgatacagtcgatgtggggaccatattctttagcttgtggcatagttagatcttttgcccgtgagattgtgttactagcgagtacactactgcagaaagtactgttggtgccagtcagaaaccctcataggtgccgaatgtaccaaccggcacgacggaggtggcactgatgaccctaggttattggtgacgattccacaactggtacctttgagacgcacataagcaaaaaaaaagaaaacggctcgatgcatcgaatcgagccaatgcatcgagcaagcatatcctcgatagatcccaagctccaaacccccaaactcatgcatacatgaaatacaatgaataatccccaaacaatcaacacatctagattgaagatcaacaacagaaccacaagaatcaacatcaaccatcacaaggcaagaacagaatcacaaacatataatacaaatcactgatttgagaacttcgccattgcatgcccgccactgtagctctccgaggatggcgcctgtcgtcaccggatccacccatgcacgtgcgagccccgctgctatcgtagctcaccggggatggcgcccgccgctgccacggtagcttgctgaggagggcgcccacctacgctgccgctgtaccattcccgctgtcaacgcggatccgccgcgggaacagatgctgacgtcggatccggccaccccgcctgctgccgacgccggatccagccacccccgtctgctgctgatgccggatccggccaccccgcctgccgccgacgccggatccagccaccccgtggctcgcctccgagagtagtggcatcgccttgccgcctgcatccgcctcctcgattgggagagagagagagagagagagagagagagatgaagttgcgagagagatgggctcggccgctcagtagatagataaggcaaatttaagtgtggtaggtgtggctcggctcggctcggctccgcttaagatgggtgccggttttataaactggcacctataataaattataggtggtttttctttagaactgatacttattttctctcggtttttggttatttcaacccgtgcaggtgggaaaaggtttataagtgtcggttttagcacttctggcatctatagtgccgacatgtacgttcctttttttttaagtagtggtacactttgttgtagaaacctaatatttttatttgcttggtgaaatctcttttatctaaaaagtgtcgattgaatcatttaaagttttatttttatatcatggcataggcgcatagcaaaacgcacggtcctgctagctaagatggtcagtgacactgacatgaattgttgggtcaattaatttgtttggatcgtttcattcattcattggaaaatagtgtggacaaagatatgtacatataatgattgaattaagcctggacaaaagaggaaggctgagtacacaagctatacctgttctcctgccaccatatggagacaaggatattgattttgatttgcattgaggtgccatgcgaaagaagagatctcagatctggtgacagtgttgaatggatgaaatgattgattccctttagcaggtgtcttaaatttgtactgtgtagtacaatatttggacagtactatgacaaaccaacggcatgcttgtttatattactcctatatgtttataaaataaattccaatccatgttttgaccagctatcgtgtgatattcaatattggcatatacgagatgccactactagctagaacaactatggatgcataaacagagatgaattgtaaattctgagttggatcagcatccagatcacttgtttaaattaattaagaaacaagcataaattcgttctggcttttgcttcaagcactgcattcatctctcgacaatccttaaaaatcataaaaagattagttgtccctctcgcaagagggtagagacactcctagcctcaagctttcaaccatcaacagtacacccggacactatattgtcatgaataatttaggaaaatgttacacgacgatatcctgtttggacgggataataaattagatgactatcaaacgatatctcagaggcattacccgtacgttcgaacggaatatcagcatacctaccagatagtatcatcctatacatccgaatgaaataccatcatatagcatttctcgtaatttaaccacataaattaggagtagtagcaccgattatcatactcgtcgtatgcgcgtcatttatccgtcctatatgcaccatagatgcgggaaatgtaggccatatatcattggacttttgacctggaatggtggctaggagtagctccaaaacacagtcccaattaattactccctcaattccaaaatataaggtataaccaccttaatccaaagactaagaaaaaattattatcatcttataatttgaatcatcctaataaatacaatacatgcatccaatagaattagagaacatgagagtagagtatttaaaaaaagtaataatttaatggagaatgggtaatagttaattgtccacatgcatgcatgacttatattatgaaatatgtaaaaagaggttgtgacttatattatgaaatggagtggagggagtaattactatatttatgtcatagccgtcatgtcccttcaactttggaaaccttatcacacggcggcatgcagtcaccgggtacagtacgggccatcgatctgatctcgtgattgcgtgacattcaatgcggccctggtacacacatgatgcgacgatgcccgtactctcgtacgtgcactatgctcgtattgtccatgcatgatgtcgacgaagcgcagcaacagctagcaaagtgtggtcaaatcgaactatccctgaatgcaaacgttcgttgctccgtggagtcgtaggtcgcgttattttttccaagatgtagattaagattatttgtgccttcacacggctaaacggtacgtttcgtgcgaaaatattttatatgaaagttgctctaaaatatcatcttaatatatttttcaagttttaataattaaaacccaatcaatcaaacgttaatatcacatcgttttgctaaaaaaacttaatcttcatttttagaagaaaagaacaccacagtatactcctatgtagatatacatcaggatgggaatggttaggatatggattgaacctaaaccgttttaagtgagttcgttgatccatggtttaatagggtcggtccaccatgagtccattatatcaataggttatctatggatatccaaatggatcggctactcttattacatttgggtaaaactcggacctaaaatttttaaactcgcgttcacactttaaaaacttatcgaattcagttgaattttggtgggataatttattgcacagagaagcaactttgtataaaatttgagccctttatacaagtggggcccacgatgcattactaggacccaaaaattctagttatatgtgtgtaaaactcggacccaaaatttttaaactcgcgttcacactataaaaacttatcgaattcagtcgaattttggtggaataatttattgcacagagaagcaactttgtgtaaattttgagcccttcatacatgtggggcccacgatgcgttgctaagacccaaaaattctagttacatgtaaaactcggatccaaaatttttaaactcgcgttcacactataaaaacttgttaaatttagttgaattttgtaggaatgaattattatatagcgaagcaactttgtataaatttttataacatttatacatgtgaagtcattttggatcgaatctcttgaaccttaggttctaatggtttgatccgtttgatccatttatatttttagagcgaccctataaatccgttagaacaaatttacggataggttcagtggataaatggatcgaccctgacaattcccatcatgagatatacggctagctcgaaaggacacggaggttaagtttatttatcgatgtgagaaggcgtcgtacgtacacccgtgacgctgctgcgtgccgcgatctcataaaacggcactgttttgcacgtacgctcccgtcggccggccggtgcgggatctagctagcttgctcacgtgtgcctcgccggaaatttcgctcgggggacttccggctgtgttgatgaaatgtacgtgcacgcgtgcgtcgatcgcagcgtcggtacgtacgctcggtccatcatcacggcctgcaggccagatgcgacgtaatgcgtgagatggcctcaaaagcaacaatttcaagtcgacggttgcatagtgcattcatcaagcgtccctttcttttcccctctccaaaagataggagtaccattcaattgccctgtgcacgcacgggtaaacgggagtgacttcgcatacacgcgtgcatatggtccccggaatcggcgatgcaacatcatacgtacgtagtactccccatgttccataatagcttaatactacgtaagtacgtatggagtattttaaaggatatgacatatcttaataatagtattttagagtctgtttagatttttggtattttaaaatccctattcatactcctattcatctaaaatcccttatattttaaaactacgtttgtctcaaattagttgtcgctttgactttttttttcgcaacgtttgaccattcgttttatttgaaaaattagtgcaaatataaaatataagtcatacataaagtgtttttataataaagcaagttacaaatagaataaataataattatatattttttaataagatgaatgataaaaaaaacttaaaagtaacaagtattttggaacgggtagtaagacggagggagtacgtagatgtaggggaaatggattctaattactcggataaacatctattcgagtgattgaatgattaaaacagtttccagttcgcgggagcgattcgggccacgcgcatccatccatggattgagcagggaactgccggggcattaattccatgatggtgtcggcacggattagatagcagcggcacatgtgacgcgcagctagcttgtttgtttttgtcgcgttggggcgccgcttgctgctgctgcggctgctgcggtgccagatccgcatactagctgagacggcatcgaaatcgttgttaatttctggtccacacggcaggtagtagtactacaccggtgcccgttgcagggcagataattgcgtgcgtccgtgccagcgatccaacgaccgggccagacacgtcgacagcgtcgtcagtacgtggcagtacgcacagctgcatgagcccagctgactactccacggacggaggagtggagtatagtactacgtacagtacctcaatttgattgagcactctgacaaaacaaaaaccaacagtattatacagagaaaacaacagtccattttcaccttggtgatggaaagccacaaggctgtagaacatcgtccgcaactgaagatcgtgaattaatgaacgaacagtttcccggcgaagaatgaatgaaggttagcagtaccaccgtactaaaataagtatagctgtgatattcgtgtttaatgtttgaccgttcatcttatttaaaaaaaataaaaataattagtcatacacaaattactattcatattttatcatctaataacaattaaaatatcaatcgtaaaaaattttcaaataagacgatcagtcaaacgtttgatatgaacggtgtaaaactgtgcttatttgggacggagtagaggcactaggcccgttaaagagcagcctagcccgaccaagcaagccagcttcgacccaaatagcctaaaaagccaaaaatacaaatttagggtctgtttaaatcccgccttgaaattttacacgctgtcacatcaaacgtttaaacacctaaataaagtattaaatataggctaaaatatagctaattacacagattacgactaatttgtgagacgaatcttttaaacctaattgctccatgatttgacaatgtgatgctacagtaaacatttgctaatgatggattaattaggcttaataaatttgtctcgcggtttactgacagattctataattatttttttattagtgcctaaacaccctatacggcatcctatataatatccgatatgacacgtcaaaactttacacccctgaatctaaacaccccttaataaccgtgaaatgctacttttcaagtttttctaaactaaactaacctgtagatttttttcccgcgttgatttgtacggtgtaatattttaaatattgaaccgggagtgatataaaactcgtgtatcatatttccaccggtagagttgtgacaacataaattttaatcttggccagaaattataaagtttggcatatctatcttggcacgataagtataataataatagtagtaataataaaaaaacagcagtaataataacctattttacgatttgaatagttatctagaaaaagaaacattttcacaatgttgggttgcacatcgagacatagatactttccacacttgtcgagaagaaacaagctagtgaaaaacaatttctttttccttttgcgaaaacaaaatgaaatacatcaccctattgaaaactaacagatcaaatgttactattctccatacggcggagtggcggaccacaccacagtggcaagagtacaaagcctcgcgctcgcggtcgatcgatcggctcacgtcgctgccgcgcgctgcggcccgtggacgcccatgatgccacaatggttagtagttcccacgcttcacagaaacacgtacgcgagacgcaaaagccacaaatggttctcaatttgcccccgtccgtccccgtcgccgcgaaagctacagcggcccccccccccccccccccaacagccggtgctcgctcgcgcg

SEQ ID NO: 66143 - DNA, 4712 bp, Oryza sativa
ggcgttcgctgggcgcgcgcgcggccgatcgtatcattcctatcccatgagcaacggccgcgacgcacatgagaagaggggggagggggggggggggatcaggggagggaggtgatggcgatgcgtggtgccaagacgtgtcgtgtggtgtggtgctgtggtccaagcgaccggtgtggtggtggtggtggtggtggtggtgtccgtgttcagttctgggatcagtaccgggagatgggagccatgtgggggccacgaacaagatgcgggcttggccaaaagttcttttggagaaaaaactgttagggccacatgtaatgtgtaccaaatcgttagtactacgggtctgtttataggagtttctagctgctgcaactttttctagaattagaagctccaccaaacaatctatcttttgattcaaattctaggaaactgtagttgtataatacagaaaatgacttagaagtcagaagctagaaacccagcttttccagattctcagaagctggctacccctccaaacaggctctatattgtgcaggttgtaaaaaccgttacaaagaaaaccatgttgtccagaagtttaatattgtacaaggtaaagtttaaataaaaaggtcttgatagttcaaggttgaataaattttgggtagactgttttcatgctttcggttatgaaatgtactacctccatctaaaaaataagttttagagtaggtagaattaaatgtgaagagattgtgattgattgagaagtgaatgtcttaaaacttaaaattaaattcgaataccttcatcttacgatggttaaccaaactaaattttttcaggatgtttactttaactgaaaagtaggacaaggttgaatctaacaatctattatattattaaagaaatagaaaaaggagcctccacgttcgctctcatggtctagaaattctcacattaatcggagaaaaagaaaaagcagagtccatatagaaatacaattaggaaatagctgaaattcgaaattaaaaaaataagaaatattagaagaggagactagagtccatatagaaatacaatttagaaatagttaaaattcggaattaaaaaataaggaatattagaagaggagactagagtccatatagaaatacaattaagaaataactgaaattcggaattaaaaaataaggaatattagaagagaagactagagtccatatagaaatacaattaggaaatagttgaaattcggaattaaaaataaggaatattagaagtcgagtatagagttaatatagaaatacaattatgaaataactgaaaatcgaaattaaaaataaggaatattagaagtagagtatagagtccatatagaaatacaattaggaaataactgaaattcgaaattaaaaataatgaatattagaaatagagtatagagtccatattgaaatacaattaggaaataactgaaatttagaattaaaaatatgaaatattagaagtagagtatagagtccatatagaaatacaattaggaaataatataaatttaaaattaaaaataaggaatattagaagtagagtatagagtccatacaggaatttaaaattaactaaaatttagaataaacataataaaattaaaagtagagtttagagtccgtataaaaatacaatttacaaataactaaaattcgaaattaagaaaaacatgtgaagaagagtttaaggtcaatatagaatacaatttagaagtaactgaaattcgaaattaaaaattaaagaatattaaaagatgaatttagagtccacatagaaatacaattagaaataataaaaattcagaaataaaaataaataatattggaagaagagcatagagtctatatagaaatacaatttacagaaatttcggaattaaaaaaatattaaaagacgagtctagagtccatataggaatatatataatttacaaataactaaaatttaatattaaaaataattaataactaacacatatataaaatataatatgaatattacacattagtagttttgtaaagttattgcaaaatttaaaattatgttgtcattttaatatatttgaataatataatgagaaaacatatatactattatatgagagaaaatataatgatgctagccgcgcaatctgcgcgggccaccatgctagttaaaaatatactaaaaaggttcattataacaattactcaaattttcattaaaaaatatatatagaaaatttaaggattcgtcgttccttattgtggtgctcttgtgctctacgattcgcaacttcatgttttagtttgatatattatatggatgagtaacaaatcccgagacacctcaaatttgatcaaatccttgtcgcgtttcactttctttacaagataggtttctagacaaaaaaaaatgaaataatgctcttttaaaatatatattccgctattgggtgaactattctacaaaacatgtggacatgatttacatgtttcctgtcctcctaaaagaatgatttttttttactttcaccatcattctctttcttgcatttgtacaccttataatatcacgatacggcaatacatttcacagtcattgttgaattcgcaacactatgaccgcaagaaaaggaagcacaatggaaaaaatacccgtggcatgcctatgtacacctttttttattgatcaacaagccctttcagctacaattatgacagctaccacaataaaaacgaaatacagcgacttgcactagcagccagttaagcccgaaaacgatacgacaattatactgttttcactttcaccaatcgatcccttcccgcatactaatgttgacgggtctgacaaactacaactcagctacacctactaaacctctcttatcaaccaaaccaaaaagctactatagtactagtaataagacacataagcatgcatttatccgtaggtgtgaatgacttgattaagtgtgattgactaggcacgtcacccttcagcctttgatcgagatgaccgagctagaggagtactccagctaatgacttggtgcgtgctcccaaagtctttaaacacacgatggaaagctgcgaaaaccacgcaaaatccaccgtgtgcggtgcagagaaaccggaacgcgtccaatcccgggtggacgtgcaaaaggtggtccattcgtgtgcctgtcggagcttgtcgatcacacgtcaacatggttgatatgcaatcaaaggtggtggaacgacgagctatatattcattgatttcattagtagcgttaggggatcgagtacctgtcatatatatatatatatatatctccatgttgatgtggaagtatacttttccgtctgtgattattcgcgtcttgatactgtatactggtgattaatgccgtcctttttctgcttaacgtgatggcaacgtggcagggggaggccccggagcatgagcatgagtgctttaattttataaaattagaaaatccctacgagttgcccaacttgaggtatatcgagatatacatgacgaaaataacatagtttagttgtagtttgcatctatacggctctgagtgtatcgttatatcatataggtaggttgtggtattttattgctataaatatgggttattctaaaataagatatgtcatttagatacttctcttcaactccgaactattgtgatacaaataatacaaatagttaaaattaattttacgaaagaaaagaaggtggattatgggagtgtgcgacttgaattattgatttggccatacagatagagacttatggatctgccacaggtgtctctatatccaatcaacacgtaagtcccctgtctagtaaaggataggttaattcaattgaggagaatattttctatgggcgtttctctcaaatcaatctacataagccatggttaaatcattatcttgtcacgcacaatttttttattattgtcagcataatctgtgtgacacgctcactctgtattcatatgacggtcatgataatgtaaagtcctacgcaaattttcaccttgtctgtatagcacactataaatacgcacatagttaaggacattatacattccccgcaaaaaaggagacattatatatgcatttggggcactctcaagtgtttgtatgctcaggtaactttcgttgtctgaatgttatgttagactaataattacacaacattttctttaaaaataaatacactacacaaataatggtcagtttcaccctatacactggacgtgggtacttaaagctacatcttaatcatcaatccgtaggccaggacataagtatagcgcgaaagtgacaaagaaaccacggaggttgagacacggcactggcatcgcatccgtctttgtcgatcagtagatgacatcgatgggaggagctctcattgttttgtacttcgtatgactctgaacaataatataggcctgacaaagtgcatacaaaaaacctggcagccaagttgcttactaactccatcccaaaataagtgcagttttgcactattcacgttcaacgtttgaccgtccgttttatttgaaaaatttgtgaaaaaattaaaaacatttagtcacacataaagtattattcatgttttatcatctaatagcaataaaaatactaatcataaaaatttttcaaataagatggacggtc

SEQ ID NO: 66144 - DNA, 15017 bp, Oryza sativa
  unsure (1)..(15017): unsure at all n locations
aggcgatcgcatcgttatcatgatagtcaatcctaatcggtttgcagcaaccatcgaattgatcgcatgaacagagattgagagagaatcaagtcgatcgttgcaatgaccacttcaaggcccttatgggcaattcgggcctcccgggccaaatcttttcattatgtcccttttacttaactataccgataagtgttagtattccactattaagtctacagtttacctgtcacctagctcgctgctgcatacttcctccatttgagaataagattatttttttcgtttcccgtttgtttttcatataaatctattttctttagcaatcatttaatcagattttttaaaagtcagagataaatgaaagaaataattattgtgcgatttgataaagtacgattgttttagtcttttagctttgtattgactaggaaaaaaatgcccgtgcgttacaacgggtgaatgttattttaatgttattattgttatatggtaggttgagttaagatgatattcactgtagaaattcgcttggatatatattttttctaaaaaatcatgagctgcaattaggagtccgatcatctcaatcaagttagcatgcgatatttttaaagagatactagtatcttatacaactctttccgtatttccaaaagcaaacgaatttaaaacccgacttaaatacaaatatgtatttttaaatcaaacgaacttaaaaaccgattcatacacgaatgatgtaccaaagtattaataaaaatatcttcaatttttataagagatgtgcttctatacttcttaaaaaaaaattgcacgaaaatcaaagcacataagtggctgagattaaaagtgggttaacagtctaatcctcattagtgaggggtactttcgtcttcgtccatagaaattccagcccacgacgatatcgttgtctcctcgtcaggcagcgttgctacccgctggtttcctctgcagcgtaagcgccacccgcgcgcttcccctccctaccccgctagaacaccctaattagatcccatcgatggattgatcgattcgtggtgatttgagtcggcagttcgctcgcaacacgatgagctagcgggagctccagtgaataatatgctgccccgggccacaatgaagatcgtcgccgccatgctcaacaagatcagcctcgagcacgtggactatatatatagcaacgtgaaggccaccaccgccacatcgagcacaccaccgtgacggcagtagtcaggccaccccaacgacagctgcagcagcttctcgatccggtgccatgatctaccactcatttaaggccaagtcgcaattcgattgaaccaaagtttaaacagaagaaataacacaaaataatcctttttctgtctccaatcaattgaaccaaagtagctgcaacagcaagtttgatgtgacttgtgatggtggtgagctgtgtaaattaatgaacgggggagacatgcatgtagatatatactgtacttgtttatgagtactggctagttgtgagatggacaaaatgcatggagcgtcgtgctgcaccgcgtgatgagaggaagaagagggcagagcggcggcgctgtttgcaagaggaagccggccgggctgcgaggggaggaagagggaggggaggcggcgaggcaagggaagcgcgggcggtgcttgcgaggctgaggagcggcgctacccaaggagagagcatcccagactagcggtcatggtcgtggtcgtggtcgtggaggaatcggcgtcgccattggtaattcggggcctgtttggcacagctccagctccagctccacccctcctggagctggagctcagccaaacagtttcagctccaccagaactaggagtggagttaggtggagctctctcacaaaatgtactagagttgtggagctaggtttaggcagctccacaactccactccagacttagctcctgaagttatatttaggagtttgagctgtaccaaacaggcccttggtattgctgcagagttggacggggctcaaaattccatggacgaaaatacccctcgctaatgaggaatagagtattaatccctcttaatctcagccactgatgtgctttgattttcgtgcaactttttttaaaaaagtatagaagcacatctctttttgtaacagtagagatatgtgtgagatgcatgaaaaattagcttattttgagataaagagagtagccaatattggagtaatactgaataactggactatacatagtattcacaatccctatgttggattagaatccgctcatgagtggtttcatcggattccacgggatctgttgtaaaccaataaaaccaatgaattttggataaattttgttaaaaattaaaatttagtttgatttttaaaaatttaacttgaaaattcgagtggtttttaactaggcgctacagatacaactgaagaaccctagattagattgaaatttggggtttgtgttttgatccggtctaaatagtccggattatgtaaaatccgaagcagatttcactgtaagggcttgttcggtttggagggattgagaggattgatgtgtgaaataaatcccatccaatccttctctcaagagaattaatcgaacaaggtgtaattgtgaatatacggataccggagcactactatttgtggaacggcacgggtgagggtgagtgaacaattttgatcgtggatgatcacggggtggtagctgcctgcgccaccgaaaaggctggcacccgcggcgtgtggccgcgagcgcgcgcgcgcgcgcggggctcgacgccccaccgcgcagcgcacggcacggcgcacacgccaccaaacccatactactacatggtggctttcctgacgcgcgcgctggtggacgcgcactgcgtggggggcggcaggccgtgcagctagcctaacactcatcagcggagcgggggttcttatgattttatcgtgcccgtgcatgagcaagcgtgcatctgtctctcgatctcaatgcggcttttgaccctgaccatcatctactccatccatcactacgggtgatgaccggagacgcacgcctgcctgcctgcctgtgccggccggcgcccagattccaactccattatccggtagtgctgctaggctagctgtcgtcgctcgccgtgcccccccttgacgttgttgtcgtcgtcgtcgtctttgatgcagcgctgattcagcccgtcgcatgctcacatggcccccacaagttaccgtccgtttttatactatcgtgcaagaaattagagagagagagacagagagagagacagagacagagcgtgtgtgtgcggccccagttgtttatatatccatccgtgcgtgtttggtgtggccggcatggttcatggcgcgccaggaaacgtgcaacgcaggtcccggtagctagatgccactccaagcactggaggaccacaggttgcagatgtcccgctgccgataagttaatagtgtattgatttactaggaaacgaggttcgctgtcaggacgtgatgctgtggtccgcgaccggcttcgtgtatagcttttgtcatgaaacaattaagcactgttagctactagtagctgtatttttatgaaatgtgcactcactccactttatgaaatgtgcagaccgtcgtgtgcgcgtacggcgtacctgggattcccggtccgtatggagtattttgtgacttttctttggagtttaccagcgcaaagatccctagagcaaggtttttttctctgtactagtattaaaaaatactgagaagagtacacacagtatgtaatactcctagtcctatcactgcactacgcatgtcgcagttggaacagagcaggacgaaccatgcgctgctgctcctcctgtgcatcgcatcgatcgcatgcctgtgcccgccgcaccgctcctactggctaaaaattcggcctgtagcagcaggcgtagcgcacagccttttttacaaacctttcccgtctccccaaacggccactgttggttactcctcgcaacaagccatctgaaacaaaccacgcatcatcagtccgggcaacagcaaagcagcggcagcaacagcagcaagcagcgatagtatctggtcgtctgccatcacgcagactgttcctcctcctccccccctacaaacctgggccctgatgagccccctcccccttctcctcatcacagaaaagtgaaagcgtatctttctctttactactctcaccaaacgacagggcgaagcagaagtgcatgcaccatgcgtggatctgatctgccagctctcctccttggcccggccattccgcgccttgagagacgagagttgcatggtggagtaggggggggtgcatatgccaatgtgatgccatgccttcgacttgggcgttggcatcgattgcaataatatgggacagtgccacagtggtactggtacgtcgtctgcaggggggcaggcatttgcagtgtgcctgtgcctgtgggggggaagtacggatgatctgatggcaaccgaaaaggttgagagagaaaagagagaggacctggctgccaacctcctcctggggttgtgatgtcaagcaacctgagtccgtgatccgtgagcccttttgctagtccatgctcaagtctaacgaggcaaaaaaaaaaaaaaaacctgtcgttaattgcatcatgttccaggcctgtgtgagttcacttaaaatgaagattaaatacggaaacataaaatgagaaaattgcaactccccggtcccatagtattagagattttgaagggatgtcacatcgcataattaattaaatttgtttttaattttttaaacttaaaatgaatgtatcttgtattttaaaacaacctatatatacttacgagtttgaaaagcgtataacacaaatgagataaactatgtatcttaattttttaaaaaatagccaatggatgcaatttttgtttaactagccgaatattatctcccgtcattaagcttatactcccaacgtcaaatactattaatgactgaggcactactattcactttgctctatgatgcattgctacagtttaaaaaataatgtaaaattcgtgtgctcggtttaccaagtatattgtttggttaactaggcactgctcggagcatatccaataataatagcactctccccgtttcaaaatatttaacaccgttgactttttagtacgtatttgaccattcgtcttatttaaaaaaattaagtaattatttattttttttcatatcatttgatttatttttaaatatactttcatatacacatatagttttacatatttcacaaatttttttaataagacgaacggtcaaatatttactaaaaagtcaacttttttaagcattttgaaatgtagggagcagtagattttttgaatacgaccgttcatcacgcaatgtaggagtatcgatatgtcaatatgtacggttattccatgtacgtacacagcatggactggcacggcgccgtgccctagcgctagctcacagaaacagagctcacgactggcgagcttggaccatctagcgctggctacgacgagccaaacaggaaaacctggattttttttataagaaaaacttattttatgataatcccctgaaaaacttgttttagaaattaacaatctttctcgacatcaaagccattaattggcgtcgacaccctcgtcactccctattacctaagtcgctcatatgaagtgggtcgagccaaggaaactaataccgaggacctatttatattctttttcaaaaatgattaaaaactaaaatattttcttacaaatagacctcaatgctagcctccatgatgctgaggatctatttataagaaaaggtaattacataatggtccttctcaaaaaaatatattacaaatctgtcctcggctgctaggggggtaatggtgttggcaccaatatttttggttttagaccttggtgtcaagggttattgtcattgagaaatggaccatttttagaataagtttttagagaaagggtttatttgtaaaataagttttaagaaagggtcgaaacataaaaaattcagcagcgtaaacagagaaagcgctggatgcatatgcccacacgcgcgcgccgatgcgtgcagtcgatagggcagcagcgctatccgtacgtacgttcaggttcagggaccctgcttactgcgcgcatgcatgatacagccgtccggaccaacacagcacgagccatggtcctgaaaggctgaaactgtgcaatgcagctgccatatagatgtgtcatgtatatatatgcggctgttaagctagctgtgcacgacgcgggcgcatatatacgtgactccacacggcatgtgacactgttcactggaagtatgtggtacgtttactgtgatgtggtcatggggctatagcttatgtaagctagctactatactatagctctctaccccgacggccgtgcatgcgtgttgccattagactcgcagatctggccatgctttgcgcgctacgatcgactactaggaacgtacgcgtacgcagtaatgcatgcacgacggggcacgcagtacaccaatccatatatccatccatgatgcgtgtgcatgcttatattgatcggttagtccgtgtgttctggtggacagccgcaggtataagtattactaccttcatattttaatgtatgacgccgttaattttttatctaacgtttgactgttcgttttattcaaaaaaaattatacaattatcatttattttattgtgattcatcatcaaatgttaaatgttctttaagcatgatataaatactttcatatttgtacaaaaattttaaataaaacgaatgatcaaacgttgatcgaaaaatcaatggtgtcatacgttaaaatacggagggagtatgtacgaaagggggatcggatgtgggcgggctttaatttgcggtagctttcccaggccggcggggccaccgaccgtgtgatcgaattcattacgggcgggcgcgcgatcagatcgatcagtcggtcgccgatcgactccccccggagacgtaggcgctgacgtactcgcgctgcacgtacaccgtactactacgtggtagcgccacagcgcatgatgcatcgcagttagcagatgacagtaatacggcattaccgcattagcatattgacaatgtcatggattacgtacgtaatgtaacgctaacgcctactggagcacggctgacatatactgtgtgtttttgcatgcagctgtgtgcacggccaggcaggcaggcccagaggcagcagtatatcagggtgcaggcagggtgatcacgcggctcgcgtgcacggctgctcgaatcttaatgcgtgtccccatgcaattgcatgcatgggtagtagctagttgggtacagcagctgcagctcgcgcgggcgcgcggtccaccagccagtcctccccggcggccggctcgacggtcagggccgtgccggccggtcggtcggtcggtgcgagccatcaatataatggcgcgcgtggcgacgacgtacaacaacaagctgcagcctgcgcgcgcggtgcagtgtacgtgcgtggtggatcggagtatctcgctaagcttcatcggtgccaagacaagcacggactgcgtacgccgcagcgcgcgctgtacgtgcgatgtacgtacgtatagctgccgctgctgctgctgtcacggtgggcagattgtctttggatcgttttgcactgcaactgtacgtacggctgcttgctcggggtacgtataggagtactatatatgctgctagttcagctctgttacggaaattaatcgatcaccgttcttgtagttctagatctggagatgtgctagctagatcttcgacggatccgtcaaccgtcagacctacatgtgggagacaaggggggcaaggtactactgtaatgaggtatgcacgcgcctgaactagtagtaaacccaatccgccaaaggtaattaatcaaaaagctgtattggcacgggcagcacagagatgtggttaaccactaaatatttccggggtcacgacgagttaagagatcgctcatcagacaacgctagatccggttataatgcaaacgcaacgtgcccatccattgaattccacggtccactcctccctggccatgattccgttgattaatttgcgagccgtgaggtgtgggggctgggaagacgctgcacagtgctgcgcagcgtaggccttagtttcagaatccagagaagttattttctaaaatctaaaactataacttctcaaaatctgaatcaaaagataggctgtttagggagcttcagattccgagagaagttataatagctagtagctctccaaacaaacaagtccttaaactgcgcatctccgtggcttacggcgctgccggttgaatgaagcgcttcgatcgcgtcgacctcgcgcgcctagaaagtgtctggggcgggcgctatgccatggacttccagggagaaagcggcattttcaccgctcacctgtttcctaccgagcgtactctgatcggctaacaagaacacgtacatatgtactggatctcaaaagaaaaaaaagaacacacatactgctagtaggtaaggcgtattataccaagataacaggcaggatacactatttctttttcctgagacgttttcattacacaagacaaacgccacacgtacataagtatataaccaccagtacacactcttccaacacacatatcctaaatcggataaatactttgtaaattaaattaaagtgctcgaaaattttatatttctttcaaaataaaaaaaaatcattcagatactattaatgtaatcacatatctagatttacaaatttgtaaagttagaaatatccctttcaaaaaaaatttgcatttgaaaccgtgtcaaaacaagcctgaaacaatagtctttacatgcctttatttgtctcaaaataaattcatcttttagtaatcattgcattggagattgtgaaatcagctaataatcatattggaagtaggtaaagtaaaaaataatttcattagaatttaataaaataggtttttttttagtttgtactaccgtggttttataccaagttactccctccgtcccataatataagggatttttagtttttgtttgcactacttaaccactcgtcttattcaaaaaaatttgtgtaaatataaaaaacgaaaagttgtgcttaaattactttggataataaagcaagtaaaaaaacaataattttaattttttttaaacaagacaagcgatcaaaaagtacaaataaaaacttaaaatcccttttatcgtgggacggagggagtagtccttaccgtagtactagtattttcacatattgaatttttgtcacgccttttgtggctttgtccttcccaggagcgtgtaatacgtgtcttacccacaacgcctctcttcacaggccagtgagccactgcttccccaaccgtaggagcgggtacatataaaacgctcgccgccgttcgccattcgtttccacgcatcccttccactgactccactgcttctcacccaactcgcgcgcgccattccttgccttctccgccctctcatctcatcaaggaaagctcgcgctcacgcatcgtgtcgctggccatggccgtgcaggcgcagcgcctcgcccaggctttcccttacgacctccacgcggcggcgagcggcggcgccctgttcctggacgagctcgccggcgagtgcgcgccgcccatggcggcggtggaagggatcgggggcgcggtggtgttcggcggcgacaacggcgagtacgggttcgtggagaggaagcggccgcgcgtggcggcgggtctgttggaggaccagcgcgcggtcctggcgcacgcgatggcggcgccgctgcaggggatcttgcccttcggggatgtggcgggcagggcggcgtgcgccggcgcggcgtccaccagcgggaggaggatggacggtgcgggcggaatctcgcagggccttctttcgcagctctaccaccatggcgtggagatcgacgcgctcgttcggctcgaggtatgggaagaaggcttctccgttaaccgtggactcccctgtttgtgtttggtgagtggtgtttgatcggcgtcggtgtttggtggatgttcgtgcaggccgagcggatgcgcgcggggctggaggaggcgcagcggcggcacgtccgggcgctggtggcggccgcggcgcgcgccacgacggggagggtgcgtgcggcggaggccgagctggagcgcgcgcgctgccgcaacgcggagctggaggagaagctccgccaggtgagcgcggaggggcaggcgtggatgggcgtcgccaagagccacgaggccgtcgccgccggcctccgcgccacgctcgaccagctcctcctccagtccccctgcgccgccgccgccgccgccgcctccgcgggggaaggcgacgccgaggacgcccactcgtgctgcttcgagacccccgccgccgccgccgatgtcgcggtctccacggcgacgtcgtgcaaggcatgccgtgtcgcggaggcgtccgtgctgctgctcccgtgccgccacctgtgcctgtgcggcgcctgcgaggccgccgccgacgcttgccccgtctgcgccgccaccaagaacgcctccgtccatgtcctcctctcctgaagtcacacgaaccacagctatggcgagaccgaaaccgaccatccggcgtcaagcaaagctaacaacaatcatcctgtcccaagttacatggaaaattcatgccacggttcagtgcatcggtgatctccgggccacgcgagtttttgtcggtggaagcaacagtgttcggtgcggtggattgaatggtttgattgccgatcgatctcatctgccgcaggtaccgttgcttcaaaagatttggcagcaagtggggggcagtctaaaatggacctacttctacgaacacaatccctgtccataattggcagtttggcaccggcgtataaatgcactggttcacttgtcgccgttgtccggggttacacggttcagctggcagattaattatcttcagaggtgtggtgtgaactgtgaagtgatggaggtgttgttcttgagatgaacagagacaacaaagggggttacagttacagttacagtcagacgagatgctatacaaatgagaaatgacagcagctgatgatggccgctgcaacccaaagctccacgcatgatggtcgaaagtgcggcgtttcagaaatctgcttcggctgtgtcggccaccatcgaagttattctgaacataaattggtttgggtcaaaactctgctttgctttggagtgcagaaagggagtgtagaggcgcactaacgattaggggtcgagttgtgcgaggatcctgtacaagaacagcaggagattttttgcgcatggaacatcgaaaatgccttgatcaaaggcataattagaaagattgtcttgtaaaattggtcaaagtttttgttccaattcatgtagcgatgtgtgatcctgcggtccttcaatcagcaggaattgtttctttttaattaaaaagaatgacgattcttatctgatcaagtgactatttgacgttttatgcacgctgtacactcggagctttgaacatctgtggcatccctgggtttcacgttacttgcgttaggtttcgtcttgatctgtccatctttccgtgcatgattgcgttagtcaagaatgaattttctcgtggagcattttagtactgtttcgtgtgcacgtgctactcagtacaccccatcatgtttcgttctttaagctcttgtctgagagattgtaaaagggttgatgaacaagatatagatgagaagatagtttggtcacttccgtgttcaagttggcaacgctgatttggattgtatttgacattcgaattagaatctttgcaagtttgcaggatggggatgccatcagcgtggtcacttgaacggcggtagctgtaccttttcttagtttttgttttctttccgctagagtttcctaaaaaaaaaatacggtaagaaaaaaaaaagaacatgtggatgtgttggtccgtttaaatgtgtgatacatggaagggtaaacctgatcggtaaaaactcaattgacgtactacggcgattctgacgcggccctccggctggatttccagtggacaccatccaaagcaattggatttgccttggagtacatatactccaagtctccaattaccacaagatccaactctcttagctgaaataataccgatcctgtgctccaataattgttatgcccatgttgagaccaagcaactggatgactgtaccactacttctggattacgtgcgtcttctcgtcgttcctcaaatgcggcagcacggaggttgcgttggccccccaaaccccaagctttaccagtggtggttcgtgatgactgatgaccgtgttacgctttgaccaacacccgcccacccgcccggcacgccaagtcgcggatcgatcgctcgccggcggccaccctccctccctgcctcccggagtccacggatccgcacgatgaaccgcgtgttttgaccgagaaacacacgcacggtctgagatgtgatcatcaggggtgtgcgcgtgtgtggccacttcggctgtcgcgttcgccttccacgcgtggagcgcggatggcgctgccatgcgacgcagtgcgcgcagtggtcgtcctgcctgcagagatgtaaaacagcatgtgacgacggtgcgtgtggtgggtgccggccggccgaagacgccgatagaggcgcgaaagccgaacgcgtgggggaaggggagggcgaccgtgctgtatcccctgtatgtgcggtggaatggaaattaaagtggtttggctgccgttggccggggccggagttgctgactacgtgactgcgcgcatctgcgtgcgtgactctgggatgatgggcctggtttttcgtcgaggtcttgacgacaaggtgcgcttggctttagctttgacaccggaattgtttggtgctactaccagagtatgagtaggatcgctgtttttcattttccttttgttttgtcctatgtcgttattgtatgatgtagatatattcatatatatatatatgggatgataatactgcgtacaagattaattacaagtgtgtagtatataaaggggtagctacgcatgcatatgctttgcaaattgcgagggcttgtatttgtgacttgatttggatgctgacatgcagccatatgatatgggccataggccatagcccatgggctatgcttgcaagtttttctagctttcccactcacaaaaggctagcattactaactgcagatgtgcttcgagtttattattattattattattttttacctcacacaagctacaccatcaccaggatcaaaacgtcccaaacaggatcccatgctcgattcctttccgacccggctatattcatctcaagttgctatcggggaagcaacaataccagtgagaatttcttgcacgaaaagcgaccaactttgagtccagaataattcctcaccaaaacgaacagggtgagagcgaaatacttgcaagtttggaacttaggatgtgctacagacagcccacgatctcagtttagtctagttgtgcggttagcatcgttcagatcattcaacaacctacttcaatagacatttgcgaagctccccctaaagcaaattctaaacacaaggctcacagagatttaggctctctttgagattattgtaatatagattattgaaccaaattactgtaaagtgaattataataaaccgatataaaataagctgtgagctatttgtttctctggattataagctgtttgttagctgttagccacccaataatctaaaataagcacatttagagtggattactagattataataatctatcataataagctatctatttttttcagcttatttctaataatctagattataataatcctaagctgaatcaaacagggccttactcacttcaatgccggggctctgttcattgctttggtttagttggttcaactactaatcttgcattgcatccatgcataaggatcggtcaaaaatatactcggcacataatacaaggcgtatgaattgaattactagatactgacaaaagacattcagtatgtaaattgaaatcagatgaattgtccggggaaaatggaatgaataaaatgataagagacctagcagcctataaaatgtatacagaatataccaatgaacaaatatggtttacaatcaacatggatgtcagtaatttccctatgggtatatattcacaaggaagcaatctcaaattctctcagtattatagtataactaatgctgtatgtactgtggtgaggagtgcatccggcaaacccattcagcgcttcaaggaagagaaccacagaggattccactcttcagggttccaagctccaactatcaggaggggccaaaaggccaagcaataaaatccatgtccaaagcaaagctcccgcgtggttactaaaacaataaccagtgcttcttcctaggcttgtatttgctagggagatctgcaaagtaatgggtattttcctcttattagggaaagggatgtataacagtacaaggcaccaaatctgatagcgcactataagaaatgagaaatatttattttttctcacctcgagcatcatatagcgagttatagtgaacttccgaccagaaacttagccaaatttctgaaaaacacgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 66145 - DNA, 1633 bp, Oryza sativa
gaaaatatcaaacccagaatacataaaatccacagaagcactagttgtgtgatcaatgagtcatgggtgcgtgagcgtgactccaccttttagggttcaaattctagtgaacattacgtacaggccgatgtacttagaatagaattttagtaactaaggagatgttgttaatctgtctttttagcgtacaatagagaatgcaatcacgggtacataagagtggtgtgtatgaatgcatcttccatgtaatcgagaaaaaaaacataaaatcctcatacacatataataccctcctagcgtgtatcggcaaatttgccacggtagtttaggccaacttcaaggttgctatggtttaccttttgtttgaacatcgaaaatgtgaaagtctcaagtaaaaaggaaattgtgaaagtcgtaggagtctatcatcatagacttaggttcaatttaaaacatattgttggtattgttgatttgaattatctacttgcttatgagactaaattaaatattttaataaataaaattaagtctaaagtagaattttctttttagaaaacgtatatttttgaaacttggagcaaacaatcagtttcaataatccggtaaataatctgaaatgaacttaagccctcagttgttgaatgctggtcatgaattacattgttatgcagtaaaatctttggaactttgaacattagtaccttttaaatatttatttggatatataaaaaatcatatatgtagattggtggtgaaaagttttttttttcataacactgctagttcatcaaattttaaaataaggtgcaatataaattattcatatatgtttcatatcatatcacgctttgattttttttctagtcaaacttaaagaagtttgaccgaccaagtttaaaggaaaaacatagcgatatttttagcacaaaacaaacatattatcaatatatatttagtgctagatttagctaaatttatttgatattatagatgttagtatttttctataaaattgatcaaacttaaaaagtttaactagaaaaagggtcgagacatcttataatataaacggatggagtagtaataaaaatttgtatcttaaagactatgttaatacctaaaacaacatttttcttataatgagggggagtatgttgcacatatgaagggcatgtttagtttactactattttcaatcctacaaagtttttggcaatactaagatttggcaacattaagtagtggtaagatttgataacgctaagtgtcagggttacggataaggtataccctctatccttggatatacgttgtatactaatacggtatacccgcgcgtatacagatagttcccgtatacattaaggaaatctatcacgtgatagatatggtatctacggatggaaagagttctgctcagacaaagactgggtctttaccatatcgtgagaggtccgatatctccgagtcctacttggagatcaactgacccgcggtataaaagggaccccctgggcaggacctaaggcatcgaatctcaccgccaacacacccaccacagcctacgaagccggagcgcataggagccaagtcgccgggagatctagttggacctactcgactacggtat

SEQ ID NO: 66146 - DNA, 2390 bp, Oryza sativa
  unsure (1)..(2390): unsure at all n locations
cggcacacgcgacgcgagctgcagcaagcgtcgtcgaagtgcggaagaaacgggaggaggaggaggagctgcggccgatggaggaggagaaggcgggcatcgacgccgcggcggcggcgcaggtgcggcgggagctgtggtgcgggctgggcctcctggcggcgcagacgctggggttcatgcggctcaccttctgggagctctcgtgggacgtcatggagcccgtctgcttctacgtcacgtcgctctacttcatgtccggatacgccttcttcatgcgcacctccacggagccgtccttcgagggcttctaccgcagccgcctcgcgtccaggcagcgacgcctcatgcgggcgcgcagcttcgacgtcgcccggtacgaggcgctgaaggagcaggtgggaggaggagcacggtacggcgtcgcggcgcgcgacgccatcgtgttgaggcagcagcacgtcacgcacgttcattagcagcagcagcagggtgtttttttttttttggtgtggctaattaggtgtgacgtcgagcgcgtgcgtagttgccagctaggagtagtacagtaatactgtactccacgtagtttgagacgtggacgatccgggactcgggtgagtccatgatgtccagctgtaccagcagccatttattcggtcagaaatctgaaaaattggttgaatcactaagtaaaattttttctccagataacacggataaatctcaagcgttcaattttagattcaacaatagtttaagtttccactcatgtgtgatttgcgctacattttcttcagaaatctacatgttaactaaggagggctgctatataccggtatcacgttcaaaaacgagatgaaaccgggtaggtatcaggacaggtgcgtttctaccacatatcagatgatacttacgaggtatcagatgatatgcgatttttaccacgtggtgggtgatgcttgtgatgtatcatgtcctgataccccttaccaggtatcatgcgattctacaacgtatcaagtgatacgtgtgaggtatcagatgatactaacaagtatcatgcgattcttacaacctagaaaatgatacctatcagatatcaggtgatttttaccacgtagaagatgatacctatcaggtatcatgcgattcttatcacgtagaagatgattctaccacactcaacagtcagccatgaccaagtcaataagctctttgcaccacatcttgtctctttgctctctcgaagcagcagatggatagaataaaggcccggacttagcagcgggatcgacggccggcgacgaaggcgacgaccgaagaaggcccgcgacggagttgggacgccggcggagggcgcaccggccggccacgcggatggagccggggatgggcgttaatggcggcaccgtggatggcgggcggcggtgctggagctccaggcgacaatccggcgaccacgtcgccaacggccacatggccggcgacggagttggggcgcaccggctggccacgcggatggagccgaaggtgggcgttaacggcggtgccgtggacggcgagcagcggtgctcgagcactaggcgacaatccggcaaccatgtcgccgacggccgcgccctcctctcgccgagcaggtcttcttccccagcctgcgccggagtcaccgacggccacctcctcctcacggctcaggcgctcagcctcgttcctctttggatgggaaaggttgacaaaatgtatcccatcccgatggtatattggtataggaaatagcatttctgtaactaagaagtgtttacggcccacaagcactatagcgatccaatttcttcataggctgggcccgtaatcaggttccctgacgggccacgatcagggtcgctaattcgctaccggaataagttcactggaggtccctcaacttaacagcgagaattttttacatccctcaaccataaaaccagaaatcttcacccctaaacttactcaaaccgtgcaaagaagttcccatggcagtatgtgcacccgattttgttgacatggcatcctagtcagcaaaaaataaaaataataattatgtggggcccacatgtaagtgagagaaaatggtgtacacccccacatcttctcctttctttcctttttttttttcccctcccccctccctttttttttttttttaccgcggggcccccgggggggaaatcctcccttttaaagggggggccccccgnccaaaaaatttggggggggcggggggggttttgtgggggggggggggaaaaaaaaaaaacccccccccctttttttgggggggcccccccccccgcggggggggaaaaaatttatgcccccccccccccctttttttggggggggggggg

SEQ ID NO: 66147 - DNA, 6102 bp, Oryza sativa
tatttttgctgactaggatgccacgtcatcaaaaccagccattgccttgggacctaaattagacggttttgtatagtttaggggtgaagatttctggttttttggttaagggatctcagaaaatctcgctgttaagttgagggacctccggtgaacttattccttcgctacccgctacctagccactctgttccttaacaggctgggccgtgattgcgtaacttggtcggtcggcctggttggcgaaccatcagcctacgaggcccaagattccatgcccccactaaacccccgctttgtcacggggatggtggcttgattttcgcaactaaaaaatggctccatgcaactacacagtactacaatagagagatcagcgctgatcaacccattttttagtgcaaatccctaaaaacgaaacagaggatacaatttgcattcagtcattcacgacctactaggctactactacgaagcaaaggtaagagaaaaaaaagagagggacttgaatcaccggagatggatggcctaatcagaaatcctgaggtctgttgcggtgatcatcactgctgctgcgcggggcagaaggtgatgacgtactgcgcgccggtgccgcacgtgaacgtgctggtggggtcgtcgtacgcgtagctgtacgccgccgggcacgccgccttgaacagccgcgagtacctcgtcggcccgcagctgtccggcccgccgtgcgcccccgtgcagcagtactccgccgtcccgaacgcctcgcacgcgctccggcacgccaccgtcgtcgtcgccgccgccccggactgctggtcgttctccttccccgccacctgcagctccgcggggcacagcgcgttcacgtcgccgacgcacccggcgtacccgcacgtcgagcggttcaccctggcgcccgtcgccgccacgccgatgccgacgttgtacccgtccaccaggctcacgtcgtagaagtccttcccgtcggtgccgcccagcgtgaactcggcgagggtgacaggcggcgcgccgccgagggagcagctcacggcgccgccgcagtcccccgtgacgcaggcgagggacgcggtgccggagggtgcacagtccgtgcgcgcccacaagcggccggaccaaccagccggggccgggaacgagacgttggcgccgggcgacagctcgaacccgccgcccccgacggccaccgcggtgttgccggacaaggtggccggccagacggtgtaggtgcagttgttgcgcagcgtgaagaccgtcgtgccgactgcctcagcgccgaactgcagctgcgaccataggacccctgcattgagacacgcattgttgaagaataaagaagatgtatgctaacagcctaaagttaacctgaaagtttctcagacttaccaacgatgatttgaagggctggagttcgtccgaattccatggattgaaatggtttagctcgaatgagaaaaaaaatgaatatgtgttttttttttggaattgaggagagaaatggcagttgaacaatgcgggtaatagaagaggaaatgcgcaaatggtgaactagcagcaacagtaatttgcccggtgattatcttgtctatatggacgttggtgatatcctcagatattaggtgggaactggagagaacatggcggagtttgttgagaattcggaggaaggcacgagcagcgccggacgtcgcgtgcccaacttctgccattcacgcctaaatataggcgtagtggctcagattgatcggtggagtggaggtagtggagctgtggaggtggattggtggcaacaattccgtagcagatgaaaagtcgatagcaatgtaaagtgcatgcttggacaaaggattgaatcacatttgagttcgtacaaacgcaagtttatttttaaggcccagatatatatatatgggccatgacacactgttatcgaaggacaaacgcttgtaccaaagtcaagcttcattttaagtggaaaggaaaataataaatagtatattagtttctctctaaaattggatctcctattacacattatttgagatctatttataggtttacaacctttaaattttggtgtgctaatgattttacataattgtcctcgtgacagggatatatgtaagggcattgtcttttggtctagctggttcatgggtcttactggtccgcgattgagccccttattgggtctcctttatttctgcgtgctatggctagtcgtgctttgcctccggatctgccgccgctgccgagtccccggccttcggatccaccgccgccgccctccctaccgccaaacttcactgccgccgtcactgagccgcctgctgtcgctcgagcccgacgtgctctcgtcgagcatccccaggtgactgatgcgaggagcaaagtagcaacgggactcatgccgtgcgcccatctcaggtgggacgagttcgtccgctcgattttgccggatcggttggtcccggatttaagagttattctatttagggaccaacccatcccgctcacccctaaaccaaacctatttaaaagtgggttcgtcccatcgcattccatcccaaaccttgcaaccaaacactacccaacagtgttatacatacccattgctgtgttttgatctatctagctgccacctcgttcccaatcccgatgctgtcctccgagctgggctgccatagcctctcgaacgcgtcggagacggacagcggctgtccgagcaccgagaggctgaacgcgatctcggccatcttgggccgccgcgccgcgtcctcctcggtgcacgccctcgccatgccggccaagctgagcgccgcgtccacgccgtactcaccgccgagggtcgggtccatccacttcctcagcttcgccgccctcttgtccccgccggcgtccagcacggtgcggatctccgtccgcagcatgccgatctccaccccgacgcgcgcctccaccgccctcctcccggagaggagctcgaggaggagcagcccgaacgcgaacacgtcgctgctcgtcgccgccgcgtcgaccatggcggccggcttggccagggagaagttggacagcttcgccctgaagcccgcggtgaggaggatgttccgggcacggacgtcgccgtgcaccatgctcggctgcgtgtgctcgtgcaggtagagcaagccgttcgcgacgtccagcgcgatgcccagcctctggtcccacgacagagttgccacggagctcgacgacggctgcgagcacggcggcttctggtacagccacttgtcaagcgagcccttctcggcgaactcgtacacgaggaaggcgtagtcgccgtccgcgccgatggatatgccggccagcttggtcaggttggcgtggttcaccatctgcatcatcctcagctccccggcaacgttgcctttcgccggcttcaccgcgaacacctccctttcaaggttcgcgcggtaatacgagctgccgagcttgcactgttcgtccaagttcatcgtcgcttccatgatttcctcctctctaaagatgatcggtttgtcgatgaactgcgacacgctggtgagcagcttgtcccctccattgatcatgcgagcaatggagctattgctgtcgaatctgttcaggctcttggtccaagaaagcttcgggctgacgtgctttggcaccggcgccttcttgcggtacctccggtacgccaagatcgccgtgcacagcacggcgcacgcgacgaaagaccccgcgatgctcgtcgccacgatgatgccgtggcggtgcttgcccgctccgggatcggcggcgatggcaccgtaggtcagcggaggaaaacgcggcggctgcgacaccgggatcagcacgggctgccccgtcgcgaaggtggagttgcccgcgacgccgttcgacgcggcgatgttggcagcggaggcgttcatcagcgcgctcaccacggacacgtcgtccccgggctgccacacgtaggtgacgaggagccgtgacccggcgctgagctcctcccgcgtcgggcaccggcagaagagcggcacgacgacctcctgccacggctccagcctggtcgcctccgccgccgggttgagctcctcgacgaggacgaagtcggtgaggttctcgaacgcggtgacggcgagcccgaagaaggtgtcgcgaggccggatggggtacgtgacgttggcgaaggagcgcgcgcccgtgcagccgcacttgaccggcacgagcagcggctgccccggcaggagcaccccgtcctcggtggtcagcttgttggcgctggcgatcagcgcccggctcacgccgaacaggtccgagatgttgccgaggtcgaggaaccccggcgactgcgtccggtacacgacgaacgtgtcgcacggcgccgacacgttacaggcgaagcgacgtgcccgggcagtggcatcggtgacggcctccccgccggcgagctggaaggcgatgacgacggcgaggatgcacaaacccttgtgttccatttggagctggctgtcacggtgcttgtgaacgtactagttgtgaggagtgagagagctcggtttttcagtggagttaacgtgcagcgtggggtttttgttcgggtcaaacgccggtgcgtctgttgtcgcggctctgctgcttttgattcggtcgtgaaagtccctcctcgcggctcagatgccattccttctgtgtctgcatcacgcctgattagattagttcacaatagtacgcatcatttgatcagaaaattattgtgagggcgtcggcctgcttgtatcttgtgaacggagctttcatgagcggccgttttgcagccggaacaacggaaccggtctgccgccatcagccatctgattggaggttttcccgtcagataacaacacaagggcatcgttatcaacagaaagaaatatggattatgtaaggaaggtaatgatgttgcagccggagcggaataagggcatgtacaaagatatatagtcagatataaactctacgttatctagatattagcatcctacaacagatagaaacaatatggtctctaatcattaatgtattcaaataaatttttttactcttctttccttcctttcaccaccatgcaaaaaaatttgctctaataaatgctaagagtcgactctgagccgttgtcctacataagggcaagtacaaaggtagagaccggtatggtctctacgtcaattagaggctaccatattacaatagttaaaacaatatgatctctaatcattaatgtaccaaaatacttttttactagtcatctttcctttgttagactcgatgcaacgaaaaatttcctaataaatgctaagagtcgactctatgccgttgtcatgcgtagcaaccatctttctctttccttcttcctctctcttccatgtcatcaaatatgcttgcatgacaacgaagagagaccgctaataaagaccattgtacatgccctaacaaccatactcctttctctttcttccatgtcatcaaatttacttgcatggcaatagagagagactactaataaagaccgttgtacatgccctaacacctagaaccttcatcatgggatttacagtacttcattcatggagtatagaccaccagacgacagcaacccaccgcagtgcgatgcagctcaaattctctctgtcatgaccacggtaggaaatactctccatggctccaataatattcccatcctattacgctcattctcacttctcacccgtcccggcccatagagcgtagggaaatactcgctgaaagttcaaaaaaagggctctatcaatatatttcctaacatattattggatcactattctcttaatgtttatcgctttctcttggtagggcatttttaacatatatggcccatattgacatcaagttggccctcaaaaatctaaagcagagagctaaggcctaagaacatgtacaacgttctttattagtggactctctttattaccgtgcaagtaaatttaaatttagtgtcgtggaagaaagagatgagaggaaagaaaaatatagttgctaagtataacaatggctcaacgtcgg

SEQ ID NO: 66148 - DNA, 2308 bp, Oryza sativa
attaattcttatgggaaacgtcttccaaatgccaacggtgacagctaaaattatgcaaactacccatatgaattttagtacatgacagggcaaacaaattaaatcaatcatgcaatacccatctacagaaaaaacttttaaatgacctagcaagttgtcattttcaaacacaatgcttataactctagaaaggcaagatatcaatagtctgaatatctagcgggcattagccaaaacatgatagatgtacaagataagatgaatcggattgctttaatttcagatcaatgacaatatcgccaacatgtgattattggcttcaatccattctaaagtcaccgttagggaatcctatcctaatccactcttctagtactctatttgtggtatttcaatgaaaatacattgtatctttgttttttgattcttactcaattaatctagatctgcaaagtttatgttaaagaaaatatatttatcatctaagcatagttattgattaattatcacatttttaccttttcagagtttgaatggtacaatctaattctttcaccccatatctaatactagcatcaacgtttccactgcaataaacatacatcatacacataattagagaaaatgctaggaatacacaagcaacaaattatatttcaatatccaacattctacgtgaaatcgctgtagttaaaatgtatccaatgattataatattgttcttttggctagtgcattgtgtataccatgtgaacttgacctctacttttatgtcggtccatacatacatcgttgtttcatattgttccatattctaggggatttatactatagttttgaagtaagttctctaatttataatttatagtgatgttaactcatgtccattctctagaaggaaaagattaaaaacctcaactttgcctttttattttgctaccatctacatatgatgaagggagttgtcaccaacgttcttctttttttgagctcaatatcactagaggcgtgctatactacatttctatataaaaatgaactttctacaagtaaaagcaaataggtgagtgggttttcatgatccaaggtctggcagattaagcaataagaagatgaactatagagcatgaagagtactctcgctgatgaggttgcttctttcccgttatccttctacttctctctgtcccttcggatctttgtgactaatctggccctcttcttaaccttggtggaattcacatattcaaaatctcatgagactttcttgtcgtcgatcatctagacatcgcctccacagaggagtagcttgacaacattctatctatcggtgctagtgtcgaatgatggcaacctcggttttggtgcacgtctcccagtcaagatcaatgtgctcggagcaacgatgcttcttgaccttggccttgtccctgtttttctgtttttcttggtggggcgagaggatttctcaggcttttagttgggggggagggttgattctgtttgcagaaggctttgatgggcctattagtaggagggtggaggttgggtgaccaagagtttattaatgacaatggaaatctgtggttgtggaggtggatttttgcttctgctagggtttggtagggacagattgttccttgggatgactgttgcttccgatggcaacaaggactccttggggttggagggaagaagaatgtggtcatgcaagatctggcgttgtcggtagagaacatcatcgatgtggatgttggaagggaaggagagatcccttgcatagagacggtatagtcatggatatatggctgatgccgctacaacactcaacaccataccacatgtcatctccgtcgacatctttgattttgcatcctccactcgccccaacatcccaatttcaatgagatatagggtatggaaataacacaactacttctctaagaaaatgttgttagtccagcttaaacaaatatgttgtacacaattgcttaccatcatcacttgtgtattcagcgcaaactcgagaaaaaaaaatgtgagggagtcgtatctcaatgcttcacacatttgcacagaggttccaattttcgttcgtacttcgtgatggcggatgtttagcacatcggaatcggaagggtgaagagtgcttttacgatgcaaaaacgcaagcgaaaatccaacggaatctagcaggtcacacaacatcgcggcaattttctatttacgcccctcctcctcagcaaagcaccgcaaaccagtccctctttccggccgcaccaccaccgcctcccctccgtttcccctc

SEQ ID NO: 66149 - DNA, 3174 bp, Oryza sativa
tgtcaaaacccaaaacagcaattttgaagtatcatgtggtgaatgtgttttgacagaaatttcattttcactgaaaatttagtttaaatttattctgatttgatgcttttgaatgtagctggttatgcggtggtgctactggcagagatcacacatggtcaagtattagtggccacagttgtggtcgattcactgaagatcagtcaaagaagacagagcaagctaggagaaacctttatcggtacatgcactaccacaacagatacaaagctcacactgattctcttaagcaggaagcaaagcttaagggcgacatccaggggaagatttccatttctgaaaacaaggattccaagataaaagattactcttgggtgataaatggattaaacagacttttcaggtcaaggcgggttctttcatattcttatccttttgcattctacatgtttggtgatgagattttcaaggatgagatgacttctgatgaaagagaactaaagcaaaacctatttgaggaccaacaacaacaattagaattcaacgttgaaagactatctggtttccttgagagggattttcaaaattttagtgatgatgaggttatggatacaatgaagcatgtcatcaatctttccaatgtggttgatagactctgcaagcaaatgtaagagctcaacaaaagtttggtagtgtctgtaaattactgttctaactatattaccttgcaggtatcagtgcattgagaatgatttgttgtatccactgcgtacgcctcataatattgctccatacaaatccaagggccttgacagggcctcagagctcaatgtttgttgggattcttctgaacaaggtttgcaaccaattaaatacagtcaagatgaacacaagagtcagcctggtttatctggtacttatattgacacctttcatttctattgcagcttcaatttatatgtttctgatagctgatgcatatttcaacatgccctgtaggttcatctatttttggaaagcggcaacttggctcaagttctaataacaatgggcggcctcacaagcgagaaagaaatgatgcccatggtggggctgccctttttgacctcaatgtgccagctgaagtggcagacaagatatgaaacttaaataacttacagcacattccgttgcaagtgtacagctgacccgggcttcttcagctacataaaggaaaactctgctcttttttgttgcgttagagtgtcgacatggcaagtttaaacggggggctataataccaacaatagggtagcgttcacttattctcttgtaaatcatgacaagaattggtggcaatgtgcaatgtgcacgttgcatagctcttataatgctaaatctacccctcgggcaagacgatggcattttggaagataaaattttgaaatgtccttttgcaaacatgcaaggtaatgtatgaagcatattggaagtgcctgcggatgcgtagcacctggaaattaatagaaacaaactaattgagtcgcgacatattcttggccgagcttatgggctcatcttatccgtcaaacctattttgtggccagaaggcagctgatctctaggtcagttttggttgacatatatccaagcattcattgctgggattctgggaatgtctgaattccgattcccatctgctgaagtgcaagatgcaaatcttggtccctgttcaggacaggatttctggttttcttctcttgtttcatcctagagcctttggattatttgtcacaacttgtactccctccgtcccacattatatgggactgggcactgttcatccaaaataaggaggttagcaaaagacgcatgtacccctcatttacttagtactgggcactagcagtgagaatatttgggtttacaagcttgccagcaaatgattggcacaaagaaagagtaagcattcctcagtacacaatgacattaatgcacatgttgacaagagtcaattaaatcccactcacctctttgctgcccaaaattcacacgcactacacattagcgccacaaatacacatgcattagctgttcaaaatttaaacttgatgctcagaaccagcccgccattttcactcccttgctctcactcacaggtctaaaaaccaaagctctcatattacactcatattagcaacctactccatcattacaccaagagagaccctcaactaatccatggaagaagaggaatatgagattcctgatctcaaccttgatcctggtgtgcaagaagtgctgcaagatgaaggtgatgggatccctgaccttaacctggttcctgctgtgcaaggagaagatgccttccaatatgaagatgaagagcttcctgacaaccaatgttttggtgctcatgaagatgaacatccaggccctgccatgcaagcagttgaactctccaatggccggagtgcacaagaaatttgtcatctaaacatggagccaggtatggaatcaaaatcttaatgcaaagcaagttatgggcttattcacatttcccatcctcccttctgctgaaataacagaaacataaatgttgaaagtagcaaagtttgtatgatcaaaatttatgaccaaattcataaactaacaagcccaatattacttctttgcataacacagagctttgcagctttgctattagtgtcaatcagttgttgcttttagtcaggagttgtaaacttcagccatcagtcatatatatactcttatgtggtactatgcaaaaatgatgatcataaatggctctatgaattttatttgctcattatgataaccagccattagcccaacaacctccaaagtttataagcgtacatcatgtgttctaaatagttggaatcagcatagttaaagttttatttcataaagctggttttaatatcagaaactactaaaacaacccaaaaaatgaatagtatgaactttatatataacaccactgcaggatgacccatataggtatgggaacatgtgttttttttgtggtagatgacctaatgcaaaaaaaaaacttttgtggtcaagaatggttacttaatttataatgcacttttctgtatatttcatcatacaaagcacatgacagggtggttaaagccgcgcgaatgcactacttcattagctagtttc

SEQ ID NO: 66150 - DNA, 814 bp, Oryza sativa
actcgggtagtgtccgatattttgcgttgcatcggacgtccgggcggtagtctcctcccataccttcctgatattcgcgttttttttatcagttttcagtagtgtacaaaacccacttttgcacagttgttttgggccacttttgcagtctattgggcctagtctgtgattataacgggctctggttttaccgaataaatgctctgggcctaataggcccatatgttggcggacggcctcgcgcaggtcgcgacacagggacgacgaggactcgacggccgcgtgagccacccgcgccgcgccccatccggccatccgccacctctccgccgcgcgcgcggctgcggttgctatgctactccggccacgcctctccctcctccgagccgtcgcgccgcgccccgtcccaccaccaccccgcgcctcgctccccgtccgtcgcacgctctcctcgccggccggagcggcgaggaccgcgtccgccggcgatgcgccgccgccggcgcagcgaaccgggctcaagggcgggaggaagagcgcgccaccgccgccgcctcccaggggttcgtccgtgaaccccgcgctgttcttcccgccgggggtggatcgggacgcggcggtggcggcggagatggtgataccggcgtcgaacatcgtggtagggccctacgcgggggactcgcgggtgaaggaggcggagttcgtcaagagcagcgcgcgcgcgcgggactgccccaaggacgaccgccccgagttcgccgtgctggggcgctccaacgtcggcaagtcctcgctcatcaacgcccttatccgc

SEQ ID NO: 66151 - DNA, 6867 bp, Oryza sativa
catccattcctggctgcttgcttgctagctgctgccgatccattgtcgtgtccttctcaaattcacaagttgtgtcattcgatcagaattgctcgtgtgacgcatgcgtatcccttcaaagacggctctcactgtccacaagattagatccttgttgcctaggcaggcaggcatgcgagcggtgaacatggattggggaggctagttgaatgaatccccagtctattggacgtttccatgcatgcgcaagaatcccaataattcggggaattttctcaccggccggaacggactccgtgtcacgctgcaattgcgccgaaaggctctttccagtttttctcgctgcatttcgtaggggcttagtataatcgattgcgaaggtggattccacgaagcgagctgaggtagctatagctagtgggatctttgattaatccacaggccactagcaaagcgatcgatcgatcgattgagcttgttgagcccttgctacgaacatatgcgacgagacacttgctcatatatgctttctgattcttctcctagctcttgaggatctattaggccgccaccaccgggatctgggacatgtgctgatgcttattccgatactacttcggaagtcgtcgcactggttgccgttctcccgttgcttggaaatcaactcactaaatggaaccttaaaatttgggacaagttgggggtagatatactgtggagggatcggaatacatggccttcatgttgatcagatgtgtttgcagccgtagcatgcagtagcatatatattccagattctgaaaccgaccgggaacttagcaatttagtactagcatgttattataacaagacgatcactgtgcatggcgtgtctggactgattcgtactgaaaaattgatagcacaaataacgtggatagaacatcatgaggaatacagatccatttttgttaggttgcatttcactaaccaatttagtaaaacatgctgcacaaatggttatttcgtctgtcccataaaaaaaataggatgtgacacatcctaatactataaatctgaacaaacatatcatgtattaggtttgtgtttttatgagacaggaaatattgctagcctactctatattgggcaaaactcccgacccagcgactccttccactgcctcgctcctgacccctcgtttcctctctccgctaccttgccgctgtcccaagcggctacaagaaaggcggggttgttccttagtagggacctagcttgcgccttgtgttgcgacggaggaggggggcatcgggtctaggattcctgcccccagatctggcggcataggagacgttggggaggggcgtagcggtggtggctaggcctacgcctggccaaacgggttggtgacgacaacgggtagcggtaaggcatcggtgggtgcattagaggacaacggcgggctaagcgtcgatggctagtccttggtagggagaaggtggatcaggcggaggtggtcccgtaggcagttgacactagggatggtggcggcctaggagttcgggctaaagactccttggtggcggcggcttgagcaccggtgcaaggttctcagtgaggggacggtggtacaggcagaggcagatctcgttggtagtggaggcctggaagtcctggcgtaagaggatatcctcggcgacggtgggctaggaatccgagaggcggaggagggtctgacgacgacggtggccctatgggcggcggaggcctaggaatccagcgaagcggaagcggatcatgttggcttgcgtttggtgatcagctaattctgactggacaatgacatatgaaggtggggctaaccggtggcacatggcgttagcttacttgaagcggatgaagatggcaccagcggaggttcgcagtgacgacacactaggggcggctgtgactagacgacttccacttgtcaaatctggccatttcaggagaggatgtcaggaagcaagtttgtgctaaggtagtagttttttttttctgttgttatgtgttctcctacttgttgaggtatgagtgtaagtactcttgtattattttggctgtgtatatcctttgtggaaatagagaccggattaacgaaaatccattaatcgagaagcggatggcgaggcctagcaaaaatcgagaagcggatcctaagaccagaaatttgcaagatttttgccttaaatttatgtcaaatattatttggcaattccgcatgttgacttaaacttgacctttcaacattgatagtatgatcttagttatacactagcaagttcacgtaaaagtttaggttgttacacaaaggaggcactatgcctatgctttaacactcccttttacccttctttagaaatgagccgggagcttttgccagttacagtcacagtggagaaaaggatacggtccatcttgacgagtaaatgagcggaaattgttttaaacactcaggtggacatccacctatttcttgcatgtcatctaaatggttatgaaaaattttcaaaaaaatgacatgataggataatatgtaatatatcatctcacaaacatgcaagtttaaattcgacttctacaagctgtaacaaaaataacaaatttgactgtgaatatacacatgctagttagagtttaatttgttatttttgttacagcttgtagatgtcgaatttaaaattgcatgtttgtgaaatgatatattacatattaacctatcttatatatatatttagaattttttcataatcatttaggtgacatgcaagaaacgggtggacatctacccgagagattagaatcaatctccgttaatgagctgattcatgatgttcgaaagctccttcctttccaaccaaagagtgctagaatttgatgggggcgtagaaatgagagatcattcacatctaacaacattcagcatcttttatgtttcacagtctgacgacatagcacactattttttttcttttgagaccactatcaatttgaattgggaatcgacctgttagcttagctcctaaagtctgaaatttgttttttctgacaaagaagccaaataattttagtgatgcttttgtggaatgcgttcagagactttggtcgggtggttagttaaatgttgatttaaccgatgcttagtgtgctgtaattatgagcttctactttacgtcttgtgatttttccccgttgtgctagatctgtcagaatgaaaggtacaggactgtaccagttgggcaactaacactggagtaataataaaaaggcatgcctcatcactggttcgtctagcgttagtttaaatttcaaaagaggtcgaagaaacagaatacaaatataaacaacacaattgcagttgagtggctctattcagaagctttgttaggttttgaaaaattctctaaagtttggtagcaacagcgtcaatacaaaaattcaagacggacggaatttgtctgctctgtccaaggaaaaataagtttttggcagtctgtattactgcacacaatgacacaaaccagcattctccaaggtgtttttatctcgtgaacaattgcatgatccaatcgagatagcaacactgaatctgaatcgaaacattctcggagaatctcgggtgaatgctcgatgaatcacccgtcagttgaatccaccatatctgcacatatcttgaaagcttcagtagatgcctcaactcggatatgtaattaactagtgtgacagtgtcccaggatcaccgtagctagttgcaacgaataatgtcagattcttgctggtcctggtctagtagtgctgctgctcaagtatggaatgatgcagagaaggcgacgctgatgcatctggaggaatacgagcgtggcatccggttctgggttctttgattcggcagcctgagaaaacaagtgcggtgtatgcagagctggccaaaaggaacaaactttggtggccacaccccagcatcccagattcacaggaatcctttgttccttccttgtcaagcagcactaatcgcctattactactctactaggatgctctgtttgccagattctggactttgatgatcgactcttttcttcattctgtttcagggaacccaactagtagacattcttccaccggctgccataagtgagtgcgttgtaattgaatagtctagatagatcgtttgctagctggcttatccgtaactagaatttaaattttaaaacttaattttaaagttgattttgagaatttatcatatatatatttcaatattgtcttttaaatttactcctacaacagactcttggactaacactcccactctcagaaccgaactcgcaaagggggtctatcgattccccattgcagaagctccgttctccgatacacgtaaacattacgtcattcaaaactggtcattatactattttgggactatttagggcctgttcactttgatgccaaaaaaaaccttaccaaattttggtatagttgccaaaattttggcaaattttgacatgatttcttatatagttacctaaatttggtagcaaactaaatgtagccactttttttggcaacgttaccaaaatttggtaaggttgaaaatgacatcaaagtgaacaggctcttacaccgatttaaaaagctgagaatgtgttgtacttagttttaccgtagaaaaaaaatccaaaacgaagaaggaattttttttcctatcttgcttgttttgctgggccgatattatcttcttctatcaatcatagacggaataagttcatctgaggtctcttaacttgtcaacgtcgtgtaaaatgtggggcccaccatttttaaattaattttttggtgtaaactgatatgtgggcccacaatttttaatattttccaattacattgccacataagcgccacgtcatgtgaagaccgagtcaaaatagccacgtaggcgttacgtcagtgaaaaccgctatccaaaccaccatgggacctatattgcaccggttttaaaagttgagggacccattgtatctgtttttcggttgaaggacgaaaatcggatttgttgacaagttaagggacctcaaacgaacttattccatcacagactccgtaccccgggagtcagagttggcccataactgacactggcccgtaggccgtagtagcttatcggttaacaatctcatgggctcagttttcaacagatcctaacatccccgtactatacgagtctacgacgatgactatgctgcaaagcaaaggaaaaggccagtaaaccatatctttcgctttcgtccgtataagcacgaagaaaatgccaccaaacacgcccctcgcgtttgacgagatttctgaagcaatgaaaccgtcacgcttcctagaaatcttcccgaaacgcacggcacgtcgaatccgtgatgaatcgctcgcaccctacccaacccaaccctccccgactcgccgctccacgccgcaggcccccgcgcgcgcagaggcgtaggcgagcgagcaaacgacacggcacgacagtacggcaccaaaccccaaccccaacaccggtcgcgctcgcgtcgcaccgccccggcagccaagagagagaagcccaggaaaggccaaggtgatcgacgagcgcacgcacgcacgcacgcggcgccgtcagaaggccagagcggggggagaggggaggaggggctaaatcggggagaggtctccgtcatctccgactcgcggcgcggccccctcgccgagaccgacgggccgacgcaaccgaggcgagccagcgatcgagcgggcggggggcaacgcgtacaaaaaaaccccctccccttcccttcccttccctctcggtcgcgtcgtcgcgtggtcggcgaatattcgagcggcaacggcataacaccattgtcgcccgggacgcgcgctctttctctctctctctctcttcctggcgatggcggcggcggcgggggaggaggtggaggcggcgcggtgggcggaggcggaggacgagaggaaggaggggctgcggcggcggcggaggtacgggcttgtggagtaccgggcgctgccgggctacatgcgggacaacgagtacatcctgcgccactaccgctgcgagtggccgctcccgcaggtgctcctctccgccttctccatccacaacgagaccctcaacgtctggacgtacgttccctcgttcctttctccgtctctcctccccccctctcgattgattgtgcggttgaatttcctgtcatgtgagaaggaggttaagttgttcattgcacgggtaatgcggtggaaaggagatgtgacatcgatttctttcatggatggatctgttatacggagcaaagaaattggtctatagatcgggcgttcgaaacatctcttgtctgcttgtggatgctatagctttatgtttcaggctggataaatcccatacaacatatttcttctggcattgggtatttgaagtctgaatcttgaaatattaggctgccctcaaaatatctagccattctgtagatttttgctcttgtgcttatttactaatttatttatttattttatttgaatattctcaatagtgcatagttttgtagttgtgtaaattagggaggccaaggcttacagtttctaaacagtctggtattcaatttacctacctttctctctactttaaagactaaactcaatttgctcatatggattctcatgttgcaagctgacattaatttgaaagaaacgggcaaggaacttcaacaactagaatgcaatagagggacgactcccagctggaaaagccttcgttttgtacttgactgttcatatcatgcaacaggtcacaggacc

SEQ ID NO: 66152 - DNA, 1865 bp, Oryza sativa
agggtaggaggggggttgggggagggggaagaggggggtttcctcggagcttagagggatggccgtgggcggtgtacttcggcgaggcggtggcggcgccgccgaagccgcagggatggaggagggtggtgggccggcatcggcggcgggggcaaagcaagcgtgtggttaggaggcggcgggcggtggttgcggatccggcggtagggagccgccggagacggggaagacggcggggcgggggcacctcgtcgtcgccgcctcgaggagaaagagaggagggaagggggagggggcctcgccggcgccgttgaccccttccggccagccggcgaggcgggcagcggcgcggtggggcgatggcggtggcagtggtgggggatcgcgcgaggacgaggagtggcggcagcgtgcgatctgaattgggggaagaggagaggagttagggttagagtggtctacacaaatcttgaagcatatccaatggtccaaaattcgaataataggaggtggcattttttgtcacatgatatatagacagccccttcttttattgtattcgttgcatatatatatcgagctcgaatggagatcaagcaatttgattggcatcatacaacgtttatttggttactgttatttaaaagttatgtgctcgtatggagatgtatgcattctggaaaattatgactgtggcaagtgcaactcctaggcgacatttttttatgtaaaaaagttatcaatgtgattaatgcaggaatacgtctgctaagttacttttcctgatatactaaagctgttttttaatttgtgaactcaggcacttgataggatttttcatctttcttgttcttaccatatacaccgcaacacaagttccaaatgtagtagatcttcaaagtctgcagcatttacctgatgtgctgagaaacgctgatcttcataagattcagacagaacttgtggcatgccttccttcgttacctcacctttctgacttgcaaaagctgaaggatgaattgaaaagctcatggaattcaattgaggtgcttccatcattgtcccgttggcacctcttggagttactatcaagttgcttgccgcacagatttactcattccaatgaaaccagtctgtctgttcttgtaagtagtcaacaacttccctagtttattactcacttattatgctactagtatgttatttcagatatcgcaaaattaatgataatatgctggcacaattttcaaccggaaattattactagggatggaatatcaattcgcaatcgtttggtttcttagtttatgctagttcgtactgatctgatttcatctgacttatgacaaagtttaggccatgaccatgaacaaaagttgagtttatgctagtttaagctgatgctgacgaaagatttggtttctataccatgaccagtaaaaaatataaaaaccaacagattcctaggcaggtcactgctttactggaaaatcaggatcattaagaagttgcaactttatgattttgagaaccctttgtttagtcagcactcattttattgaaggtgtctagttttacaaacactggcacacaattacacatacagagaacaattgtatggtatgactagattttatctagacatttttgtcttcagagatagcaaataacattttctcacatgtgattatttgattgaaattttggagtgaaggtcattaattcagtccccgtcatcttatatacccccgttttttttttgttttatgcagcaaagcatgaaggaagatatagcaaacatgattgcgccacagttgattaggccaattccgagatggccattttatgccttcttgggaggagca

SEQ ID NO: 66153 - DNA, 4638 bp, Oryza sativa
cagcttgctcaagttcaatgcatacataaattgtgtttacaataggagcttgggaagtgaaatgaatgttcaggtaatgtccctatcgaacgaccaccgaaaccatcatcattcatcaccaatcatgagatccactccccgatttgctacggttgtgggcagcaaaacgaaggaaaccaacggcctcaccggctcgcctcgcctgtgcggtcaccatcaccggctcaatctgccattctgccgcctccaattctccaagaacttaaggcctttggggctccacgttgaagtcggatgtgtttccttgcagctagtacgatgtattgctgctagtatctactcctagttcacaggccgtgctgctgattttctgatggactcacgaagtcgcacacgtacgagtgcacgttagagacgcccgtccaagggctatattgcttgatggactcatagctgtgggctgttcagatgagtaacccatttccacccatcgtgccaagatcatgtgccggcccgactgcgatggcgacacacaattgtcgattgcctaccacaaacagctagatcttgaagaagaagaaaacgacgagatttttttttggcatctcgactgcgcccgctaagccgtgacgttgatcgtgatgaaaacttgacatgtcgagacccagagacagctaaccactataattgctgtaggtggcccgtattctcgcctcgcaacaaacgcacccacacatggatctcctccggcgagtcgccgtggtagccgtgctcctgtcgctgccgtcgcgtggccgctccggcggcggcggcagcgatctgcacccggtcgtgctcgtgccggggtacgggtccaaccggctctacgcgcggctgactgcggcgtacgagccggcggcgcctcgctgcggcgcgcgagaggggaaggatgagtggttccagctgtggccgatcgacgcggcggcgagcgaacccgcccaggccccctgcctcgccgagaagatgagcctcgtctacgaccccgtcgccgacgactaccgcaacgtcgccggcgtcgtcaccagggtcccctccttcgcctccacccgcgccttggttgggtgagtatcactgtgtcacgctgtcactgtgtcagagtatgtcttacgtcgtactaacaatcgtacgcacgtgtatcaatgcccgtgcatcaccaggtagatactcctagatagatgggcagccaaaatttatcggaattgctagaaaacttgcgacagttttctccaaagaaaacagtcgaatttgcagcccttagatccgctccgtgattcatgcgggcaagaaggaagaaaacagctaaaaatattgtcatagacaggagtcgaaccaaggccctccccttaaaaaggacagcataacaaccactaagctagctcaagtatacgttgaatgtgaaattacattttggttacattttacttacgctttaattaactacacaattagtcccctgttttcatctaatttttggataatcttgttatatttcactctcttacgggcttgctagcaatgacgtcgctgttggatgcaaaggctaaaaaagtttgaatgtttggtacctagtttctgtcgaacgtcctatacgtattcacgtgttttaatctacttacatagcacttacactctagttacatagtagttacgtagcacttacatcctagttatatagtagttacatagcacttatatcccagttatatagtagttatatgatagttatagggtaattacattatataaaattaggatttacaatttttttaagatcatgcatattacttttgaattatttttcccttatatatgttgaacaaattcttaccgttgaatcaacctaggcataagattagtggtttgtacttgtgtggacccgtttcaacagatcctatggttgaaaaatttgaaagttttgagtctcaaaaactgtcaacaactcactagctacttccaaatttatttactatttatttattcttgtctgactggcaggtgggacccactggtgcggcagctggaggcgatgggccaccgcgacggcgggagcctcttcgccgcgccctacgacttccgctacgcggtggcgccgcggggccacccgtcggcggtgggcgagcgctacttcgctcgcctcacgcgcctcatcgagagggcgagccggctcaacggcgggcggcctgccgtcgtggtggcgcacagcttcggctgcgcgctcacgtaccagttcctgcgcgcccgcccgctcgcctggcgccaacgcttcgtcaagcacgccgtcctcctggccgccgcgctcggcggcttcgcggaggggatggacggcctcgcctccggcgccggctccggcctccccaacctcgcgccgccggcgagggccaggcttgcgcggagccagcagagcgcgctctggcgcctgccgacgccgatggtgttcggtgaccggccggtggtggtgaccaagaactcgacctactccgccaacaacatcaccgagttcctcgacgccatcggcttcacggaaggggtccagccgtacgtgacacgggtgctgccgatgtggcgggcgctcccggcgccgatggtgccggtgacaagcatgtacggggtcggtgtcaggacgccggagacgttcgtctacggcgaagctgggttcgaggggacaccggaggtggtgtacggcgacggcgacgggaacatgaacattgtgagcctgatggctgcggaggagtggtctggggtggaaggccaaatcttgaaggtggtcaggttgccaggtgttagtcacgttggcttcttcagcgatcttgctctcaagaaagtagttgctgaaatacagaaggcagttagcagcatagaggtacacaggaaagagaaaatcttctcttttctgaataattttgaatttacaattcctgtgccactaggatggtgatgtccatatgtcattactgatccgtgcaaataaataatagcaataattttggctgctgtaagtaggcaatttatgggtgactagaaatgatatgattttttttagataagttagtttggtacccctctaactatggttgattgtcggggtctttactgtaacagtgaaggatgttgatgaagccgaaagatgcacgctaaggctggggctctttgatctcggtattgcttgaagctgctgagaacttgcactccgaggtgggaatggaatgatgctggcttaccttgcgaaggattctgatcttagtgttacctatagtgtgactgtatttagtttctggtgttgctgcttagttgtctaggtaggctagttgcttaagaacctcctgtcttttgggtgacctatgtgcccatggtgcttaataggtaaagctggttttgcctaggtgggacttatgtttctgtgagaatgactaaagtttagtccctccttcccaaacactaccctagtatccatcttttttgctttctaaaaaaacagggctatgtaagagaactcttttaatcacttgaattaacatccacacgtttattacatattaattagttatgatttttaaaaaatatcaagataaattaatatgtaatatatcacttcacaaatatatacaggttcaaatttccaacttatacaagctataaaaataataaatttaactataaatgtatatatactacctagagtttaatttgttactttttataactagtcgtcagagtacggaactcctttaacaggaagctatgcgctccctaggtgagtttagctagggtgcaagtttcaagctcaagtcatgatcctgcgaagggaataaacacaagcatgtatacatattcggctcgtacggatacgtaataccctattcatgtatggtggacgatggatggtgaagaggattacaagtaagatatgaaagattctaagtgagaaggagaagatctttgctcgcacggtgtttggctagtctagaaatgtgaacccttttcacggtggtatggatcctccttttatacattaagtggagtccacaatactattgcacgcatgcaggagtgggtctcacttctctaaacttaatatacttactcttgttgttgtcacttcaagccagttggccagatgtgacgaccacagctactgattgacaaatggagtagaaaggcaaaagtctttgttccaacttccacgggtccacgtgttagcaacaatagtccacaacggtgcccccgaagggaggatgttgaggacacaccacgtcgtacgtctcgttctcttcgggacgatgtgcatgcaaggcactacatgcacagccacatctcctatatttgtggatgagctgtgcaccgagtttgtaccaccccataatcaatgtaatgtgatgatttaaaagtaaccacggtactaagtcaactctccttaatagggtaacccctctaaggagagcctagggcgtcctcaggaccctaattagcttgcttatttgtgtagtgatgtattatatattaatatatcatgtcattttagaaaaaaaaagatagaaatgtaggatatgtacatatactagttaaaatttaatttattatttttgttacaacttgtagaag

SEQ ID NO: 66154 - DNA, 1629 bp, Oryza sativa
cctggatgacagccgaacacttctctttatcgaacggctccagttatctcgtcccctgacaaatccttgtttgggctctatagatgataggcactcttctaacatgggctgcccatgtgcacacgcccatgcgctacttggcacaagcctggaaatcatcacttcaacgaagcaacgaacacttgcccaacatgaaactgtcagatgtgcccgctttcgagtcgtctacccaaggaaatgtccctgtagcgcacgaacacgacaggtcgcgattttgcgagtgctcgtcgtatcgttcgtcctgtaacgatttcgcgacgagacggagcagcagctagccatctagcgaggaccaccattatcccgcgggccctttcgatgggcatctttcggccccattaccccgcgcagtgaagttgatggcgctaggccatccgggtccagccaatcggaggaggggagatgggcccggatgcctgtgtggttccaagtcctgtcgttggtttggctcttttccgccacttccacggtttcaaagcaactggatcttctgcagatcagtacagtggagttagctggaggcctggacctttgatttcttgagattttgctcaacataaatggcgcaggttatctgtcgtttctttttctgttatggccatgggtgtgagtatgctttaggtctatcattttcatcaaacctttgtgtccccgtcagtggtataagctatttagaaaagcttgagaaattcatgtgtttacttccggacattgtgtttttgactagtccatttaaagctatcttgatttgtagggaaaacatttgaatcttggaagatttcaatctatagaaaaaaaatcttatgaagtactttcaaatagagaattgaattgtatcctatctttagaaattactatgaaatcgacaacaaaaagttagcaagagcttaaacggattgaaaatttccatgtgagaatattccatttgttagttcttacggtctattcatacgatcattcttatatttttcgaagtttgttttgcaattgaatttctatcaaaattaaatattttttctattcctttatgttttcgatcctgcattttaaagagctttagttgatatttttttccaccgatcgattcggtagcacctgatggacatatattttctttccaaaatggtccagagcgggaatttcttgtagcgtatagccccaagaccgtgggatccataccagccaaacgagtcccctaccggcagggcaagggaagcaatcaaacggatccacgtccactccgtcagttcatctcttcaccaccacccacctctacgaccacgattactcctatcatcttcctctctctccctcttcccatccaatcctgttaacaagtgttagctgagaaaagaaaagaagcgaaagcgttgctgctgctagctacaaaaacccgaccagcactggtccttgagaaagcgaagtgcaacagatcgatcaaacgcttggtgaggtcacggtcaaagcgaggaggaggggagcgaggcacggaggaggcagcttgcaaaggtggttggcagcaccgagaaatgccctcctcgattgctgctgctgctgctgcgtgccgtc

SEQ ID NO: 66155 - DNA, 2988 bp, Oryza sativa
tcgctcgctggctgcatcccccaccccaaaccttggaccacattgaccggtcagacaagaggcctcaaccccaccccgtccccgcgcggcacactgcacaccgccaccccccgtgcatgcgacgccacgcgctacggtttccgtctcctcgtgagccccagcgccgcacaccacacgccctgtgcgcggtgtcgcccccgtcctcctccggattagtagcctacgtcgctgcctccggattattttgattactactactagtaatcagaccctgtttacatccctgataaaattttacacgctatcacattaaatatttaaataaatatatgaagtattaaatatagaaaaaaaaacaaattacacagattacgtgtaaattacgagacaaatcttttaaatctaactacgccattatttaaccatgtggtgctacaataaatactccatctgtactcataaagaaaatcatttaggacaatgtttaagtcaaaccttgggaatataaatcataaataactctcaatttattgagtttaaaaatataaaaaatatataaatagatttatcatgaaaaataatttgataaaagtatacatgcatcgcctggagcgtagcgtgatgatgatcgtagcagcagcgcgcggttaagttattgctgtttgggtcgcgcggatgccggtgcgggggctggctatctcggcgagggggaaagcgaccctgtctccctgatgccgcgctgatttgttttatggctgctcagacagctgctgttcttctcctttgtgcttgtggtactagagttgtactatactaccactaccaattggagtattttagccgggggggggggggggttagagcaagtttaatagtagagctcactacttactattagttaatgttaaagctaacatatatagtatgttggctataaggttatctttattttcttcatcctctctctctctcaccatgaatttaatgcatattttttagagtttgtgtgcagttagctcttgcatgagagccaacactctctactttttttatctctctcttccacataagcatatagcttgcttatagcccactattatcctttttatctctctctttcacataagcatatagcttgtttatccttactcttataagatgctcgctttctgcctctcagggacagaccggattaattagcagcgcgcgcatcgcacaggcttttgacagttttattatagtgctgctgcgtcgtcccagtgaccgtcagggcggttttggatgcacgtggacgctgacactaacctgaaagatgggttcaaggtgggtgcgtacccatgctagctcaatgccacttgaattcacaaatgtttcgcccgggtgaggccatgtactgtagtacgatggtttgattcaggtataggaaagctttgaaagaaatgatcgtaaaactaaaaataaaacctcgtaaaaacacatgcataaaaagacagaaaccaaatgccatactaattggattcctatgaaatttcataattcacaaaaaaatcaaaactattgttcgattggcacgcatgaaaatcacaagaaatcaatacacctgaacaagaaaacatgaggtgagatttcacttttattcttagacaaatttgcttctgctattccataggaattttacaagaattgctagaaatcgatcatttgtttcaaaggatttcatagagttatttttctcagaatacaaatcctctataaattatatggagtgaagtgcatgagcggttcttaaacttgtacggatgtatcatctatatccataaactttcaaaatgcatttttgggtctccaaacttgtcatgagtatcatatatgtccaaacaggccccaacctactccgtgaggtgacgtggcatccatggtgacgcttatatgtcagtgagatccacatgccagtcatatagaaaaaataaaatttaaaaagaggggggagagagagagagagaggagaaagcgatgtttttaattttgaaaaaataaattaaaaaagagagaagaaaaaatatgttcttattttttttctatatgtgttgacatatgggtcctactgatacgtaggcgctaacgtggcatgctacgttagcacatggagcaggttgaaatctgtttggacctatatgacacctgagacaagttgagggatccaaaaaattcattttgagagtttagggatctaggtgacacatccagacaaatttaggggccgcccgtggactttacttaattacatgttattcctttatttcaaaacccgaattttttattcataataattaataatgcagaaattaaatatataataaagcaaagtcattttttacgaaaatagaaaggacgctattgcatagggcgtccaggtgtggacgctgttgtagacaacgtccagatggggacgtttcttacaagggcgtccataatgctgcagttgaagaccccaaagagccgtccaattcaccggactagggcctgtttggttggtgccctgagtgatgagcctgagaaaaaagcatgcctgggtggaagaaaatttataaaatgttttccctgatcaggcatataagagggtttgttgtttggttggtaccctggacaagaaacgagcctgagagcatgaaaccatgtgaaagcaaacaagaaaatataaaatattgcattctcaaccggttagtacaagtaaacattctgaaatgacgccatgcaactagaatattccaacctcacctaatctaccttctttaattcggttgcctgagtcaggccacccaattcaagcgcctgagcctgagcaaccacgcctgtgtccagcaccttctcaggacttgaaccaaacagaccaatgaaaatgtcaggcaagcttcagctcaggcgaatttgcttcagggcagcaaccaaacagacccttataagattggactttggaaccaatcacac

SEQ ID NO: 66156 - DNA, 2227 bp, Oryza sativa
gacacagtagccagcctgagcctgctagttggagtcatgcgcctcgttcgagacaagcggcatccggacggcgtcgctgcggggcttgagctgctcaattcgatatgcgcagtgcacaagcctgcaagaagtttgattgttagcatcggtgcggttccgcaactagtagaattgctgccagagctgccaacggagtgtgtagagccagccttggatatcttggatgcgcttgccgcagtcccggagggtcggatagcgctgaaggattgccccaggacgataaccaatgctgtgagattgttgatgagggtttcagaagcatgcacacggcgagctttgtcaatgctgtgggtggtgtgtaggatggcgcctgaagaatgcgcgccggctgctctagatgccgggcttggggccaagcttctcttggtcatacagagtgggtgcggaccagagctgaaacagcaagcgtccgaactgctcaagctgtgcaccatgaattgcacatcgacggtattcatctccaagtgcaagcttacgaagacaatccagtgagtggagtttggaattgtgctgttccgcttgtgatttggtcgatggtgaatggttcacctgttgggtctcacataatctgaagaaatggcagcaattagcaattggcagtcgacagcgtctatgtatagataaactttgcagttatgcagaatttgccatgtcatctgatggcataagggtggatgatatgagtagattgtgagacctgtggccatgttatcactgtccagcgagatgatgcgtatcgcagcattcaaaatgcagcatacacacagctaattcagtggcaagcaggtgggatgtacatgcaaattgatgaggattttggtcagctcaataagcactcgaggctgggaggtggtaagtacagccagttttgccattggtagtagaaaaattaagcaagaaacctgctgttttagattttcggcaatgtgggtctttcagggctgtagatgttcttcctttttctcatcttcggtgtaattgatggtataaactgggtagaattgtatacagtactgttgcttcataattgaaatacacattgccataggccatatcttggaaaaaattggaactctttgctgcatctttcattgctttgatcatccagtaaatttttcaaggataacctttgtcctgtagcatatactgaaaagcttcaggcggcgttcctggtgctgaaattgaaacagtagaaagacgaagtccagtgtcagcttgtgctggtgccacaagtactactgtaattaacaagtatagtatcagatggcccagtttgaatctagagagcataatcagtcaagcaattgtagtcttcttgtagatttagccgcacactatccttaaaaagggagaaaacagataatttggtttaagttcttttctgatgattcagcaaatagtcgagaattgccagtcaaggttgacaacaacaccaaacattcattttcctggattgcatctactagtactctcactggaaaagcgggtctttgtatatttcacatcagggggctgtcttatctaatctcagggaaaaaaaaccttggtcatcagcaaggacagataaagccatggcaacgcctagcatagggtcactcatctatgatcaggagtaggctatgctcagtactttttccctttatacgttgccaatcgtaaagcagatgatgggtgctggtgccgcacaattgacctgtggaatggaagcaggatgaggaagtgagcgcaccatgcatgccatgcctcgtcagtctcctgcttttgccatgatccgcgacgtgacgtaccgccctccatgcaccgcgccggcgcgcgcacgcacaaacgccacaaacccacccgtcgtccgtccccatttccacacgccattctccggtctcgcctcgcgagaaaaaggtggactcgcgggccagcccaaaccatgtggcgtgggcacccccacctctcctctcctcgcctccgcgcagtcgaacgcgaggtgaggtgatcgcctgcccaaaggctggatcgggagcgagcaggaccacgggcatgcgcgcctgcctcctcccgttgatggatggacgacgactactcactgattgggtggcgctactgtgccgagcacaactcgtacacgggagcgccaggattgtggtagtgctggtgcctgtgtacgcgtactcta

SEQ ID NO: 66157 - DNA, 3505 bp, Oryza sativa
gatccctcgtgccatcgaccagagaccgatcaagccatcgaccgatcgatcagagggaaaacctgataagcgcgtgggcggcagatgcgaaatcattggcgttcccctgtgggcgtggactttggtctgatggatcggctctccccctgcaacgcttcctctttcgcttatacacgccgatgcatgcatatgccgatcgagctgtccctcactcactcactcactgatgggcaattctgggctcttgccgcgcgcatctggtgatcgatccgcgtcgcgtgctgctgctgctgctgctacagccttttcgtgatgtttgtacgcagcggccatttactccgggtctccggccgtccggcgatggcattggttggtgtacactcctaccctggtggtagggctggtagcagcagcgggtcatctttcagtcactgtgcggtgggccctgcacgacagaggggacgaggtgggggcgagtggctggttgcccccaagcggcagcggcagcggcagcggggcatggggtggtttcattgacctccagagtggcaatcgatcgaacgagacgagtgaagcttttgctgccagtttggcgtccggatcacggccagtatgcgtccgtcccaagtggcctcacctgaccggcaaaactgatcacatcacgcgacgtaggcatgcaagcatatcccctcagcttttttcagctctcgtgtccaggactccggacgcccgctgtttcagccaaaacagcaccaacgcgtttaattttaccctgttcatggtttgacacgcagaacggctaactttaaaacttataaagtgctggttagttaagggttaggggagcaacgtgttgcatgcattgtgaaatagatggccttgctagatatgccagtactactagcttgtcacttgtggacgtgtgacccaccggcgtgaggcaggccggcggggttaggggagcggcacgcgcagcaccggtgaaagtgaaacaccttctgtacgtgcatgcatggctgcctttctgttttctctgctcccggcttcaccgtggggcctgtaaactgtgccctctcgtagtctaaggagacagggctggtcaatcaagcaaactacacattatcaaagcgaaagcgatcatcccatgcaaaggacagcaaggccgagacatactatgcacagtgcacagtcacacacagccagtggaatctagatttacatcatcaaaattactagcagtgcttgttactgccatcatgaagtgtaaaaccatccaggccggcagtctgtcggatcgggcgacgaaatgtatgaaatgcacagtactagtagtagaatttttggcaataagtttcgtgccattgaatgcttacagtcctttgaatttcctaggctgccttcaccataactgttgtctagttccagatcgctccccctgccgccgcagaacctacgccgtaatgtatgcattcagaaattatgaaaagacttaattaacctaggtaggagtcgatttaagatagagtgagaatgcaacctgttaaatgtatacacctgagactctgaggaggggaaattacaagaagctccacatcgcaaagcctctcttagtatcccactataaaccaaagggtcatacaacagaatgagaaggaactggactaaaagctcatgtaattcaagatatatcggcaagggtcaaggactcgtggtttgtaattccctcttccctcttctaagcaaatcatggactcatggttgcttcattgtcccagtaattcctcaactgcgacatgtggaggagcagcccatctcggcctaatccagtaacgctactcgtcatgatccatggaggaggctctgggtacagggaactgatcgtctcctggaactctttgatgttctcctctggccggccccctttacctttcttggatttatcacactttgtgaacacataggtcaatccaatctgaaatagtacccaaacaacagaagtcagactgcaacaatatagttggagaacatgaaagatatgttattagatatcagtacatggcatagactgtcttatgttgccttacattgttacggccaagccaattggcacagtctatgtcaattttctgaggcggaatactggcatcaacaaggagcagtacgccaaccaaggtatctctgttcaagaagtaacccttggtaaatgaagaccaatctgttcgagcagattgagatgcagccgcaaacctacatttgtgaacagatttgattatcaccaggcgccaaatgagttccaacagtatgctggggttgtgtcccaatgggaatggaaaagcaacagtagttgacttataaagtttatttcgtacagaatgtgctcactgttacaatgtcagatactggcatgcagaaacagaaactacagccgaatagaagggaataattgaatctatgccatctaaagatcaccacttcagaaatatataaaactgaactgactaggttcactaatatgatcaaaagatcacagttcaagtttctaacactccgcctagtttcataagccttttcctcctcattaagtggtaatgaagtgaacaacatcgattcaatggtataccctggtggcatatacacaattgcctacttctaacatagtattttcaagtgaaaatttgctaccggacactcaaagtttgcgctctttgctactggacacccaaagaacgtgtatttgctgcaggacaccgtgggaatatggggacactggccgtattattttattatatctgatccaatggagagagaaattgtcaaaaaaaaaacaagtttacccatacgacatatttctttttaactcgaccaggtctagtttgaatcagacctacaccatcagagtgagaatggactgtatcgagggagtgaaaatggactgggtctggttctaaccagaccgagttgtcttacaagccgatgaacacaagggcaaaattgtacttctcgctctgtttctctccatttgcaatgccatctatgattttgtcattgtgatacatcctagaaagtagcacatgcaaatcaagttacatatgaattgagggtagaaaaggtcaacatacccgtaaccaggcaaatccacaaggtaccaacttttgttaaccaagaaatgattaatcgtctgggtcttccctatgaaagcataagatattccatgtaacaacagaagtacacatttcaacaaaatgcagaagataacaacatgttggttttgtaatgccaaactacattatctgaattcgtgtgcaattacgcagctaaatgcattatatacatcattatatacaattacatttcttatacacctaaaataaccctaatatctctcactagtctacaattctacagtttcaaccatccaaaaccaattgtgtgcatataccttttctccagcaatttacatggtattttttaaccaacttttgttaaccaagagccaatatattca

SEQ ID NO: 66158 - DNA, 2070 bp, Oryza sativa
  unsure (1)..(2070): unsure at all n locations
agatgaacctgtgagatgtgtgcaaaataaaaatgccatagataaagttatgtttttatcaactcttgcaaagcctaggtatgatgaggaaggaaattgctacttcgatggcaaaataggaatatggccctttgttaggaaggtgaagtctcaacttgattcaatctgtttttattgctttcaagtcactttgtagctaacttgttctttgctctatatgttaggaaccagcacaaaggagtagtcgcaacaggccgaagggtacattggtcacaaaatctattatggtgtcgagagaaacaagtagggctttcttgattacaaaggttattccagctattgcctcttgttggcctagagaagatgtagggaagaccatttggattcagcaagacaatgcactgacacatattctgccaaacgacgaagcatttgccctcgcggtggcccaagtaggcctagacatacgcatcatgaaccagccccctaattcaccagacatgaatgtgcttgatctgggtttctttgcttctcttcaatcgaagacatacctcaaaaattgtagtaacatggatgaattaatcagcaatgtggacgaagagtacaatgagtataattctaacttggtgagtagggttttcctaaacctacaagcttgcttcatagaagtgatgaaagccgatggaggcaatggctacaagataccccatatgaacaaggatcgattggagaggcttgacatgctccctactagtctgacttgtgatattgcactttacaacaaggttatgcagaccttgttgaactagtccagcctggccatacttttgttttttttttactccgatggagtttgtaagtatgtggtaatgcacaccttgttaaactagcccagcctagccatacttttgtcttttgtactccgatggagtttgtaagtatgtggtgatgcagaccatgttgaacaactagtccagcctagccatacttttgtttttgcgtagctgccgatggagtttgnngaaataatgatttcagacttttgttatatataggtaattcagcataactagttttagcaatcagcaatatgtgattctatatttaattcagcactaatttcataacaatgaatacttaattgaacccatttcagaacatgtcattgcatagttaatttcagcactaactttggaacaatactacaatcattagaacaatatattataggagtatatgactataactagggcatttccataacaaaatactccgtactagtctggcaaccatatggaacactacggtaatttgtacacttataaacatggtagtcctacatccatattgcactaagtactcctacgtccattgtgcatttccacaacaaaataccacaacaaaatcacattcaacagtttggtagtcctaaattcttctacgcttgcatacctgggtataggtaggaaacatgatatcgtgcaaatctttcatatgtaaattccgaggcacaccgacaccctcatcatcagtctctgcgtcggagattgactttctctcggcgatgcatgccttcttctcaggcacaccgacgccctcatcatcagtttctgcatcggagattgacttcccctcgtcgacgcatgccttcttctcggagcttgtgttcaccttccttggatttccctcatagtccacatcagcgattgcctttttctcatcagcccatgccttctcgatggtttccatgtcgatgcttggcttctcatactctgaaatagcccgaagccaattgtgcaacattgtactgtaaagaagataagacaaatcaatataaatcaagatgtgactcaatttgcatgctacaaatgcataaccatcccaaatcgacaatctagtgtgaatcacataccccaagcgaggacgcactccgagctggcgcggccctcctgatttgcttgtcactggatggttgcaccgtaaggagaaataaatggaacatcaaaaagcacataatttaacaaaattgaatggaaggactaataattaaataaataagagaggaaccct

SEQ ID NO: 66159 - DNA, 8586 bp, Oryza sativa
cattgccagccccttcatcatccaagtcagggacaaacatcaagtcgtcaaaacaaacgccttccgccactggacgcggctctttgcctagcaaccaccacgtcccgcgaaccctgccgctgggccgcattctgccgccagcccgtaaaccgctgccggcgacatgttaaatcattatattcctattttaaataaattttttaattttaaactatcaaaatgaaacatataaactttaaatctaacatgaatctaagatatgatgtgcctaacagcgtctaagattaataaaattgacactttagtttttttaacaccgttaatttcctagtactccgtatgatctaagagtagttggcaatgtattaagaacctcttcagctctaaataagaactgcaacttcaaatcctagcactttgcctaatggataactacatccctgcaaaacatccacctaaaatcgctccattcttcattcttgaccaatttagcatggtggcatctagatcctggttaaatgcgattaaattgatactcctacttgtgaggcttgtcccatatagttcactggctagaacgttgctgcaaatttcatgtccagtaccacaccaatcaatggctacatccaagtcatacccacgctagcttccaaatcttgcattgcgatgctgcggtgtcaaaatcaaacaatccaaagcgtaaactgacatccaatgcaagatccaaaacaaacacaggtactaccaacaacgtggaaacggaagcacgcacatcgaactcggctgcgctgtatatatatacctggacgttgaacttgacgaaggcgacggcggcgtgcgcggcggcccggccgaacgagagcagcgtgttctcccgctcccacaccacctcgattcgcttctccggtggtgcccccaccgcacgggccaggttgggcaccggtggcggtggcgcatgggccaggttggccgccgccattggctgccgcaccgccggcgttggcgtcaacggatgggaggtggaagggaaggagctcggatggatgggaggaggtagaagaagatgcgggtgggagggaggcgctgatggaggggacggagaaaaagcgaagaaaatcgggaggggaacgagcggtggtcgatgggcgactcggtgagaggataaggtagggacaaattccaccgacagctctctgtccgcattagtactctccctgcccgatgtctgtttgcattagtactccacctacccaatcccttatattttgagacacgtttttaacctctaatcccatataatatgggacggagggagtactagctaagaatcacataaactctcaagtcaatcgttggattatgcgttgataaaacggggcatctagcttgccttttctttctagaacccatgcaaaggacaagcatacggtgacccatcggaatcgacggcgatgcactcgtacagcgcgctggacttatgggaatcttgtgcgtgaaagaacactctatgttgtcctctcctgtctcgtgttggtccattcttctcaagaggtcacttgctacttgctagactctactacccagcaatattactagctctgcagctcattgactttgtcaataagacaccattgccgtcatagtagtacttgctctgctactgctgtggtttggttaagttaaatctttctctgacagcttggaaaaccgatgggaagaatctttctggatctcggactctactagcttgcataatcaaatgaactggagctggtttcctatgttcattggtagcattgccaattgcaatcacagtatatgtagtttcctattgctatctcacctcacctgctctttctactaacaattatttacctctagtagatggacatagtattggaattgtatcaaattagaggagggtccaagagcacatgaaacctcgagcatgtctgtcgccggatgtttctttaatcagctaatcaccccactgagatttgattagggatggaaattaagctttctcaaggttcacttttgtcatcatttacctgcacggcttccctagtcgtcattggcagcatcattgtatcatagtggtcgagataacaatcattgtaaacttatgcatgcatctgtgagctgggccggggaaaagagcacaacaccgagcgtgccttctcctgacctgcctcctcctctcttctattgcatgagagatgccttaacaagtggctaggttgcaggagctgtctactcgatggctcacacgttcacaaataataatggaataaacaagggccaattttggttgtccggtagccttcactccagagtccagatgtgataaatacaaatggtacagtactcacattgtactcttacaagcaggtaaggattcctactatttcatttacgacggttttatagcatggatgattcacacgcacaaacacaaagaagttccaaggcaaggcctaacaatacatacaattttgtaaaaccttttttattaaaattttaaaacgaacactctaaaagaacctttgaaaagggcaaagttattgtaattcactgtagaagaagagagtcaaccgagtttacaagagaaacttgccgtaaaattttacagctaccaaaaagtttaggttaaaataagttcaagaggatcctttttaaataatttatattgaaaaggttattacaaatccatacgtgcaccacatgtgctgttgtggtgctgcttctgcatcctgtttccagaacagtggacgcaggccaagtgaggccaaagccatagctcaactgcactgggattttaggtcacccaaagattctgtgacaagcaactacgctccgtctgggacctggatggggtgccacattaggggtgtagtgttggcctttggggcaatgaggcatctaccgatacaaaccgatgtaccatttttcatgtagcgtttgtcatgtatgctcacagtgctacttgccacgaacaaagcactttgtgggatgaattggcacaatcaaaccatgtgtgccgttgcctgtctaacgtgccgattcctctgtcatgtttcgcacagaaacaaacaggcaacacagctgtgtgtaaaaactgtggcattgacagtaactggaatgcatcacagttaacaagccaagagcaattgattcacattgttgcttaacaatcggtaactggttaatgattatgattgatccgaacaggatggtagcaactatagccgcagtgcaggacggtggctgtgacgatcttgtgactcgcgagtacttggtagtagcagcagcagcagctagctagcactgtcgtgcactgcgctgctgcactggtggtagacagtaagatatgtgaccgtgtcacatgacctgccaaaaattttcttttggagttcactcaggaaggcagtgcaaacgagggcaagggagcgcctcttcctaggcgaaaaaaaatgacaaattcaccgagacagcactgggtgtgggctgcacatttccttggctgcttgtgtgggtctcccatgtaactccatgccttctccgcacacacttgccgctgtccgtggtgttcactggcgtggtcttgtacacgcataggacgagctccatcaattaccggagcagagccagtcacaggtcaaagaaaagacatgcatgatactgtccttctctgctgctgcaattttatctgcatatgagctgctcatcattgtagggggggaacacagaacatttgcaggaaaacagtgaaacggtaccatcgtttatggagaaaaatctgtactacattgtcactgaactgtatgtatttggtccaactttgaatcttagatcccttaactaaaaccatttacttttgatccagcagctctgaaagatgtcgcggtgcctacatggatgaggagtgacaacatcaaccttactttcttttcctatttctctgcctaatcctacatggcgtcatgtcatcgaaaaccacctaggttgggtggagtaatgaaatacggataatttcaagtgttagctgagtcactaaaaccaaaccaaggtcatacttgagagaccaaaagtagacttcttcgtatttagaaacgagagttactcaactttttgaaacaatttcttttgtaagaaaatggaaaaaaaaaggcatgtgttgacatctgaagaatactagttttagaggtcctccaagctaatgtggcaggtgggacaggcttataatgtggcagaagattaggttatatattcaccttctgatctgatattactggggtaaaaatgtcagccactttgggtgaagtaaattttccttttgggcataaataactggaatcaaccagatctggatggaatagagtgaagcctttcctgagctctcacctctatcttgcataaaaaagaaaggaagttggtaagttttaggacagacataaatatatcttccaccataaacaaagtatctgaatagccggacaggatcgatccggcatgatactgatataagagcttcagcagtagggacagtactgctagtacaagtagtagtagtgtagtacctcatcaagttcatcaccctcatcctcctagcagagaaagaaaggggcctttagaagaagcaacttttacacgagaaaaagagagaggaaaaaaggtgtcaagagctcaaaggctcaaagactttattaggtgatcaactccacagcaacaactcccaggctcccacttcctttggatgattttatctgcaaaggtgagatgcttccccattccatgcagtctctaccctgcatcatttgctctttttagttctctaactgatagtgtagttttagtggttacagagttcaactcttcgctaagatgggctcacctgtgcaaagattagagaggaggagcccttcttgagctcagaggtgcagtgcaggcttgcagcggagttgttcacttgtaggctccttccttaacctgctcaatgtatcatagccgctccaagaggtgagaagcttgtagctttggttacagcaccctggttggggttgcaggttgaaaataaagcttgtagctttacttcttgttaccaagttacagatattgatctctgaccagatgctatgattctacatgttttagataggatcagttcttggctaatgcctaatgatcttgacgaatttgcatcggcagcgactctgttagaatgctcagaatggatggcacggatttgtcttccccaaggtgcaatgttcagcatctacaggtaatttggtggtggtggagataaaatggcttgttacttattgcttcatttgttcattctcttgactccaagcatgtgggtcggtgtcatttttgctggtaaaaaatttcacagcagaatttcccctcctttttccccttaactttctgaaccattttcttctgcccaagatcagtacagaactcttgactagtgcatttgctatgtccctttggaatataatctctctttttttcagtccataacccaaaacatctcacttttctttctatttttctgttcacggaagaatgccgaagaactgaaggatcagaatagcaccaataagaggctgccccggactacagagctcccatgctctttgatacaagaggtaagaagtagacatcgcaagtattgcacaaagtttccgatgttgtagcatatttgtgtgatacatggactactttaaagcgtgttaatgatgtgaaattttaagattcagttgggaagtcgtagtacagagttccgtaacaggcattcattcctgcattgctagagttaaagagacatcccaattttgagtagtgccaagtacagggtatcctttattttgtcctgcccaagtgtagcataagactaaacaaatggttctactgtaatttgtaaggtaatagtgatactacagaattgcagaactgcagattggttttgatacatagagttagctctgcaggtccaacaccttgagaagcgactaaatgatcaatttgctatgcggcgtgctttggagaaagcattaggttataagccttgtgccattcattcatccaatgagagctgcattccaaaggtaaaattttcctccacttttttcctcaattgtatcgcaaatgtttttgaaggctgtgttttcccgttgcttactgaaagcttctgtgtctttcttctcatgttgtctcagcctactgaggaactaataaaggagattgctgtgctggagctagaggtcatatgcttggagcaacatctcctagcactctaccggaaggcctttgatcaacaaatttgcagcgtgtcttcttcctgtgacatggaaatcaacaagcagtcagcaaggtcattctcaggtatactcacaggatcttcagaactggatttctcaaccccaaggaaacaccaactcctgcagtccagtggcatggtcatggcacgcaagtctacaccgacaactctcactagcgaaaccagaacttcacattacaatgacaagactggtatcggacgcagccattcctcgctcctgcagcgttccatttgttcagccagagtatctccttcagcaaacaatcttgctagggctctcaaaccatgccatactttgcctctatcctttgtcgaggtgcaggacgatgtctgaaaactctctttcatttctgacctgttaaaccactttgctatcagatctttgtcatatacttgtaacggtgttgatactgacataattgaaatgaccaggagggcaagtgcatggatcctggtattgtgagcctggcggatatcctagggaccaggatagcagatcatgttcctcaaacaccgaacaaaatatctgaggacatgatcaaatgcattgcttcgatatacataaggattagggacttcaatgccgtgcaacatcccttcttcccctcaccatgctcatcattttcatcagcgagcgggctctcttccaaatacactggggatatatggagcccaagatgtaggaaagagggctatattgaggcctggcaagacgatgcgttaggaactggcgaatcaagatacttcagtcaacaatatgattctgtgattgaggtgtctgctctttgcaagggggcccagaggtctgctgatgttaaagacatgctacacaaatacaagtgagtattgttcatgacatgctggaaatgatgcataaatctatttgcagactagtaaaagatgttattctgcaggtctcttgtacagctgctagaaagtgctgatctcaacggaatgaaaaatgaagaaaaaattgctttctggatcaatgtgcacaatgccatgatgatgcatgtaactagtttcttaacccacatttctgtcttgctatatttcttcaattgtggagtctaatgttgacaatttcttttaggcccatatagaatacgggattccgcaaagtaacagcaagagaatattgcttactaaggtggaaaacatcctcaaactgcaattttcttagatagaatgatatagcagtatctcattccgtatgaaatcataatctggtaacaacttctgtgccacagttatcttacctcatcagtggccagagagtaaacccggagttgatagagtaccatatcctatgctgccgagtgcactctcctacacaggtttgtcctacttcctgcattttacaacctccccatcaaaaaaaaaagaaaaacgaaaatattagggaatgacctaatatcaaataaatataaggagtgaggcttcgaaccggttagctcaccaccttaagaagctagccggaagaccctggagcgtctctcacaacctccccttccaaagtccctgaaaatttagtcacagtttgacctgcttgagtgattggtaaaatttgccatcttgaattgcatatgatttgtgcagtggctgagactactcctgtacccgaaatggaagtccaaggagaaggaagacctgcaggggttcgccgtcgacaggccggagccgctggtgcacttcgcgctgtcgtcggggagccactccgacccggtggtgcggttgtaccggccggagcgcctcctccagcagctggaggcggcgagggacgagttcgtccgcgccaacgtcggcgtccgcggggggcggcgcgggcgcgggcgccgggtgctcctcctcctcccgaagctcctcgagccgtactcgagggacgccggcctcggtgcgcacgacctcctccgcgcggtggagtcctgcctcccggagccgctccggccggcggcgcagcaggcggcgcggtcgcgcggcggcggcggcggcgtcgagtggaggccccacaacccggccttccgctacctgctcgcgcgggagctcgtgggcccacccgcgccaacggcccacctatcctccacgtaaagtttcacggcccaatgtacagagccttgtaaagttgatattttgggcccggcccaacaaacttggaaagttagttatctgggcctgaaaagaggccgtggcttttggcccatgtttgtggaacgttctacctgcttggtctctcggatggc

SEQ ID NO: 66160 - DNA, 2575 bp, Oryza sativa
tgtctctaaatggctgagtcagagaacccttcccagaccatagtactggctgccacaaattcacctgatatagtacggcacacactgctccaacagctcccttgttatccgatcgtgatattgctgcatccagatttaacttttgacaatcttctagaggtaaaatgcccaggcatttgtgcgtagcccttcggctgccaaacctggatcggaacatctggctaatttggcccaaaagggccgtggctttctcccatgtttgtggaacgttccatccactactggtcttttgggcggcacgaatacgaacaaattttgacttggtttctaaactcaaacccgccacaggtttccgcgcgcggcgcgccaaaccgcccctattatgcagacgcgagcgagacatgcagacagcagagttgcggccttgcgggcatgccgtcgtgcagcttcccggcctctctcgggcacacagtttcacggctttgattgatggatattcgctactacctccggccagtacgtagagctgtagtggagtgccaccaccaagcatgcttctcttgctcgtcacgaccatcagatccagctccatcctgggaccgatcgacctgtataaatcagcctcactacgctctagtttggattcaggcagcaaccaacatttgagttcagttgagcttgaattgatctagcagtgtcccttgctcgatcacttgctacgcagagtaaccacatcgaagcaggaattttgtcaggaagccatggctgcgaacggaagcaacgtcgtgtcgaggggagcagtcaggttcaccgaggagcaggaggcgctggtgctcaagtcgtgggccatcatgaagaacgactccgcccacattgggcaccgcttcttccttaagtaagaaaaatgttactgccattttggcagaatcagttactgcaccaaccatgtgtttctcaagcattaagcaatacattttcacttgtacatttgttgatgtgtgtgtctgcatatgattggttctaatctatatctgtactactccaggatcttcgaggtcgcgccgtcggcgcgccagctgttctcgttcctgcgaaactccgacgtgccgctcgagaagaaccccaagctcaagatccacgccatggccgtcttcgtcatggtattagaactactccatatatagttcgttattgccgtcgatgagtaagattttgccgcaatcactgacggagaatgtgtgcgtgtgtcgcagacgtgcgaggcggctgcgcagctgcggaaaaccgggagggtcaccgtgagggacaccaccatcaagaggctgggctccacgcacttcaagaacggcgtctccgacgcccacttcgaggtatctctagctaattaatggccgcttcgatcgatcatttgatcgacgcgaaaactcgatcgtgttctgatttttgtaaaacaaacaggtggcgaagttcgcgctgcttgagacgatcaaggaggcggttccggcgagcatgtggagccccgcgatgaagggcgcgtggggcgaagcttacgaccacctggttgcagccatcaagcaggggatgaagccggctgctgcgtaatacgtgtgcaccttcaagccttcaagaatcaagatcctccatatatatctcgacatcgttcgttgctcgccgattggtgttatgtttttttttccattatatatatgctcgtctgatatatattcttcgccgagaatggagtgtccgtgtgtgtacgttggatgcaagcactgttgtttttctactcgtgacaaaatattaataaagagacatttttttgttccacatgtcatgcatgcgcttggatatgtaacatttagaaaagagaagacaattggggcaagtacatctcagccgacttatatcatttcgatcattaggatgtggattttcatccttcgaagagacattccctcgttatttaaatatcatctaaataattataaaaacatatagattaatatgaaatatatcactctataaacatgcaggaccaaatttcaacttctacaagtttcaaaaaaaataacaaattaaactgaaaatagttattgcacatttgtaactatatttgttacttttgttacaacttgtagtagttgagtttaaacatgtatgtttgtgaagtgatatatttcatattaatctacgttgccattttttttcatattttttatgactatttaggtggcatatgtataaaacaaggggatattctctcgagggataaaatcactttcccccggtcatcctataaattggaggccctggcgctaaacctacgataagaccctctattttaaaaatatcagcaagtaaaatagtagagtttacttttgactgtgcatgtaaattgaagttacaaataaactaatgttatagactatttcacttaatgccacataatttacaattcattgtaatattcattatctctatgctttgctcagccacagaccacagccacgatgtggctggtgatcttctatccacatcagaagtattgtccctaaatccaatgtggaaaaactat

SEQ ID NO: 66161 - DNA, 2871 bp, Oryza sativa
ttaccctcaaagacttatcatagcaaaagaaaaaaaaacatactcgttccagcgagatcactggaggaggggatgtgaaacttacaaagatggaatggggatgtcctgaaacctattaaaacacaatatttgattgaattaaaacctataagagcctttagttttgggagcccttgtgcggtcgagcaccccgcatctgcctacgagatctttgttaaagttaaattgtacagttagtgtatatatatagtaaataacaagtagattttttaacgcaaaatttatcaatgttatggataaggtatatctcatatacttgagaaatgctccgtatctggttttgcggttaagcgacatgaataaaactcaacctataattgagggatataaagtggacctttttcttgtaacaatatgtattaagttaggccaaaaaatggtcgtcaccttctcccatttttgtggaacgttccatccaccactgcccttttgggcagcacgaacaaaccatctcgcctctagttcgagtcttcaggcaagaaagaaattaagggccgggaccatggatggtttgacttggataaactggattcttaactcaaacctgccgctggtttccgcgcgcggcgcgcccaaaaccgcccccatcaatccatcatgcaaccgcgagacaatgcagagttgcaggcatgctgccttcgtgcagcttcccgctctcgcagctgcactcgggcacacagttttcacggcttgcatggacggatattcgccatattcaggtcgtttttctgcttccttccgtgcagctggagtggacgtggagtgccaccaccatgcgtctcgctcgtcgacacgatcgacagccaatggccgcccccattcccggaccgatcgaccagtataaatcggcctcgcactgctgcagtttgtattcagatagcatagcatcgatccagcagttgagttgcactgagctcgatcgggttgatctagctgcgatcgaatcgatcacctgtgaaatcaaagcaggaacttggtagatcaggattcattcaggaaggccatggctttcgcgagcgcaagcaacggggcggtcaggttcaccgaggagcaggaggcgctggtgctcaagtcgtgggctatcatgaaggacgattccgccaacatcggccaccgcttcttcttgaagtacgtagtatgagtacatttcactgccgttttctgcaactttcaagtgcatttgttgatcgattgctgctgctactctatctgtactccaggatcttcgaggtcgcgccgtcggctcgccatctgttctcgttcctgcgaaactccgatgtgccgctcgagaagaaccccaatctcaagaaacacgccatggccgtcttcgtcatggtaaacaaaaaacagtttcgccgacctttgtactagagtttgcagctgacactgacagattttgtgcgcgcatttgccgcgatcaaccgatcgatggatctcgcatgcagacgtgtgaggcggctgcgcagctgcggaaaaccgggagggtcaccgtgagggacaccaccatcaagaggctgggctccacgcacttcaagaacggcgtctccgacacccacttcgaggtatgtatacgtagtgctccgtcccatttaattacagccaaatgtttttatatccaatattttaccgttcgtcttatttaaaaattttattaaaaaatttaaaaaataaatcacgtaaaaaatattatttataatttatcatctaataacaaacaaactaataaaaaaataaataaaatggacggttaaacgttggatatagaaaccgatagttgtacttgaaataagagtataagacggatgtagtaggagttgcttggatcgtttgatcgacgtgaaaactcgaccgtgttctgatggtgttgttgcatcgaaattaaactgcaggtggcgaggttcgcgctgcttgagacgatcaaagatgggattccggcgagcatgtggagccccgagatgaaaaacgcgtggggcgaagcctacgagcacctggttgcggccatcaaggaggggatgaagccggtcgctctgttataagcgtactgcctcagcttcatgcatgattctccatcgacgtcccgtgtaaatcaatttaactatttgtcactcttatgatatgacaattaacgatttacccctcactgtctataacatgtgggtcctcatgtgtctatgacgtatgggtctagtggtaaatcgttaagcaccattcgtaagagtgacaaatagttgaaagcccatgttgatttcgttgcttgatcgcccattcactttgtgccatttaatttgctcgtttaatttttctgagtgtgtcggtgtgtacgttacaattgttgtaagcacggcctgatgttttgttcttgtgattcaacataaataaagatggttttcttctgtgtttaagcttcgatatgtaggagttgtttggatgatgcttagagcatggcctatcgtattcctttgtgaagcctaatcctaaaatttggatttcttatgtgaaaaacgtgctctaacgattccctttcaatatgtcttaaaaatttacattttgtcctcctttctcgttctccataaatcagaaagcactctcttcacaaagttttttaaaaaaaactctaaaccagaatgcattctcttcacaaagtcggaaagcgctctcattctcaattttcttcctacggcaagaagaaagatatgtgcatagcaatttatagcaagagatgtgcatagcaatttctgtttccgtggtagttaagacttaagagtagcccacattttattattgagagttattttttgcaccttaaatttt

SEQ ID NO: 66162 - DNA, 7431 bp, Oryza sativa
tccatccaatcatcatacaattcctaaagggtaaccagaagatggactgaattgcatgactactgtaaaataatagtaagccccactatcaatcatcaagctcacctggttgctgtgaccacacttcttcttgcggcagttgacagccctagggtgcaggcgcgcatagcatctgtagataaataacaaggtcggtcaaagttaaaatttgtttttttacagtccaagatacatacagaaatataaaacatgaccccttgggagttatgtacagcatgaaaagttgcaaatagcatgtcaaataaaagcatgcacatacataggcaattgaaaataagagaacatggaccacagacatgtaacgaaacactgaaatacaacagtagattggcaagtcagacaattgtatgcctcaaaattttagctcataaggtaacctcgtacatctaattgattcatcattcctgccaattaaaaaaggaccaactgtccatacaaacaaataaagaaaaccaaattcacacaccgataatcaataaccaaaaataacaagaatgaacaaagcaaataggcactgcaatttgcaactatgaagagaagtacatatggcagttcagacagaatgtatgcctcaaaagttaagttcataaggtcacttcacacatctaattgattcatcactactgccaggtagaaaagtagcacactcgacacataaaacacagaaaaaataacacaaaagactaaaccaaataatagctgtctagaacatgccaacatggaaattctttggccgtgcatggtgcatcttccagagtcttacactcttccggagtatctatgaagacaatgtgcccagaactgatggccacagcaaaaatctaagggcatttacattgatggctctcagtctaggccaaagttttccacacatgaagatccatcagaagatagcttcccacttccttttacactatgctccactatctcgctgcatccttcaatcgcaatcttttgataaaggacaaaaactacgaaaataaattccgtagtagttcttcaccaaaaggaagagatttcataaggaatcaccgagaaggaagagcaaagagtaatgaaagaaatgagattttacacttcctccggtcttcaaattcggtgtggttaaagcaagagtagtcatcatcgagccaaataactgttttttgctactctgatgctcacaaaatagctgaaagtaggggataaaatgttatataagtgttggacctacgagaaaatgcgagaatctactggaagaagccgcatgtccagaggtccccataatttatcttgcatctcttcagaaaagaaagcttcaggtccacttaatggtgaccgaagtgacttatctttaaagctagaagagtgcaccacaaataagtaacgaaacaataaaaatattatcttttttattccaaggctgaataaaaatgtgtctctaggttttggctccattcctgacgaacgcaattccatatactcaaaagataaacggcacaagtacaggagaaacgcgctggctagctagcctgcttataaacatgctaccactatccatagcatcaagaaaggaacgaatatgttgtatggctggataaaagtaaagtaagatgatttggtgagaagtttgtagcttacttgcggcagatcatcttgtcctggttgtacttgcgggcaagcgcctgaagcgacggctcgatgataccgccacggagcctgaggacgaggtggagggtggactccttctggatgttgtagtcagccagggtgcgtccgtcctccagctgcttcccggcgaagatcagccgctgctggtccggcgggattcctgccgacacaaacccccatgagctaccgccgcaaagccacagatgaaggaggaggaacaacaagaagaagagggtgtagtgggtgcgtaccctccttgtcctggatcttagccttgacattgtcgatggtgtcgctgctctccacctcgagggtgatggtcttcccagtcagggtcttcacgaagatttgcatcttggcgccctagctgctgcttcttcttcttccccggggctctctcccctttgtctctctagctccttgctgctgcggcggcggggggagaggaggctggatgttcgccgatttatacggtgcgagctagggtttggtctgaagaggaggggagcgtggagtgtaagacgggcagccgaaatggtccgcacaatccgagggaatagttggcccagctgcgcctctagttagtgggccgggcaagttcttgccgaggtagatgatgatggaataagttcccctaccatccctcaactttacgtcgagtctgtggtgtccctaatctccaatatcagaaatcttcaccccttaaatgttcaaaaccgtgtaaaataggtctcatatcagtatatatgggtgttttcactgacatggcatcccagttagcaatctagacccacatgtaagggagacgaataaaaatgtggggtatgcatcccttctttcttctcttttctcttttctcttctcttttctttctcttcgccgtagagaaggatgtggaagcgggtggcggcaagaccacaagagtctagagcgagtaggcagagcaacgcgcccgcgtggagcggagcaggggcgccagcggcagagaagagagcgactgcgggcgagcgcggcagcgggcggcggcgagcggcttgctccgctcaccgctccgccagctggcttcgcctgcttcatcctcgcaactacctcaccgccggccatgccattctcctacgttgctatggcctctagctctgcgtcctcttctcgcaagccggttcccatcgccacagccagcgcccatcgattagttccattgccggcagcggcggcggtcgtggcggcacctacgccctcgccgtcaaacctagcacggtctccgagaccccttctcgtacttctccggggaagatacctatctcaccgcctccgatctggtggccgcttccgtcatctcctcccacctctccgttgtgggggatggcgccgacctctccaaggtcgggatcttcctcaactccacggcgcggcaccgctctgtaaatggcatatgggctctgtaatttttttattccttctttgctgactaggcggatgccatgtcagcaaaaccacccatatataatgctatgggacctatgctatgggacctattttgtacggctttgaacatttgagaggtgaagatttctggtatttgagattagggacctcggactgactcaacgtgaagttgagggacaataatgaacttatcctatcttactataaagttataacccactaattctaaagctcaacatgcaaagatgtcacatcataatacattaacaatatatcacatcatcatccattaacaattattacatttaaacatcatacaagcatgttatcttatctataattttataatttattaaattttagagtttaaaaatgtaaacatgttaaatcatcactccaaataattcacataatatttcaatatatatcttcatcatttatgataatatcatatatacctatatggtacatcctcacttagttagtgttatttctctcttctcccattaaatcatatcacatcaattatttttagccttaaatgattaatctatggtccaaactatctcactccctttattctcttataatacttcaatatcttacttttacatttgaatcgtctatatactatttaaatttaaattatcataaaccatatcaacttatgtaagtatatgttgttagccatcttacatattatttttacttattgttatcatactgaaatcccgcagcaacgcgccgggtttcacctagttccgtagatgattggtcactaaaaaaaattaggaaatgccttttttttttcttcaagaagtaaacgttcttgtactagttagatgcttagtttgagttgattttttcagttatacagactcataagaaagtacgtgaagatcccttctaatcatcagactaattctatgtcacgaaaattacttatagcagtaagaatccaagaccagttcatcaactggtaaatactggagcagttggaggcctgaagaaggtgcaaggcaaaacacctgacaagccaaatgttgcacgcttttgaaattatctaatgcgtgtgtgcagagtataatactaaaaggtttactgtttgtactaataataatacaataaactaacaattcagcgatttctggccgacgagttgctctctcgagtaatcacctctatctggtcacgatcaagaaattagaccccttctgtcacatcagcagatcagctcaagtgctcaaccactacacaagtacacgatcaagtaggcaagtagtacgcgttggcgttggagggagtccacacatcattgcacgaaaaagcggcgtctgcaactaccgtagccggaacatgtcaaacctcgttcgagccctggtatataaatacacccggcgacgccatgtccgctccacgaacaacgcaacaccaagcttagctaatctcacagtcaccgagctgaggtagctggcgagatagatatagctagcacagagagcaaaaatttcctagcgagatcactttaattcgccggcgtgcatggcggcggcggcttcggtggtggtgttgtgcgcgctggtcgtcctcgcggcggcggggggcgcgagcgcttggccggtgatgagcccgtcgtactacgaggcgtcgtgcccaagcgtgtacgacatcgtgcggcgcgtcgtccaggaggcgcgctgcaccgacccgcgcgcccccgccagcctcctccgcctccacttccacgactgcttcgtcaatgtgcgtacagtgtgtcctaggttgcgtgccatgcatggcgtttgcgtgacatatttgagctgggattaacgtgtttgtgtgtgcaggggtgtgacgggtcgctgctgctcgacgacttcggcgcgatgcagagcgagaagaacgcgcccccgaacaaagggtcggcgcgtgggttcgacgtggtggacggcatcaaggctgccctggagaacgcctgccccggcgtcgtctcctgcgccgacatcctcgccctcgccgccgagatctccgtcgagctggtcagtccatgcacgcacccatgccatcaaacattcaatcacgccgaaccatatagtatctgtggatcgctgacacgtacgctttcttgtcgagcagtcaggagggccgagctggaacgtgatgctggggaggagggacggcacggcggcgaacttcgagggcgccagagacctccccggaccgacggacgatctggacctcctgagacggaaattctccgaattcaacctcgacgacaccgacttcgtcgctctccagggcgcgcacaccatcgggagggcgcagtgcaggttcttccacgaccggctctacaacatcagcggcacggagcagccggaccagacgctggacatggcctacctcaacgagctccggcagagctgcccggcgagcgaccccgaaagcgcggcgctgcgcaacctcgacccgcccacgccggacgcgttcgacaatagctactacggcaacctcctgcgcaaccgcggcctgctccagtccgaccaggggatgctctccgcgccgggcggcgccgcctcgaccaccgcgcccatcgtcgtgtggttcgccggtagccaggacgacttcttcaggagcttcgcgacggcgatggtcaagatgggcaacatcagcccgctcaccgggagcatgggggagatcaggaggaactgcagggtggtcaaccgcggctgatcatcaggttgatcagcgtctccgtgaaattgtttgttgaaaggaaaccagttgggtggcccgcgcaattgcgcggttagcacctatacaaaattatatatctttaatatgattttatttaaaatttattaaatagttatattgttgttaagactttgaaatttcaaatcttatcatttccatgtttctaattttatattttttattaaaagtcacaccagttgctatctgttacttctgttatatccttctttatttgcttgtccgatctggcactgtttctattcattctatttggagcctttcaaaattagatcttatggtttttagagtttattgtcccgttgggtttcgattttataatttttagaagtcccgtcaaacgctaccattatactcctatacggctcatccactacctcttcttttttattgtcgttgttattttcaaaatagaacataattatcgcttgggttcattttttactttctaagaagttccgccaaaacgtcagcagctttgtcaatgtgctcctctatggctcgcccgttgccttccttctttattgtcattgagattttaaaatcaaacatgaatatcattgaagtttttttttactttttagaagaccgaacttttaaagttggaccttatagtttttataatttattgtctcgttagaattcattttttataattttttgaaatcacgtcaaacgatgccactatattcctgtacgacccgtccgccgcttactctttatattcattgggattctaaaaaccggacataactatcattggaattcattttttaatttctagaagtcacaccaaccatccgcggctttgccattgtactcctgtacaacccgtccactgcctcttcattttattatcattgagatttaaaaaatcaaatatgattatcattggttttttttttactttatagaagtcccgccaaccaccttaaccggttgcttcacggcctgcccgtcatccttccttttgttaatagtttttagatgtcccatcaaccaccatcactctactcctttataggcctattacttaaataatctcgtcatatgttttagatgatctttgtctttcaatagtctttattttttatcaccaattttagttatttataaattgtattcctagttaaatcttatttttctttttctaatttcataatttatttttattttttatttcgaattttaactaatattgtattgtgttcttttaatatttatttcagtcttcttaaaatggaaaattggaaccatgccattataattttgtaaaatttgagatatgccatcatgacccacatgtcattgactcatatgggtcctatatgtcattgagataccgatgacatatctcaaactttgcaaaattataatggcatgattccaatttacttttaaaattgtattcatacttgaattatatttttaatttgtctagtttcagattttattttatttttcattccgaattttaattaatctcgtattgggttcttatat

SEQ ID NO: 66163 - DNA, 2258 bp, Oryza sativa
  unsure (1)..(2258): unsure at all n locations
acgcaaaaaggtaaaaatgaatagcttctatcaaaagagaaatggtttgacagatactttctaagacgaagtaacgacggaattaagcacaaaaggataattaatcatgcattcaaggcgcaatggcacaacatgcaaaaacactcgtgcatacagccatcaaatttcttgtctagtacaaacatccagcagcataaatagcacaagtcattgcataaaactatgttaaactcaaacgctgaacacagccggagaagacgtttacatggaggtcaaagtttgttgttgggtaagtatatgtcgctcgaacgactatgctaacgaagttacaggccagcagatgaaatgctgtttcagcttcttcagatttttcttttcttaactaaaacggcaacaccaaggctacataagagctactacaacacttgaatacaaattgggtcggttttacacttctacgaatgaccatcatgcttcccaagctcgctaggcgggggtaagagaagtgcaaggcgctgcttgtatctttcaatccgtcggagccgctccttttgcaaactgccaaagaaatttatgtcaaagtggaacacaacactcagtaactctgtctaatgaagataacattctcaaacagccattcctcaactaatgttttcaatctgccgtctatcaaaatgacaacctaaaacctctccactacaccacataaaagggcgttaagttagctaacttaatatctccacccagcaatataagtttgattgagcttgcgattaaggtgttaatatatgttatataaactgactacaccaaaacaatcaacatgacaacatcacactacatattttcatttgtcttgtgaaacactttcataatatatcttcttaccatttttgctagtgcatcattattgtttcgttggatacctgaagaatcaagctggacttacatattggaagcaaaagccaatcatcactattgcatcaccatattttgaacttacttgctcacttcacaaatcatacgtaaaagggctggaagatgaaaacaaatacatacccagcacggatcttttttgcacgcttcacatgctgcttcagcaagtcacttgcagtatattcaccggtttcattctgcacagaagatcaaagccaatggtttttgagctaatatagtaacactgcgattatagatgtaaaaaactatgcttgtggtgatagaaaagataatagaaggaaatagtaacaatagctacaaagtggtcagtaacagaagtcacaagcaagtagctctccccaagaatatcaatttacagacgaaaaagggactcctttatcccttcagtctcaagaactttttgggatactacatttctatggcaaggttgaaatgaacccggatttctcaaacatgttggatgaaaccgtcacctaatacctaatattattgaaggttgtaactgggaagcaaatctaactattttgggagcaaatggaacacatgggcaaataatggaccaagacaactgcaaataagcaagagtgggatatgcaggacataagatagacaatatacttcattttaaataacagggtaaagcgtaaaattcagagttggtatgtgcaactcctaagaaatacagcaatttttgcatgtattagtcataatattagttataaaaggcatacacgcttacatgccaaaaatcagaaaatgccagtatgatccagaattgcctggaaagaatataactaagtgttatgctgtacgatgaattagcataactaaaatgctagattcattgaatcaaagatcaaaacttcaaagttagttttttacaagataccttctcttcctctgagttctctttctcagcatcattgtccttttctgatatcctagagtccacgactgaagcaggcagtggtcttggaagaattggtgcannnnnnccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 66164 - DNA, 1452 bp, Oryza sativa
tgtgatagggcgtaaaatttttgggtatctaaacagccccgagacgctgcctcgcacaactacccgctttcgcagctgcattcagcacacggttttttggctcgaatcatcttcaattctttgccccctgtacatcttgccgtagacttgggagtggaacggcaactgccaccacggcacgatggccaacgcttccatgcttcttggctcgtcgcgagcgcgaaaggccgctaaaccctgggtcagatcgacctatataaatcggcctcacctgcgcagtttgaattcagatcgaaaccagcagttgttttcagagcccagctagctctcgatcatttgttacagagaaattgatcaaagcaggaaattaaccagctgtcaggaagcaatggctctcgtggaggataacaatgccgtagcggtgagcttcagcgaggagcaggaggcgctggtgctcaagtcatgggcgatcttgaagaaggattccgccaatattgccctccgcttcttcttgaagtatgtacatgcgtgttactaccatttctctttttgcggaatcagagattgggtttgtgaagcattaaattgagcaatgcatttcgctgatacatgtgtgtctgattgtgttgtaggatcttcgaggtcgcgccgtcggcgagccagatgttctcgttcctgcgcaactccgacgtgccgctcgagaagaaccccaagctcaagacccacgccatgtccgtcttcgtcatggtaatactaccatcattatttcaggcaagtaaatttgttgtggtagtagacactgacagaatgtgtgcgtgcgtcgcgatcaatcgatattgcagacatgcgaggccgccgcgcagctgcggaaagccgggaaggtcaccgtgagagacaccaccctcaagaggctcggcgccacgcacctcaagtacggcgtcggagacgcccacttcgaggtacagtgatccccaatggctgcctgcgctccattcgatcgacatgaaacttgatcgttttctgatcgtgtctttgtcgaacaacgtacatgcgatcgatcgatcgtgtaaacaggtggtgaagttcgcgctgcttgacacgatcaaggaggaggttccggcggacatgtggagcccggcgatgaagagcgcgtggagcgaagcctacgaccacctggtcgctgccatcaagcaggagatgaagcccgcggagtgatcgacaggcatgctagctgctccacctccatgatcctcgcctcgcgagtccgattagcttttgttgctttcaaatgctcgtttcatattcatcgtgtcccacaaaaaaaggagtgtgtatgtggtgtacgattggtgcacgctcctgctgttttcttctcgtgataagacataaataaagatggttttctacgcttgcatgcgcttttgaacaaacgaaaaaaaaggagaactttgg

SEQ ID NO: 66165 - DNA, 4450 bp, Oryza sativa
ttacaaataactatgtgaaacatcaaccaatatttattgaaacattctaataacaccgtgtacaacactaaaaagagtcagaaaaaagtcatcagaatacaatgatgtgagatattgttccgaagatttaattataacaaatccaactacataatttattcatagtttggataaatagttggagaaaaaaatttgaattctcaaccattatgagctgttttcctaaatttgattgcatgcacgaatgcacttacaccaactgatgtgaatgttcgatttcttccttccttctgcccggacggctgatgtgaagcattttccgaaggtatgaggtttcgaacttaattcgtctagcccaccaccttatggagctagccggaagacccaataatatttctctactaaaaactgctgattgcaatcagattattactgaggaattatgttagttttagtctctacctaaaaagaaaaggttacggagtagttttactctttgacgagattaaatgtcgttgatattttgtggagatggcacaaggctccgttggtggcatcgtcgtttctgttgctggtcattgacaatctcgcatcgtcaatactgtacctgcgaatgtcctgaaggattccatatttccattagaatcagtcacttggaagttgggaagttcacttctatggggcgtgctaccgcgtcattattgatactcgatgagaaaacaagcagcagctttatttcccggcgcttaatgacaataaccgaccaaataaacgatccaacagatcgaactgcgattatagtaaatagtttgtactccctccgttcaaaaaaaaaataaataaataatataatatattctagcataacgaatttggatacatctaggatgtgtcatggagcggagggagtatactagatgtaaaaggtagatcgctgacaatgcaaattaaatattagcaagcatactacgacgaccaggcgtacataatagaagaaccagttgtatatttgccccccaaaaaaacgaacatgaggaaaatgaaatgtgtgaaaggttttattgacccaagacctaataactggtatggactcagcaaattctagttctttgcagcgaaccttctattggtttatagttgtggcatacaatttaaaatgttaattgcgtataacagcagattcttgagaatctaagaataccttaagcagcatgtactagtgtttgaactgttctaaagtactccagttaggtcacattttgttaaaccaatgagttataaaaaggagttgaacgcatactctataaaaaaaacacgaatattaggaaggatctaatattaaataattagaaagggtgaggcttggaattcagatcgtctagcccaccacttgtatagctagccggaagatccctgggcgtttctcacacgcatactctataacaaaattgactctatgcaaagccctctgcagctctactagctgcaagttgcgacttgacagataggagtgggagaagaattgaagaaagtagcaacaaccttacaaccccagtgaggatgcgactatgtaactaatggagtataatcatgagctagtttcagcgttgactatgtacgttggcaactatcccgtcagattcaacagctccgatcgttttatttgctgtttggtctagtacagttattaggcagaatacaatacgccgatttttttttcagaaaaatgatgatactaacaacaaagataagtgaagtcaactgcttataataattggctggtagaccgggtgcctaaattaatttgactgcatggctgacgattccatctaggagcccaatacgtcaagttggtcaaccggcctaactgtccgcgcgcaatgctaactgtgcgttcagatgtattgagaagcaatagtatgtctggtggtgtgcgctgcgagcaataggacgactgcatgaatgcttgccatgaatgaaacatccttccattttttgttctacaacagctgaaataaagtttccaagcatcatctttggggattcgacaccatcgtaacgctagtaatctgaacaatttggagggagcgaaataatagggttttcaatctcgaagaaaaggtagctgggtcaaggtagcaaaagggatggtctaggaggtagcgtcatggtgtgcggctaatatggtgatatggactatcaataattagtttgcagggagttctttttatcgtggtagacagtcaatatcgtgataataggcttatgttcatttgccggttccagtttccgtctccttctgttttttgatttggggctcttggtctgtaaataatctttatttctctttatgaaaaaagtgtgctccttgcgtattccctaaaaaggcaagcaatggtatgcagaaaattatccactttgctgaaatctttaaatgcatgccactacatctaaaactgttagtttgtcaaattattcttctggttccaccggccggcatgccaaatcaaaaatcatacacataactcgtccactttggcccaagaaagattcgatagatattagaaactgtaattttattatagctgaggcaagatggatacataagttcagtatctacagtgcttacatcccaaagttccatgtactatctgaaggtgatggccggaagtcgagaatggatatacgggctgaagaacaaggagcgagaaatgtacagatagtccactacaaagttggtacaatccactccccgcaaaaaaaaaaaggggggggggggggggttggtacaatccacagaaatgaactgcagaagatcgatatccgtttgcctcatcaagcctttcttctttgcttgtttgaacgcaggaattcacagaagatcttgtagaaactgtgcgtcagagctagttcattcctccaagaatcgtggaaaattcccgtgttccaaactaccctgggcagaaacttgtgccaaagagcactggtgcatatatttgcacagctactgtgctacactagttgtgattcccttgggtgtagatgtagtcggtgtgagcaactagtgtcctcctcatcaggcactcttcctctgcttcccctcccttgcactccactgcctgatcaggttctccctgatgcatttccacaccgattccagaactaccaacactcttctgatgggcaatactggaggcaacaacaccctagaaacaccaagaagaacgcggttagatagccagcaccgatagccaaactgctcagattggaagcaaaatgcaaatactgtgtagagttcgaccaggttatgcattacatggtgactgtacctgtgatttgtggccactggatcccggttcaggccttgctgcttggctcctcgtgcagatgaggcagagcagaattgccgtcaagaagagagcagacagtttggagctggatgccatgcctcgccctttttctctgagctctccctctctgggaagttcagggatgagggatcacaggctaattattgggtgatctacaagcttaaccaagtgctttatatagggtgaagaagaagagcgaggctgatatgccaagacaccacatgaaggacagcaatgtgccgtcgccgctaggtctactccgctgttcgcgttcacatgtggagtgtttatctgacgcggacgcgcgtgtggacgtgccagacgctcatggctctgcatgcaccgtgtcaccccctgtgcgtggatgcatatgctgccagattcaggggcatacggttgctcgtgttactgtgtcgatccatgttttctagtagtgtacagtatgtgcctagactatacggtgcccggtgtcctcccagtcacatgctccttcggttttcacgcctccccgcttccaaggaatccaacggatggttgaatcgcaatgtcaatggattacatgtacattaatcgataattatttttaaataatttaacagatttaatacagtataattctgataatttttacataactttcaaaaatcctcagtaatataaacctaaacgataattatatacgatttttaaaatatcatataccaatgacaataaagagaagagacagtggacggctgtagaagagtataatgataacatttgacggaacttatagaaattataaaaacaaaacccaacgggacaataaattataaaaactatgagatccaatttttaagagagaatctcttatatgccactgaaaattggcccgatctcttatatgccactgaaaatttgctcttcccctatatgccattggaccaaatttgcacactggatttttcacattttggtccttttgaaaaacttatttcgcaaatagacccctaaaaaaacttatcccagaaatggtcctttttggggcgccagagtggctggcgccgtcatccaacgggacggcccagcctctctggcgc

SEQ ID NO: 66166 - DNA, 939 bp, Oryza sativa
tgacctgtaaaatttttcctctcctctcctctcctctcctctctctccgaactagtgcagaggagagatgtgcaacttttttatttttattttatttttttgatatttttttcacacttaggaactcacagaaaccaaccatgtaaaaaataaactcaaacggacgaaatatgtggcatgtggaattttccaaagctccaccgaaaaacttctctcctcgaaaacacaatcttgcaagcggaatttggaggttttaatatcgccgaacccggcgaagcgaggagaatcggatgtaactttttctgtagatgtccgtgcatatattatttgcctgattccgagtccgtaagataaagttacgcctgttttaatagatgacatattttgtccgtttcgatagagttttggaaaattctacatgtcacatattttgtccgtttgagtttattttttatacggttagtttctatgttctcctaagtgtgaaaaaaatatcaaaaaatgaaataaaaataaaaaaaaatgcatctctatatactgtttaacttatatatgtcatttcatgtggttatattttgaattagattaagtaatttcatatagtggtagagtgcattatgtttaacatgctgatcaaagggttttacttaaggagttatggtctaattttagtgaaggtgcaaagtaaactaagtggtatgctagctattttcagatttagctaagtgatagttcgagtttaaattttttttgtggttggttgtatcgtgatcctgagtgtgaaaaaacatccgacaaaataaaataaaaatgacaccgttgcaactccatacagaaaaataggaatggaggcggcggcgccagccatgctggcgccctcctcctgccacgtcggttcgcgtgcgccacggtggcaggaggacagcgccagagaggctg

SEQ ID NO: 66167 - DNA, 1961 bp, Oryza sativa
agccacaaattatcgatggcctagcgtcgtccggttgaggaacgtgtggatggatacgatgacaacgggtagtttcgccaacatcaccgatcgatgaaaccacaaccccgtagcactatggtgatgtttcgggttgttgccgcagtggccgcctcgacctactttacattgctgactcctcctgttagattgttggtgccggtgccacttcaaaggacatgtctcccatactatagcgttccgagtcccttgttgtatgatcgcctatgttgtttctctatccatattcaatgcataatcgtttcatcctcgatctcgagagattgggtatggccttgaggtcgcgatggctctggcaacaaagaacctcaccagataagctgtggcagggactaaatatcccaattttgcagaaggaacacaaccttgtctcgattctatggtttgctcagtgggcgatgggaagttggtactgttctgggaggattgctggctacagggctcttcaattcggtcactcgcgccggctgtctacgcagctgttcccgctcggttccggaacaggcgaacggtggttgaggctttgcaagacaagaggtggactcgagacatctctgcggcgctggggatccaggcaatactggaatatctcaagctttgggaccttcttcgatcggttcagcttggggagggactggacacgatctcttggcgttgggagagttcggggatttactctgcacgctcggcgtatcgtcttctcttcttgggaagaaccaacctcaagcacaagccaatttggaagtctctagcgcctcctcgctatcggtacttcttgtggctggtcgccctcaatcgttgttggacagcggatcgccttcggagttgagggctgtcacacccggctcactgccttctttgcgatcaatgtgatgagacgattgatcacttattggacgcttgcccgaagtctcgctggctatggtggattgctctttcagctattggtcatctgagtgtctacctctcaatgagcactcttttcattcctgttgtgtgacagtcgcaaaagaatggcaaaggagcatcgtcgaggatttgacaccattgcaactttggtagcatggacgatttggaaggaaagaaacaatcgggtcttcaaccagaagagcaggacatgggcggaaattgctagggccattacgggcgaagcggatctttggcggttggctagagccacaataccggccatggcgattcctatgtcgggtgaaagctaaggtctccaaatccgttaggagattaggcttttgttttcttcctcttccccctcctgtatcttgtccccttcgtttttttgagttttcagcccgcactgtaaatacttttattccttcttaatacaaagatgcgcccctcgcgtattcccaaaaaataatcgttttgcgacatgtgcatgctttgggcgagacgttagttctccctccttgcgaggagagatgctatccgtaattcatttactctccgatgagatcttccgcttcgattcgatgtcagtcattaatggtgatgtgcacgtgaattgatttgcagaacgatcaagcgataatttcagagtctgttttcaacttcaagtttaatttcaaaatttgggaaatgatcatccaggttcaaggtaaggaggtcttcatggttagtagattttatccacaataccaagacttccattcctggatatggaggacagggttaattcgattgaagaaggatatggagttaacgactacatgcatcttacaagctgttgttgaagagacaatgattgtgtagactttcgtcacctatgaatagagattcaccgataagattttttattgataatgctatccatgtcttttagactggtgtttaattattaaaaatgttatggctttttcttttagtagaactcatatatcgtc

SEQ ID NO: 66168 - DNA, 5894 bp, Oryza sativa
ggcagcctgcctgtgctgatgtggtggaagtatatacttcgtgaaaaaaaagtgaatgttgttttgtctagtccttcatccgtcagtgaatataatggattatatatttttttaagaactaagaaaatagtaaaaggacatgtgatgggtgaaaaaaataaagtagtataaaagttagtaggtgggagaagaaattagtataaaaatagatcatggaggaataaattagtataaaagttggtcggtgaagaatatagtatttgagattctaaaaccccttatattttaggataaattggatggagaaaatcttttctattcatggacggagggagtagtagactagtagtgagagtggattataaactctcaaatgacatcctttcatggtttacatatcatttaaatgattatgattttttttaaaaaaatatttaataagataaattaatactttctatgttcaaaaatatagtaacgtttagctatgaatttgaacaaacaattatccaatttcatagttaaaaatacttatattcaacttatccaagttaaaaataaataaattaaaccataactaggatgaggagggagatccttcttaggactggacccgcgaggtactcatacggcgtagactgctacgctgcggtccacgaggttcgaatacgcgaggacgacatgccggactggcaaaacgcgctgcatcctgcatgcattgtggtagcccggtaggctggttatgtgcgaaaagtgtagtgcaccaacgttcgcgattataatccggcaaatcagtcggaagggacacgcgaaataggaggacacgccattttctcccattttcatttttttctcttcttttacgtgattcttctttaatccgttgcaagtatcaagtatttctgttttttttctttcacttatgtttatttcttagatttcttttttcgttatacacagtatttttttatatcttcttaacagaaattttctatatataaataatttccatggaaactttctatataccgtgatattttatatatgtaaactttatatagaaattacatcatagctagaaagtttagtgcagaaataacaaaatactaacatggaatttttcaaatgaataatatccttggaaaatttctatacatagactttctatatagagagattttatatatgtaaactttatatatatggactttgaatatataaactttatatatagaaagatcttgttttctgttcgctaggttcgccgctagcgagctttcgcgcattagacatgcctggttatgtgagcctactccatcagagctcggcagctcgcagagaaaacgaatgctggagtactcgtgaaaacgtctagccccatcatttcacatataggagaaaaaaatcaaaacgatatatttgtaaattaaaaataatttttaaataaaactcttatatatatgtgttcttaaaaaatatctaaaaacaaatgttaaaaataaactatgatgaaaaaactctaaaatcaactctaaatttaatgttgaaaacacaaattttggttgataagcgtaacaatactgcttgcatactagggctatgttcggaatcatctgttcccagcatggacagtgcgcacggaaacggagcggtccattagggctaagtattagtttttttttcaaaaatggatcaatatgattctttaagtaattttcgcatagaaacttttttttaaaaaaacacaccgtttagcaattcgaaaagtgtgcgcacggaatacgatagagaggaatcgggaacccaagcttccaaacacagcctacttgcagtcatttgcagtataaaacatcttttgtgccatttaattttgtcatcacacagtactcctacttggaaagttggaaacagggcaacacagcctgatactgcctgcggccaggccggtcttgatgtggctgtagagcctcagcaaaaccccagaaaaaacaaaccaaaaaggaaaagaaaaaagaaaaaccgaagcctataaattactacaacatttaatttgggacggacggagtattccacctaggaatagcaacaggtcgggtaggacacgggtagagcgattccatgcctgaccggagacccatgtgcccgcgcccaacccatgcccacaaggtctatcaggcaaaatcctatgcatgtgcccatgcccattgagcacgggcacgggcatatcgggcccgcctgcaccgtgcgccaccactgccgtcgtgcgacgccgcctgcgccgtgcgccaccagctgccgtggggattgaggtaggagaagagagtggggaattaggttagggtttctattagttgagtatatatatgtccctggttagtgggccaagagaaaagggtatgaggaataagagatgggccaaaattagcaaatacatatgtatcgggtcgggtatgggttatccgtgggcaaaaaataatgcccggctgctgtctgctatgttcttgggtctcgggctggcatggccacgggcaaaatattacacccatgcccatgcctatcgggccgggtattcgcggatacccggaccgatgggtaaaattaccatccctaattccacttgggagtaggggtgaaaatgatacgaaaactttccacttgtgttgtaccgttgagacttaacaattggacttatatgattgtgttttatgataaattgttgaccgttgagacttgagaattggatttatcagtttaaggggccttttattccgataaatttttgttactgtatttgcaccggttcgtttttgcgtcgttttcggtttcgataatatccggggtttccaattccgattcagattccgaaaaaaaatataaaaacgaaaacgataaagatggtttccgtctattttcgtaccgttttcatccctactcgggagctaccggaggagcatggagctaccggtcttatgtggctgtagagcctgcagctaccggaggagcttaatgcaatgacgctaagctaggccctgccatgccatcctatgcctgtctctttttcttcggttacagttccaaggtctgaaccatgtgagatcgatgagggcgtcatgaagacttgctcatcctcgagaaccacatgagtacctcgcgggccatggggactggaccatcgagaaccacatgcaggcagtcggccggcctgctgtccatagtgaatgtgacaaaccggcctgtccatagtgaggagcctacatttgctcctcgccgtttgcgtgcgatgttctgcacaaccgagaaccgtgagagagaaagaggctgcgtgcgtgttgtaggctcctactacttctgtagtagccatgaaattcaaggcgactactaacgacgtgcaaaatacgggccgtgcatatatagactgtacgcggcgcacaacacgctgcgtctttgcgtaatgccccaccccgtacacgagtgatccacctccctcttattacagtcttactgttgggatcgacatctctcaatttgggatttagcgtgttgtcagcgacaaatagaacatgtatcttatatgctaaaggtacaccgatttaatttatgtactcgtacgtgaatatttacaagaattacagtgaggtacgtagtgatggcctcttaatatagttgagcagtggctaactaatatgttttcatttacttgtatttcagatctgcctgttcacggtttgggcacaaaccgttcaacccgtgaaaccaaaccaacccaaaccgtttttccatttattcacgggttggtttggaaccggcgtaacccgttgaacccgtgtctcgtccttccccctccgaacctgcgctgagcttccgcggcaacaagacgccatggcgagaaggcatctgcgtgatcgaggaaaccaagcaatagcatcggctatttagctcgcacgtaagtgcaaaacaccgtagacgttggtgccggcagcgccgatgctggcgacgacgccgaggcagccaaacggcggctcccatccgaggaggaaacaatcgctagatcgccgccgccgctggcgtgttggtgtcctgcttgttgcctgcctgcctccatcgcatggaaaggctatacgagccatggtgcaatcggctgctgttgagcttggaaggacagccatggctgtgttgctgttcttatgcttgatccccttctttcacgtacgccggaagaaagaaactttctacggtttaacccgtcaaacccattgaaaccaaaccatatgaaccggtatttctaggttggtttggtttttctgaccaaaccgccaaagttgatgaataccttgaatttcagatatacacaaccattcaaacattttaggatggtctatggatttctcatcttttgtgaatatattattgtattatttttaaaaaacaaccacacttaaatatttatcttcaaaactgaaaatatttagtcacgtgaaatagaaatatctgacataacattagagcatatacaaaagactagccattaagttagccatttcaaaatatagccaacaaaaaatgcttaaaaaaagtatgaataagaaaacacatgattcttgtttttcatgcacaagatgcttacgagttacaagaaagaggctaaagtggactttttttctataaaattatagatagagaataatgttcctatgaaaatcaagatagccaatcatttaaaacgaatgcatctattagtagctaattcaaaggaactagtatcaatctttcattttttccttcacatttccttcatgccgaatgagcccatagcttagttttgtgtattagagattactccgtatgtcatatatataatgaaaccgtggggtgtttcaaataagcgtaaacattgcatgccattccagtaggcatagaaaagcctgaattccggtttgctcttataggacctatgctatatgcatgaatgcagatcgacgtcaatacggtgtataagcataggactccatgtactgtagcactacacgtctgccctctacacactgtgtttagttcgtgaaaaaagttggaagtttagaaaaagttagaagtttataaaaaaagttaaaagcttatatgtgtatgaaagttttggatgtaatatgatgtgatagaaagttagaagttaggggtagttgggggtgaactgaaatggccggccaccatacgccaaactagtcgatcaactgtaaaaatgcagttctaaaaaaaactgtaaaaatgctctgtatataaagagttccaggtctgtaaaatggccaggtgccctcctctctctctctaaaagaacacgtgacgccttcaaagaaacaaacaccagttgacatagtactagtgtactccactccactacggaggagtactatactggctgtgcgcctatggctatgtatgcggctacagcgaaacatgggagctacaggtagaattttgtcgtcttcacttgtcgcctgcggcctcaccagacagcaggactgagccgacgctgctgtagacggagtaggactgtaggagtactcgtactagtagatgcgtacgcacatcgatacgcatttcctcccatctgcagagaatttttggtacttatgctatttatgacgggcttgccctatccaggagagccaacctgagagatttgctgaacgaacctgcaagtgcatagcctcgtttcttgctgccgcctccctggagtcttccctggcccggttaacctggttaactcgtgagccaacatcgaaccaccgaggtataacgatgacaaaacatcctcgatcgtcttgtaaaactaatatgccctttagttttctgctccttctctttagacagtactctttccgtttcacaatgtaagtcat

SEQ ID NO: 66169 - DNA, 3305 bp, Oryza sativa
gtgacgatcaacgtagtatctagattcgggaagaacctatgcccgcaactccgcaaggatggggggtccgattccaaatcagtatccgacagggctagctagagaaagaaaactttgcacaccctgtaagattggcaaaaaagattgagagaataactcgagaatatggtattacgctttcgtgcggcttgaacttgtataaagtgcttgcctccatccatttcaccccatcgtgaacttatgtccgtacacctgctcccttgccgaatccagggggttgtgcttctacttgttattgaagcttgagctctggcagctggcaagcatggacagacggtggggatgatacggaaattgcgcagttgaaggagggtggtaggtgggggtgatggtggtgctagggcgctaggcaaatcatcgccacccaacttagagaagaggagaggtggggagaggggaagagaaggagaatggccaacagagcctcgtcggtgctgattagggggagggggggagagcgtgctacgcaagtgagactgtaacactggatgaggaggtgtcactttgataggagaacgaggagtgcagaggaaagataaggttatactgccgtttaatattgattgagattggtgatttacttgcaaattttccatagccagtcccaaaatttattacagtatatggaatcgaactgtttaaatgtgacccacaaaagaatgtcgggcatgagggagcctagaaaaagagaaggaaaaggaacatctctggtagggcacattcctctctccaatctccatggggcctatcacaaatccgaagaaaccacaaacagctggccagccgaagaacaaagtgattgatttggtagcagcaaatcaacaccatcattgcgcaggaggacaacgagagagattattcgacctcctggctcctgctgcgtgtccggcccgaactaactaaaactatacactaaacgcaacacagctgggaggaggataggagaacttatccagctactactggtcactgctggttcggtggttcccgggacaagaagctaggcacattctcctcccttttttcccgtggcgagacgaggggccctccgccattgccacgcccatgctgctcctcgagggaccagcgcgctagcgctcgcgtttgaaacctttgctgcgtgcttccatcagggagagaggatgatgcggcagctagcagcaatcagccaagcaagcatgcatgcttgcgcaggcaacttttgttttcgcgggcaaagcgcaacggatcgaccgatcgatccggtggtttcttgggtgcactactgcgtaggcttgggcagctgggctgggtatgcagcagtacgatcgtacgtagggcatgatctgaaggctgaagctgccatgcatcagacgagttcatcatggtgcggcatgccggcatgcagctcgttacggcgacggcaacttgggccgtgctaggtttcatgggctaatgtttagccttgaccttttagctttaaattagccctcagagcagactattagccagctataaacatattctaataagataaaagatgagagagaagagcagcgggctatagatttgtagccagctgcagcacggactccaagacacagtgtgtgtatgacaggtgagaccatatattaatagtatagtaagcaactattgtatgaattagctattagattggttatagatgaattggagccagtagtggcctatactattaaacttgctctcaaggatctaaacaggtgggctaattttgagctaatatgaattagcgtccctcaaaacattaccctctccaagggacgctaatggggctaattttgtgttgggaccatcaaaatcagctctctctctctccttccctctcctatctttctactctctctctccaccttttagccttgaattagcccatggatccaaacatgccacctaggctaatgtttagcctactaattcatgactaaacattagctctcaaaattagctctgggctaatcttccaaacagggccttaggcctgggttcagcacgtactcttctagtagtctagcactatactgtactaccaagggatttacagcttttctttttagggatttacagctttaattagaagctgcccaaacggttcagcttttgatttaggccgagtttagatccaaagtttttcttcaaactttcaactttttcatcacatctaaacttttctatacacaaacttccaacttttctgtcacatcgttccaatttcaaccaaattttcaattttggcgtgaactaaacacacacttagattctaagaagctagccagaagctaaaaaaaattagcttttccatattctcaaaagctagataccaaccagctacttctcataatcttaagctctcccaaataggccctctattacactaacacctcacttcccagcttcgagggcagcgacagaagacttctcaaattcttcgaaatagtaccaagcacattaattcaagggccatatttttcccttatcaaaatttaaatcttaaaacttacttttttagttaattttatttttttcatcacagtttcttttcaacattaacgtttaagtcactaaaaacacatatgtaaatattttaatcataaattatttttcatcgctattatcagtaattggccaaccgatggcaacccaaaacttcaccgagcatatatgcattgcacaattgtatcacttgtgttgttagggtttcctttggattattgaaggattttcagatgaaaaaatcttaggaatttttttctagggaagttgtttgttttgtagaatttggtttggcaaagtcctttggaattcatttcctatgccctaatttcaaaggattttaaacatgggtccaacctcatgttatccgtttcctataaaaattccaaagtaacatctctctttcactctctttatcttactcaatcaaagtaatacattaatttccctaaaaactaaagtagtacgcaatcttaaaattcctatatttttttctaggagccatccaaacatatgctatgtacaagcatgtgattttatttctcatagggtccaaccgccacaacatttcaatccttttttttattcatgtgtttttagaatgatgatgtgttcctaagaagcccttattgcttacttctagtactactaagagcactatctatttatagtaccgtcttatctgtctggtatttcctctatcctaaaatataacaacttatagcacatataat

SEQ ID NO: 66170 - DNA, 2777 bp, Oryza sativa
tgcagcacagatggtcgctccttcacctggctactactacgtcggcggcgcctacggagacgggaccagcaccgccggcgtctactactcgcacctccctgtcatgcctatcaagtccgatggctccctctgcatcatggaaggtcactgttcacctctcccttctctctcgatcgatttatataatctttgtctctgacattgatcttcttggtgtgaagtaggcatgatgccgtcgtcatcgccaaagctcgaggacttcttggggtgtggcaatggcagtggccatgacccggccacctactatagccagggccaagaagcagaggatgcaagcagggcggcctaccagcaccaccagctagtcccctacaactaccagccattgacggaagcagagatgctgcaagaggccgcagcggcgccaatggaggacgcaatggcggcggccaagaacttcctcgtcaccagctacggcgcctgctacggcaaccaggagatgccgcagccgctcagcctctccatgagcccagggtcccagtccagcagctgcgtcagtgcagctccccagcagcatcagcagatggcggtggtcgctgcagctgctgctgctggtgatggccagggaagcaacagtaatgacggtggcgagcagcgtgtcgggaagaagaggggcaccgggaaagggggccaaaagcagcctgttcaccggaagtccattgacacgtttgggcagaggacatcgcagtataggggcgtcaccaggtaatctgcttacaaagattcagcttttgtgtgcatcatgtatcatcagatcatcatctgtgagctgtttgcacatagggtgtagaggccggaaggttccttccttgttatctgaaaaaaagagaaaaaaaaactgttcttgccatggttcttgtactgactagttggcttaatgtgtttttagttctatctactgataggcatgtgtgatctcttctatgtggcatttgatagtttggttagtacacacttgtacattgctgtttttgagctaatcagttattgctcggttgccatttcttgttgtcactcctactatactagtagtaatagtactagtttccagcattgatgagttcttcattccttcttacggctctgctgctcttgttagtcagtggggcgtctactgtttcttgattactactactaataatcagtttaatgcataacgctgcaatggttggatttattctctagaagtacctcttattttggtcctttgcacaagattatggcttggggtggctctgttacatctgatgcctcttcagttccttgtattgatgaggcacctactcttttgtttttgagcaaatcatttgaccctttttatattgaatgacgaaggtttgtgtgtgtttgattcactggagcaggcacaggtggactggaagatatgaagcccacctctgggataacagttgcaaaaaggatggacagacaaggaagggaaggcaaggttgaaccttgaacatctagtactactacaacatcaaaatttgttcatcttaaaaatcttgttgacaatgtcattctgatttttatatttcatcatattgggcgttaccatgaccgaaatttgatcgcttgcagtatatctaggtaactgttgccccttacaatttctttgttctcattgtacttatattttgtatctgttgctgacctttttcttcgtgttcgttaggtggttatgacactgaagataaagctgcgagggcttatgatctggctgcgctgaaatactgggggctatctacgcatataaatttcccggtatggatgatgaaaccgtgtagtacggtgggatatgggactttgattggagtatccattttctgtaatgtggactaatttattgtgtttggcagttagaaaactaccgagatgagatcgaggagatggaaaggatgacaaggcaagaatatgttgcgcacttgagaaggtcagcagcatgctcattttgcctgaattctatgattagattattatcagattgatatgtactagtaacaagctgtttttttaaaaaactatatgtactaacaagctgttcctgctcacaggagaagcagcgggttctctcgcggtgcttccatctaccggggagtaacaaggtgtttcattttgtgctgaacaagcatatgcatttttcttgataattatttcaagaacacattcgcatcaagatacaatctcactgtgttaaatgttaactgcattgcaggcatcaccagcatggaagatggcaagctcggattggcagggttgctggcaacaaggacttgtatctcggcactttcagtaagaaagacagtgtactctatttgatcttagaatctaaacgctttcacaaagtaatgcaccataaccataagtcattgcagcttttagcactaacattaactaactagcgttcctttgggatgtgactatcgatgatctatggaaattgtcttgtcaaagtagatttgccaaagaagttagtagtagacatcaatcagcagcttttactgctaatctctagtattgtcttggagtactgtacatcgttgatgcatttctttcctgatcattctttgcttttccagatggttgttcttttcataaggctgtgacctctgaacaaagcaatcagttgactgttttaactctcctttggactaaaagatatcattatcatgatgcaaaaataaccagattgtaaattgtactttgcagtaggatct

SEQ ID NO: 66171 - DNA, 800 bp, Oryza sativa
tcagagattcgcaccgaagctatccgccagattggactatttactttgagtaaaatttcaggttaattactactcagcgttgtgcgcgcctggagatgtttttattcgtagtatctagcaaatctgatctcaattaattcatagtttgtaactgttcatattaatggacaaacaaacaccaccgcccgccgcaggcccgcccgaggtggactggtccttgaggacgcgcttcacgacgcgtgacgccacgttggccgtgtcggccgcgccgcccctgccaccgtcgtcgcagccgagcgcctggagcacctgcctctgcgtcgcgccccgcgcgccgcccgcagccgagcaccagggagatgtggacgacgagggcggacacggccgtgttcccggtccccgcggcggcgaggacgcgccacgcgagcggtaggcagaaggcgcgctgtgccgcggccagctgctaccgccggcgccccttctcctgccgctcctctcccccaccgccacgtcgcgcgccgctactctccgccgtcgagctcgccatcatgccggccgtctctctctccctctcccactgccgccgccgccccagctctgccgccggccacctcacgcggagtctgccgctgcgcctgctcgagagaaagagagaagggaagagaaaaaaaaaaggaaagaaaggagagatgtggggtctacaccattttctctcacttacatgtgggccccacataattattatttttattttttgctgactaggatgccatgtacaacaaaatcgggtgcacatactg

SEQ ID NO: 66172 - DNA, 1519 bp, Oryza sativa
aaatacatatatcaaatgaacaaatagaatccacaaagtgcaaggaaaaataggacttgccgtataggatggaggcggtatagggcctcccatggtgggcatatggcctccagagaatgtcgctggcggctgcagaggcccagatgacataggtctagctggctgataagccataggaactgcttgtgatgcaggtggaacttgaccagagtgaggcaagtgctgtgtaggttgctgaaaatgtggcatctgacctggcatgccaatattagctcctggcatggcctgaccaacaggtcgaaactgctgccccggttgcatgaactgaggaggttgttgctgatgaatcaccggcctaaactgaaattagagaacgagatgacatattaggaatgtaaaatatgattaaaatggtccatgctgtggatacaaggggaaaattcaatcttccagtttacctgcataggcatcggaggtcccagattttgtggtgggacactagagcccatcatagggggcctagattgctgcttgagagagagagaaagagagaaagaatggtaaaaaattagcacatcacacgacaaaaatcaaaacttcacactgaaaactgccatccttaaaacaaccagacaacatttacctgcggtggcccagaaggttgcatattacttgccatcaaagcacatcaaaatgtgatgcgaaaaagaggaaacaagtttttcctaatacagtggctgccaagtgacaaggaaaggaagaaaatgacgggttaggacattaaatgcttacggatcgatcctcttccgaagataactgcaatatttaactaaactcaataacaaacttgctctgccagctgcactttggcacagtatttagacacaaataacgctgtgttagtatttagtaaacagggtaacggataccggcttttggatccttcctctccctccctctctcagcgacagaagcgaaagaagagaacttaccgttaccataaaaacaaacatgtcttatatacatagccaatgagctaaaactagatatcagtccagtgacctactagcgggtatagattagacatttgaacacaactggtctcctaaaccacatgccctcatatacatatccatgaaaacagatttcaaattttatctaagcacgacccccccccccaaaaaaaaaaaactaagggaggatcgaattatcagaacaaaaccacgtctcgtgttctgaaaaaaactagggcagggacagatgattccgctaaaccctaaaacaactaccgggagcaaatctatatgatggataagggcgattggtgcctatcaacgagaacagcgaaacgaacagaactagaaaagcagagctagggtttcgttactcttaccgcggggaaggaaatcaatccaggtccggatccgcgccacttccagtagaacggaggacgacgacgacgccgtctcaaccacgggagaagacccacccgagagaagtaaccccccttcgattcggg

SEQ ID NO: 66173 - DNA, 10888 bp, Oryza sativa
ccaacgggttaccgatacacacacccctttcctgtctgggaccgtgggacggcgcggggtatgtatgtgtcaatgtcatgtattgtatcggcgagggagagacgctgcttggcgttggatggataatagcaggcacgcgacgggagttttttgctttgggctttcggagtcgcgttcctcgcctcctagaaggaataagttcactccaggtccctcaatttgtcgccgagtcttgaaattcgcccctgaaccgaaatatcaggtgtacctcatcccaactcacaataccatgtcaattttggtcactcggcagtaaagtagttgtttttagctgacgtgatgagtgggacccaagtgggcttgtcagcagccaactcgtctccctgtccctttcccttttccgtctcttcccatttctcagatactcaagcatcgagcagggtagtcggtgaggagggggtcacatacgatctgtagtggtgaaggggagggacttcctcatcatcatgcgcgccccgactgtgcacggggagtccaccctgatcatgctgagctgcacctatcagagcatggtcaccatggagaccgtccacatgggaggcgacacggggatcgtccctctcatggtggaccccgtgaactacgacgtgttaccgaaggtcgagtaggagctgcaccatgtctaggccacggaggacatggtggtcatgcgcaccgccaccgagcagagcaacttcaagctggttgttgccgtcctcgaaaagcgtcatggcgtgctcaagtcacgcgcggaggagctatacgacaaaccgcggtccgtgacgtaggcagccgagctaagggagatgcaggacagggtggtgatgcgtcaggagatagaggactttggtaggggcttaatgtgtgagaaaagggataggaaaaggtggaggaatgggttcaccttgacgaggtggagttggtggcgcgaggtttggccaacggggctccggtgagggagatcgaccggcggcagcgtggtggccagacatggtagagagagaagacaagagctctaagagtttggttgtgggggaaaatggagacatcgttgtctcttataggcagcgaaaggtggttgcaatggaattcgctgatgaggacacggtagtggcggcttgagatggaagaaagcgacgccggcttcgtcttcctattggttgcccatggtggttcggtttggtgacaaacaacggatgacgtcggcagggtgactcacaactgaggttgggcagcggttagggctgtcaacgagccgagctcgagcgagcttccatgtgtaggctcgaactcactatagactcgagtcgagctcgagccgagtctaggtttgccacgagcttgaagttgagctcgagctcggctcgttcgagcttcgagcttttctcaagcctgtttggtgcggtggaatactggaacaattcattccattcaaagaaaaagctgacactgtgatgcatgattagacggctaaggccctgtttctttcagcttgggattattataatctagattattgagtcagattactataagctagattgttataatctatagtagaataagcggttagttgtttctttcctagattattgggtttgcaagtctaaagagagagtggggtggcatggtgggtaatttttcacccaataatctggaaaaaaactcacctaaatgagcttatcagattataataagctgggctccagattataataagctacttcaataagttgtctgtttctttcagcttactcccaataatctggattataataatcccaagctgaaagaaacagggcctaaaagtaatactagtgctcctatgtatactaatgcaactgtgcaagccgcacactagtactcctactctcttgttgggaaatgggacaacaaatgcatagtgctccctctgccctggcactgccagtacttgtgcagttgtgctactccagtactactagagaatttgaccgagtaagaaagagagagaaggggaggaaatacctaggagaaagaacatgagccagatgttgaggctcgccgagttattcgagctcgtgttggtaggctcgtgagcttaaagtcaagctcgagctcggtttgattcttagacgagccgagctcgaatcgagctcataacaaatcaagctcgagtagctcacgagcctcgagcatttttgacagctctagcagcggttgcttggcggcgacggcaagatggtgatagcagtgcgtgtgccacaggcacccacagggagtttggcagcggtacaaggagcccggccgtgcctacatgcccgtcgccatgagctcccactcatggcagacacccttcatggctaacatgtggggcccacgtcggtgtcactcgccgcgtcagccaaaaccggccattatactgctgggggactaaagttgacacggtattgtgagttgaaggatatacctggtatttaggttttgggacaaatttctgacccgacaacaaattaagggatctaaattgaacttactccctcctagaaagagataatgagaatatatggtgtggactggaccgagattagggtttgagcaggcttaggccctctttgtttaggcttagaccctctttgtttaggcttataagttaacttataagccgaaaaatctaagcctaaacaaacgagcaaccttttcatttggctttttaaaagccataagccactctaacactattaagccaaaagctagattagagaagcttttttggcttatgtgaggtagatgtatggctccgccactaaacttaggacattaatccaccgacttataaatcatataagccaataagctgacttaaaagtctaagcctaaacaaagagggccttataagtcaacttataagcctaaaagtctaagcctaaacaaacaagcagctttttcatttggcttttttaaagccataagccactctaacactatgcaaaaagctaggttggagaagcttttttgacttatgtgaggtagatgtattactccactactaaacttgggacattaaatccatcggcttataaatcatataagccaataagctaacttaaaagtctaagccaataaacctaaacctaaacaaagaaggccttagtgcatgtgctggtgccaacttgccaaatcttaacaggccatctaggatgaatttagatgattaaatgggcttagtatatataaattttatcttactaatgggccatctaatggtgaacaggatggttaaatgggtttagtatatgtgctatgtcctttagcacacttgccatattgtaacgggctatctggtggtgaatgggaatggagcgcactccactgggctcaactgaggatgatcttagcatgctaagcattcccagggtgaaaaataactcgtcaggttctagccctactagactcggggggaggggggcattgtcatcgctaacctcgtagcccgtaagcctttgtgagttcactaggcatccatggaaaaatacttgttggagctgctatggttgtaagtgatgcaaaacatgtgaagtaagtgcaagtgcaagatgttgaatgcagatcagcagtaccacatagagccatgtagcaacaagcttacaatattgtgagtctgctatggtaactgacgcataatgttgtagaattttttttagcaaggctagttgatttataatggagtagcttttgcaccgtagcgaataatatgaacatcaaatgggtaggaggagctcctcctatggcatttgactttttgtcttttgcagtagtgtgttaaatacatcccatttggaacatgttcgtctagccatcatgtcacttcagtgctcccttctaacaaatgagctaggttgatgcaaacctagctagatcaaatgatatattaacacgttgtcaccctttgccaatagtcgcattatatgctaaagtcaataatcatatcagatgtttaaatagttaatattgtggttggaggatatcaaatttatgatcattgtagttgttggttcataatcattctcctaccactacctattgcatatcatgaatgaaggccaaccaccactaactgcaacaaggttagttggagggaaataagaggaagaggcataaatatatagactttgtggtgatgacaaatatcatgaaataactagtacaacgtatagaagtttggttcgaggagaaaaaagaatacaagaataggaatgtaagagcttataagatgagaattgattgagcttaccggaaatttccttattatattattttcaagataggagttatgctaaacatagcaaataaagggtcaagttagagtctggtggtttctcggtcaataacttaaatatagtatcaaatacaccttaaataccctaataaagcatatcaaaacaataagcacacccattaaaggtagctctctctctctctatctatctctctctcatgtggaacaatagttatttcttcacaaaatcttccttgcgtgatgttgcttaggggtgttagtcggttgccattgccataaacatattgtggaaattcatgaaagaagctaacaaatcattatctaccaatctactttgttggagcatcacatgaggatatggcggtaggctcgtgatagtatagcacttttagacatactacatatatagttaacatcctagccattgttcttcactttgctatagttgtttgtgtgcccttcgacactattcaccattatcagctccacatcatcctacaacattgtctaatatttcacgtaacaagaccactaaatacatgtcttcctatgcttgcaagtatacccatcgcaaacaccaaggattcctcaccattccttgtgtgtccatgtattaattaaccccatgcatgactcacatgtacatttgagcaacatccatttattcatgtcttggtatggcacttgatcaatttagacacagtcaacatatacttatcaagtacacatgtcctcgaagcttatcacaattttgaggacaaacatattttgattaaaaaacatatttcataaaaggccaagtctagggtcatgtgtaacaagaaaataaaagtttaacaagattttgacacataaccgcatggatgcgcaaataagaaagaaggccaaagactagttcgatttagatgaggaggcatcaagcacgacagcaacatagcatatgttcttcattttaggctagctacttatttcattcaattatgaacagccatatgctatgctatacgtaaataacttcaaatatgaataaatttgctcttctattttatattcttttgtctttctagtttccaagtaatttttttatatggttgatggaaaaggacaatgaaggggaattctgtgtatcgtgtagctgctagagttcattatgtgagatgttgattaagaacttaatacatgatggaaaataaccttttttttgcttgtgatggtcatctcctattatcatttattgttttaatcccttaaagaaagtgtttcgtgttgcaaacaacaattatcactaacatcttattttacgcatccatatgattattaataatatacaaacctaatcacacatagataaactataataatattgtcgatgttttagatcacgactacggaatttgcatggtatggagattgttggtaccagagtatatggagggggtcgcagtcgccggtggtgggtgtcagggctagggctctccatccttgaataatgtcttcttcagtcagctcctatatatggcaattaaactcgattaatcagtggttgggtcgatttcgccttctcgtatagggatcagcctctatcgtgtttgctcccaactccttgctttccaagtagtagtactctaactcttcttccataacctctcccaccttctcaggcttgggaaggtagaggaggaagcggaggaagagggatttgttaagaggagagaagactcggaggagggagagatggacaggggctatgcgctggaagagaggatttccggtgtgggatgacagttgcgtcaccctttcttctatgaagcttgttgaaactaaaaaacatgaactctataaattggtatacttgctcaaactggtattaccaactacaggtggctacagcaagtgttgaaagggtgttctctaccatgaatcttgtgaagaccaagttgaaaaatagtatgggcaatcaagtcttgaatgattgtttggtcacatttattgagagagatattttcttgaatattagtaatgatgctgtaatggagcgcttctatgctatgaaaaagcgtcgtagtgataaacggcattagattgcattgtttctgctatgtaagacttattttggactatttgcattgtgttttaataatttaagacttaatttaatttgaactaattgtactacattcggataatttaagatgtaattgtacttttgtgcttgaggtttttgttttggcttgtccgccacactgcctccactacaagcaccatcgactaggccgcttcatcatcctagaccacacaacccctccccctccccccaccctccgtcatcgcccttgttagatccactgcctaggccacgacctaagaagatcgatggcctagtttgctggaatttgaaaatatagggggaagcaatggcaccaatgattggaaaagcagatatggcaaaataagaagatattagatatagaggggaagaagtggcggtggttggatctagtagagggaagagtagtggttgtcgtccccatgggtgtaggtgttagtcaatttctttgtgatggtggttggcaacaaatgtggaataaaaggtaggtagggagatataaatgtaagtacatgtttggcaaatgggcaaaggatcttgatgatttttttatggttctaggggctattttgcacatgtatttctgtaaaatcacattttaccaaattttgtgagctgaaatgctaaattatttacgcctaatcaaaaccactgcgcattgtgaagtaggatctcaaagagtacactcacccgatgccattccacaagaccggccactttgtattttctctactactataatagtggagccgttctccttccattccctctgaccgtactgcacatgcgcaagatgagagaaaaaaaagaaaagaaacgcttgaattcggtgctttaagctcgatctatactcccaacccattcccaattatatgggtcagtgcaacccaattatatgagcatgttactagtaaatgcttgaagttatttgcctagggcagtaatagaggtggcattacttgctaggtgagtttggtggaaagagtacaacatagagagaagcggatatgtggggattattgtgctcaaagattggctagcactccgatcctttctgatgactgatttgaaacttggtagcaacacctcatggtcatggtcaaatatagagtaggaaccttccctctcctatacatgtatatttgtttttgcatgcatttaactcagatttgctcgagtcagaggaagtaacacttgatcagatgaataacgatatgcaattttattggcgatcgatgctcatgcatatatattgcgcgtagaaaaccattatgcatgcatatatatgtcatcaagatggaagaccagaacaactcctttccataacatttcttactttaggagaaatcaacctctcctataaccttgaaatatttaaccccaagactagccaactggccatccaaatcaaagtagttatctatggatgaaggaaagaatgagaaacacaacaacataatatctgttgcttcctcccctgctccaatcctgcacctgtagacacatatcatatcccccctaccaacaaatgcaaacatctgcatgacatatatgttctccctatatatatactagatgtagaattaattaagttatgatcggtaaggcacatgcatcatgcatgcatgccttttgatcagttgtgtactatatacttggagtatgatcagacttggagttgtgaccaactgatgagagccctagcaaagctacaaggccgtggtcttgtagtggtggtggtggtggtggtacagatcctgcaacttcttccacgactcctccctctgcatcttgagctgcttgtagaagttgccgatgaacgcctccgccttggtgaacagctcttgcttgctcatcatctgctcgccgccgcccccgccgccgcccttcgtccagcacccttcctcctcctcgtggacgacgacgtcctcgccgtccccgcccccgatgaagaagaggctcgccctcgacgggcacctcctcatcttcttggacttcttggccgccgctgccgccggcatggcaccgccggcgatgacgacgacgtccctgctgccggctgcagcctctaacgccgccgccttcggtgtcaaggatggtgaagcggccacaattacagcgctgctactgctactaccgttgacatggtgatgacgaccgttggtcgccgccgcagcgacgtcgacttcacctggtctattgctgtggctcagcctcagagctgcggcggcggcggccggcttgggcagcagcttgtcgtcgcgcgggccgctggagatggcggcgaggaagccggcctcgacgccgagggcgacgacgagggcgttgaagaggaggtagaggtagggctgcctgagggaggaaggcaccaaggggaggaggaggaagaggaggaggagggacgccatcttggccacctgggccagcgttggaaacctcttcttctccatggccatcaccatttgtagctagctaaggctactagagtctaggagagatcagagagagagtaggaggggatcgatcagggtgtagcttggtcacctatatatacacgtgcagtagtgtctactgtgccccgtgtgctctactgtgcaggacacaagcttttaatatactattttccttttggaattaattgaaaaaggcggcaaatagataagcttgcgtagcgtaggtggtaggagggggatagagatcggtgatagagatgacgcacaagaaagaaagaaagaaagaagaggaatttgtttgagaaagtatctaatcttgtgtgtgtgtgtggagttgtggggcaaggtcggtgagaatattccggtcgttttcatgagcaggggcaggcgtttctcgccgtggttcggtgagggggagggtggtggccatgtgggagatctcccggtgggatcgtccatcccccttctgcttaattttattccctgccatgcatgcatatgcgcttgcgcgtgaccggcggcgggccgacggctcgcgcgcggctcccacttgctgttgcggagggatatctctggatatgctgcctggaggtgcatggacaattggtcaattggactggacacatgactggaagtctggaatatggttgtcagggacgaataactgaagcattttgtcaaaaactgtaactttttttttaaaaaaaaagaggttctccatctagtcatcagttgcgtgaaaaatttattttccacccgcattcgatattttggcggtcgctatgacgtagtataatagacacgcaacccctggtgcctaattggctaactcggtgtgttttttgtcgattgcatcttggctcctctgttgttgcgtaaaggaaaaataagtgggcagcactcacggcttattatataccacctccgttttaggttataagactttcacggtttattatatatgtgtcaagattcattaacatatatataaatatgggcaatgctaaagagttttataatctgaaacggaggaagtagaagagaaactcccatgaacattttgtattacgatagttcaaacaactaatagtactatttaagaaataccatcatgatatatagtggccaagaatttttggttgggtagttctatttcacaagtaccggtgaagaagtagaaatttcattcacatcaacgtaccaaaattttctaacattgcaaatcccataaacaaatagaaatttaattagtttaaaagcgatagaattatatcttataccatcactaatcgactaattcaactagcaaggtcaaaatttacaaagataatttagattgataggagcaagaggtgcctcttgttcttgagtttgagcttcatcaaaactatcagaaatgatggtggttcttcttgagttacaggaagagggtgttgcaatcttctttgccctttgcagttctaggaagagggtcctgcaatcttctttgccctttgcttcatggttccgctagagtgatgcaattaaggccctgtttctttcagtttgaaattattataatctagattattgagtcagattactataagttagattgttataatctgtagtagaataagtgattagttgtttctttcctagattattagagcctaaattattgggtttgcaagtctaaagagggagtggtggcatggtgggtaaattttcacccaataatctggaaaaagctcacctaaatgagcttatcagattataataagctgggcttcagattataataagctgggctccagattataataagctacttcaataagttgtctgtttctttcagcttactcctaataatctggattataataatcccaagctgaaagaaacagggcctaatatctgcatttctattcatgcctcaccaattctaccatcctacgaactaatgacaaaggcactggcgaggggatggtggtctggcggtggatccatcgccttccctttaaactccaa

SEQ ID NO: 66174 - DNA, 5560 bp, Oryza sativa
ggggtgcctagctagcttatccataatacttccttcgtcccataatataagggattttgagtttttgcttgcactgttttgaccactcgtcttattaaaaaaaattaggattattatttattttttgtaacttactttattatacaaagtactttaagcacaacttttcattttttttatatttacacaatttttttaaataagatgagtggtcaaacagtgcaagtaaaaactcaaaatttcttatattatgggacggagggagtatttagctaggtttcatgcaattgtgagctagcaaaacctttgagaattgatattccttcacgagtaaatatttttgtaaaatatcttgaaagaaattaactgataactgccaactaattaatagtacaaccaatgaaactctataccaattaaaatacaatattgttcatgtattcagctctggtttcatgccgacatgatgtagtcttaaactaagacatatcatatatccagtatctaccgagtattttcgccaggtgatctcattgactcctcattcgtaaagaaaccaaagccaactatagcagctggagacagtatactgtgtcacatccaaataaattaagccacaggtatatttgagaatttgaattaggctccgataaagatacctatcctttatactttctgggcacaagtagctttttatcctcttatccatccagaagtgcgtatgaacatgggcggtttattctcttctttgcgtagagatcgctgtccttcagtttatatgagtgtagtaatctttattattgatgccagcatagcataaatacagaatagtaatctttatatatatgatcagtagattaattagcagaactattatagctagccctttcatcaaaaggtcgtgaagaattaatatacaaattttccgaaaaggaaaaggatgaataaaatatcgaagaagatctcagggcaaacgttcattccgtggccgggttcgtattccactactttaggagagactggataaaaagctgctcactagctgagctggaagaatgagaaaaagcacaagaaggttcctttaccgcctgatggatacaccacgttgtacaaacaccgtctttttaaaggtagcacataataatcgagcaccctatccattagaaaaccatctctaggtacagatattagtgaccgctacatctacgggcacatttaatttagttttgtacatttcacggtgagtgccgattaaagccttatttgtttgagctacgtcttatagaccagttccaattttgaactacggattataagttttggaattaatttatggtctttccttgttatttttgtcgtcatcacactcggacttaagttttaaactgctgaagatagaatcgtaaaagtcttagatattctaaactcattttcccgttgtatctgtcaaaaattgacttatataattaagcccatcccagaaaaatgtctgggaagaaaaatcgcgctttagcctttagcagcagagtggacggggaatatacgcagcagtgctgcgtcgtcgcccgatcttatcttttggctgagatcagtagaaaagggcggccggagaccggaaaaaggatatatgacgatgcgagggtgtttttgccgcaggtaggcgtcgaggcacagtgtgcacgcagcgatcgaccacagagacacacgtacttttttgtggcgtatgtacgtgaccgacgtacttagcatctgcaagagaccgaagtggtagatgacaccatgcatgcatgcatatatggagtcacggacgcgacccgtttcttcgcccggtatgaccggccggccagtcggtctcgtcaatagatgatctggtagctagagtgagcaactcataataaaaattattggaggttctatacatattaattatctaattattaactaatatactaattatataatatgaatcagctagcattgagtaatttaccaggtgcctgtgatcccggtaaatagtacataggttcaccattgggtagctataggtccgtgtatgtgtattagctagctgcctagcgcttactactctgtctaaaaaacgaattcctacctacgaacttggacacacatgtgtccagattcgtagtcgtaggtaggattggtctttttttttttacggaggggtacgtgttcaactgaataagaatgtgtacatcatgcatgcagtgcacaagctgttggttttttgctcacataaatatgctcaagctgttggttttctgctcacataaatacgcgcacacttgttcgtccgaacacacatactttcttttatattcacttgttgcctcaacaacctatttcttttttattgtctaggaggaaaatattagttcgaggtccacctatgctagaatacgacactagtacataactggtcatcgtgaactatggatgaaaacagatcggaaacgaacggaaattacctttatcatatttgttttcataatttttttcggaatcaaaatcagaattaaaaacctggatgtggaaatgaaatcgaatattatcgaatacagatacggaacaaataagacaacgaacatttgtcggtatataaaaatcccctcaaattgagtttccttaataaggaagagatatcgctcgtttttttagatcaatatctccaacatttatatcatcaatttgtaggagatcccacaattgtatgtgttcatggccattcccctaagaaacccacatgtaaatataattattcatttttaatcccaaatccttttactatatgtatagcttacttaccatatcacttatcaagttattgttgtataaattagagatgttatttattttattgttaccaggttagctagtgattctaagacacctctatacgttgaatgcaagtcaaaacacaccaaattatcaataaccctggacctaatgaagctaaagacaagcattagatggacagacaagagtttcacttaactgttgggtatattgaagcgtttgcttcataaggagaacgcattgctcaagatgacatatgaatcaaagcatattttgtgtctcttgggcttaggggttcatagaattcatgcttgtccaaacaactgcatattgtatcacaagcaatatgcggacttagaggcttgtcctgtgcaaggcttctcgatacaagcgaaagagaagttctgattaagggaaaaagtcaaagagggctggttcgacgaaggttgtgtggtatctatgttgacgatcgttaagtgcatattttaactaccaattcctgcgtaaaagatatcaattatattatcaaaacttagtataggactatactactaaccacttccactagttttggtaaatatagctatgcaggttatttaaggagaaaatacacccgacatgcaatgaaaatgaacccccgaccaatcacgtgcgagtacacggattgaggagcccacaagtcaacttaaaccgactcaaggtgaggccaaccacccgggaaccgactaaggggcccacctgtcatccaccgaccaaagtcggaggagaaagacggttgaggtggttcggccaaacccctgctggcgccgctaactgtcaccttccatgtgtcactccctgattggttcctgatggcggttatgggaggtcgatggccagaaaccgccatactcaaccatcattggacactataaaaggaggactccatcaaacttctcaacacacaactcttgagctcaagtagagtacaattcacttgtagttttatatttagtatgttagtttggtagagagtgacgggaagctccggaaggagtggctcgaaatatcggagttccttcgagaattttagggaggagtgccggagtgtcggcattcttccaacggagtttcggagaaagccgggattgttggccttcttctctcgcttgtacctcgaagaatgctttctttatcaagtaagtgttcgggtttatttatgtcccttaattagtttatttaactgagataagtattcttatcggtgtgggttcgtcgcttagtgtgcaactgagtgctctagcactaggactctggataaagaaggaagttcctacacaaggttagaatagtaattaataacttagacgtggtgtctaggttagaaattaacttcatttgttgcgtgctccatggaaagtaaggtaggtggcaggtggtgacagccatgtccgtccttcgtatctctccacgttcgggtacatcatatagctcaaggccggactcatcctagcagaccaggggagagccggtacccgaagcattcgatagagttttatctttaacttaattaactaattaaaagacataggaatcatttctagccaatttatcttaagttgttgtccttggattgaatcttgatcgtatattatacacacacgttccttgtgttcgatacccttggaatactctaagggggaagtgctacaacggtattccttgcgcttacggatttatctgtgatcataagaaatacgatcaatctacctatcgttgatcgtttcaagaaaatctttgctaatcttaagaaagtagagttatacccaattataagaacgtggatgaattcatcgcagggacccagatcgtgcacccaagaagtcagggtgacacaaacattttggtccatcaccgccgaggggagcgttttgaaagttcaagtgccattaatttggttttggtgattaatgataaatccaattacatgagactaatattgttataagcatttctttgtctactagtctcatgtggatatgaaagtggaatttgtgagaggtgattcctggacttcatatgagttgagatagaaacattcagtgatggtggacctaaatcacaaggatgaaatgcatggagatcaagctatatgtatcactctttttcttcgtgcacatattgatatattcatatataatatttttcatgtgattacgtaagcatgtgagactaatgttttgattgagccatatcttgtttaatctctttacattgaagacatggagatgatgaaggtatgtttttattttaatgtctatatttgatgaatgccttctattcttgtataggataagctctcaatgtttcatagctttttatgtatactcttgcttcacacaaatattccgtatgcatacatttagggggagcaaaccctatacgttagttatgcatgtatttgatccaagttattcactttcatttaattgggatctctacatttaagtatacaatcgagtatatgacacttgtggtgttgattaatactcaccacttattcatatccttttatatactcgatcggttagtcaacatgtgaaggttgacaactggatcattgggactaataattttattgagttgaatgagagaaataggtcccaaggattgcaaaggtgctgatgctcaagtgatatcattacacctaaatatactaaggatgaccaagtgaagatattgaagatgtggaatatgaagtggctac

SEQ ID NO: 66175 - DNA, 1606 bp, Oryza sativa
cgactttgtcacgatggaccgtgtgaggccatttgaagctacaagtaaccgcatcaatcatttgaagaatatatggtgaaacggttttggcgttgacgtcccttaagacaaagaaaggaagatggaaagaagtcattcctattgctataattttcttcctatttacatttgtgtcggtgacatgggaccgggagtatcatgacttagagacttgaggcagacacgatcacccacgtggcctaaccccctcgggggggggggggggggtcgggcccgagggtgatacggccgcccttctctttgtcttcccgaggggtcggaccgctcctgtctcggccccgagggccaaggcgccccgaccccttgtgggttttgcgccgcgtatatggggtaggtgagcatagcggggctcacctaaccacatttattgcggtttggacgagcgcatcacgccgcatgtaacgcagtgcagcgcactcgtttatccggtctgtgaccagtcacagaccggtcagatcgtgggttaggtggcgacaggcggtctgacgcacgcctcgccccatcccgtcaggacgagagcctccaagcactcgtccctagccggagccggcgtgttagctcctggagatggcacgttggttccggtcagatatatgccaggcttcatcctaaccattacaggcaagatattgtatgaagaagggcgaaatgcagattgataaactgacacgtggtcgacaagaatgaccgatttgtgaccggtctgacactggtcatgtcgtcagcagacagccatgttcccacgtcgcgcctgttccggcggaagtggaggtaggtgtgggccgtcccatcagaaggtcattcggacggcaaccatacaagtctccgtctgtttatgaaaagataggataagtccccacaaaaaagagagagatggggcatgtggtatccccttgagatataaaaggaggaccttgcccacttagaaaagaaaaaaaaaacgatcccagaacgatcgggggctggctagcactttgtagcttctccatacacagatccaccaaaacacaggagtagggtattacacttctcagcggcccgaacctgtatacatcgcccgtgtcttgtgctttttccattctcgcgaaccttccacacacagaccaggagcttagaacctcacccagggcccccggccgaaccggcaaagggggacctgcgcggtctcccggtgaggagccccaagctccgtcatctgacgcgccaggtagggggttctgcgtgtgttcttctaagctctcgcactttttcgtgtgcgccaagcttttcctgttcagcccaatggccgaacaagcaaaggcgcacaacctctctccgagtgttagcggtgacgacggggagccgaacccacgccgtcgagctcgtactccatcgccccctccacgccaaagtcctaggcgggaggaggcgctcgagagggtcgaaggatccgcgacttcgacatccacgggtgatggggaaggatggcgagatggggagcgtcgcctcctcgtctacggcgacggcagcacgccccagggcgcattccaaagctgcgggcgcgctc

SEQ ID NO: 66176 - DNA, 19084 bp, Oryza sativa
  unsure (1)..(19084): unsure at all n locations
cggcagcgcctaggtgctggtgggcggtcctccgccaccaagacctctggcgccgctaccactggctccgtgtcgtcgaggcggagggcgcggcgagcggcgacagttgctcgtcattctgccgccactccttcgtcagcgcctccgacccaggaagatcagcgtggggggccagatgcccgcatcgatatcgagcgccggcgtaatggtcggcgtgctccccacgcaacggagggcgcctcctcgtccggagtgtcacctcaacacggacgcggggatcagccctccgtgcccccggttggtggtgtcggctgtagagcctttgtggcgagccttcggaacgtccgttggcccccaaggttccggcccaccatcgccgaaaaatatgacgggagcgtcaaccccgccgagtttctccaggtctacacgaccgggatcgaagccgctgggggtgatgacagggtcatggcgaatttctttcccatggccctgaagggacaggcgcggggttggctaatgaacttgccacccgcgtccgtccactcttgggaggatttgtgtcaacagttctccatgaactttcaaggcacatatccgcgcccaggtgaagaagcggacttacatgcagtccagcgaagggatgatgagtcacttcgctcatacattcagcggttctgtcaagtccgcaacaccattccatgcatccctgcacacgcggtgatctacgcattcagggggggtgtgcggcacaaccgcatgctcaaaaagatcgcctccaaagagccccagactaccgcggagctttttcagctcgcggaccgagtggctcgtaaggaggaggcatggacctggaacccctccggttccggtgtggcagcttcggccgcccccggatccactgctcagacagggcggcgtgacaggaggaggaagaagaggtcagcccataccgacgacgagggtcatgtcctcgccgtcgagggcgcttcgcgggccacccgaaaggggaggcctgcgggcgacaaaaagaaggaggccggcgctcccagcaaggagcgcccaaccggcaagtggtgcatcgtccacaacacttcccttcacgacctcgcggactgccgcgcagtcaaaagtttggctgagcggacgaggaagtgggaggaggagaggaggcaggagcgccgagagggtaagtccccggcggttccttccggcaatcggcgaagtgaggccaagcagaaggcccccgccgaggacatcgatgacggcgatgatgacctaggtgtccaagagcctggggccaccattgccactgtcgatgggggagcgtgtgctcacgtttctcgccggagcctcaaggccatgaagcgagagcttctggccacggcccctactcatgaggcgacgcgccgggcgcggtggtcggaggttgccctcaccttcgaccagaccgaccacccaccgtgcgttgcccggggaggacagatcgcaatggtggtttcccccactgtttgcaacgtaaagctggggcgtgtcctcattgatggaggagcagccctcaacatcctttcccccgcagcctttgacgccatcaaggccccggggatggtgctccggccgtcccaaccgattatcggtgtgacgccggggcacacttggccgctaggtcatatcgacctcccggtcaccttcggtggatccgccaacttccgcacggagcgggtgaactttgatgtggcggacctcaatctgccctacaacgcggtcttagggaggcccgcgttggtgaagttcatggcgacggtccactacgcctacctccagatgaagatgccgggccccggtggccccatctctgtccatggcgacctcaaagtcgcgcttgcttgtatggagcagcgcgcggaccacctcgccgccgcgtccaagcccgagggtggcgacgagaggcttagcacatccgcccccgctgccccgaggcagcggatagtcacatgcgacgaggtcccggtcaaggaggttgccctgggcgacggcccgtccaagaccacacggatcggtggtcttctggacggcaaataggaagacgcgctcgtctctttcctgcgggcaaacgctgacgtcttcgcatggagaccggcggatatgcccggggtccccagggaggtggttgagcaccgtcttgccgtgcggtcgggcgcaaggccggtccggcagaaagtacggcggcaggccccggaacgtcaagccttcatccgcgaggaggtggcgcgacttctggaggccggattcatctgcgaggtcatccatccggagtggctggcgaacccggtggtcattcccaaggcgaacggcaagcttcggatgtgcatcgactacaccgaccttaacaaggcatgtcctaaggacccttaccccctgcctcgcatagatcagattgtcgactccacagcggggtgcgaccttttgtgttttctagatgcatactctggttaccatcagattcgcatggcaagggaggatgaggaaaaaactgcattcattacccctataggaacttattgttatacgacaatgcccttcgggttaaagaatgcaggtcctacttttcagcgtactactcgaatttctttgggtagccaaataggacgtaatgttgaggcttatgtcgatgacttggttgtaaagacgcgcaaccaagagaccttactctcggatctagcggaaacttttgagagtctccgctccgcccgcataaaactgaaccccgataagtgcgtgttcggtgtacctgcgggcaagcttctcgggtttttggtctctgcccgaggcatcgaggccaaccccgagaagatacgagctatagagcggatgcgcccccccagcaagcttagggatgtgcaatgcgtcaccggttgcatggtgtcacgcccggaatttctatccaaaattccaaacgcttacatgtgtgtgaaccctcgtccaggaatcagccgaggcacacaataacaaattgataatagagtacaaatattactctaattaataagcgaataaactgtcattacagaggtagatagttcctctcaatcaataaagatctaagcagcggaaaataaataaacggcgcagacggctccactccacaggcagcttgaccaaggctacacctaatcctccacaccatcagcctcattgtagaactcttcctctgatgaatgattgcaaggtgagtatatgacatactcagccagccacgcagcaaatatgcaagtgcacaggataacaaaggatagcataatagggttgcatttgcaaaagcagcatttagcaaacatttgagaatttgataaagcagttaagtaattaaacaattttaatccaacgctatacaacataccctgttgtataggcccaaccattctgaacaaccaccccggctgcacagttctatctccaaaccaggaatataccattccaaaccaggagctaatcaaattattaccagtttaagcatcttttacaatgatgagaggtgtgagactaatcacgaaagacattgttagacccacccataaccgcgggcacggctattcgaatagttttactctgatcagaggtgtaccactgtacccacaagacacagccccacatcatgtcaccatgtgcctcaataccaccacggtatctcggaaaggagttgtgacaatacccctcgcataacacaatccactgcagcgcaccttcctggatcataatcacccccttataaacaaggcatggactccccagcgacccccgtgggcttatctccgccacttctcagtctggtgccccgcaatgaaccatgctatacaaaagataaagccgttgcccatgctggcttgtggttggcacggttaatgtttcacaaccgaaactcgtgaaccggtccttaattgtcatgagcacgaccaacaaaaccatgtgctcacaacccaccattaccaggttttagttggcacattaattaattaactaatcacgattgaccatcgtgaactatcatgaaaccatcattaaataatagtgaatcattagttatcccataagtgagctaatgtttctaagcaaggctaagcaattatatctaatatctagttgaaccaatataaataaagctcaactagtcaaattataatatcccaaggtatcaaggaataaggtaatcaagaacaaaagggctatagcaaacaataggtcaattccacccaatgacattcgaaaatagatgcaatagttgaatagaaacaatagctttaaataggatcaacatgctcaaagggttgtttgggatctgtgtgacttgccttgctggccttggaactcttcaaactcttcttctgcgaaaacggactctccggaaacgacggaatataagcagaaaagagcaaaatcaccaaaacagcacataaacaagcatgaacagtacatgtggatatttttaaagtgtaaatctcaattttagaaaaatttagagacttgaaccaactaaatcggagctaagatgaattagttatgaatttttaaagattaaatcggattaaaacacttatatcggttaaaattgaattatgacgcaataatgaattatttttgaaaaggaaaagaaggattattgcgtcagcgggctagggtttcggtggaccgggcgcacgggcgacggttcacgcgaacggacggccgagatcgatccaatccaaaacggacggccgagatcgaacggtccacgaccggctcacggcggacgaccccgatgacgtcggcaatgacgtcaccgacagcggcggcggctcggcggagcggacggctcgggcggcgcacgcttgccggcgaacggcggcgctaggacgcaaacggagggcaccagcacgtagaggacgacgcggcgaacacaccggtgaccaaaacggcggcggaagaacaacgaacgacgacggcgacgaggaggaaacggcggaaaccttcgggttgtcgacggcgacgaagctccggcgatctccggcgacggcgaaggggcggacgaggacggcgacgacttggcgagcacaacggtggccttcccgagcgacggcgacggctgaaacgacggcggcgcacggctggagcggcggcgacgacggcaaagctagggcacacggcgctagagcgattccggcgacgagaggcgaaggcaagggtggcgacgggtagaggagacaccgggggtccttttaaaggggctcggaggcgacggcgaaagcccacggcggcggcaacggcgaaggaaagctcggacttggagagaagaaagccgatccgattcgaactcgaatcaaactcattccaaaccgatttagccgaagattccaaaggagaaaaggtagaggagatcccggagatcatttcccctctttcaattcggccggagaaggaaaggagcggccggatttggaaagcggcggcggcggcggcgcgctagggtttcggcccgaggaggacgacgatcccgacaggtgggccccacctgtcagcgggcggacgcgcgctcgcgcgcggcggactgggccggctgggtcgaggagagagaagagaggttttgggccgactttcggcccaaagccaaaagagactttttaaaacctttttcaatttaaattattccttaaatgcaattccatttattaaaaatacttccttagctcaaataaatcccagaaaaatctaggaattatagaattaagcaaagtatttaatgaaattttatctggccacattttatattggaatttattaattaaaattagattttctcttcaagacttttaaaattatttctaaaaattccatttaaacaacaatttataaattttaaattttcagggtgtgacacatggccgccctaagtcggttcatatcgaggctgggagagaaggcgctacccttatttaagctcctcaaacgctccgggccgtttacttggacggaggaagctgaacgtgctctcactcagttgaaggcgtatctcagctctcccccagttctggtcgccccggagccaaatgaaccctcgctactctacttagcggcgaccccgcaagtggttagtgcggcgttggttgtggagcgcgatgaggacaatcctcattccgcgcacccccaccctgtgccggcttggcccgggagaaagcagggaggagaggcccccgagccgaacgatggcccaaggcccccgacgaccggagcaggccctctccccgcttgtcagacgatgccaggtgcccccgacccccaaggtggcccgagggccactgcgggaaggccgcacctatcgccctctgaccccgaggctaaccctgtgccgactcgacccgggagagagcagggagaagaggcccccgagccgaacggtggcctaaggcccctgacgaccggagttggccctttgcccgcttgtccgacgacgccaggagcctccgacccccaggacggccccgaggccactgtgggaaggccgcccctgtcgtcctccgaccccgaggtcatcggcacagaagaagagtgcaccccgcgaggccgcttggacaaagagcaccccagggatgtggcccctagcgaagaggatcggccccaccgaaaggtgcagcggcccgtctactttgttagtgaggccctccgggacgccaagacccgataccctcaggcccagaagatgctttacgctattctgatggcttcgaggaaactgcgccattatttccaggcgcatcgggtcacggtggttacgtcttaccccctcggccaaatcttgcataatcgagagggtactggacgggtggtgaaatgggcaatcgaactttctgagtttgatttgcactttgaaacacaccacgctatcaagagccaagccctcgccgattttgtggcagagtggaccccagctcccgagcccgtctcagtccccgaggccagctcgggcccctcgcagctgcctcacaccgcccactgggtgatgcagttcgacggctccctgtctcttcagggcgccggtgcgggggtcacgttgacctcgccgagcggagacgtcctcagatatttggttcgccttgactttcgggcgaccaataatatggcagagtacgagggactccttgcgggactcagggtggcagctggactggggatccgccgcctcctggtgttaggcgactcccagctggtcgttaaccaggtctgtaaggagtaccggtgctctgacccgcagatggacgcttacgtgcgccaagtacggcgtatggagcgccattttgacgggatagagcttcggcacgtgcccagacgagataacacggttgccgacgaactctcacggctcgcttcctcgcgagcccagaccccaccgggcgcctttgaagaaaggcttgcccagccgtcggcgcgacccgaccccttaggggagacggacgcgcctgacaggcccccgaggcccgtcggagtccaggcctcgggacccgaggggagcgctcccagctcccttagattgattgcttggatcgctgagatccaagcatacctcacagataagactctacccgaggaccgtgaagggagtgaacgcgtccagcgcatctccaaacgctacgtgctggtagaagggaccctctatcggcgcgcggctaacggaatcctcctgaagtgcattcctcgggaacaaggcgttgagcttcttgccgatatccatgaaggcgaatgcggagcccactccgcctcgcgcaccttggttggcaaagcctttcgacaaggtttctattggccgacagctctcaatgatgcggtcgacctggtcaggcgatgcagagcgtgtcaattccacgccaagcaaatccatcagccggcccaggccctacagatcataccactttcatggccatttgctgtctgggggctcgatatcctgggaccgtttaggcgggccccgggcgggtttgagtatctgtatgtcgcgatcgacaagttcactaagtggcccgaggcttatccggtcgtcaagatcgataagcactccgcacttaaattcattaagggcatcacagcccggtttggagtgcctaaccgtattattatggataacggcacctaattcactagtgaacttttcggcgattactgcgaagacatgggcatcaagctctgcttcgcctcgcctgcccaccccagaagcaacggccaagtggagcgcgccaatgcggaaatcctcaaaagccttaaaaccaagaccttcaacatcctcaagaagcacggcaattcgtggatcgaggagttgccagcggtgctctgggcgaaccgaaccacgccaagccgagcaaccggggaaacgcctttcttcctcgtctacggcgcggaagcggttctcccatccgagctcaccctgaagtcccctcgggccaccatgtactgcgaggctgatcaagatcagcttcgcagagatgacctcgattacttggaagagcgaaggcgacgcgcggccctccgagccgcacgctaccagcagagcctgcggcgctaccatcagcgccacgtccgggcccgatcactctgcgtcgacgacctcgtcctacgccgcgtccaaacgcgtgctggattgagcaagctctcaccaatatgggagggtccgtatcgagtgatcggcgtcccccggccgggctccgttcggctggccacgggcgacggcatagagctgcctaacccgtggaacatcgaacaccttcgtcgcttctacccctaaaggggaatcgggtgtcaggtttcgggctcgggccaaccccgcacccccatcgggcgtgcagggttggccgggggctaccacatatgcatattcttgtttctcttatatctgtatttcaataaaagcattttcgatttcctaagggctgtatctgtgctgttgtttccttttgaaggatcttgacttgaaataggtcactcgtgttcaatcttgccctcgggggctcgggtcggctaaaaccgccaaacggggcccagaaccgagccgtgccccggggcgtggtgaactccgggggggaatcggcaaaaacccacaatcgggtcacccataaccctcagtcaccgcgctcccggcctggccagtctcgacatgtggatctccccaggcactagccccgacccgagccatttgaggactaggacctgggcacgagcccttgttcaagccaagacacgaaaggatcgcggcacagatatcctcgtctcatacacacaacaaatagaattgacacaaaaaatttcctctttatttgattgcagattaaattagtctatacaagaagggggcccgaaggcctcggaagaagaaaagaagaaactatttaaagattggcgggggcctgggcgctcactccgatgcacccgggtcgccagcctcgtcgccactatcgcccactccgccgtcatcgtcctcctcgtcggagttgggggcgaacgcgagccgaggggccgaaccctcgaagctgtggacgatatggtcggcggcgtcccggacctgcgcgcgcgcgccatcctcggtcccgggagggaactcgtccagcgccgtccatggggagaagtcgggatccctggcttggtaactcgccagtacgagctccaccgctcctcgggcgaggtccctcgaagatgacttaatcgtcctctcaagctcctcggggagccgttggagagtcccggctatctccgagaggcgctgggcgaggcccccctggttggcggcgtacttcgcagttcgcccgccccagaggcccacctgccggccggcgcggtctagacgggagacggcgtcccgaagcatgccgggccctacctcgcctgccaagcggagggcctcgacctccccggcggatgagtctagcgcgccctgcagatcggcgatggtgtgttcggcagctgcgaggcgggcggttaagtcgctgtcgcccatggccaccccgccgctgcgtgcccttgcatccagctcccttgcctgcgcctcgagttcagcggcccgctggttcagtgcggccctctcggcgcaggcactttccagattgcgacgcgcttgttcctcttgcgcagcctcgcggagggacaggctgtccgccagccgttgcgccgcggcctcggcctcctcgagagctcgctcccgctcggtgagcgcgtcctcgcggaggcggagcgcggactcttcttcggcgcaggcggcttcgtgcaccgccagtgtgacctcccgaatagcaacggcggcctcgcgatccgccaggtccctctccacggcgcaggcacgctcttctagcgccatggcacgggcctcaagggcttcctcgcgctgccgggatgccacctcggtctccgccacccgcagttctcgggcagcggcagcgtcaaggaccccccgggcggcgtcgagcttttttcctagctccgcctcccagctcccgtattgaaggcggagggtgtcctgcgcctcgttcatcacggtggtggcgatgagggcagccccccgctcctcctccacctccttggcgatctcccccagcaccttccgacgggcttcgagctctgagacgtgccggcggtgtgccttgcggcccacctccaccatggcctccaccgagcgtcgcccctcttcgacacgcgcccatgcggcgttgagctccgcccgctctgcttgcagggcctccacctgggcacttaacccgtccaacaccgtggtgtttgcgacggctaaggcctgcagaaggggttctgcgctcagtggagcaacggaaggcgtggggaagagccgcctcgaagaggatgccgcgcggctcggcccgccgatggacgtgccggactcagggatgtcccccagacctggcttgtcctgagcgttgcccgaggaagtgggcccaagcgatgcgcccgcggcctcgtcgcgagttgcctcggaagtcatcgccgcctcggcctggcgaagtctggcctcctcccgagcggcttcttcagcttggcgagctcggacggccacctgggcagcttcctcggcttctcgaaggcgatccgcggcctcttgccggtcagtttcacgggtcgcctcggaggatgtcgtcgcctcggcctggcggagtccggcctcctcccgaacggcttcctcggtctgacgagcccgggcggcctcccgagcggcctcctcggcttcccgaaggcgatccgcggcttctcgccggtcggattcccgcctccgggcctctgtggtcgccgggtcctcggcctcagactggccggacttggaatggcgggagggacgcgacgggatctcgctgaaacagaagaaataccagaagacaaacaagatggatgagtgaaaactcgtgttgagggaatgaatacggccgcaatgggcgtgggacgaacctgcgagggggtcggttaaacaaccaccttggaggggaaatgaggtttccccgggatggttctgtcccccccgtcttgcggagtcattttttcttccgctccccctcgggatgcgacgtcggcgtggccccctccgggcgcctgctgctggcacgggccgccccgccccctcggggaggagatgggggaggggttccttcctgcttcctcttcccccgggcgtcggcagggcggccgctccccgggcccccgacgcggggcccagaagcacgaccccctcccggggtagattgttcccccctgcggctcccacccgcgccatcgtggcctcgaggagcccgctcctccgacgccccgaccgcctgcatgatggtcaggatggaggcgcggtctggatcgctacagagggggaggactccttgaggaatgagggatgcctccacggagctgagattcagcacccgttggaccactatcttgaagtcctcaggagcccagtcccatctgaccccctggtgggtcctcatacagtcctcggacccggtgtactcccaggcgccccgggcgcgccgctggagtggcgcgatccggcgacgaagatagtcgccgaacaccatggcccctgtgagcccctaggatcgcaggcccgccaggcgatcgaggacggcgtcatagccatctcccagatctaccggcgcccgccagttggaggcctgcgctggaggctggctcggaagtcggaggcgcgcttcgtcggcgaggggggtgtagaaccagtcgctcttccagtcatcccacttcttgcaaaggacgcagggaatgtagcggtttagcaccggcccccgcggctggaagtagcaaccaccaaccaccgacggcggcgacaccggctgtacgatgaagaaccaccggaacagccgaagggatgggcgcaccccgatgaacatctcgcacaggtgcgcgaagatggccaaggtcattaccgcgttgggggtgaggtgcgccatctggagatcgtaaaactccagaacatccatgaagaaagaagaaaatagcggaaccagccctgccatagcaaaagggaggaagaagacagaccgccccgggtagcgtggcgccgggcatccctcgcccagcgagactatctcccggccggtggcagattccggcatgaagcggcgcggcagcccggcctgtctctcgctcacgatgcgggaaggcggcagcacgctaccgtcaagcggagcggagccccgtgccatgacgccggaagaagagatgtttgagagcgagcgcgtgtggcgaaggtagggcacaggaaacaaggagtcagggcgtaagcggcgaagacaaggggaataatggcgaaaggaaggaagcaaatctcttcctcggcgactttatacccttgccaacgctatgcccggctcctcgtttctcgcgcccactatctgccccctcgtttctcgcgcccacgcttccactaatcccattcgcccgtttgcggtgcatgaggtggatatgcggctgtggcagtcgagatggaacatctcgtgcgcgcgttaatcacgctcgccgaccgaagcgccatcatcatatctccaggaaaaacgaaccggcttgtcccgattcccgtgttactcgagtaatgtggcagtcttgaagagaccgctcattattgacagccgagtaaccattgccgatgtgcgtgatttgcgaccgttgggtttctgcccaactgtggagaccggtcccacctgtcaccaggccttaggaagtggcgtcacacccgaccgcttccctcgaggagggcgatcgccctggcataacgccgggggctactgtcggtgacatgggaccgggagtatcatgacttagagacttgaggcagacacgatcacccacgtggcctaaccccctcggggggggggggggtcgggcccgagggtgatacggccgcccttctctttgtcttcccgaggggtcggaccgctcctgtctcggccccgagggccaaggcgccccgaccccttgtgggttttgcgccgcgtatatggggtaggtgagcatagcggggctcacctaaccacatttattgcggtttggacgagcgcatcacgccgcatgtaacgcagtgcagcgcactcgtttatccggtctgtgaccagaccggtcagatcgtgggttaggtggcgacaggcggtctgacgcacgcctcgccccatcccgtcaggacgagagcctccaagcactcgtccctagccggagcggcgtgttagctcctggagatggcacgtggttcgggtcagatatatgcanggcttcatcctaaccattacaggcaagatattgtatgaagaagggcgaaatgcagattgataaactgacacgtggtcgacaagaatgaccgatttgtgaccggtttgacactggtcatgtcgtcagcagacagccatgttcccacgtcgcgcctgttccggcggaagtggaggtaggtgtgggccgtcccatcagaaggtcattcggacggcaaccatacaagtctccgtctgtttatgaaaagataggataagtccccacaaaaaagagagagatggggcatgtggtatccccttgagatataaaaggaggaccttgcccacttagaaaagaaaaaaaaaaacgatcccagaacgatcgggggctggctggcactttgtagcttctccatacacagatccaccaaaacacaggagtagggtattacgcttctcagcggcccgaacctgtatacatcgcccgtgtcttgtgctttttccattctcgcgaaccttccacacacagaccaggagcttagaacctcacccagggcccccggccgaaccggcaaagggggacctgcgcggtctcccggtgaggagccccaagctccatcaatttgagtataggaatgttgtactattaagagggatgtaacgtcgatgtgtttgtgtatgtctcattgctcaaagtgacccatcctttgagtggttttagacattccttttggttgatttgagtagttctctttgtgagctttccatagagtccaagatcatcaaacggacttacgagcaaaaagttatggccgttttgccatgtgtttttcggaaaatccgaaaaaattccggaaagtccgaaaatatttcggaaattccaaaaatggctgcgatattgagattgtcttctgttgatttttggatttgcccgaaatgcatttcggaaattccgaaaaatggaatcttggcctccaacggctagttttgagaggctcgggtattgataacaacggaattttgcatcagactcggagaggtagaagaaagttcgaagcggatttggtgcagaatcgagttgaattcagagtcagactgtgcatcggttggacatcatatcggctaaaaacagagcaaatgcttagcctagccgatatggcaagcaaccgatatggtatgacttggggcttggtttgggcctagactaagataaccgcaattggagcttgattaaggcaattgtatctattaattaggatatttatgtcggtttttgttagagatatggtaagagaccaccgtgtggtcttgtttgtattttatctttaggaaagtttgagtcgtgtctataatggactaagtttgtactcggggtataaatatgaacccgagatcattgtaaaaaagggacgacaaatgcaatacaactttggcgcatcgccaccctttttgttcttcttttcggcgagttctctcgataagaggtaacttgtctcgatgacttgtgctattggagctattatgtcgatttagatattttagtccttctatcatgaccatttgctatcatatgtcttaagtaatctagtcttagtatcccgatttagccctatcgactggttctcgctttagggttctcactgatatcgactaaatcatcttgctagattagattagcaaaggaatctaccaccctaaaaagtggttgccctatcggctggttctcgctttagggttctcactgatatcgactatagcaaaggcatctaccatcctaaaaagtggttaattacttgattgtttagactttaagtttctttacatactttgtaatagtactccctccagaaccacgtagccagcccaaccgacgggcgggcccacttacacataccaccccacttacactttcgtcctcgcttcgtgtaaaagggttaacccgggagtaacatggttggagggaagaggccttataagttggttccactcgtgctaaactagcaagatggtaataaacatgcgcacacagctcacatgggccacacaggcctcatcctaattgggccaggatgtcacatacactccccatcaaaggacccgacgtccccgtcggcccaacttacccagccacataggcaaatgtctaggaacacaccccctaagatcttagcgcacgtcacccccctccccctctaggcaacatcaatgccctttcagttttcaagcctaccccaaaaaccaaagtgcacggggtggatttggtggctgggcatgccaaagtccaagttgacatgatcaagtcaactgacctctagagatcccacaaaacgactaaattttgaaactgggagctacacgtgggacctttatccaatggcctaaggatcaaattgtcataaggatggttcctaagtcaaatgcaccacgagctccatcgcctatctccactccagctcgttcagcccctcctaccatcgaaggcgcaccacaagatgatattgattttgggtttgattttgtggaagctgacgatatggctaacattctcccctcctcagaaaaagagcaaggcacattcttctccaccagcggtatctagcaaaaaagccagtagagggaaaggaaaggaaaggtgacaacctcactcttggctgttaggaaatgatcggcagataaacgatgaagaacgacagatcaatcacagaagacacgagatttatcgtggacaaccctcctaaggcacgagagaaaaaaccacgggcgccagccagcaaatcttcactatataaactcaacatttgctcccaagaagctagatataggcaaggaggtatcagtttgtcctaagagcctagctcagagcagctacagttaggcatgccattggttggagaccacgagcttaccaagatgggtccaacgtaccgagagttacacgggtactacatagagaggtcgaactcaaggagaaagaatagagagatatagatattgggttttcatggcccagagccatttcttgggccatttggctatattttaataggcttcgacaatctctatgacctcttgaagctgcgagcggtggacacaaaacttcttaagtattacttgttgtagccttcggcgacgggcctccgcttgctccgaccgaagttggcctttatatgtgtgtaaatgaatttggatcacaactcaacattggctcccaagaagctagatataggcaaggaggtatcagattgtcctaagagcctagctcagagcagctccagttaggcatgccattggttggagaccacgagcttaccaagatggatcaaacttactgagagttgcacgggtactacatagagaagtcgaactcaaggagaaagaatagagagacatagatattgggtttttatggcccagagccatttcttgggccatctggctatattttaataggcttcgacaatctctatgacctcttgaagctgcgagcggtagacacaaatcttcttaagggttattgacatgattgtaagttaagttggaaggaggccaatgggcaaccaatttgggcatttgacaggttgacccaggaacgatgcaagttcactgcaaatgtgatacatatacaaattaaactccagtaaaagcatcaaaacctgggcacaaaaagatgcctgaatcgggctacattgcaagttggcaacgtattaaaagtagcaggagcagcagctagctagagaagtagcacagtttcaaagatcgagttgatacaggcctcgtatagattccaacccaacgtaaccactaccattctcgccaaacagactgcccgcgctattctgtaggctcagatggatagcgcactgttttctcttctcttattcacctctgtcatggtcatcgctgagccaattatcatcactgcatgagaagctagtaaagaacacacgggatgaaggtagggcttctggtagtcatagtggccaatctcccctggccttaaggagaagaagttttccgacatgcggaaatgtgccactggaaattttccattcttgacagtattgaagacggtttttatctcttggtccttcttgatgggaagttgaggttgggatttgattctgaaattacttgcaacctgcaaaagagtcaaaacttagagtcaaggtaaaataatgaacaatattgtcaggcctaagaattgatcatgaggaaaattaataaaggaatgttaattttgaaagacagggaacgaaaagtggactactggattttgatggaaataccctattgattccatatctatatggaattatggacaagaagtgtagcaagaaatgcagtttgtgcctttgtgggaagaaacaagtaaacaattgagaactggatcaaagaggtactacaacctcaattccttgaccaaagcgcaaacactagatatgaaaatgaaaataatgtttaaatagtttctaaggctactttgttatggcagattcactaatatatgactaggaggacagtttaaaaatagatgcacatcatattatgcttccaaacctttctggaacactagtccagtcttgaaggtttaaactttaattccactgaaatttccaggacaaccatgaggaatggccactgaagcgtccgatacttatgatattgataagaaagtcgacaaagaagggcatcttggtgtgacagaatgcaattgctcatacaaggtgttgcatcttcctgatatgatattaattaattgtttcaagaacaccggaaatgtgtatttttactaacaaaatatggaattgtggttacaataggattatgtgcaggatattcttgtgagttatttttgtccaggagataaacaaatggatgattgcataccaactaattaaaatcatgaattgcagcttggtaacctcactaaaccttacatatgatcctccttttaggccttattccttttgtttctgaaaatcatggtgtggcttgtaactcagaaagcagggcataggaatatgcaaaatacaatcactttgcaggaatatagccatcaactagtgcatattttctatttgcaaaatttatgaacataaacagatgaagtagtgctactgtgcttgatccaagagcgcctgtaatttttgaagtaacaactaaaataaaatgactataaaggcacactttagcctatcaaacaacacatgacatgatacatctaaaacagatattacctcaggttgttgctttcttctgcctaggacaccacattcttctagaatttgcagtacagtagcaagtcgatgattctaatttcttttccaacaact

SEQ ID NO: 66177 - DNA, 2413 bp, Oryza sativa
atacactttcgctctatcatatcatcaactaattctctgaagactccccctctagcagatacactagcagcttcaccaaacatccacaaacagtgtctatatgaaaggaaaaatgcagccaatatatatagctgttattagaagctaaagtaacatatacagccgaatcaaattttgaattcaatatttttaacgaaccttgctttggtaattgcagcattgatcttttcaatctgaagaatcgtgttctcgtctttgaaaagcattgatagaataaccacttgataagtttctccttcaaaactatcagcagactcaatgtgcacattgattttattgtgagaagcatatttttgtctgagagaacttttgatttcactaatattgctgccacacagacacaggacaccaacatcaatcacttcagtatcttccagacctgaacaatttttttacaaagaacgtaaattaaggtctttatagtattgctgcaaaaacagcctcaaacaactacaagtgacagctatctagaagacataccttggaaatgatctcaagcatgtattggattgtggcaagctcaatggtgtttttctctttgcagctaggcccgtctgttccagtgacatcaataaagcaataattgggaaatttaagacctttgaattttttgttgtattcaggagaaatacagtcgcaccatttgtgattctcccttcataaaatttctcattgcggaactgccagattgatggatgaattgcatattgctcagtgagcatatgcttccgaaaacccaaattgagcaatcttttgaaaggactcatagtaaacctggcattttcccgtacctaaccatttcatcaataagatatatcatttgcatcagccagcattaatattgtctagtttactgtctagtcatgtaaacgaatacactagaaaatcagaaagaaaagattaccttgcttggctgcaaattgaagtcgtcgcctagcatcaaaatgtgtgtcaccagcaggcgcaatggaataatgaggtcgcattcgttgattttggctgcatcatctactattaataaattgattggttccatagctgcttcatggagccgaaaagttgactaagttgtagaaatgatgactttagcatgtttgatgcagaagtcctcaagaaacttcctttccacaaactttggtaatttgagtgagcttctgaaacttcgaatgaaatccacgcattgcagccttaaataattcagtttagaaggaactgaacttaatccaaatgtccactggacacgtttgtcgcgtaacctcccatgacataaatcctcaaaatccttcgacaagctcaacaagtttttgttatgtcattggcaatatcaacagacaaataaatttctgaaaatttttcttttagatttgtcaaccattcttttctcatgagaagcttggtaaacttgtccttgaatgaactcaatgtgaacacgagaagactattggtgctacatatgattcttgtggtctcatgatcacatttttcagcgcagtatggatctagattaagtagcactaacaattcatgcaaccatattttaaagagagaatctattctataccactaagtttagcccgtgtttagttgcaaaatttttcttcaaacttccaacttttccatcacatcaaaactttcctacatacataaacttccaacttttccgtcacattgttctaattttaaccaaacttttaattttagtgtgaactaaacacacccttagcaaagttgagctacaaaccaaaccaaccctcgtttgcccaattggatttcagcacagttggtgtcccgttttgattcttgaggcccatgtagcaaatactactcctaccagaggagaaaaccgtgaaaccggcatagctcctctcaaaaaacaaaaaggaggggaaaaagaatcacgacatatagctgatagctccggtccaaactccaaacccggccgtctttgctcgaccggagcggagcgcagcgcagcgcagaccagcggcgcggacgacgcgcgccccctctggatcgccgctcccccgcgcgccacagcttccatccggcgactgcaaggccgcccaagccaagaggttattattcgtcttccgttccatgattctgattttgttttttttttctttgcctgaagatgattcgcttcgctggatattttagtagtttctacctcgctgtttattggattcgttcaattcgtctcctccttgggacgaaattctctcgtatgtggttattgggacgaaattcttccgagtattccctcaaaaaaaaattcttccgagtagcctagggtttggggaaccttttccgcgatttttatcatcgtgtcgattagttctttatgtattag

SEQ ID NO: 66178 - DNA, 1380 bp, Oryza sativa
ccccaccgccacaacccatctcttttctctcttctttctctcttatctcttctctcttcctccaccatcgcctctcccctcaaccgtgcgccggctgcgtcaccacctccttcgcccctcggcgtcctctaggagctcggggtcgccacctccttcgcccaccgtcgacctccaggaggtcgggccccgcggccttcaacatcgatgccgccgccacctcctgaccgccggaccgccggtcaccgcggggccttcaacatcgatgccgccgccacctcctgaccgccggtcaccagatccagccgccgatgccttctcccgcctcccggctgctaacgcgcgccgcctgccttgccaggccaggccaggcgagcgagcgcgcgcgtgtgtttcccctcttctctccaccacacatgcttcaagtggctaggagggcatcctcccttttaaggaggtccccttctcctagaataagcaaggtggtactaaactccacatgcatgccatcccatgaggtgggcttttgtgattttccaaagaattaatacttgaatgggccttagcccatctattaattccaacaatcccccaccaaatctcaaaatcccactgagatttgccttttccaatgtactgtttatataccagcggttcgatggagaccgattaaggttgaacatccatctagaacttcaagctacacttactcacaacttgaacaatggactacgccttgaattgcaagtcttgtgcaagcaagtttcactcagagtcttatctggtactagaccgtctgtagactacccctcgggtggagtgtataagtcatactcctaggtctttagtaagcttcctagaagattcacccaaaatcttcatagactgcgaccaacaagctcacaaaggtgagttctttcaaaaatgctctgcaggacaacatctttgctaattaaagccaacagaactcattaaagcatagccaacctgccttgcagctcacgagagtatatgcatcttcacttagagagggtatatattggtactctcctctagtttactgatggtttgttcttcccaggttctaattcacaggatctccaatcacatagaatgggttaccaccatagtataactcacatgggtctcaaacccatctccttcgatgcattgtctatcacatttcgtgatagtccctttgtgaagggatctgccaggtttctagctgtttggatgtaatccaacgttataactccagagtttctcaatttcctgacagactttaatcgtcttttcacatgtctagacgatttcatattatccttagaactattcactttgacaattaccgtttgattgtcacagttcaaaagatagccggca

SEQ ID NO: 66179 - DNA, 6432 bp, Oryza sativa
ctccacataatgggattgcaagagtgtaatcccattctcacctctaattagcttaatgtttaggataacatcagctactcccaaatccttcatatcaaaattttgagacaagaatgatttaacctcatttatcacctaaaggtttgtcccaaatatcagtatgtcattaacatacaagcacataataactccctcacccccaccatggcgatagtacacacatttatctgtctcattgactgcaaagcctacggatgtcaatgttttgtcaaatttctcatgccattgcttaggagcttgtttcagaccatacaaagacttcaataatttgcacactttgccttcttgaccttcaactacaaacccatcaggttgatccatatagatctcctcatccagctctccattaagaaaagttgtcttaacgtccatttgatgaacgagaagaccatgtgaggctgctagggaaagtagcacacgaattgtggtcaatctagcaacaggtgagtaagtgtcaaagaaatcttcgccttctttctgagtatagcccttagcaacaagccgagccttgtacttttcaatagtaccatcaggcctaagcttcttcttgaacacccacttgcaccccagaggtttacaccccataggtcgctctgtcacctcccaagtcccgttagcgataatggaatccatttcactagggacagcctccttccagtagtctgcatcaggagatgcatatgcttctgaaattgacttaggagtgtcatccacgaagtacacagtgaaatcatcaccaaaggacttagccgtcctttgtctcttactccttcgaggagcttcactgccatcctcctcagtgacatgttcatgtgtatattcagtttgttctggtggtgtgattgaactgggaattatttcagaaggttggctagaactactatgtgtatccttcattgggaaaaagctctcaaagaaggtagcatcacgagtctccataattgtaccaacatgcatgtcaggtacctcagatttaactattaaaaatctataggcaatgctatgatgagcatatcccagaaagacacagtccacagtcttaggtccaagtttgcgcttcttcgttattggtacattgactttcgccaagcacccccatgtgcgcaaataacaaagtgatggttttctcccaatccatatctcatatggtgttttgtccttatttctgttaggaactctgtttaacacatgattcgaggtcaacaatgcctccccccaccatgccttaggtagtcccgcggtgtccaacatggcattcaccaagtcagtcagtgtgcggttcttcctttcagcaatcccattagactcgggagaatagggaggcgtcctctcatgtatgatgccatgttcctcacagaataagtcaaactcgtttgagaaaaactctccaccacgatcagacctgagtttttttatctttctgtcaatttgattttcaacttctgccttataaattttaaaatagtctagagcctcgtctttcatttttaacaagtacacatagcaaaatctagtagcatcatcaatcaacgtcatgaaatatcgttttccacccttcgtcaacaccccattcatttcacaaagatctgaatgtaggagttctagtggtgccaagtttctctcctcggcagccttgtgaggcttgcgaggttgcttcgattgcacacaactatggcacttaaaacctttgacaatggaaaacttagaaattaaacacatgctggaaagccgagacatcaagccaaaattaatatgacataaacgtgagtgccaaacattagcctcatcatccacactgccacaaatatggttcacagacttattgtagaaatcagaaagggaaaagcggaacaagcctccgcactcataacctttaccaataaaatatccatgtttagacacgactactttattagactcaaaaaccaacttaaatccgtctctagtcagacgggagccactaacaagattcctgtcgatagaagggacatgctgcacgttcttcagttgcacgatctttcccgaagtaaacttcagatctaccgtgccaacaccatgaacaggagcatgtgacccattccccattaggacggtggaaccccgtgcaacctgataagaagaaaacaatgggatgtcagcacaaacatgtacattggccccagtatcaacccaccaattagtagactgattaactgaaaaaacagtaggtaaattaccatacccgcttccatctccagtattgccaatggtcacattagcagacttagaagtctgccctgcaggtgccttcatccccttgcgctgtggacacttcctagctagatgactaggttggccacacacaaagcaagtcctctcatcctgattaggattgttgttgttcttcttctgcttcttgaagttggtggtctgttgagctttgtatttccccttgctcttgttctgggccttgtgcacaacattggcactggactgcccaccatcgcccttagacgcggcgtccttttcccgagctttctcctcaacatcaagagacgctatcaacccctcaatggagtattcctgtctcttgtgtttgagtgcagtaccgaaacttcttcaagatggaggtagtttcgcaataatgcaccctgccacaaatttgtcgggtaagacacacttaaggagttcgagttccttagccatggtttgtatctcatgagcctgttcgactacagaacggttgtcaaccatcctgtagtcatgaaactcctccatgatgtacagatcattgctagcatcagtagcgccaaatttagtattcagtgcatcccacaactccttagcgtcggtcatgtgcatatacacctcgttccagacgatcgccaagaacgctaagaatgcatcccacaaagagagtagtggcttcctcgaattgcttctgctgttgagcagtaagaattccttcaggtttgccagtactcacccagaagcatttcatagctgtcagccacatagtgaccctgatctgccatctcttaaagtgcacaccggtgctgttgagcagtaagaattccttcaggtttgccagtactcacccagaagcatttcatagctgtcagccacatagtgaccctgatctgccatctcttaaagtgcacaccggtgaatttatccggcctcagtgcatcggcaataccagccatagtaaaatcacagcgcctataataaggtttttggattgttgagattatatgcatataatgatttaatatattccataaataaatcatgacattgcagatgtaaactagcatgaacgcatcattagatctacacatgtaaactaagagggcatcctcccttttaaggaggtccccctctcctagaataagcaaggtggtactaaactccacatgcatgccatcccatgagatgggcttttgtgattttccaaagaattaattcttgaatgggccttagcccatctattaattccaacagcttcatcgacggaatgcgtcggagaaagcggcggctccggcaactccgtcgctccgcctcctcgacccatcggctccgccgtcccccgcccatgacgctggcctccatgcccttggcctcctggaaagagtgacgggaaggacgggaagaatgacgggaaacgcgatggagtggcatggattcaatttttcaaaattttagtggcacctagtcgatatcgcgaatagtattggcatttttctaattttccatatttgcagtggcatggatctattgatccaattaacccaacccttagttaaaaaagaggagaggcgcaaggaaagcccgatggtatgcatagggcatgtgacatgcgagggctaaggattcgcagatttattttttaatagatagatatacatctaatagtctacgataatgagtccaccgttttaagtgaaaattaaggatgtgatgttttgctttttttttctcagaatttataggattttcttaatttaatggtgtgccatgtagcgaatgaggagtgtttgtaggagtccatgtggtggcttagaagtgtttataggacgtttaatggaattttagtatataatagatcacgagtttacctccagtttcagtccagaaatgcttgtccactcgaacaatcgtcctttgtctggatgagttgggttgtaacagcatgcttgcatttatggtgtaccatggtcagcaaggaactgaatagagcagtggctgctagaggaacgatttctgtccagtggtttctgtacatgccctttgaagcatggcatcagaatgcatcctagccatgaatttggtaacagctaaacatgctccagtgctatcgatcagtagtagctgcaatctctttctggatcatcagtgcaagacatactcaaggcaataaccaaattcaaaataacttgcaccaaaagagagtaaggtggatagacttacctaaatgacattaagtggaagtactgtaataattctattaactttcttgttcagaatgcaaaatgcagagattcttcgacatccataaaagctttccatatcatctcagaagtactctaattattctccataaaaattcagagatgatatcaattgttaatactttcggatgtcggcaatatcataccaattgccaagaatttcagtcaattggttgaggagcatgcctgcctgctctttcactaacatgtcatcttgctcaaacagttgctgttttcaccctttacacttgcttatccagtcatagttgccttaccagtatggcaaatagaggaacaaaaattcagcacgcatgcaagcagtcgagcacttctttctatgctttttatataagcattcgtgtatctacctgcatgctctgcaacttaacatcatgttctgaaaggcacctcaaccatgttgcacatgtcttcctcctctccactaatattaaccaatagacagatatactatcacagtatatatactctcactgagattggttgtcccctttatatttcaacacagcagtttgcagttccatcttgaatcaagacaaacacaatcaggagctagaggctctgccctctatctccaatgcctattcggctgcatatctttgtcaattctgcaaggcatgccatcaactcatcggcattcatttgtcggttcatcgcataccatcttagcccgcttttgattcacttatcctattttcttatcattgatatacttggttttgtttccttggtggtgctcaggccaagcaaccacaagtacaatcctcgctatgttgatatgtttttcctatcgacatctgcagttacagtcataggattagccaccatacaaatggaggatctttccagctctcagatagctatcctgactctcttgatgttcttagacagtaagatgttcctttcctttcttggccttgtccttgagtcaagcaagcaaaacaagcatgatcctgaaaaccgtagagtcagttcagttactgtgtgcaagcaatcacagctagaagaggcgactccccaaactccatccatgaactccattgatatcaagaagagatgcctcaaatacttagtgtttgtggtgctggcatacatgatcattattcttgtcactggttctctattggtgttcatgtacatagctcatgtttcaagtgctagagatgtgctaacaaggaaaagcatcaacaaagctctcttctcgatatcggtcacagtctcctcattcacaaatggagggttattgccgacaaatgagagtatggttgtattctcctcaaacaatggcctcctgttgctactcattggccagattcttgcaggcagcacactgttccctgtgtttctgaggttggtgatatgggcattgagaggactaagattagcaaaagctgaagagcctgacttcatgatgaacaacagcagcgcagtaggtttcagtcacctgctgcctaacttgcagacaatatttcttgcagttgtggaggttgcttttgtagccatgacagtcatcctcttctgctgcttgaactgggattctgtagtgtttgcagggctcagctccctccagaagataaccaatgcattgttcatggcagtgaatgcaaggcaggcaggagaaaattccattgattgttcccttgttgcgccagcggctttagtactattcatggtcatgatgtgagttcctctctttcaagttcttcacagtctcaggcaacaatcagaagagataacataacatggttgcttacatttcttaggtacactccatccttgacaaagttgttctcagcatgtcaagatcacaaacgaatcggcccagaaagcgacgatagaacaagcaaggggaaaccattcctga

SEQ ID NO: 66180 - DNA, 1352 bp, Oryza sativa
agacaaggcaatcaagttgggagaaacctgctgagttgatgacaccgttggaggttagttgtgctgtgtgcttatgtgtcatctacacttacctttttgtagatatattcttcggttaccttaattttttatatgctaaacatgtcatgacttgttacatttcccttagggtgttctgtctatctcttaaaatttatggaatggtctgttctacttccatctactttacaatagtccatatcctaacacgcactacaaaactgcttactgactcatctccactttgaaaggaagtactaaacactcttcggttgtggtttcctaagcaactgtcatgttggtcacatacatggcatcttggtcttgttaagtttaagttgctaaattaattggtaatccatctaatagaaagaggagagatataggaggaatagtcaaagagagatttgtgtttatttttacatgaatttcctgaatatgtgcaatgacttcctttcatggcttatgggcttttgctgacttgtctgatatagccaccatttggattggtattgctactaccaattccaccatcaggttgtaaactgcactggattttaaagttgaggggcttattcaatttggaccatcttgaaagtctaaagggggtgaattggaattcatcactatattgactacttctatttccagaatgaactctttactctttccacgagaggacaatgcatgttcttagtttcttactgaaatgatgtatggaacgtttagcgtattacaacttcaactttatctttgattctgcatctttgctatgctaaaagttacgtgttcttaattatttattttttgatgtaacagagagctgatgcctctactgaatggaaagaatttactacacaagagggtcgaaagtaagttcttgatggaacacatgctatcacatctgtatgaagttaaacaaatcactttcttgccggttcttattattctgtcattccaggtactattacaataaggtgacaaagcaatccaaatggacgattccagatgagttaaaggtttcccagccttctttgatgtttgattttatatttgtttattgaatattgttgtatatctataaacaattttttcttcccttttagattgcgcgtgaattagcagagaaggcgtcaaatccacgccctgatcaagaaacggaaacaactgctggtgctccttctggacccacttcaaactctgtggaaccttcttctgtacctgctaaccagtcctccacaacgattatgggtgctccaagtacacttgatgcagcagcgaactctgttcctcctggtgctggcccttcgcac

SEQ ID NO: 66181 - DNA, 4195 bp, Oryza sativa
  unsure (1)..(4195): unsure at all n locations
tcgtgaaagaaactaaagatcccctaggatagctcaagctggtttggtgcttcaaaattaatgtgaaacatatgttctggtccttcaaaattactgtgaacttacgtctgataaatcctgtactctggtaacaccgatacttctatgggagtcaatagtcatttaagaacctaataaagtatgagattgtaagaaaaatgtaccacttattttctcatgccattgcttgtaattttaacaatgtaatctcaatatcatatcatctccatatttttcctgctttgaaatatgtgtatacttgctgtatccacatttttcaaaaatttcgtatccccgtattgccgtaacagtatcgtttatctgtgattcctaggattgattggatatattctacatgttaagtagcttaatagtctgagcattattcccacactggtgaattttcagttgaaaatatctattatcaccatcctgtgcaatattgccatgatacatgctacttcttacttggaacgtatgttagggtggacaattgtacaagaattgctgtaatacaaatcccaaggtgtgactcaattcggatggaagcaaacactgatttttttccttacatggatatgtatgctttgtttaatacgaaaagaaaatatgcaaaatttcacaaaactacagatactttgtccaaattatcgcaaaactattgatttaaggtgatatatatcacaaaactacagatttaacaataaatttatcacaaaactacaggtttaagactaagtatcgcaaaactacaggtttaataataaaattgtcacaaaactaaagattttatggtttaaatccttaatactaatgttatgtttgagttataaacgtccaagttttgtgattaaatatgcgctaaacttgtagttttgtgataactttgttactaaatctgtagttttgcaatactccaccttaaatctgtagttttgtgataaatttagtattaaatctatagttttacgatagcttggtcaatatatctgtaattttgtgaaatttactccaaatagagaaatatcatttgctacatctttattctttcatttcaagtcttggatattttttctggggttagcgtgagttgggataaggaaatcatcctgcctactccctcagtgaactacaagggtagctatattttgggacgtagggaatagtgagtggtgacagaagcatgtcaatttgagtttaattccttagaagaaatttaggcctacttagggttgggctatgccgacggtcacagttgtgctcttctaagtgcctacacatttgcatttgatatatctcactctcgtgtttgtgtgtttgtgtgtctgtctgtatgtatgtgtttatatgtgtatacctgtacatttatgctgcttatattctctgtaggaggccaaaaagaccatggcagttccagggaagatcaatgttactccagtagaagacaaaactagtgaagaagaacctgtgacctatgctaataagttggtaagggaaacttgcacatattaagaattgactgtgcatttcaagttttaagctcatataggtacacttttcttttgacttataggaagctaaaaatgcgttcaaagctctgcttgaatcatcaaatgttgagtctgattggacatgggatcaggtatgtaactttacttgaatcgatatcagttaatgaattgcttgacactgatataatatgtctaggctatgagggtcatcataaatgacaaaaggtatggtgccctcaaaactcttggggagaggaagcaagcttttaatgaggttagctctttgttgtacgagctagaatctgtcttagcaattacatggaatgttgaagtcttctattgcattgttttattcttcacttagtggttcactgaagccaggcctatttgtttttgcagtatctaaaccagaggaaaaagcttgaagcagaagaaagacgtatcaaacagcggaaggcacgtgatgattttttagctatgctagaagtaagatatctaactcatgttatgtcccttactaatactcatttgtcttgactatactgactattttactttctgctatgtgttttaggaatctaaggagcttacttcatcaacaagatggaggtatgcgccactgacttcaagcttctattcatacataataacagtcctgtgatagttcgatgcaattttgtttaccaaactgttagtttctagttgctgtttacattgtaactttttgtgggggtgctggaggatgccttatgtttgttcgtgttcaatgttatgcagtaaagcaataactatgtttgaggatgatgaacggtttagtgctgttgagcgtccaagggagcgtgaagacttatttgagagctatcttatggaactacagaagaaggttctgtcttatagaaattctgttccccttttaaattttaattggtgttgggcttatctgtttgtagaatacacttttgggaatcttattctgcaatttcttagtttttttagtatgtctaagaacaaaactagagatttttctggcatgacttgactgtatggatcaagatctaagtatctacgatcatcctgttataggaaagagccagggctgctgaagagcacaaaaggcacatagcagaatatagagcttttctcgagtcatgtgaattcataaaggttgtttcattactactcctattaactgtttagtcaattagtatgcaaacagcttcatcaatgagaaacatatatatttctgtgctgcagacaagtacccagtggagaaaagttcaagaacgtcttgaggatgatgaacgctgttcccgacttgaaaagatcgatcgactggagattttccaagttagtatttttttagatctgcagtgactttctttattttgtgcttcaactatgcatttctgtgcaatccaggagtatataagggatctggagaaagaagaggaagagcacaagcggatacataaggtttttttggtcacataacgttcacttcttttttttttgttcgatgtcttgaaccactatggatgtttaatataagtcaattctgtcaggaacaagtaaggaggcaagagcgcaaaaatcgtgatgaatttcgcaagatgttggaagaacatgtagctgaaggaatgcttactgcaaaaactcgttggcgtgattactgtgcccaggtcattgaaatcgaccttttataaatacgattaaaatgacaacattttttttcttgattcataaaattatcgatttacaggttaaagattcctctgtgtacttggctgtggcctcgaacataagtggttcaatgccaaaagatctgtttgaagatgtaatggaggagcttgagaaacaggttggcctttaaaattcgtagtatactcttgcttatccaatgtattaagtcatcaatgtgctatagttgcctctatgcctgaatttggaattgcaattatcatggcaagtaaaatctgtagtgaatagaggtggccagcaactatggcaaaaacctacatcttggtcctgctgaaagatgttaattctatccattctcatgctttgtaaaacacaataacaaattttatttccatcatgtcacaaaaaagcacgagtctacaatattttcatctcatcacaatcaccatttaaattctggaatatctgttattttttgttatgcatgaacttatgtacctaccatccttttatctcagtatcaagatgacaaagcccgaattaaagaagcagtgaagtctggaaaggtaccttttattttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 66182 - DNA, 1102 bp, Oryza sativa
tgataaagtgcttgtagatcaagttgtggatagtaatatttataaaataaattggaacagtattcaaatgcataaagacatcaacactgatgtcagggtgcagttgtcaacattccaggaaatggcagcgaattgaataacctcttaattgctctggaaatatgttgcacactaatgaacttagaacaaatatctcttgtaaatagagctcaatattgttgttaaccgagtcagtacatgattaagttaaactgactagtgatgccttgcaatttgacatttaacctttttttaggaaatttaccggataaggctcccaggtaaaccaacagatattggcgagggaaagcctaataatcaaaatcacgctataatcttcactagaggagaagcgcttcaagcaattgacatgaaccaggtatgcaatctctgtgtaaaataagtcccacttagtagtttatcttatattctctgttgtgcaggataattaccttgaggaagcatttaaaatgagaaatctactggaagagttccttattaaacacggaaagtctgaaccaacaatattgggtgttcgcgaacatatctttactgggaggtttggcttttctttttttctattaatcacctctagactttagcgcgccatcaattttgctgatagtgtatttatttttttaactccttttgtactaacattatgttgttcttacttgacatatagtgtttcatcccttgcgtggtttatgtcaaaccaagagactagtttcgttaccattggacaacgtgttcttgcgaacactctcaagtatgtctcctttcaccttcaaaattatattggccaattcattttatacaacttctgcaatatagtcaccatattgcacaaccttaatgtctgcttgattcatattcctttcatgttgttggcttctcctcaagcattcagtatggttttgtctaagctttgatcctatctaattcatggcagagctcctacccacaaatgtgtagctttcatattattggattttgataactactaaatgttccatggagccataaccaaccaccaaactagaatatttttatgagttacaca

SEQ ID NO: 66183 - DNA, 14661 bp, Oryza sativa
ctgaaactcattttaagccatcactgcagtatattataaataaccatcaagtccacataaaattataataaaaaaagatatcttcattaaaataagacatcggaatacacatcacctatactatcaatatcactctagcttgcattcacccataaagcagttctggttcatgcctctcaatgtcactctagcttgtattcacctttaaaatgtcactccagcttatattcgcccttgaagcagtccggttcatgcattgggcgaacttagcatctcgggtaggatcgaaatagatataatcgtccccacacatgcctactctattgcctgcgcacttcccacaactaatgattcttgcattggtcagcttatgagtgccatgcgccatttctatgaagtccatgtcgccaccacaataattttcaatcggatgcgcaggatgcataatcctggtcccttcatattcacaataacaacaacgagcttctccaaaaaagacaataccaaaaaaaggttagcatcaaaatacaagaaagaatcattctataaattatatttaagaaaaggacacaatcatatatcaaacataccgtgttttgattttcttgagacggtacagcaaaaggatacatcatcatcatcattactgaattcagcaaagaataacttaagtccacttccaacttttggtcttgccaaaaagtttacatgtgaatatggacatttgaagtccaagaagttcatctggctgcccacacgctcatttgcaacacagattacttgaagatcatatagatatccctacaaccatgaaagaagtgaacttgtagaaaaatggcaattataatgacattatgaaaaggacaattacacactaaacatatactcttgttatcctaatcaatagggaagaagtgaacttgcaaaaaaaataaactacaatggcattatgaaatgggtaattccacaccgaacaaatcctttcatcattatcctaatcaaatcattagggaataagtgaacttgcagaaaagtgcaaccataatgacatcatgaaatggataattccatgctaaatagatactaaaaccaggaaagaagtgaacttgcataaaactgcaattattaatttataatgacattatgaaatgataattcggcgataacagatcctttcattatctcaatcatcaggtaagaattgaatatgcagagaagagcagttataatgacaatatgaaatagataattctgcactaaatatatattttcattatccaaatcaatagtctaactagagagcaatactttgaaagtagcacataatatggaatggaaagtactaacccttttccttagtgcagcttcaatctttctatgaaaaaaaccctgttgagtgacaaatttttccttgaacgctataaacatatccaatgcatctgtagacagatcaacaattgtctccaaagatttagcagagatgcagtttgaagatggcaacaacgtagctagctgaagaacatcattcgaggaaagtggggtagaagcacgctatagtgatttaacggcagcctggcaccttaggtagagattgagtggaaaactggtacataagcttcgggctcaggatgaaacgatgcatccgctgcagccttgtaggcactgacatcccagctggatttccacccttccgctcctgccatttcaattgctttgcgaactttcagattattctttagcagatatatcatggcatcatgctcagaaatctcaggaatgcatgtaagcaatagcttgataaggccacgaagggaccgggactccacacgaacaaaggtggaggtgcagatcatgtccacctcaagtttctccatagcagggaaagtagagtcataccagagagtgttgacgatgatgttggtcacacaactgaatgggccatagcagtaaccaccgttgacaagggcacggtggtaagtggtaacgagcccgaacatcttgcataggtaatcgagagattgccttgaggtacttggcatgaatcttgtcaagtagaacagcccgaagtgatattgtcaaaccacctggcaccttctcacaattagcatcaccactagcattagcatcggtatggcagttacgaagccgccgttcatcagcaaaaatcattggattgtcagacttgtcaagcatgcgcggcttcttcttcagcattccagacagcaacaagatcttctcaacagacaatacatagctgcgatctgctagcacggtctgggtgacgaattcaagatgagacgccagcgaaaacgaaccagcaatgaagccgtcgacgtcaggctgcctcgccgatgatgctgcgcatgtaagggcagccctggcagcgtaggaggagatgtggaaccgttcatccttggtgttgtagcagcgatcaagctcgatgaggcggacggcgacgaggaggtcggcgttggcgaggcacaggtagcggagcgcatcccaggtggggaggtagcggaagtaagatgtgaggaaggtgatgaggccctccagcgatcgctcggcgatggttcgtgtctccggcggaggggagggggcgtcgccggcggcatccgacctcgctgctgccgatggcgtcttgatgcttgccttgcgcttgtgcttcttggcccggtgatcgggatcaggcttgtcggggaggaaggaggagagggtgttggcgatgatgttggtggtagggtcgccgaagccgaagcagacgccggcgccaacgaggcgcggggcaagctccggcaagtcgtcgagcggcagcacggcgagcgcctccttgtagtagccgtggatggtgcccaaaatcacggatcggttgtgggcgattccatccgaattgccgtaggaaacatccggcctcccgctgcgccgccgtcggccatccatcgccaggcggcgattagggtttggcctcgacgggggatttgatttgatttgatcttttctttttttttccttttcttttttcttttttgtcctttctccctcgccccatccggcctaatctccactcgacacttggacagacaaggtaaagtatgacagagagtgagtgggcctaaactgggacagattcgaggaataggagttctggatgggaataagttcactttgaacctcttaactagtgactgaatctgatccgtattctttaattacaataccggatatcttgaccctctaactattaaaatcggtgtaatttaactccctcgatagctttggagaatgatttcgctgacgtggtgtctatgtgccagtattgacttggctttatgatattgacatgacgcttaggtggcactacaattaaaatgggacatatttgtcattaaaaaagaaaaaatgtggggcccactggcatgtggcccccttgtcatcctctcctcgatccttcttcctcctcgctctctcccttctctgtctgtatctttctctctctttcgatcggtcgcatcgctgcctgccaccgagctgcgccgtgctgccgcctgttgctgccctctccttcaccttccgccgcatggggcagcacgtggatctcagcggcggcctgctacgggagcttgagctcgtaacggctccaaggtgtggcggtgctacgcgctcgtaacggcatgccaggaggactgcgactacctccactacctgctcctcagcgcccggatggccgacgagctccgcgcagcacgagattgacatgtacacctgcctcatctatctcatctctctcgtcgacagcagcaacaataatcgtcgtgtcacagtataaagcccttgtttcaacctcctctagtaataagataatttgggtggttcatctcaaaactgaagattatggcgtatgaagatgggcgagcaattactaatctcttttatgatgattcatctgatcgaagcgatatgctcaagtgatcatgtcaatgtttctgttgtgcacttgtacttgaatttctcctttgacgggagtgggctccatcacacgacggtgtcgagcggctctcccaactccatcatgttagaaaatgatagacacataaaccataaaaaacaataaatcaatcataaagacataagatttaacatggaaaacccttctaaagtaggagagaaaaaaccacggtatcccaaacctccggcgacgggcctccgcttcgctccatttaaagctggcctttattcgtgtgcaaatgaatttggattacaattcaacacttccatcccattaactcaatatttgaaactttttactcggattggaaaactttcaaatcaagattttaaaacttttaactcggatttaaaaacttttgactcaagatttatttaatctttgagttaatgtttttaaaattcgagttgagagtttcgaaatttgagatgtaagttttgcagtttgagttcaaattttaagctgaaagtttcaaatagaagtttttaaatttgagataaaagatctaaattgtaaaatacattaaaaaacagaaaaaggaaaaacatgcgctggagattaaaaaaatcatgaaaaaaggaaaacgcaccggaaagttggggagcgtgcaaaaacagcaataaaaaaggaaaaatgcgcagggtaggagcacctgctggcacgtacacgctagatagcaatcctctctcctcatttagccaaatcgcaagcataaacataacttataaaaatcaacattggcttcatgtacatagaaccaccaccatcacgagataacgttgccaaaaatattgatacagattaatgcagcaaaaaatacttatatttcagatatgaagctagagttttggagttttaaaaaagtaactgcaccctttgtattttgtggagtagattcacccatgttacttttaaaaaaatgtggatatttggttcggttcctacttcatcggataaacatgccctcatgtggtagatgcggcaggagtaaaaaaagaagaagtaaaagaaaaaactagaaaatgcagaaaaacaagagcagattattatgaatcttgacgaaagcaagggaaaatctaaaaaaaaaaatcatgaaatgatgagcatacatatactgaattttgtcacgaccacatgtccttatctgaccagtgggcccacgtggcatagagagagagagagagagatgcacttctttccgcccgttagacagattccccccatcgttccaactccctcaaaccccttcccattccggcggctctccccgaaaatttgaaatcgccgccgaaaacccccccaaaaacgaaaccgactcaaaaaaaaaaaaaatcccccaaatcgacattcctctccgcggatcgatcggccgcgaagatgccagccgccgaccccgccaccgcgctggcgccggcgccgaccccgccgccggcgcgcgggacggcggcggggccgcggctgctgctgctgcagtcgccgccgcccgccttcccgctcggctccaacgacgaccagctcgagcgcgcccgggcccgcgccgccgcccgcgcggcctccgtccgccgccgctccctcgccgcgtccctcgcccccagggcggcggcgcagcagcagcacgacctcctcaaccgcgaccaggtcatggacctcttccacaactgcatcaagctcgcctccgagaacgtacgcgccttctgtaccttaccccccctcgtcgttgttcttccccaccgccgcgccgaaaccctagggccactcgcgcgcgcctcgtattgagttcgccttctttgtgtttttgttttttccccctcttttccgatggggaatttgagcagaaaattaaccagaagaacacgtgggagctggggctcatcgaccacctcagcgagatcatccaggccggggaggaggacgacgacgagaccaatttccagaaggtgcggctgtgctgatttcttccattttcgaccttctttctactactaccgtgggaggagatttgtgacctcttctgacttcgattgagaaatttttttttaaccattttcttgtgaccaggctagctgcacgctcgaggcgggcgtgaagatttactctttgcgtgtagattcagtgcactctgaggcgtacaaggtgcttggaggcatcaaccgtgctggaagaggcgatgaggctggtaaatacccactagagtttcatagcgctttccaatttttactgtagccattcgattgtaattcgattttattcatgtgagtcagcttcgagttgcaaaagtattattagtattctgggcaccactaaactgtttcagttaaattcaaactaagtcaacttacatgatagaaatttggctttgtaccaaaaaaaatgtccatctataaattgatcgaacaataaatagaaagatgttttaagattttttttaagaaatcaagtccctgtgagaaatggccttttctgacttttggttcattggagcactcttcagttttcacgatcatgctactactgtatctcaaaaccttagatgataaatgatgcacgaggattagttgaattgcatttgatcatttgttttatttgttaggccgtgtttagtttcccccctattcccaactttccatcacatcatatcacatcaaaaactttcctacacacataaacttctaactttttttccaaactcccaactttcttcaaacttccaacttttttcaggaactaaagacacccttaaggtaaaagttaggcagtaattctgcaaattatcataaatacacctttgttgtgcctatagctttcccttggtaaatgcatgctgcttcattatgatgtcctgatttggtgttttattttacttaagattcagaagaaggtagcaatccaaagcattcacaagaaggtacaaacaaaaaggatgcagataggagggtatgcctatctgaattggttactgttcgtttttccacttaagttctgcttggttttttttctaatagcctagtgctgtttcatatgtgcagatatcacccacatcaactttggagtcctcatttgattcgcttaatgtaaagaagtttgatggtaagctccaagcagatcttttaaaaacttttttgctttgtgcttctgtcgggattactatcataggaccaaaagtttaaaattgtagagtataatattaatttattgcactttctgctagttgccttcacggttgatcctttgtaccatcaaactaccgcgcaatttgatgagggtggggcaaagggtctcttgtcatataacctcggagtatatgacagttgccgtgtgctctttgattcgtttgaagcacctgacaagtgcatcttaagtgatatgcaaactgagatggctgagttgattggtctttcatttgctaaaggtatgattgtcaatctgtttctattctgctgtctatgctctgcatttttttatttccatttaaggttttgtaatggtctactcttaaacagagcaaatcgagcagatgataattcatatgcccctctgcaatgatatttctcctaccttgagcaatatagtttatcagtttgatgatgaaaaccgaagaccacctcatgaagcaatttctaggcaaattccagtgatggaagatcaggtggttgacggtaatgatgtggcgaatgatgacatcacacaaaatgatatgcaaaatgattgtggaacttgggattttggaggttgtgatgatcaagagagcgtgtatgatgaacactgtgacccaatggatcatagctccatgaacggtcaagaggtacttcctgcaaacagtaaaacctagacacattttgtgtgtggttagagcatgcattttttgggggttgacagcttttgttcttttcttctttttatttcccaatgtttccaattactggagttttctgcgcagtttaaaaatctatgagaattgacattaaatgaatgtgagaaaacattgattaatcatggtatcaattaatatttttttaagataaaagtcaaattgagtaactttgtaggatgcaatttgatgcctattacttatccattcattcaccatccaatgacatttctttgattgaaatgtctgaagtactcagttcaaattatggtttatttgtttgttttctgaagtataaatatctgagggtatatttttttgcaggaaactgatgagtacacttttgagtctgctgaaggtcttgatgtaaatgaaagaattgacaaaattgcagatttcttgtcatttggcatgggattctctgcaaaaacaaatgcctgggcaggacctgagcattggaaatatcgaaaagctaaaggtactatgggtacatagtcctgttttagttttgtttcaggcaggcttgtttaatctaacctttgggcttacattcaactagatttggaccctgtcccaactaaacctgatgattcagacgccccaaaaaagacaaagaagaaaagaggcaaggatgaacctgacattgatttcagcaaagcattggaacatgatatgccaaatatctttgcacctcctaagaattcaaaatcattgctgctgccggcaaatagggctaccagcaataacaaacttccagaggattgccattatagacctgaaagccttgttaaattattccttcttccggatgttttggtaatggcaatttcttataatttttttcttgatatggatctggggtggttatagtaactatggatctttttgtagtgtctggctcggagaaggaaaaaaccacttggtaagttttctatgttcttgcattgtgtatttcacatgaagttttcttgttgccttgttattatatcttgaagtcctgttgtaaattctgaaggttcttaaattatttatcacatcttccctgttcatattacctgtgttactttcctccagctccttttggtatttgatatatgggttaattggattcatgccattgcaaatttaccgtattagaaaaataccactactattcgtgatatcggctgagtgccattataattttgtaaaattagatctatgccatcaccgttatattttctgtcagactctccttcctttcttctcctctcctttttcttcctcttcttcctctacctgctccttcttctcccttccactgctatttctgccactgctcctgctcctgcccaggacgtggacagcgaccaccaccagcagcagctcatcttccccatctctctccactgctattgctactgctgctgctcctccccaagaggccaaggcatgagcggtgaccaccaccagccgatatgacgaataatagtggcatttttctaatacaacaaatttgtaatggcatggatccaattaacccttgatatattggtaagttcatattgctacttaaatacttaaacgaaacaatctgtgaatcgtatgatgttagagtattattatctgaaactgtggaatgcaaataagtataaagttcaggactgggtttatttatagagaatgctctgcacaactccaagaaaggtggtaatgtgatacttatgttggctattaggtagcaaattgactttcccttttcagagaagaactttactattctcatactagattatgtctgtttgctaatgtgtggcaagttgatgtatgtatggacagcctttgttcttgttaatgcctttctatttatatagaattgttttcctacatttgttaaccacagaacacctttgttctctagtaggtggttcaagggagaatactgatgacttcatcccatctgaaccttgggatggtgatgatttttgtaatgatcatgtcgatgaaggaaatggtgataccgatgtagaggatgcagtagatcttattaccaaaccaagacaggtgcgctccttttttcttttgccttcccttgttagacattttggttttgtgtgcttatattggagtctggttctgtattgatatttcgatgggcgctcgtacaaagttgcaattgacaccatttgaaatactaaagctggttagatctgaatgtagtaactaaaaagcactataacatcagaataactttacacaaaagaaattgtgtaaacagaatgcagagataatagctacctttctagttttctagttcttgaactagacaggtagctatattttgggatggagggagtaattaattcaagctttaacattatgtatattgatgtctgtcccataaactttaatttgtggcctcctagaaagcagaatcacatgcccatcaatatatgttaaatttatgccaagtcagtgcagatttaactcttatactttgggtactgaacagtccctagagttctgttatattttctgtacgacaaatggtgttttgactcccctccaaaaaaaaggagggcgttttgactttttgcaaatgtatagggtttacatgcctgatctggcttgacatgagttggctgttcgtagtggtggacatctatgctgctgatttttatggcacaataaatgtatccaaacaaacgataaaagtgtatcttgcaaatttattatgcatttacaccttacctatactcaggagcttctattcttgtgagcttagaattgctgacctttcgacagagtgctctgccagaggacttacatgaaaaaactagtgatctgaataaattattgtaatgtgtttgagtttttaagatgaccttgttttttttttaatgttactaacttacttggcctggtaaagtctgaattaatacctgtttccttcctaaatcaaaggtcaacaagattgatatacaatatgacaaggtatcaaaacaagtcgatgttcatgccttgaaagaagtgctctggaatcacatcaatacatctgctgacactgatgacctggtaatatcttctgttattgctaaaaattgctatctgaataacactaatacaatattgttttcattttcgtaaatagaatagcttaaaatgtaatcaataaaacacgtatgtttgttatttggttaatcttacccgtgacatatatgattgacaaaacttaaggttttattgtgctacattatatagtacagggtttacacgtggcatactggcatatgctttacaacatctagggacttaaaacggaatattaacaactatgctgttatcatccatactgccacaaccagctttctggaaactatttgtttatattcttttggtaaagtttatttttgatgtcgtgtttgatattttttgtaatatataaaatgggtagaaattaattaccagttgcaactgccaggacatggataatgaggaaatgattattatttatacttgaaacttgaaagtcaagccagttttttgctagtttctggctttcctcaagtataactaataacattgtgcccacccaccagacacaagtttggaacttggttaatattttgataattcaaaactaatacctgtatctgtttgctgaaaataagtttgttgcaaattgaaatgtttcaagagccctttattgctttgttatcctagtttaatttgccttggaaaattttcatgaagagtgtctaggaggatatttgtgaactgtgatactaacaaacatgaaaaatttgctttaaaaaaaggaatatctgtgtaattttctttgaatatatcgaaacatcaatatgatagacttgatactctgaaattcgaactgaacctttctccctaatttctgttgttctatattaatatgttaacaatattgtactcggttaaaatttgttcagcaggaagacaaggacacagaatcacccctgtgcctatcgaaagtattgcaagatcttccaagctgcaaccctgatgctgcagcaacagaaatttcaccgcacctatatttcatttgcctcttgcatttggcaaatgagcacagcttgaccttacgtgatcgtccaacattggatgaaattgacatatacattcctgcttcatctctcgtgaagtaatcctgtagttcaatatgttgtgcatgtttgttttattttttgttggttagggacttctcgttctcggtgtattattagattgccttgtatgttgaagattatgtattatgtaatgagcagcagattattggattgcgctaagctaatatataggtaacctatcatttactctagttgacctaatgaactatatataaaaatataaagtagagaaaatggttgttttgccaaggtgattcctttgtgacagtactccaatcatcactatttgatgtttgtgataaaatttggttaaatctgtacatcaattttattttttttctcgaaaacgtaagagaattgcatttcatttcattagggaagaaaaataaaggaaaatgtaaattaagtacatcaattttatatagaacaaatttacaagatctaattacttcatgatgtactaggacttttcgaggcaaatgtgcctgtaacatctcttttatttctaaactaactatttgagaaattattaatagtttaaattttaaaagttgaaccaaatcttattttatatatcaaatattcttaattggatggagtatatttttttttataaccaaccgctggcctaagtatattaagaggagcaggaatttacagttttgcttagagcactgaacaacagagcacctacaacttatatccagggtttaccaaaccttatagggtataaggtgaggttaccagcatcccacgatttagcggttatcgtgaaaaccatgtggttaccacaaggtaaatcgtgtttttaaaaacttagaaggttaccgcacgtgataattacgataactgtacggttttgtaaaccttgcttatatcaaagatagctttctaggtacacacaaatgaaagctgccccgatgcatttcaaagcgtggcgagcaggcccaccatcttccaagtttcccgttcatcctcgacctcgatagtcgcacacaatcttgctggtgaggttgcttgtccttcgaaaacacgaactatgacatttctaaacgtcaaacaaaatgaaagattgacatgctacatccagaacggctgaacagaagaacacacgttcgagaacagaaggaaactgatgtctagccagtcactaactaattaatatatcctgacatgccgacccttggaaatataccaacgtactgcatttatgttaattgcttactacatatatatgccttgttctaaagaggaacaaacatttatactacagttcagatgtaccggctactatttgtttgttcagaactatttaaaaaaggccctatcaacgaactagccgcccaaaatcgatggttttttcgtccaagcgagttcaccggaggagacgaggccaggaggggccattcatccattcattcattcctctccaatgtccttttgcccggcgaggatccttgagatctggaggccacggctgaaggcctggttgaagagcagtcgtgtctggaactcggacacgaaggggaaccatgacaagaggccgatggggaggaagaggacgagtcccatcaggttctcgtacgacctcccgagctccatgatggaatcccacagcattgccttcttcaccaacggcgaacatgcctgcccaatctgtggatgaatgacaagatcatacaaatcatttgggtccagattacgatgaacgctaaaatttatctttttattgagaaaatggacagggttttatatttgttcttggaattaagttttatgcttacaaaaaaaaacaaataagtggtgcagaagggtttcactcaccagaagaatgcaccaaccagtaggcatgaacccaagaatactagcaaaaacatccgaaattgtgaggttacaaacgacgaataatacagccatcacagagacaaaaccaaggaacaggaggcccttgagaatgcggaacataagctgcagatctgttccaaacttctgtcgcccaatcgaaaccatctgtatggaagaaacaacaaacaacaggtaagattattaatcatctgaggtagtataccacctgacatgctgtagctttacctttagaactactaggactgagagcataaccagccatgacaatccatatacctagatattgaaaagaggccagtaaattaaggtatatatcctgcaatagtaggaactatgaaagtagcaagcagaacagattgtgtttagatgaggtaccagaatgcttttgctgcggcgtgctatgttcagatggtacacaataccgtactgatagatcaagaagcggagcgaaagaatgatttccaagaggagagagcgaatgctagtcttcctaaggtgctcctgctcacttatccaccaagcctcccagctttgatccacagacatgccgatacccccacggttccccatccacttcctccaatctgtccagtcatcaactgtcttctgccattcgaagcatgacggattgaagataaagggtgcgaagagccaagatgcaaccaggaaccatatggagaaggtgacaaataggtacatgcttgagctgcggtaggaacttccatacactaaataaaccaccagaagtatcaacagttcaagtcctttaacaaagtggctgc

SEQ ID NO: 66184 - DNA, 1540 bp, Oryza sativa
tttttgttcttttgtaagtaactttctacaattttagtgttatacaatttttagtagggttgattctcaaggaagattatgtttagtagtgttatacaagacagaaatacctttttaggagctatcaataatataaacttccaaatgaacatgttcaattaatattcttaccatgctactaaagtaaaacccaactgtagtaaagtagaaggatagcattctataaaaatcgaatctgcgccccagccgatagatatcacgactcaatgtttgttcaccattgccatttgccaccttagcttcaaagcttgaaatttgattcattcccacatcacgccccttaccaacttgcatatactcatgatgtgtgacattcccttctctcattgttgaattaaaacctataagaaaattgcgtttcagtaactgcatgctaggtaatggatttgtaaacatgtatgagatgcacggcttacctgaaaatatatcttcacttagatttatagtctttgaggctttacttatgccacctctagtaatatggaagagtctatcgaaaatatcaggatgaccataatggaaccgaaccctgtattcatcttgcaataatgagttgtagacataaaagcacaacatgataaaaaatatacagtcataaatcaatgttaaatgaaacaatatctaaccatgtggaaactactcaaatcttagtgaaccccgctccatgtcataactgtttagttacatttgtagaatgatttccagaaagctaggtctgactttatttttatagttgtgtaacaaattatcaaagcatatttggtagtttccttttccagttcatactaacacgggcatgagccacttatgatttccaaacatgcaataaggattgtgtgaaccaattgacaaagctatttgcgatcaaagtaagagtaactccagatacttatcagtgttttatggaaacaataaaagattttaaaacaattttcagataaattgcagttagcaattaggccaaaagtctactctgtctaggaagatgtggaacttgaatactggtcatggtctcatgggtataacagtcatgggctcacgactagctctttttatttggtcaacttattactaacaacacttcacaagttttgttttaattagaataatgagcttcccagttcaaaaatcctttggattttttcacagcacaggatatacattctttttgaataaggctgccatgtgcagaaattacaatgatggttagttgtttatttagctttaggaggtaagtggctagaaataagacgactggtcctttcttcttgaagttttgtgccatttgggttttgggagacgatggtgtaatttgctatgccttttgctgtcaacctcttccacaagagttttggtgaatggagagcccggccaggacattgctcactgtagaggcctccggcaaggtgaccccttgtctcctatcctttttatctaggttatggacgcgttgaacttagttgtggcgtgtgcggatcgt

SEQ ID NO: 66185 - DNA, 4405 bp, Oryza sativa
tttttggttaatttctggactaaggaccaatatgatcaagagctcttgcactcctattcactgcttggaagatgatctggaagtgatttctaatgagttgtcttgtgaagtggcgagcttcccttgctcttatctcggacttcctcttacaatccgtaaatcaaccaagacagacttgttgccccttgtggacaaagtggcagataatttaccgagttggaaagcctctttaatgaacagggtgggtcagctaataacagttaggtggtcctcttggctattcctatttatgcaatgatggcgttggatcttcctaagtgggtggtcaaggctatagataaaaggtgtcgtggcttcttatggaagggaagagaaaatactaatggaggaaattgtttgatctcttgggatcgtgtgtgtcggcctttgtcctatggaggccctggtatccctaacctagaaaatatggggtgggcactacgcctgaggtggttattgtttcaaaaaactgattttgctagaccttggggcggtttatctattcatgtgtctcaatgtacgttctcttttcaatgtggctgtcaaaactatagttggaaatggagaaaatactgaatttggagtgataggtggctgcaagggaaaacagtagcagagctggcgcctaatctctttgccttgatctctaagagcacaagcaagcaacgtactgtggcgcaggctttggagaacagaagatgggcggctgacataaatgggggctatctgttcaggttcttaatgagtacttgcatagatggccaaatgggctgcccggcccagcatggcccaggcacgaccgtgcctgggctgaggtaagtcgggctggcacagccagacctacatgtcgagccgtgccgtgccaacccacgggctgcacacggcccaggcacggcccaataagactcgggccgtgccgagccgtccgaaagcacgacaacccatcattcttcttcacagaataagtctatttttgctcctcaactcattgggctgtgtctatatggctggaaaataagtctattttgtattcctattctctttgggccttaccttatatggttgattaagtctattttgggtctctcttactttttttcttcattcgcgccaggccgtgccggcccatcgtgccgaggaagcagcctaggcacggcacggctgtcgggccgggccggcacgggcatgaccctagtcgggccgtgccatgcttgggtcgggccaaattgtcgtgccttgggccgggccattgggcctcgggccatatggccatctataagtacttgaccatttgggttttggtagaagaggtggttctgctacaagatgtacaagatcagcatgtttggaagctaaccgccgatggatgtatacttgtaaatctatctatgaagcttatttcctgggatcgatcaagtttgctccatggaaaaacatttggaagagttgggctcctcttcgctgtaagttcttcatttggttggccgtcaataagaggtgttggacagccgaccggcttgctaagcgcggactgcagcaccccacggcctgtcccttttgtgatcaaagtgaagaatccgtccaacacattttgatttcgtgtcttttctcgccaagtgtggatggcactgttcttgaagctagggttctctgatgcagtgcctcaaccttcagccgatcatttttttaggtggtgagccaagctacaaaagaccggccaaaggacgtgcgaaaatggctcaactccttggtcatcttagtggcttgggagatttggaagcatcgcaatgactgtgttttcaatgggcgccaatcctagtattgcgacggtcttgcaggtggtagagaatgagggtaatctttggtgtttagcgggggcgcctgccctccaaaagtttcttaataggtcggcaaacctaagcagctagagcttgctggtgttggctggggcgtgtgggtgtgttttttcggtaggagggctttggatctcctactttgtatatttttttctttatttcttccccttaatgaaatgatacgcaattctcttgttttttcgagaaaaaaatagattttttagatataagagtttgagatgtttggtttaaggatagagttagagatatgatttattacttcctattggagaaagttgttaggggataaacccctataaaagttagagacgagccacatcaactattcacattaagcaaagaatgaactaatctagttacatgctcaaatcactcatcccaatttatagtattccctcttcacatgctagcaccacctggctatcctgttagtggtgtctatcaatgaatgaagggccataaaaactgacaaaatttaaaacaataatattagaactatcaaaactgttcataaaaagatagtggtttctggtgactgctgtgggcatagtgatgtggtcatgtgactgaggctgaaacaacttttcaaactagctaatgactttttttttatttgatctatggattatttgttacttagataaatttgctacaactgaaataaaatataattgaactgccaaaagagtatttctaaacaaaaagaagccactgtttatgagataattaaattttattgacctctacaacaaatgtacccaggttctatatattccattgtaaatttagatttttagaatattttgatatcatttactaatttttaaaactcaaaacataccccaaggctaacaagatatttgcatatgtaaaactattaaatgattcagatcaattctaggcgaattctcagttgcaccatagattatttagagccaaaacaaattcagccattgcaaaggaaaaaataaagtctatttagctgaggtaaaattatttttttaatcattaaacactatttattgccatagaattatactttaattcacttggatcaaatttatcaatgttataattaccccatagagcaaatgagaatttcttttgaagtcattcattagtcgttgaaattcagaaatcaaaagtagttttagctttacatcatgtcccgcctgaccgagaaaagtttaagaaatgcacggtgttgatagttcagggttgtttctcagactgccgtgacagttcaaggttgtaaatggaattttatattccttcccatttgacattttgtatcaacagagtattccatccatactaggttacaattactttttgacatattgagaattgggcatagtacttatcccataattgatctgttttgtaaaatacttatgtaaggatataatggccttttatgcatgattgcctcaagataaagctgaaatgattttaaaatggttctcacagtactagttaggtaaaaggaaaaaatatcatcaaatactttttaacttttaaatggatgacgcacccaattcaaataggttaccattctgatgaaatgcatcagaaaaaaaaatccttaaaaaatccttctaacacaatgttaaaatgaagatttacatacttgagaggattagccaagactcgttgcccaatggtaacaaaactggtctcttggttggacataaaccaagcaagtgatgaaacactaaaatagaaaacaaaatacagaaaagggttactaatagatggcataaacaagatataattgaccagaattttggatagatacacatacctcccagtaaaaatgtgctcacggaggcctaatatagtgggttttctctttccatacttttcactctcaaactcctccagcacatttctcattttaaatgcctcttcgaggtaattatcctacgagtaaaggaacaatattatttttgtattgtacatgtaaaaatgtgtgctagaaatagtttaggtcagtcccagctggtccaacgcagttttgtacagtttgtacatgtatatattgatcatttgatccatgactaagactactagtgtttctcccccatatctaatatagtaagaaaatcaacatattgagttcaaaattaagctagcaaaatttcaagacaccacaatgtctactagcaaatgagcatgatttttttatagtgtttccctttttgggtatatgaacatgattctgtaattttcttgggcagtgacacaattttgcagtgtgtgtcagcaaaaaccaacaaaatgcagtgtgtaccatagccattgtttgcaaaatattatccaaagtgggtcataggggaagaccatgtatgatcccaatatacatactttgtccatatggctgagttgagcctgggcgtgaggggctgtatttatgactatttgtttacatttctcaacaacttcagtgaaatagtcaacataaagggtcttgaaaaataaaatgcgga

SEQ ID NO: 66186 - DNA, 732 bp, Oryza sativa
gaccttggcaaataattatggagattggagagcacttatgtgccaaaaagtaaaaggcaaaagacattcggcaacactggttggtgaaagaagtggagggagagtttcggttttcttacctaaaggacatcatactgcggacctgtggagcctttggcattttcatgaaaagtgagtttgcaaagaaagtgatcctgcgacgagcatccaagtttgtaggtacatatattgcagattctttcgttgtcaataatagttgaagcctaacacactgttaacacagaatcccaattcataatgagaggacatcagtacttgtaaacttatggtagaaaagaatattcatattgaaataagttgcttggatggacatataaccttctccttccaagttttatcttttactgaatccagatttatatttgcaaacaattgattgtttctgttttcatccttcaaaatactgcatgattggcaaaatattggtgaaaaaacaaaaaaaaaagaactcttgactatgcacacttaaatatagatcttacccttgtccattcttcataatatcctgtgtgatgatttccattatatcttgtaacaaattggcaatttgtgtctttatcggttcaatgtcttcatcagttctctgcaaacgcaagtgatcattttttggagaagaaagaaaatgtggtacagagaacatatagtcaataggatacaaaggtatgttatcag

SEQ ID NO: 66187 - DNA, 2046 bp, Oryza sativa
tatcacagattttgctctaatacaagtgaaaaatattggctggaaagaaattaatttgacagtatgtgattggctggttgcatggaaagattattttaggatgataagtattcagatcttggaactgtttcatgttcacttgaaataaacagtatacgctagttgctttttagctaatgtttctttgttttttcttcttacagcgcactacatcaacaaagcccaaaacgaattttgttgaagtccgcacatttctacacatatttagaagttttaatcgaatgtggatgtttttcatactagcttttcaggtgactcctctttctgaagtacatcagaatcttttcaactctttaaacttgcaacacaaacaccttgaatttccacttccaggcaatgctaatagtatcatggagttcgtctggatctctttctgcgcttgctgatgcaactgttttcagaagtgttttaagtgtctttataacagctgctctactcaacttcattaaaggtgtagtactctcttctaaatgcttttcattttgtcaggttgaactattttgttgtactacatagtattcatttcaaagagctatgctatttctataactcctattttctactcgtgcagtaactctggacatagtgcttactttccaagcatgggggaatatggactggatacaaatagtcagatatctattaaaattcttcgtggccattgcttggataataattcttccattagcatattctagttccatcagatacccatctggtgctggaaaactcctgaatagttgggtaggaaattggcataacccgtcagtatataatgttgcaatcatcatatatatagtcccggacattttggctgcctttcttttcttgttgccacaacttcagaatatcatggaacgctcaaactggcgtgtaattggtcttattatgtggtggattcaggtcagcgtttcatatttcctttaacatgatgcacacatacaaaactaatttgagtgttgagcataattagcgcttacatgatgttttgccacatatcagccaagattatatgttgcacgtggtatgcatgaagatatattgtccattattaagtaagtgcttcaccttttcaatttattgttttcctttgaattgaatatgactgttcatttggatgcaacaggtatgtcttcttttgggtcgttttgctcacctgcaagcttgcatttagtttttatgttgaggtaaattactgaaatattgcactatttttcagtacatatttgaaagttgtcaattactaatgctttcgcctggtgcaaattagataatattttcagaagattgccaacttgtttgaaggattacatttgtcacaccgtactattaggatttggatcctccaaaagtttcttctctgatttctgttggcaaactgtcacaagtacacaacttacataccactagttaagtgtgtaacaagaagtacaagaaaagctcattttttgctagcataagacaactctaggtctaggcaataatatctcataaaaaatgttaccaattaacctcaaggttgagaaatttctgttgcagaaaaatagaaaaccatgtgttcattattacttcatgttgttttggcttggctagtgccacttccaacatgttagtgagagtgatgtttccttgttcttctatccaatgttgttcctctcttgtctctcccctgtgctctcatgtacagtgatgatagtacaagccagtgcctgctacaccagtgaacgtgcatctaatgctcacatttgtcttagtggcttgattatgcatgttggctcctgcatactcagcggtttgggtaggtgtggctaaatggggtctgacatgagctcctgtacacagagtcgggttggctcgacctaatgaatgcaccgcaggtactacaacttgaaagtacaacacatgctgtaccatgctgggcgtgagtaccgagtagtcttatgggccagagacttaaccttgtttgccctgaaaaaatgaaaaatc

SEQ ID NO: 66188 - DNA, 823 bp, Oryza sativa
attgattttatatgcttttgcaatttacacctttgatcaaacatgcaaaggctagaaataattgagatgatgtgactttaaaagtgaagaaagataatttgctgcataggttaatcatccaaaggttagaaacaattgaggctatttataagagaagtgagacaatttgaactgtagtttgatcatccaaagctacaaacaattgaggtcatgtggtttcatgagagaagagagaaatacattaactacacttagttttctttattttttatgtgtgtgtgtgtgtgtgtggcagttgggggaggggggcaactatataattaagtatatggggcttctccttatttcttttctaatattctcttgttattttggatatacatgttatctgcatggttcttatggtgattatattttacttacaatattcttgttaatttttaacagtgccacacaaccttggtgtcgtcattactatatgggccccaatcgtcatggtatgtaattataatcatgaaggttcaatttttttttctcgaacttggaaggttctaatattgttccatgattgatataacctactgctctatttataggtgtacttcatggatatacaaatatggtatgctattttttcaactgcatttgggggtgtttcaggtgcccttagtcatgttggtgaggttagtgactcttttatgtatgacaatatatttgcagtgttaaaaatgtttagttgtaagatatcttctttttcttttaatgtagatacgtacccttggcatgttaagagccagattcaaatcaatgccagaagctttca

SEQ ID NO: 66189 - DNA, 1507 bp, Oryza sativa
ttgccgtcgtttcctcccgcgccggccgaaccccggtgagaactccctctctcttcctcccgcgcgcgccgccgctccccgcatgcgtgtcgccgcgatgcaccgtcgcccgcgtcgccggccgctgttgtcttctcgccggccgccgccgtcggaggccgcttgccgccgccgccctcgccataaccggccggccggcttgaagccgagccgagccaggccgctttcccccccccccttgtgacgctgcccggtgggtcccgcctgccagccgcccctctccctctctcctgtgcctctgtcccgtgggtcccgcatgtcggcgccgccccaccccttgctgacgtcagccctgggatgaattattgcgcaataaattgattaagggtttttcttttatagtaataaacacagtgaatcttctaaaattcataactaattcatccgagctccgattaatcccattcaagtctcagtaaattcataaaaatgtgtagaatccattaaaaatggttttgcttcctgtttcagtagtcttatagcatgttttgcttgtgtgctttgtttgtcgcgtagatttcgcccgtttcgtcgattcgtggtttcgcgaagacgttgctgtggttccatcagtgcgagagcaaggcaagtcatacattgcaattgatcatattgtacctaatttacaaatgtcccgcatttctattaaatattgcattgttttacaatatcatgtgggatgggtcctattactcagctatatgttgtttcccatatgccattgataacttgggtattaaaatgactagatgttggtttaggagatgcttagccatgcttagttcaactagtgcacaaaaggggaccacattaaagcatagacttgattattggcaatagctttggattagtgccaccgcaatggtgttggctaattaaaatacactacatggtgggctgtgggtgcatggttttgctagacgtgcccatggcgattaaggaccggttcgcgggatgccctggaagaacttatcgtacttaccacaagccagcgtgggcaacggctgggcttgtagtgtagcttttctctagccgacgtacccaggcgagggtgggcgtgatggagttgggtcggccggggtgtccggttgatcggctgccggattcaccgcggcacgaaaggggggctgcccgttgcctgctggggacgggggcgaaccctaaggtgtggtgcgatcggttagagggggttatacgaagggtcctgtcacggcctctttccggtatgtcgtggtggcatgtcggcgcacgggaacgtgtcgtggggctgtgtcttgtgggtacagttgtacacctctgatcagagtaaaactattcgaatagccgtgcccgcggttatgggcggtcgaccagattcaccgtgattagtttcaccctagttagcttttggaactgattagtttaggtggtggtttgggcctgttgcaacgtggtgtaacgttggaca

SEQ ID NO: 66190 - DNA, 744 bp, Oryza sativa
aaaaccataatctctagcctgcttcttgattgctaataagggtttcatcggggtttcagctggtgagttatctggacgttgcatcggctcataaggattgcatatacatataagttggatttagccgatgacaacaaaggcttcactgtttaatctaatcttgtggatttcatgacatcggacctccatccgatgtgtgctttgaccttcggatcgatgcttatttatcatatcattatttgctgattggtttatactggattatattgttattttattacatcgtcgtcagccgattgcctttatatcattatctacattggacatatagccgattgcttaaaccctatcggcatcggctgctatcagcatcggctattatcggcatcggctggaactactccatcggcttgtcagccgatcggttgttttgatctactatttgcatatcttgtcagttacaggatcaaactgactggcacgctcgtatctcaccaatctttagacctgcactggagttaagcagatctctcaggctggtgtgttcgatttttttcatcagtatctagcatcgatccacatcagggccatcctagttacatctacatgattcatttaataacctccttaattgatgctaccataatggttttattttggtactaatcaaaacacacttttgaacaaacttgagaggataagcgttggaatcggtacaatatttagagtatatttgccacagct

SEQ ID NO: 66191 - DNA, 773 bp, Oryza sativa
cctcgcgtcctgcgtccaccaccaccacctccgtggcgccaccgtcctcgagctcggcgccggcacgggcctcccgggcatcgccgccgtcgcctgcctcggcgccgcgcgctgcgtgctcaccgacgtgcgcccgctcctccccggcctcagggccaacgccgacgccaacgggctcaccgccgagcaggcggacgtgcgtgagctccggtggggtgggcacctcgagcccgaggtccaggtggacgtggtgctcatgtccgacgtgttctacgacccggacgacatgccggcgatggcggacacgctgcatgggctatggcgagacggcgacagcgacagcgacggcggcggcacggtggggtgggcggcgagcgaggcgcgcgacggcgtgcaggactgtatcgacgtgctgcgagagcaaggcttcgaggtggtcgaggtagacagggtcactaggccgctgctgcgcgaccccgagcaggccgccgacttcgccgtctatcgtctttttcgccggacaacttcgccgtccatcgtctccaatccaacgccgataactacagccgggtgttgactttcactctgtaacagtaaagccaagcttgtaacggcaccagaatcacctttgaccttttattttccaaaaggccattttgtacgtactttcttctcggttgcaggacttgtaaatgttccacaatgagtcaaggggacaaagacatagcaataatatatgcaagtctactgtaggaagctacagtagtatacat

SEQ ID NO: 66192 - DNA, 793 bp, Oryza sativa
ccatccatctatatctatctggcccagctacgtacggtacatgcaatgcaaagccatgaagcatcttttctccctgatcgatcgtccactggtccatcaggtattcaggtgaattgcaggtatatacttatgaacacacgatacggccgacgggttgctacggtgtcccttctttccatctcttcagggttcagactacttcagaaattagctcttcaggtttttaagcagctgggacgtcgtcagtactgcagtacagtgacaatgtgtacagattggttggtcgatcacttaattggttgcttagcttaaatgatgtgctcagatcatcagcaggggtactgtacaattgcatatcgccttgcagaaggaaataaattagtaaacgtcaagatgcattaatatataccttgatatcagcatatatatttattatgtcatgttagtgtcaatcagcgagtaattaacgcgttaagcgtacaatactggtgtacatggcgtgtgcgatagcacacatacgtagccatcaaactcactcaccattaagagtaatcgagcagtagtaattacaagtatacgtactgctaattaatcgctcagagcaggcaaacgatgttgatacgtgtggccgccggccgacgcgtttgcagaagatccggggcggatcagacgcttgcgtgggggaaacaagaaggtgttttgcttgcttggggttcggatcatctgcgccgcgtcgaacgccggacgcgccgtgcggccacacgcggcggcggctgtcgtcgccgtcgccggg

SEQ ID NO: 66193 - DNA, 704 bp, Oryza sativa
gtgggccttccaccctgatcgtctgtcagcaccgtccctatcacccgagtaacttcgacaacgactacaacggtggcagtcacaacaacagtaagcagcacaaccacaactcgactccacccccactaatggcaccagctcagtcagatccgccagctgtgtcagttcagtcagaacaacccaagaagggggctgtaggaaagccaggaccctgcttcaactgtggcaagcacggccattttgctggcaagtgtccgaagctgaatcgcactggacccaggttcatccaggcccgcgccaatcatgtgtctgcagaggaagcacaggcagcaccagaggtcgtgttgggcacgtttccagtgaactcatatccagcaacagttctctttgattcaggtgcctcgcattctttcatttccaaaagatttgctgggacacatggattatcgatagtagaacttaaaataccgatgcaggttcatacccctggaaatgatatgaggacagcacactactgcccctcggtgactatagagatcaaaagatcaccgtttctatccaacctcatccttctcgaatctaaagacctggatgtcattcttggaatggattggttgaccagaaacaagggagtgattgactgcgcaagccgcaccatcaccctaaccaacgacaaggggagaagaacaccttccgttcccagc

SEQ ID NO: 66194 - DNA, 795 bp, Oryza sativa
acacaagatggctatgtactgtacaacttattggtaaattcgccataaaggcaacatcatctagagaaagtttgaggagctctttgttgtccaccaaatggaggagttgttctatgtttttttttctctagttgttcagaatgcaattgggaatgggtataatctgtgcaaccaatcatgcagaatgttatccttgagcttggtgttgtggcctgcaacctcctggtccatttccatagctggggttatggtagcctggtttgttgccagagcctgatggaccatttgatcttccaggatgtccgtagtgatggtgatggtgttcttgccctggatgcagaactggacgccaagggccagggggagcaaaattgctaggtggcctcacgtgtcctgaagttgcaggaagattggccattaaatcaaatgttgttcatcaggaaaagtaccatttttgtttccatggtttcacggggaatgaaaattacctggagtaaatggaggacaaggatgtggaggagcatgacgaggaaatgggccttgatttgcatggaacggaggacgccaaggatataagtcttgacctgcaaatggaggacaacgccgaggaaagaagccttgatttggtagtacaggtggaggatgccgaggaacgaagccttgaccagctaatgcaggaggaggacaccgaggagcaaggccttgatcttctagtacaggaggaggaagccgaggaacataaccttgatctgctagtacaggaggatgccgagctgctaaccgttgatccccttg

SEQ ID NO: 66195 - DNA, 810 bp, Oryza sativa
gtttgtgttctacgcagtagactagaatacctgaacaaaaagaattattggcatgcgtggtgctgaagaaagagaatttcagactacgaacaatagagacagattctctagcagcacatgagatgcccatacatgacatcctttgcgattccattttatgtaccaaatactaattaaaaattgaatgctaattagtcttttagacttttcattgaatcaatttttatagttaacaaggaaaatcttaccaagccaccagagaagaacaagactgaaaagtccgaggtagccaaacagtttttggacatcaaccttttctccttcctctccagcaaacttttttagaagcactaaaataatgttgaaacaattagcagttgaatcaagacagatcaactaaaggaagcaaagaactaaccagtgaataaaccatatgacatagctgacagaagaccaaacatgtcacctagaagagttctctgagtggcactgcattcataaagtttacagattagctgcagaacttgtggccaacaaagtgagtgctgtctcaaagttacaaaatcatcttcaacatgatcttcagttacaaggccatcttaaaaatggaataaatagcgcttttatgtttttttatgcacttatatttatatgaaaagcaattcagttgcagcaaccaatctactacaagcaagcaaatgcaagggctttatgagcatagcaaattaatcacaaacaattttatatgtcctgaggcatcagtgcagaactgtgatgtttatttaagggtaaaacgcactaacccagaat

SEQ ID NO: 66196 - DNA, 734 bp, Oryza sativa
ataagaagataaaaacaataagatctggagaatagatataagtttggcagcttactagaggatagaaacattcatagtaccagttctggcaagtgtttgaccacggtaagatgcccagatacggacatcatccatgtacccttttactgcctcttcattttctgggtcaactccaatgcgttctagaaagttcttccattcatctggtgaagtgacaaagcattactcattaaatttttactatgaacacagaaataagatgaactacatttaggatacactaaaatctgatgagtaagatggttgatagtatggaaaaccagattggtggaacacatactctttcactcttcacatttatcatgtcactatttttaatttgtaacattgatctgcggatccttcacgaattgtgttcagcagtttttattgataaaaaagaatctgcaactcacctggataaatcttttgtagatagaacaaaattgaaatgccatcttcattcttcttattcagttcatgagaagaatagagcacttcctcattataatatggagtcaaaacactaaatagtggagtttgttagaatgtgaagttcctcaaaatgagtgcagaggatagtaaattaataacagaagtaacactgcgcattatgtacaggtgtacagggctgagtgaagatataataaaaaattaaaaacatcatatcgttaacatgatttatttcgaaagac

SEQ ID NO: 66197 - DNA, 1526 bp, Oryza sativa
accaatttactcccaagttagactggtttgactaacttgaacaattttcatcaatcccaaactgattggcagtgcctagagtgagtctagaaaccacccaataacccaccagttttagggaaccagtgggggctaggtactatcacaattctcaccgtgtaaaacctgattttaggtacaatttatcgtgtaggagataattttttgagaggataggagataaattgttaagtaaatataggaattataaaactcaagtgatacaggttaggctagaatgattttcaccttgctgtgtagatctttgtacaattgtaccatgagcagcggagttattttctttggttatttttccaaatttcttatgcagggtacgattccattatggtcaccctgatgttttcgatagaatctttcacctcacaaggggtggcataagcaaggcatcaaaggttatcaaccttagcgaggatatctttgcaggtaaaatttccagagattatgtgcatcatgcaaattagttttgttctgtgcagtaagcttatggttgttctgattaaaggattcaattcaaccctgcggcaaggaaatgttactcatcatgaatatatacagctgggtaaaggacgtgatgttggaatgaatcaaatatccaactttgaggccaaggtggcaaacggaaatggtgaacaaacactctgtcgagatatttatcgactagggcacagatttgatttctacaggatgttgtctctatacttcactacagttggtttctacttcaatagtatggtatgaatcttattctttgacacatcaacttagtaacatataaagtttctggagctgcaatagctgattggttcactttgtggtttgtaaagcacgacaacaaacaagatatgaactagaaaaatcttgccactaaaaccaataaccaaccagtattattgcaaaaaaaacaaaaagtcccaggaagatatttggatgtgaagttaagtttgaggcacatttagcatgttggcccaataattatgctcccttatctttgcattccgtttgaggagataaattctctacaaagaaaacaacctagtagggaaataaaatggtctatattgttcttcatgatttttaaagcagtgaccagcagattataaagaactaaaaaatgtgacataaggtttgtacttttgtacaaagtgtgctaacgcattttatggctttgattactttcaggtggctgttcttacagtgtatgtatttttatacgggaggttatatcttgttttgagtggcctagagaagtcaattctccaggatccacaaattaagaacatcaagccctttgaaaatgcacttgcaactcaatctattttccaacttggaatgttgctcgtcctccctatgatgatagaggttggcttggagaaaggatttggcagagccttgggagagtttgtaataatgcaacttcaattagcttctgtttcttcccttccatcttggaacgaagactcactact

SEQ ID NO: 66198 - DNA, 10228 bp, Oryza sativa
catggttttcaaaatataccggtacaggccgggggtttgttgtgcgccatgcaaagtttgctgagaattaccggatgtattcccggagccactttgtgaaagcactggagctactcattcttttggttgtctatctagcttatggcatttcgtacaggagctcaagtttgtatctatatgtcacaatttcaatatggttccttgttttctgttggctgtttgcaccttttgtcttcaatccatcatgctttgagtggcacaagactgttgatgactggactgactggtggcattggatgagcaatagaggaggtattggcctggcaccagagcaaagttgggaggcttggtggataagtgaacatgaccacctgaggaatggtacaatacgtagcctgctgttggagttcgtcctctcccttcgcttcttgatataccaatatggtattgtttatcatttacacatagtgcatgggaacagaagcttcatggtacttatcctgactagagtgctctgcatcaatgtatgaattctgaccggactaatggtttttctttcttttttttgtttccacaggtgtatgcactatcatggctggttatagctatagttcttgtatcacttaaggtaacagtttatttggtattgtattatgttctttgcaatagtaatcctacagttgagcatatttcttcttccaggtcgtctcaatggggagagagaagtttattaccaattttcaacttgtattccgtatcctcaagggcattgtctttattgtcctcatcagcttggtggtcatattatttgttgttttcaatctgactgtctctgatgttggtgccagtattttggcattcatccctactggctggtttattcttcaggtaagtgatgcatctgtgctcacaacttcaacctgattttttcccccttcccactagaattgtccactcatttgtccattgtattcaatcatcacattcactttactctcgtagattgcacagctctgtggaccattgttccggagattggtgacggagccgctctgcgccctgttctgttcatgttgcaccgggggcaccgcatgcaaggggcgttgctgcgccaggtttaggctgaggagccgggatgtgctccgcaagatcgggccatgggactccatccaggagatggcgaggatgtacgagtacaccatggggatcctcatcttcttccccatcgccgtcctgtcgtggttccccttcgtctccgagtttcagactcggctgctcttcaaccaggccttcagccgggggctgcagatctccaggatcctcaccggccagaatggtagcggctcaaagagggactgatcatgatgaatatatgggttgtgcttctctgcaggtttgactagtacaatccgatgtaacttttcctggcaccgatatggcggttctgggatttatttgtttctggttccatcgtgttcatatgagggcatgtgtgtagtagcccctattgttttattgcttggttgcagtgtttggggaacaaaaaaacaatgagaatgacgaccaggattttctataacaatgaatttcattttcagagcgcagttgcttgctgcaaataatactcttttttatctaattgtatcaccttatctaattttatcacctttggatgtaattatctgagatgatcaacaaagctttaattcctttatctaaattattgtggaggaatcattggtaaaggaatcaagtcattcattgaagacacacatgctggaatcaagatttcaccacaggataacaattttcttggtttgcatgatagactcgttactgtcacaggacccttggaccatcagatgcgtgcaatatatttgatatgaagcataagttatcggaggacgttcactacccacctaatctgagttccccatttccatatgcaggccttagtttccctagttaccctggtgttcctgttgggtattatgatcccacaggtgccgtataataatgctgtgaattatggacctaatgggtatggaggaagggaccaaaacaacaaacccagtacacctatgagatctcacctgctaacaatgacgcccaagattctcactattggtattgctgatgaacattttggtgctgtcgtacgacgtgccggaaggaacattacagagatcattcaggctagtggtgccaggatcaagatatctgatagggataactggaacatcagaagctattcaggcagcagagtctatgataatgcacagggtgtcagccagttccgagaggtgataaaatctcgtgaagagacgaggggcattatcatctgatggaaaagaattctgatgccaagttaggaggaaaaatttgataatttaacgcttttttcattgtccaattactttaattgatatttttgtgaggatgatatgtgagaccatatgagtgtatgaaagtgaaccagaatgtcaaataatcgaaacccattgaaaatagtgttaaattatcaaatctctcagttaggaggaggggatggagattgtcttttctagttttagcactatccgcaaaaaaaaaagaaacggcacgcaatctcgattttacggctaaccactaattatcgtatcatacgtctttatcgtatgcatggcgatccggcttaactactttgtttgtttctctgtgcaatagtatctccaagattaacaaacccatgcccacgtgtactacgtaattatcctctattgtatctatctccaacgtacggcgcatcgtatcgctgcggcctataaattccgtatcacccccacgcccgatctctgcaattcgatcgcttgcatctgcaaagttgcaactcatctcgtctcctcctctcctcccctcctcccctgtagcctagctaattaacttcaaattagcagcagtatgatgggacggcgcggcagcagctggtgccggtggtgggtggcgctgctggtcctcgccgtggcggccgatgccgtgggctgcaccagcgtcagctacgacgaccgcagcctcgtcatcgacggccagcgccggatcatcctctctggttccatccattatccccggagcactcccgaggtaaccgacttgttatactagccgtcaacccgtgcaacgcacgagataattttaaatattattttttagccctataaaattttactctgatagtatttcagtcatacaaaatcgtataggaatggtttaaattgatggcaaattaatgccaactgcaatatggtgatttttaatttattttctgagtgaattatattttaatcatagaattcgttgtatatttttaaaattgtaagatccatgtattatgaatggtgtacaatattgatattgttatcaccgttgagaattatattgaaattgtaactatgcgtagtaatgtgttaagtggaaaactaattaattaaataaattttggcattagatccaatctgtacatgtaaaaagaaataaaaaaagtagccacggaattaatcatatgttggtagcaacataatcattgtccaaaattctgtccgtgtagtcaacataatcatagactaaactctgtcagcaaagtaattagcacgttactatgtactcttccaggtgctcatttttcaaccgtgtcatatatatagtttacccaggttaaaattgtttgagatgagaaaccaatctagattgagaaacaataatacccgatcgacttggagatatctgagcgcgtcctaaagttcatctctatttccatttgtgttgatgcctccgcttgaaatccagatcatcggcaatatatccaactgaattcccaacaaaattgtatgtagagattattggatgggatttgtgaggcccatgggaccatgatattaactataaattaataatgtgtgggtctatttgatcaacggcagattcaccaggttaacgctgtataggtatagatattcctagtgtatactatttttgtttttcaatacatgatgtcgttaattttttaatatgtttgaacatttgtaataatttatggagatacataagatataaatcatgcttaaaatactttgagtgataaaacaactcacaaaaaataaattataattatgtttttttaataagaagaatggttaaatgtgtgaaaaaatcaacaacatcatgtattaaaaaatagagatagttgataatattaatctgcaaattaaatgcatatacaactttgagtgttttgtactagtaggatacagagttgcttgcttgagtgtttcttttctttttgtgccatagatcgtgatgagctaagcagtgcgaggagttttatgttctatacttttatatacttatgcatgcatattatgttgtgacttatattcgttcgatctttattttcttaatttgtgttaagaaattaatgaacataagcaatatatgtacgtgcgcaaaagattaatttgattttttttctatctaatctaatcttattgttgctatgcagatgtggccggatctgatcaagaaggcgaaggaaggtggtctcgatgccatcgagacttacatcttttggaacggccatgagccgcaccgccgccaggttcaatattactacttttgctttagcacataaacactactacgtactgcagctattacatacaataacaaccatggataaatactagtaatactataacaatgtttttgctttgatcggcagtacaattttgagggtaactacgatgtcgtcaggttcttcaaggagatccagaatgccggcatgtacgccattcttcgcattggcccgtacatctgtggcgaatggaactatgggtatgtatcatgtatataaatgctaaagcatttgtgtgtcaaagtgataaatagaatagaatattatattgatctgcaaattaatcgaatattatatctataatgttcatatagaattagagaaaaaaacgaaatagaatagactattatatcgatctgcaaattaatcaaatattatatctatagtgttcatatagaataagaggaaacaagcgagcacactaaactactctagtttctttctataacattattatgtgtccatgcatgcatgttgaagtgctcactgtgttttgttgttttctaaaacaaatgccaaatgtgcagaggacttccagcttggctacgcgacatccctggaatgcagtttaggctgcataatgagccttttgaggttaaataataataataataataaaattctcatctatttttgtgtacttttacatatactagcatataattaatgcaagtgtttttttccatgatatagaatgagatggagacattcaccactcttatagttaacaagatgaaggattcaaaaatgtttgctgaacaaggaggaccgatcatccttgctcaggtattgtaatgatcattcttcaatatgattgaacaatgggaaattagcatgttaataatttgtactattgtcattccacaatatatattgtcaattaatatcaatgcattaatggatcaatgcacagattgagaatgagtatggaaacatcatggggaaattaaacaacaaccagtctgcatctgaatacatccactggtgtgctgacatggcgaacaagcagaacgtcggtgtcccatggatcatgtgtcaacaagacgacgatgtgccgcacaatgtggtgagcatgggttttaatcccacaagaatatagaatattatatgaatttatttgtttatcactcatctaataacatgagtttgtcattgttttggaccgctctaggtcaatacctgtaatggattctattgccatgactggtttccaaataggacaggcatccctaagatttggacagagaactggactggctggtatttttttttcttccattagtatttctctcattgtttacaaaattaacttttagtacatatatctctttgtttgcaaaattattttttgatgaacatggaggagatttatcttaatttgttgatgtacttaacgttaggttcaaagcttgggacaagccggatttccataggtcagctgaagacattgcttttgcggttgcgatgttcttccaaaagcgtggatctctgcaaaattactatatggtatgctggctagcttgtatctctttcacaatgactgaattttcgttgatttatgctgagttttttttttccattttttgttagtaccatggtggaaccaactttggtcgtacctccggaggtccgtacatcacaacaagctatgattatgacgcgcctttggatgagtatggtaagctttgattaatatattttaccgtactgttaattatatggtgaatttgaataagaaagcaattttttgtcttattttaattataatcttgttggtctacttttgatttattacaggtaatctcaggcaacccaaatatggtcacttgaaggaactccactccgtgctcaagtccatggagaaaactcttgtccatggagagtattttgacaccaactatggcgataacatcacagtaatattcagatcacgcccttcttttaatcaaaattatcacgtctaatgcaaacatatctaatgcatgcatattggtactatctctgatcaatgtaggttaccaagtacactctggactcctcatctgcttgcttcatcaacaacagatttgatgataaagatgtcaatgtgaccctcgatggagccactcacctcctgcctgcatggtcagtcagcatcttgcctgactgcaagactgttgccttcaatagcgccaaggtatttttcctttctcaataatcaataatgaaattaaaatgagaccaagtgtaaggtctataattcatctcttaattttgttttcctcttggtatgacctagattaagacccagacgtctgtcatggtgaagaaacccaacacggcggagcaggagcaggagagcctaaaatggtcttggatgcctgaaaacttgagtcctttcatgaccgatgagaagggcaactttaggaagaatgagctcttggagcagatcgtcacgtcaaccgatcaaagtgattacctgtggtacagaacaaggtatttttttaaaaaaaaaatctctttatactaaagaaaagagatcatgatgatgtaaatttgaaatgattccgacaaaaaaatatatatatgttacaaatttagaacgtcaccaacaaaaaaaaaattgcagtcttaatcacaaaggagaagggagctacaaattgtacgtgaacacgactggccatgaactttatgcctttgtgaacgggaagcttattggtgagtatcaaagttattttttttccatattttcgttgcaccattcttttaattctgtgtgggtcgaaattaaagaatgtttgtgaacctgcgggtcaaaattaaggaatgttcattgacaaacatgtgtgttcataatttgtcagggaaaaaccattctgccgatggagattttgtcttccaactagagtcgccggtgaagctccatgatggcaagaactacatctctcttctgagtgcaaccgttggcctcaaggttcctaattttctttcttgaatgctcacttccatcgtatcagcaacgaactcatcttctttatttgcaattaatcatgtataccagtgataaattgtttgatcattcttggtaaacagaactatggcccttcgttcgaaaagatgcccacgggcattgttggaggccctgttaagctgatagacagcaatggcaccgcaattgatctctccaacagctcctggtcttataaggttacacattatttttcatcaatgcttagttgtttgttaactttgctggtattgatcatatagtgtttcttgctttgatgtttttttgtgttgtaggctggcttggctagtgagtacaggcagatccatcttgacaagccaggctacaaatggaatggcaacaatggcaccatccccatcaacaggccttttacttggtacaaggtacagtatatgtccattatttactcactctctccggttttataattcttaacattctgaacaatgacataattttcaaaatatatttctgactatatttctctattacaatatattaatataaatatatatatatattacttttgttatagtactttgtaagtcaaatttatatatgttgttttggtgcctttaaactagatatttttaaagtcattattagttaatttataaaagtttaacctaaaacttatcaattatgaaactggagtaatttaattacctgtatgatttcatttcatcgtttcattctttcacctgcaaaaataaaaggatttttaatactttttttgttttcttatgaagactacaatttacttaatttaccttccctatgaaatttcatcatgtcattaattctttcaccgccaaaacaatcttaatactttggttacttttttttttgttatgaaggctacatttgaagctccgtccggcgaggacgcggtggtggtggacctgctgggcttgaacaagggcgtggcgtgggtgaacggcaacaacctcggccgctactggccgtcgtacacggcggcggagatggccggctgccaccgctgcgactaccgcggcgcgttccaggcggagggcgacggcaccaggtgcctcacgggctgcggcgagccgtcgcagcgctactaccacgtgccgcgctccttcctcgccgccggcgagcccaacacgctgctcctcttcgaggaggccggcggcgacccctcgggcgtcgccctccgcaccgtggtgcccggtgccgtgtgcacctccggcgaggccggtgacgccgtcacgctgtcgtgcggcggcggccacgccgtgtcgagcgtcgacgtggccagcttcggcgtggggcgcgggcggtgcggcggctacgagggcgggtgcgagtccaaggcggcgtacgaggcgttcacggcggcgtgcgtcgggaaggagtcgtgcacggtggagatcaccggcgcgttcgccggcgccgggtgcctgtccggcgtgctcaccgtccaggccacttgctgattgatctacatgcatatatatggagtggccatgtctttgattaattaggtctttaattagtcgcttaattaggatggtttgtttattgagttaagctggtagtcgcccctggtgcatgtgttaattcgggggtaaaaagtgagtttattaattagggttctctgatcaactgttgattgcagagacgcagagtgtgatatatactgggaccaaatatttcatctatgaagtacttttacgatcgagtggttaaacatgtgtgttaatgcccttgattttttgttgtttttcatttttgttgctctagaaactatatgcccttcttgggaattcattgcatagttcattcccctacttcactatcaaaatagtttctagtttccttatccgataacaaattaacaatataatgagaggaaccagaacctcctttccaccacttttgaattgatacatactcctctcctatgtatgactcttctccaccaagtcaacaaaaccatatttttagatgagcctatgttgtaaagtaatctaattactactaactagtaatctcaactttgatgtccttttgccatgcaaaatttaaggtggacttggttttggttttctacttcaagccgtacattaccttggtattgtgcaaagtagtggcgaattatttgttgctgtattgttcaaagcattgttacttggtctatatgtaagtcaagtcttcttggctttacaaacgaattttatacttacttgatggtgaagtaaggtggtacaagcagatgttccctacattaatagaaaaacctcagctaaagtagttatggaaaagagtgatattgacaagttaggtaattagcattttcacttttgctggcataacattgtgatctctccaaaaagacacaagtttatcttagaatctcattcctatatattaaaaccttagcctcctactttcaattgtgattttatccctgctttttaggtttgtgtttttgcccctactttttaaaatgaagcaaccgtttacccccagttgtgacagtagttaggtagactcggaactttcaaattaaacaaagggaaaaaatgatattg

SEQ ID NO: 66199 - DNA, 2298 bp, Oryza sativa
acaagctatcaccggtaactaactccaacaaaaacaggccaccaagtgatacctggtttgggagaattctagacactgccatgcgaattctagtgggtaacggaactatggaattgcgaaacctcagaccgtatggtaaaactgtaaggccagttggcaaagtactctctagaggtcaacataaaatcaggcttttggtgctttatgctgcaagcaaggactgtgagaaagtaacattttgtaatcttcaaaaaatcatacttgattagaggaattttttttttctgaaacagatggcagggccacagaagctctgcccattcctctgtactaatataaaaggaacaaatttaaactacatggatgctataaagcatcatggccattcatcctctagtttggaaagatgagatataaaggtgggtccttactctataattaatcatacacaattaatatgcaattaaaatagagactctccattactaagatttgcagtgcaagtgagaataacttcaatagggaaaatatctacttaaatccctcaagtgtaatggtttatttccttagcaccctgaacactaggtatcgtaccaccttaactaacaaaaaccagagcaaatgtaggcgtattgccagcatggcagatcaagctggcaacatgatagtgactcagcaaatcaaatatataaaatatctcttgcacagtgggcccctatgtcagtggtatactcttgttctttctcatctttcaccccccccccccctctgtttgttatggagaaaaaaaagagcacattccccgcatctctgccatgctgcttgtgaggtaagagcatagtgaaaaaaaccagaccggcccggtgtttggaccggaaaaaaccggaaccagaggtcagcgcggttcggttggatggaaagactggacatgtaattgacccgctttagaccgcttgaaccggccagttttaagtgaaccggtgataaaccagcctcgatcggaccggcctagacatctgaattgcttaaatgggccggaagaaggcccatttaattcgaaggcccgaaataactagatatttaggcaaaaatgaccaagaaaaagggaatggtggggagtcaaaccctggtggtgggtttgaagttgactccggtagccatccaagcattaggttgttagttctgatacgagaatataaagtaatttttatctagtagcgaaccacggttagaccggccggttcaccagtcagaccgtcggaccagtgaaccaagaggttgaccgggtcactcactggtccagtcttttcaactatgagtaagagcattagtgacatattcctctcaatcatctcagggcttgcaccgagcctgcttcccatgggcatcttggcattcctcaggttcatagttgctattgccgaaagcacaaccgctctgaccgtctattctaagaccagacttagctccgcaattctactgacacatacttcatcaagtagctttaagtcatcttaccattttaacaattaccgatttcctcgtgactagttgagaacatacttttggtacgtggtaggatcgaaattgcaggagatttattgctctcatagcttgggcgcgatattgttggtatgaaattgtatcaatctctcaccaccctgtgtcacctgttgactctgattagacccttcttttgcacatccagatctcatcatgctaatagcatatgaggggagaaagagagagcatatgaggaagcttaggtgcgttgcaccagcatggatcagagactgttgatggaggcatccatggcggtaaccaggaggtggcagaatgagacagagggtagaaaggggaagaagagagacttcatagagaaagggggcccacattcaagacaaattttacacattgttgagtcatatccatgctgctggccgtgttatcctccacagtggcaatactgccacggaactagcccagtgggttctttttcttccttttatattacgtggtactatactttagggtgtaaagtagacgaactgctacatttcaccttctaaggataacattgcaaactgcatatcgaggtgcagaaattttctttcggcgcaacagtctctctcaatagttaaattattcaggcacatcattattgtttatttgtgtcacgattccaggtgcttactgcaatttgtttgcatttccatttcacatcataaaagttcaaacagtttaacaccatcacaagaaatacacatgcacttaacaacaaaagctatgtgattcctg

SEQ ID NO: 66200 - DNA, 7578 bp, Oryza sativa
taggtggaggaatagcaggaaaagcagataccttctccagcctatgcaagaggtatgttttgaattgccgaactcctcgtccacctgagtttggatccatggtgtgagccttctcgaacgcggtaaaccgaccttttagcaagcaccaagccaccaaccaaaaaccacagtcaagtcatcacaataggctaagttcaaagcagaggtatacaagggagataaacatgcacatttcttacataaacagaaaaaaaaataaaaataattctgcaatcgatactatagctgcgaaatgagattcttccaatttccaaggctcactggctcagaacattcatgatggcactagactacctaaatggtgtggtcggctgcgtccgtgcatgtaatacggagcaattcattagagtatgattaattaagcatcaactaaaataaatttgaaaaatgaattaatatgaattttaagcaaattttctatagatttttttaattaaaaaaacaccaatatgtgtcaacgagcgagcatagctgcgcatgcaggcaacagatagcgaaatcataggagagaagtaaaaaaaaaaaagggaaaggggaacgcagagcacgcacagaggtaggcgacgcgctggttctcctcctcgatctcgttggcggcgcggaggatggggacgatgggggcgagcgagttaggcaccagctcgctctcctcgctgtactccccgccgtcctccccggagtacccctccggcctcatggtgaacgccctcgacaagccccgccgcagcgacggctgcggccccgacaacccccctccccccgtcgccatgcctcccccgccccgcggcggcgactacgacaacgacgacgacgaccaacgtaccccctcctccctattcgacaacgatcgagaccaacgccgcggcggcgttggcggcggtggcggcggtggtggtggtgaggatcggcgaggaaggggaggaggagatgggggcaaggcatcttcttaagcgggagggaggggggagtgtgagtgcggagtgcgcgctttttcgcttttgccgctttggccttctttctttctttcttcgaggggaggagaagggaggaggaggagattgtgcttcgctttgctttttttttttttctttctctttctttttgcggcgcagatgcggatcgagcgggggtggccggcgagggaagcaaggaattggaatttggaacggtgctgacgtgtggggccaggtaggcagggacaggggctttgttgaggttttttttcacttccctaattcatctctcgtttttttacgcgcacgctttttaaatttctaaacggtgtgtttctttaaaaattttctatacgaaagctactttaaaaattatattaacctatttaaaaataactaatacttaattaattatatatgctaatgaatactccctccgtactcgtaaaggaagtcgtttagcacaatgtttaagttaaaccttgggaatataaatcataaataactatcaagttgttgagtttaaaaatgtaaaaattatatgaatatatttgttttgaaaaatactttcataaaagtatacatatatcacttttcaataaatatttctatagaaacaagaagtcaaagttatgtttcggagaccgtatcgctgtccaaacgagaccgtgtcactgtccgaaacgaatttctttacgagtacggagggagtacacccattttatatggacagagtattagggcatgttctctttaatgcaaaaaaagacttactaaaatttggcattgccaaaattttgacatagttgccaaaattatatactcactaaaatttgacagcaaactaaatatagctacttttttgataactttatcaaaatttggtaagatcaaaaatgacatcaaagtgaacagagccttagtttccaacaggagccgaacacagggccgggctcttcgctttctttcgtgtgcgcttttctttatgaggtaaaaaacgaataatgtttatacctggtttcctggcttcaaaatgtctgtgtttcatgtcatgtgtaccaccgtatgtcggcgccgtactgcagagggaatgagaggatggataaaggtacagctacccgctttcgaattatttgtcgtcttatctaaattaaccattttaagttcgatcattaatctttagaaatctatttgtgtagtataacgttatactcccttcatttcataatgtaagactttctagcattactcatcatatttatatagatgttaataaatatagacacatatatatatttaaattcattagcatctctataaatatatggacaatactagaaagactcacgttatgaaacggaggaagatttatgcttttattcactacagaaacaactccatagtcgaactaatggtcaagattaaagcaatgagtataaatggaggggatcaatgagcatcggtaagctttgctttcctatatatgagtactaagttctaatgttttataacctcgtagagtggcagggagtcgttaataatttcttctttcgctttctccaaattgaaacttgaacaggacaggatttgaaaccggctctctccggatctgttcattgggcgatcgttcaattatgcacgcaaaagagagtgctttaatcaaataaaagatacagtttgggcacgtctcaactctaaagctagctatcactagcttcactggcgtgtttagttagcatcaagtggcagctatatatatatactcagaacaatctagcatatatattcaactggattgagatcctctgacataacttctcactaacttggtggctgacatgtgggcccgaaagtggtgaggcccacatgtcagtcacggcgaacattagaggatcatctttcatattctactagtgtggattgcatggatacgggactaccacgggtggaactacgtacacctgggatgggaatagctaattatattgcctcgctagggctcagtttctactgttttttttaggaaaaaattgctataggatactcaaaaatcgtgtaattgtctaagagacactgtaaaaatgtgacactgccgatggacagtacaaaagttgtgtagtttaggacaccaaaggcattattttataatttctgggctgaaagaggggagagaaattttgaaatgatgggaatgcccctgtactccttattcctttctctcaatgcagccgacatgtggacccacgctcagtgtcgtcatcctcctctcgccagcgcccaatgccgaccgacgccactgcatcccttccaaaatccgatcgattcggtgagagagtcagcgatgcccaatccggtggctacaacgaggcagtgcctctcgtcggccgccgtccctgcccacgacgccatcgtcacctccaccggccaccgcgcccacgcccagaccacctccctccacctcatctcctccctcctcaccgcgacgccctcgcccgcacccacagcgccgcctactccccacgcatccaactcaaggccctcgacctctgcttcgttgtctccctcgataggctcccctccgtctccgcctcctcctcctttgcctctacgccgatgaaccccccgtctccaactccctcatggccgccatcaagcactcccaggccaaccagcgccgcaacccggacaccttccacttctaccaccaggccaccaccgcccaaactcccgccgctgtcaaggtcgagctctcctagcttgtcctcgccatcctcaatgaccccatcatcagtcgtgtcttccctgaggccggattccgcagcagggacatcaagctcaccatcctccgtccggctccacccatgccactcctcggccgcctccccacgtgcacccacccgccgcctctcttcctctgcagcttcgccaccgtggatgacgttgatgtcccttcgccggccgggaaccttgccggcgttggggaggagaactgctgccacatcaccgagatcctctcccacggccgcaactctcactgccgtcaaggtcgagctgtcccagcttgtcctcgccatcctcgatgaccccatctttgctcgaattttggaagggaccagcgcggccaaggcagcatagacgcacgccttcaagacgatgacagaagcggtgagcacgcagaacaggaagatggacaagcatacaacggtgaagtcatcgacacttggggggcaatccggacaattcaataaaaatctcaccactttcatctcgaaaatgataaaataatgtgttcggtgttatacggccaattacataacttttgcagtgtccatgggcagtgtcacgtttttgtggtgtccctcagccaattacacgtttttttgcgtgtcttgtagtaaatgttttctctttttgagaaaatccatgaaatgccattgacaagcaccctaatccaagaaatgccattacagccaaactgttgttaacttctctccgttaagttgtatgaaaagacaatattacccctgggcaaacatttgctcactcatcattctgtattgtttgcccacacaacattatttttgcattgatgcatatttgaattcagacataattattttgctatcaatcaaattatttcaaaattaaattcacaaattttgccatcaaaattatttcagaaatttcgctatcaattatcagggttgtgatatgagcagaaatcaggctatcaatgattttagaaattttgttatcaatctgagctaaataacaaaacatggtttcagagttgagtacaataggtagactgcctgacaataaaatagagctaccatcaatcatttttcaggcattgaacgtgcagactaataatcatgtcaaaattcgatactactttcatgtaacccacatcagggcaatcaacacacaaagtagcaattatgatgcttaagcgaggatttgggcctgaaaaaaaccctaaagcggatggagagagacggggagttgagcatttgagcatttgctagttgagcatttgctgtctgggtacttaacataaaagaacaaatgtaatacagagcaaagggacatgaaaaacataggccaagtttagttttaaaatttttcttcaaacttccaactttccatcacatcaaaactttcctacacacataaacttccaacttttccgtcacatcgttccaatttcaaccaaacttccaattttgacgtgaactaaacacacccataggctttccctcaattcagcctgcatgcgtgctccatcgctgatggatcccaattcccaaaacccctgccaccgccggcgtctagtgcccggcgccggggctcgggccggagtccatgatcccgccaagcatgtcgaggctgacagacttcagccactgcaggccaccgtcaccggcattctccatgctcccgaccattgcctccaaatcgaccgccagcgactccaccgcgtccccgtctttctccatctgcttaagcatctaatactcctgggagcgccgcatcgccgctgagggccgccgcgccaccgcctggggccaccgcatcgcccctgtcacccatcgtgttaggtttagggctgtcttcttatttttccaatttcttttcttttaacggattgagatagtataatttggagtgagggcgatttagtcatttttgtaaactttttttgttctaacagtgtggactaaacagtgcgttgactgtgatggcatttctgggacaaataggcttgtataatggcactttcaggaagttgtgcttgttgacggcatttctgggattagggtacttgtcaatggcatttcatggattctctttttttttattacacggtacacacaccactacatgcgcaatattacactcacatcccctacgaatgtgcctctaacgcatgcttaaagagacgaaaaccaaatgcacatccttgatcttactaaaatcatgttaaaaactcgcctataaatacgtaatattcgtgggtacaggatttaaaccctgatgaataaaatcatgcaccatgactccgccatcccaacactaattcttccccacctcattagacttgttaaccagctcttgcacattatgtaacaaaacaatatatgctaactagtaaattatactaattacataaaaaatagttggaagtaatttgtaggacaaaatactacttaggtgttaggagcagtaaataaaaaaaagactggactttttctttgctattttaacctttttagaaaaatattttacaaatcgacccttacaatttagaaaccttattgcacatcctcggtcctcggtatcagggacgttggcaccaaggtgtgatgtctcgacgccagatgagctgacaccaagggatgggttttgatgtcaattaggctgtgttcggcagcctatgtttccaactcccctcttcgttttccgtgcacgcttttcaaattactgaacggtgtattttttgcaaaaaaaaagttctataggaaagttgcttaaaaaatcttattaatccatttttcaagttagttttagctaatacttaattaattatgcgataataagctattccgttttccgtgccagagggataggctccaactggcacaaatgaacgcagcctttagtttggcactgacctctcccatctagatttttttagggaaactctcccatctagatttcctctaaatctatacattttaaaactaaactattcaaacaggacgaaacacccttcccctattttagctagttttgacatgagctagcggtgaatataagatgaatctcataagttggagttccacaaaccaaactagcagtgaaactgcaatgacagaataatctaagcaaaacccaaccctaattcaacaacggctactgaataaatagattctagggttgaccaaggacccatggacacgtccctaatggatgccaacatatttcgatgattctcgttgacttagaaggagtgttaacatgagaccagatccattggagagttgatctcgttagctttccatacatatgtagaaagtaaaaaagtaattcgaatgagatcttggcgatgattttggtgcgagcttctcctggattccaagatggattcaaacttaatatgaattgggcctccatctccaagcctctctccaagtgcttcctagccctcgctcatacacatccaaagcagtgatgccatcatcagttgctgccctagatccatgttgcgatggtcaccacactcactgccgtcctagaaccatgctcaggttcagctcatcgggaaagtgtgcaatgaggaggaggtcggcatgtgctcctagcgtgtcaaggagtaggcagcagggaggcgtgatcagggtcatcgtgtgcatggtatgaattgtctaccagagagacgggagagatgacagggagtacatggcatcatggagacttaagcaattaggcacacacttttatcatagcatgcatttttatctgaaaacaatgcgatatgaaaattttggcataacatgatcaa

SEQ ID NO: 66201 - DNA, 3647 bp, Oryza sativa
  unsure (1)..(3647): unsure at all n locations
nnnnnnnnnnnnnnnnnnnnnnnnnnnnnnnnnnnnnnnnnnnnnnnnnnnactatacttactactatcatacatggcctccatgccacaatacaaactgacactacttgtataccttgggtactgtagcatttccggcaaactagctagctgcaattttaagttcacaaagacgcggccacgaaagacgtcgagtatacggtatgttattattgagttgcatgcaccaaccagttaaactcaaaagcttaagctaaagagctaaggcgggcaattcaggacatatagattgttggtatgatcaaggagtgtcagttgacgaccctgcaagatgtcctgacctcgccggcgtcgccctccttgaggtcgagctgccccatcttgagcatcccctgctggaacgcgtagaagaagtatgcctggttcatggcgaacatgttcaccagccgcttcgtctccggcgactcgaacagcgtctggtcggaggtcagcaggccccgccgctgctgcagctcgcggaagtagaccccgtcgaacacgttgctcgtccggtcgaacgtcgccgtcgcggcgtccccgccggcggcgcacgtgctgcccagcgacgacgccagcgccgcgtccagcgtcgccgcctccgtcgccacccggttcttgaagttggcgcagtgcgcccgccccagcgtgtgcccccccgacagcgccaccatgtcctgcgcggtgaacccgtgcgtcccgaacagctggatcagcgccgtcgcgttcaagaacggcggcggcagcgccaccgtgtcggccgcgctagaccgcgtcccgtccctcctccccgtcgccacgccgtagtacgggccccccgccatgatgacggcgtcgcgcgcggcgagggcgaggacgtcggcgcaggagacgacgccggggcaccgcgactcgagggcgtccttgatgcggtcgatgacctcgaagccgcggaggctcttgttggcgagcgcgtccttctcggcggtgttgtccggggtggagtcgaggaggacggaggcgtcgcagccctggacgaagcagtcatggaagtggaggcggaggaggctggcggcgagcgacgggtcgcccatcagcgcctggctcaccacgctcctcaccaccatctccgcgaacgggcagctcatcccgtagtagtccatgctcagcgccgccgctcgccgcggcgccgccgccatggccaccacctccaccatgatcagcaacctcaccagcttcttcatcatcttcgattcactcttactagcttgcgatgaagaagatgagagtgtgtgtgagagtgagtgagtgatcacatgtatgatgcggtatttatagctgaagctgaagcacatgaacgatgtcgattgatttgaattatgcacaattgattaatgtacgtagtgcacgacatggatgaatccaaaaaccagagcactaaacggtggagagatcatgttgtagcaagagtcaaaaaagctctctgtgcctctctgaagatagcggcgtatgtagtgtcactcatgcatgcaaacgcaactaactgaatgtccgaatcgtatcatattaaccatataaaattgccatcagggcaatcaatcagtcgacgaacaatcttctgaaaccattttttaatcaatatttctgtggcattggtataatttcagacgtagtacgtgggcgtcgcatctgcagctggcatccatggccagatgccatgcatcaccttggctatcgccgtacgttgccatcgcagcggcgaagtgggtcactctcgatcgattcatccactttaaaaatccctttctgaatgaacaattgcacgcgcgtgcgtgcctggaaattcagtaatctctgcattacagttctacgtatgcagcgcattgcaaatgtagtgcagaaaggtatagccagccgccatggatttcaattcactcaaactgcgcctgcgtcaccgagcattatttcagttagtagtatatgggtagatcgcatagacttttcccatactgtgcaagcgatgcaagatgtgataggcccaaggcattaagtccacaatctctagctctgaatttgtctgcatattgtactagtggttggatcactagtaggccattaccactaagctaggtagtgatatatcatactgaaaaatctgaatgctgagagagtcatcccatcaagttgtttcactcattcattgattggagtgtatatggatagtatgttttcaccatcgtgcgaaatggtgagataactctgaataataatcttacatgtggttgatgtttagttgaccttgtaaggactaaggacggaaatattagtatttgcaatgtggacgtaataatgcatggagatgagtttatcacactaggaatatatgttgatgaacttatgaattataaaattaactgttaatgttctgtatatgtagttgtttaatcactacaattaagctagtgatactgaaaaatctgaatgctgccgagttacccctttctcttgtttcactgactagctcctgatgcatcatatgtacttaattatgcgagctcccccggtgacatttcaggaaaaaaaaaagagtaaaatgtattggcagttcttaaatttgtagggttgtgttatatatatctctaaactctcaaaatacatatccatgtcctaaaacttgccaaagtgtatcatctaggtcccaaatcgacacatcccctctggtattctacgtggcgctgatgtggcatactacatggacgtgacgtgtccttttctttttttttcttcttttcatttatttttctttttcgttttcttctcattcttctttttttcctttcttctgctcgggtcacagagaaaggagaagaaaggggaaaaggagaaaaaaagaaaaagaataattttaaatgggtcccattaatttgtcagtcaaaatgatgccacgtcatgtccgtgtggcatgccacattaatgctacgtaggatcctgaaagagttgtggcaatttggaaactagatgataaactatgacaagttctataacttagatatgcattttgagagtttagggatctaggtgacacacctctacaagtttaagaaccgtccgtacactttactcaaaaaaaaaaagtatgcaatctgaaacatatatgatgtttgagcatcgtgcgaaatctgaatgacaggttgtttcatagctttgtactatgaattgaaacctgaagaaacctatatgtttcactgaactagctcctgcatattagtagcatatgtatgcactaacgcagaggataaaattaggcaacactactttataagaaaaagggattgcttgtcaaaatagtggctgtcactccagaccaattagccatgagcccatgacattactgacatttcggagatggatttgttttgcgcatgttgtctagtaagtcatcaaaactttgaaaaaaaaattaacttatacaaatatgtaagttaaatttgaacctacatatttgtgcagtgatatactacctccgttttttaatagatgacgccgttgactttttctcacatgtctgaccatttgtcttattcaaaaattttatgcaaatgtataagatataaatcacacttaaagtacta

SEQ ID NO: 66202 - DNA, 14314 bp, Oryza sativa
ttaaaaaagggagggagtatcacatattaaactattttgttaatttattttaaaaaataaataactttttaggtgacatataaaaacaagtagcgcagataaactccttagactccacatgctatatcataaaagcagaggtcaataggctcagacgcatagttagcaacgcaaattggaaggaaaatgctttgtacatgccattttttatagtaatccctccgtcccaaaataagtgtagttttagcactgttcatatctaacatttgaccgtttgtcttatttgaaaaaaattatgattaatatttttattgctattatatgataaaacatgagtagtactttatgtgggactaatttttttaatttttttataaattttttcaaataagatggacggtcaaaacgctaaacacggatatctatggctgcacttattttaggacagatgcagtaattcacactgcaagttttctgatgccttattacaaccaggaatcacgcatgacagagttgagtagatattttatacacctaggtagtttaaacaattatataaaagattcataaaaattaataagagagattatgataatataagacactatataaacatgcaagtctaaattcaatttaatatgaagaaataaaaaacaacaattttctttataggtactattcactatatgattttattatttttatttctctaattgtagataaatatagtcttgcatgtttgtatgtagacttatatcatgatgttaatttttttttaaaaaaattatctataactatttgagtcgcgtcaaatgatggatgctatggtatctagtgcagaaaatccatatccagagtcgagtaaacaaaaagagagaaatacttagtagcaagtagcaacaaccatttcaatagttttgctcatgcataagcatgatccagttagcttattgctaactaggagtacttgtgatctacagtatcaactaatttcctgccatttagcatgacagggttgaaggaacaaaaataaatagctgatcaaatatacttgtagcatcagctcagtggcttaattagctgaaggtgagcacactctcatgcatgctgtcatcgatcatgcatgatcatcgatatctaattcgtttattgctattgatggtttgatggatcgattcagagggcggcgaggcggcggacgttgatgggggagacgacgtcggcgccgccgtagaaagcctccctggcgatgagcacgttgaccgccgccgtcgggtggaaggcgtcccagaacacgtagcggtcgcggccgtcgcacggcggcatgaacgggaggcacgtcacctggccggcgttcctcccgatgccgcagcatccgcggtccaccacggcgaacccgtgcgccgccgggtcgccgaggatggccttgaacacgccgtagttgtccaggaacaccaggctcgcgccggggaggccgccgccgtcgaggcggcccagcatcgccctcacgttggcgttgaacggcaccaccagcgcgtccacctccggcgagcaccggctctccacgctctgcgccagcacgttcgggatgcaccccatcgaccccactccggccaccacaaacttcctcgccccggccttgtacagcctctgcatccattattgaggacattgataagctcgaagatgatcgatcaatggcggcggcggctaattacgtacggtgagctgggcggcgtagcggtcggcgaggaggtcggcgaactggcgcggggtgtagcggcggcgggtgttgtagttgggcatgaggtagttgttgaggtagtcgttgctgcccagcccgacgaagaggatggaccgcgccaccatggacgccgccgcctccttgccgccgacggcgccggcgatctgctccaccgtggcctcgaagttgtcgatctgctggttgaacggaatccgtcccacctgcatttgcaatcaaacaacatcagttcttgatcgatcatttccttgcatgaatgatcaatccatggatcgagaggaggattgattgattggttgtgatttacgaagttcccgccgctttcgtcgaggatgccggcggcggcggaggcgaagttgacgccctgaagaagctgctgcacatgcccggacgcttgggagtatggtggcaccagtggcagcccaagcagctcagctgcaattagctcagtcagttaccattttgttctatattatgatgttttgagtttatcttaagtcaaactatttaccacttgacaaaatctatctatctatctatctattatatactaaaaatccattaaatttcctacaaacactcctaaaccgccatgtggcttatacaaacgctcttataccgctatgtggcgctctaacaaattatagaaattctaaggaaaaaataaaaatccgaccatcgattttcacttaatacggtggacccaccatttcacaccattagatatctatcttgtaacaaggaaaaaaaattcacaaaacccatccgtatcccctccatcacgtacataccgtacgtacgttccccaccttctctctctttctttccatttatttataggtagcaaattttatattaaaatattaatattaaataattagaatttcttataatatatttgattttaattattccatgtgttggagtgtgtgtgtatatgtgtgtatatatatatatatatatatatatatatatatatatatatatatatatatatatatatatatatatatatatatatatatataagaaatatatcatttgcatataaactcatatcctttatataataactaaatattaatacatatcatgcaatcgtaaatgatctaccctctctccttactcactttattatccttatttctggctagcagcttagtatataaataattaatatataattcttattatataataaagatttggtaagcagatccccataaaatatcatgcagatctatccattatacatcctttatagtgtttctagctcatcacatggcacatctaatatattataaaaagtactataaatgctgcaaaagaaacatttaatcaatgattttcatttaaatagataaacctattattttcaaccataaaatctatctatataaaacttttaaataaaaaacgtctcctccccttcctcctccttcctctcatcttacattattctggaaacatgcatatgtaaattaaaactacaatgtcaaacaaaaattagaaattcaactattaaatagtgttttgtcgagagacagcatccctgctttttttttccatgtcatccgaattgacataataaaatatgaaataattgaaaaaaaatcacatgcactcataatttatatgaaatatgccttttaccatggaatcattattttttttaccattagatttatcttaatagatagacaaaaagagaaaaggcccaatcccaaccctcctgtcctattacattatgtccgtacatatgcatgtctgcgccctcccccctcatgcacgagcacaacctcgcctcctattttccttctctcccattgtcctatttttatgcttattaattagatagaaaacatattttgtgatagcaatttctaaacaactataccacctaaactattttttttatctgtgcacctcattagattatttgcagtaaactttcatgagtcgaatccaaattaactactacttctgtcccaaaatgtaactatttttagctaaaaatgcttacattttaggacggatgtagtatatttaacaagtaaaagaaataaattactttagaccatattttggaggctagctattggtcagtcataaatatttaggaaaagccacaaagatttttaaaccatatgattaacaacatgttgcttacattataacaatgtgaaacacttttaagtagttagataacacatttgtggaaaataacaaataccgacgaagaatatttgtggagaaaacatactttgaagtatgacagtgctatccggttaatattatgttcttataagtttttgaaacacgcagaccacaatagatgcccgcgcgaatgcgtattaggaaatagttataacccctcaagccgccacgtggcatcctaaaaatactcccgagtcgccatgtgacattctaataaaatagagaaatctgaccatcgattttcacttaaacaggtgggcccattattttagatcgttagattatctttaaagaaaaaaaaaccctaccgtccctacctccgtgcaggatgcgtattgtacgctccctatcaccccttcttttttttttctctttgtttctttcttctttttttatctttatgaaaaaaaatccctacaaatagacatcatacgagtaagtccattaaacttcttagaaacgcttttaagccaccatgtggctcctacaaacgctcttgagccgccacgtggcgttctgataaattagagaaatataagaaattccaagaaaaaaaaagaaaaacatcgtaccatttattttctctttacacaccattagatctatatatgtaaaaaacaaatgtcacgtacgtccacacctctccctaggtccctcatctcctaacatgtacgtacatccaaagtacgtatgtctccccacccctctcttcatccttccatttatggtagcaaaattttgtatataaaaaccacaacaactaaatatttagaatatcttataatatattcgattttaatttgaactatgtttaccatattttggtatgtacatatataagaaacatatcatttgacataaacccctttatcgcaactaaatagtaataaaacattacaaaaagtaacatatatcatgccatcgtaaatgatctcctattatctctcatgctcactttcttatccatattttctagcgagcagttcagtacataaagaaccaacaaatgctatattaactatctattatatacttaaaaattcattaaactccctacagatcctcttaaactgtcatatggttttctataaacactcatgagatgccatgtagtgctcaaataaattaaaagttcctagaaattatgataaaaaaatcaaaccattgattttcctttaaatatgtagatccaataattataactgctacatctcacaaaaataaatcctatacccccacctccatccctaccgtatgtgagcatgcatgtacgtacgtacctccaccgtcctactcatctccgggatccaattctcatatcctatttttaagataacttttcctattttctacctagcacataatatatagaaaaataataatagctaaatgatcatgactctcaagttacatgtacttttctcagtttatttgactttttgtgttatttataattaaattcaagacccatattgcacatatttactatatataagttagataatactgctattctgactacaaatatttgagcaaaatagcacttcgaaaatgatgaatgaattcaaatgtgtgggtctaaagtccaagttcaatcaccaccaaagaagcttggaaccagaatgcacactctgggcctgaacccgatgaaggcggagctacaagacattattagcgaggtggacactgacggcagcggcatcatcgacttctacaagttcctggacctaatagcgcactaaatgattagatgaaggacaaggactaagaggaggggagcagagggagacgttccatgtcttcgacaaggactagaaaacagcttcatatttgccactgagccccgccacgtcatgtccaatgtatcaagagaggataactgatgaggaggtcaaaaatgatccgcgatgctgatggtgacaggcggatcaccacaaggagtttgtaattaaattcagaacaaaaatataaaacaagcaatttgattaaaatacacaaacaaaaaataaaaaacactaaaactataaaaaaaaacaagattccatgtagaatataaaatatcaagagtccctataaaagtataagttataaatatctaaaatttggaataataaaataagtattaaaagaagagatcaaatacaacacgagatgagattaagcgcaatttaaaatccctaaaaatacaatttagaataaagtaatttgatttgaatacaaagtcgaattaagaatcactcaatcactaaattcagaatacaataaatattttttaaagaatttttctatctttattgattcacatgcataacaaaatgcatatatatgaagcaattaaagagagggctagcagaatggtaaaaatatatatttattaccaatgaaagtttgtcgagatttcttcacgaaaaaaagatataataaatactcaattaacagtagagaatacattactttaattttttattttttagaactattttcggtacaaactaatacgcatgcccgcgcgaatgcgcgggctatcttcctagtttatagaaaaatatatcgatatttcaaacaaatatactatagataatttaagtattttctacacctggatgctatggcacctaggtgtatgcacgtagtttaaacaattatataaaaattttataaaatttgataagatagactatgataatataatatactatacaaacatgcaaggttaaatttgatctacatatgaaaaacaaaaacaacaaattttatccgcattgtacgggattcaatggtggatgttgctaagttatttacaaaattggccaaatttaaatgtaagaatgtttgacttagaaaggtaattagtaacacgtgagctagtaaatcaacaaaactaaactgataactcagcctttgtactactagtatttagtacaaatgaaattgtcagccaaatgaatcctatatatacatatatgcatcattgttttgttcagttcattcactgaaccattgctgacttgtgcgcatgtgcgcaggtcgctagctagccagttcattcagtgtcttgcagtcgagtatgaggtactggagatgaatcacgaaattttgcaagctccaaacaggaaatgccaactgttgcaattgcaatgttactgctacttctgcagatctggtctgcgaggaggaggagataactacatcgtggtacgtttcataaatgcgagtatgtaatgtgctccatttctgtggctctgttggtagtaaattgtgctctgcctaggatgttggatctgtgttcaacgctcggtgagaagatataggctggtcaacatgtacagcaacatcaccaatgttcatcacaatcaaacatgtgggctaattaatcacaagtcagtaagcagcctaatcaacaagcagaaaaaaaacacgcctaaaacctgaactctgttcgctcaaaaagatcaaaaaaaaaaagagaagcaacctgaactctgaaactcttgctagaaatctagaatggcgttcaaaaatcttcagattgcattgcaacatggttcaaacacaaatccattttcagcttagcttaaaaaaagaagagtaaattgcactttggtccaccttttattacccaagtttctatttggaccacccttaaacctatatttttaatttggaccaggtaaatttaccattattgcggtttggactactatgaacaacttttctcgtcatgtctaacttccctttcggcaaacatatgaaccacacatagaggagttcggccgtatattagagctaatgtgtttaaggtcgttgattgtacttaaaaaaaatcattcgtggtggttcaaatcacaacaatggtaaaatttatccggtccaaagtgaaaagatttgtttaagggtggtttaaagtgaaacttaagtaataaaatgtggtacaaagctttattcactccaaaaagaaatcgatatgcaatacactgtctgacagtggtgaacggtgactagcagatgcagtttgtgacaggggcggatctaaagtatagtcatcggtgtcaggtgacaccaacgactttcggcaaaacctatagcaaaactaattatctatatattataacatcatattctaaaatataattagtatactatgacatcgataaacacgttatgacaccaataaattaattttctatatccgccaatggtttgtgaggtaatgaacataccgagctcgtcgacgatggtgtagccgttgcagaagcggccggttgggccggcggcgaagtcgatgccgtaggggtagtagttcgccttggcgaacgacgccaggttgttgttgttcccgttgtcgatcagcgagtcgccgaacacgaacagcgccggcaccatcgctgctttccctgtcgacgccgccgcctcctcgctgccgccgccctccgccaccacgacgaataccgcgccgacgacgaccaccgcgcagagaacgaccatcgacgccggcgccggacgcagcgtagccatcagcatttggaagcgaaacgcaacactgtgcaggtgggtgcagtaggctgagttaatataaagcagggtgggttcgctgcatttactccattttaacaaacttaggcttagtttcaaatactacattactaagcaaattctggttacggattatctatttaattataaatataaattaaatattttggtaaataaacctaatagatagatttaataagcaacacaataataataagcaacacaataattcttcatgtgagaaaatatagagtaaattgcgtccacggtacataaacttagtaggtgggtgcgatctagtgtaacaacttgaaaaatgattattctggttagtacgtgcattctggtttaaaaaaacaatattagacaccacaccttttaagccacgtagtaaaaaaaaatcgtcgttgccaataatctaataaggataatgattgtcaaataataatggtctagatgtattgtatttgcttgcttacaataataaataacatgtcgattcgaaaccgaaaatatcgttaaaactaagtgcataaaaattgttgtaacatagtttccgaacgattctactactcaaatatattcaattgtactcatcaccaataattataatagaacaaacaaaataggttgaatcatatgtatgtaacaacgttttttaccaaaatgcacttaattgctaagtttatgtaccggtctatatattttttaagttgttgcactaaatcgcaacccatggtagttcttatactactgattcaatttactcgtgaaaatgtatttcttgaagcgtgaagtaaataatatctgtttaacaatccgatgaataatttgaaaataacctagcctgacttgccccaaatctgaatttacttcgaggagtaaatgcgctgccgtgccatagacatactgtcatattgccactgtgattggcgtgtcatcgaccgtggattgtgaaagtgcttcttcaatcgtgtaaacggaggcacatcttttctacgttaagacttagattttatttttggttaacacgtttttcaaattactgaacaatgttttttacgaaaaccttttatataaaagttgctttaaaatattaaatatattgacttgttaaatttataataattaaaacttaattagtcatgtgctagttaataagtttctcgttttacgtacgccaacataatcttcatattcaccagatgagcccagacatgtaaaagtggactccctctcttgcatgtcttttaggctgttttcttaagtccacttttccaacttcaactcacctgtttttcgcgcgcacgttccccaaacttctagacaatactccatccgtccaacaatatagcaatatagtaccagataggacacttcatagtacaataaatttggatatagtttctatccagattcattgtatcatgaagtatcatatcaggtactaggttactatattatgggacagaggggtatgtttttttttaaaaaaacatttatataggaaaattgctttcaaaattcatataaattcattttaaaagtttttaatctaatacttaattaatcatgcgataatatgtcgctacattttgcgttcccgaggaagaagctcccaaccataagacaagaacacagcctatgtatggatgagatttggcttgccctatcaaaacacgcctgatctaaggtgctttggtttactaccttcattttttaatatatgacactattgatttttttaatcatgtttgatcatttgtcttattcaaaaaatttaagtaaatatcttttcttttattgtggcttgatttatcactaaaggaactttaagcgttacttatattttaagatttgcacaaaatttttgataagatgaatgatcaaatataatgtaaaatgttaatgatgtcatatattaaaaatagaagggagtatctttttttgggaaaaaccgtccggtctttcaaaggaactgagccagacaccggttcctgttgaatcatcggtccggtctggttttctagctgtggtgggccctgaccaaccatgccggcccatattgagttccactgcaatttgggccaattgaggcccaaagtgagaaggcccattagtgactgctcctagtcgtcccctccccttcctcctcgtctccaggtagaagccaaacgcgaggcgaaaccaccacacctcaccgtcgaatcgaatccaaggcggcggcggcggcggcggcggcggcggcgatggggatccacgagcacgtcgaggggatcaaggcgcactgggcgaagaacttctccttcctcgactacttcaagaaggtctacggccgggacaagcccctccccaagtggaccgatgccgacgtcgacgagttcatcgcctccgatcccgtctacggcccgcaggtcaccctcctcctcctccttcccgcacaatccgtctcctgctcgtccggccgcccgtctaaccacgcgaattttcccgatcccccctgtgtttttgcagctcaaggcgatgagggaatccaggaagttcgcgctcggcggggctctcgtcggcggcgcgcacctcggcggcatcgccctcaagtactccaaggccccgcacggtatcaccaccaatcgcgacctatctagtaatttcaacttgcgctgtgattgcgcgtgcatccggtgcctgatttggttgggctgcaggtgtcgtcctggccaccggcttcggggcgatctgcggcgccgtcgtcggatcggaggtggcggagcactggtaccagctctacaagacggacaagcagggggccaacctaaggttcatctactggtgggaggacaaggtcgcaggtatcataccaccttcttcgtctcttgttcttctcattctcatgtgctttacttgctctaattcgatcaggccatttcctttgcaagtgaacactacatcacaatgatgattccggtagttgatttccgatgtaaaatttgtagtaattatgaggtatcaatattgtgcccctttagtgaattgggaatattagtttgcaatcatgagatggtctataatacagttggaatgggctaggaatatcgagtcgtgaatgcgaggtgtcgactctatgctgtttgagtaacttagaaacgtttgaagaatacaacgaagttgtgtgtcagtttttggtcgtggacagttgttaacacaactgatcaggataaagggactgcatgatgttgttccattgagctagcaagtaaatgcatcgcatttgaaggcctccttctaaccgtgttcgattttctttttgggtgcttttgtgaacaggaaaccagaaaagttgagtggtgtctatctggtccagcagcttggcaagagtgatgtccccccgctgggatttttagttgctcattcctagtatttccaaataaggtgtgtattggttgtgacgattacgcagatggagtatgtttccttttgctagtaccgtgagctctgtctgttcacagcctgaacaacaacttttgtgctctgaatggttcacaaactaaatgctgatctttaccggtatctgttgatctttgtccattaaagattactttgcatattgtaagtactgctttaccttgaagataataaggctacataacgtaaccaattcccccctgttagtctttctcaatggatcataattcctaagtgatcattggtgtctcctatgggatctcattcctagtagttttcaaatgaagtgtgcgtggttgtattttgcaattatgcagacgtagtgtgcttccatttgctactactgtgagctctatctgttcacagcctaaaacaactttgcacgaatgattaaattgcatctcggaagtactactctattttaaagataataaaggcttcataatgtgatcaaacttgtttttttctcctgttagtctatctcaacgcatcctaagtgatcatcggttatgagggcctaaacttttgacgttgtagttacttccaatgcatcaatgatcttgattccaatgaaggtcgaccattaatgtatgatgatatagcgctggaattgccatttcttgcatggtatttaaaatgcatatatttttcttccattcttttactaccatgtatggtgctatcatggcattgtgctgcatcctgagcaatgttgtgtaaacatcaacatttcatatgtacatgttgccaaaggactcgagtagttcattttctgatcttggttgtaggtcttcttttattttctgtaccatacttactgttagagttaatttttgtgtaatatgggtggagagcgctggaaaggtgatataagcattgagtttcagcgcaatttgacagtgttaatagttttcctagcatgacctcatcactttgatatttacagttattatttgcacatagattttgtgagcttaaacctggcaaactgaaaccatatatttagatagattttgcgagcttaaacttggcaaactgaaaccagatatttaggtagattttgcaagcttaaacttgtaaactgaaatccgataaaaaaatgcttaattctacaaatgtaataaacgttccaggaaacaatagtctcaattacttgaaatggttcaacaacagagctcctcaagagttctttagggaaaaacaaagcaccacagcccaagacaaatacaatactaaaagacacttcctgcgggaacttgtctaaataaggtacatcagaatagcaaagcaaacagcaacacaagcattattaaccatattacacactagtaatgaacacaagtatcccccaggccattattagtgttagaaggaatagcccatctccgagcccctacaagtagaatagccactcagtatagtcagtgggttagtgatctcttctaacagtgggactgtactaaaatgcccattctgttgatctgctaccatcatgcctacgtcgatcagaccattctgttctactatctgcaagcaaaagcacatatctgacatcagtttacggcacgctgcaacattttatcttcatttttaaaactggcaagtgcacagttctatgtcaatggactgccagtaccttttcttggagaatttcgttagcagctttcaacatgccttcctgcacgattagagataaactatgcttttagttagttattaatcattttattggatatttatagagttaaacaagatagtttggcttgccttgctctttagtgcttggatctcttggatcattatctgcatctgttagattaaagattttagatctcttgaacaatttgttctttatgaaatctgaagactttcaatgagttacctttgcggagcgaatgttgtacatccatatctctaagtacctctctagggcattcagctcttcaacagtcatgtgttcatttgccctgttcccatagatgtacctgccatgggttttaattttgtcaagagttaagtgtctgaactcattataatgtaaataatatatgatgtattcttattacatcaatttctcgagtaaacagttcggtttggtgaatgaagctcttttacttagtgtgagttcaacaatttttttgtaacacttccatgtatggttatgttacttgcagtgatctagtgaatgatactgagtgtggaccaagtctggatagcattgcatacttgttgcgatgtgaacttactaattggacatagaaagctatgtttgtttatgaaatcaaacttggatatttttgctggaagattgtatgattttatctattttttcttctagaa

SEQ ID NO: 66203 - DNA, 1179 bp, Oryza sativa
agcttaattatgtgctagcatctgatgggtaactggtcagtaatgtagttcaattcctgaataaatgttcaggctcaggagttgcatgcaaattaggtcttcttaatgcgagaaatcagctaaatctattacctaaatgcggagataaaataaatcttgcacctaatgttctggtgaagcttagattaagataagaaataaagaacttgaaacaaaagaaaattgagataagagccaggggcgccttggtattgtgattttgttggctttatggccgcacaaataaaactgaaattgggtgcctaatggctacaaaattcctcctccattttgctttacgaccatttgtcttgttaaaaagatggctagctttgctagcttaattaaaacatgatgcccatttggtgtcatgtcaataacccctctttttctcctcccctctctcttttgctgcacaaagcatctttacccaacaatttgcaatcccaaatgattctctgccattttaaatccctcacttgttagtgctctcacaaggttttcatctctatcacccttggcaaatttcccttttggcccacaggaaatggcataagtactcactgaaaaaactacagcttgaacttgagaggaatacattgacaaggcattctgtggaagagagtaccttgtccatgaaaatgatgtttcctcgtcgaaaatacatcctgacatgaacataaagtaggtttttatatcttacaatatgtatcaatataaagtggtagcagttctagaaaggtgcccttgttagttagctgagggttggagatggggatgaatctggagtgagtgagtttgtttgttcttgttttttcttttttaaaaaatgatgagcttaaaaagaagcacattgtttctatgatgagtcacaactcacaagtacagtttgctcgacatagtagattaaaaggtctttgatatgtgtcaacatataattctgttgtttggggatagcaacaaattctctcctgaaaaagaaattctgaattcagaactttgtgggggctcatacatctatataactgaaagtgcaaaccttcagatatacaggagtagtatacttttctgtcaatattttttttccttcaaaacaatttacaattgacaagatgaaagttactgcttactatagaaatc

SEQ ID NO: 66204 - DNA, 4978 bp, Oryza sativa
tattgctgagatgtacatgttttatagatagcaccttactttaccattgcgggtgctcttataatattgaaattataattagtatgtacttgattaacatatttatcatttggacatttggtcttggtctatttaatgtgttgacgatacattcctgggtgtgtacatgtatgtgttccactgtaatcaaaataagacaaaacgaaaaggtgacactgaaaatttacacatacgcactcgcgggtgtatgctggtgtttggttttaaacggctgaggcaacccggattaaacaaccctaataatatggaggctactgtcaaactggataattttcgccaggccatcgtcaaactagattgtgtttttaggccaacggcctgacgtcctgattttatagaatgcaactaaattcaaacattagactcaaaacaatactatccaagaagaaaagcattagactcaaactgcattgttgacatgaggatttcaaactttgttgcaatatttgactcttttggtccctttgcaatggagcatagtgccggtcaaatagtaactctatgtatatggagacgcacttgatagtgcagtggtaaggggacgtgtggtttcaacaccgagattccgtgtcaatctccaacatattcataaatttcttctttaaaaagtattcgaagggacgtcttttccttcaaatctcgattttaataattatatgtatatgacaaaataattttaactaaagaaagagggttcctcccatcctttagaggcatatacctccctatatattatttaagagcaaaaaaaaaccggttgaactgataaacaattttatgataggagaaaatctcgttctgtgcatggttctctcaccccgtcacccgaggtgtatacctcccaatatttgagagaaaaaatattaaaccgattaaactgattattaaaaaaataagtttataattggcaatgagctatagacttttctgggatccacaaggtatatatagggatatataccttctggctaatacaaatatctatacctcttaaaaaattatatacaaaaagggctctcaatactattctaatttaagtttagttttgatatctactttttatagctatgtatatcttgattatgacgaagtgtatacctctcccagataagagagaacgacttgtagttgtttggcacaaatccaccttagcaacttccccatttgctaattaaaaagagtatgacctacatatgacgacaattaatcgacgtaagtttaggggaatcataaaaagtaaaaaagtaaagtacaaattcatacagtaaactaggttttttcaatgacgtaaaacatatttttctccctatatgttccatatagtctatcatggttagcatagtcaacacacgcacttgattaacttacagtaaaggtaagccggccgccaaatgaatctagctaggcctcaatagccaaatttcccaacacaatatatatcttgtgtggagctagattttaaaaaacaaaattaaatttcacatacaactatataattctctttctaaaatacaattttattttctatataattgtgctgaattcggaaccaccatgattaaataatgctcatgtttatccggttctctgacaaacgtggccttctaagccttccggacaaaatgtggttgctcattatataaaaggcatatcttgagagggcaccaaggattaagaagagtatataaaccaaggcaaaattgagttaaaattaacatactgtccctatttgaatacattggaaatagagaagagtagttagtgagatgtgttttaggaggagactatacaataaatagggacacaaggaaaatgtcacgccccgaactagtaccgaccggaactagcccgtgacgctccaaattaacctgttagtcgataccagtcccaggaaacagtgctggtatcacaggaagacggattatcacagcaacagaggtctctttattatagagtagaggtacagtcatgttgggctgcggacagatcccgagctcacaactgcattacaaaagggaaacggaagccaggactaggaccaaacaacacaggcgcgacttgggaactaggccgaaaccctaaaactcatcgtagccggcttgctcctggaagaactcctcatcagcaggatccgcttcatcttcttcagcaactgggggaggattatttatatagagcaagggtgagtacgggagtactcagcaagccaagggaaaataagtgtttaatgcaggcttcaaggaaaggctgttgtttttgcaattgattttatttgaactcctttctgaaaacaactaagtgagtgcttctcaaacgacacggatgagacagtgcgtctcgtccgatcggagtatgtgcaatgtatcagtctttagaattgaatcaaggttggcacccggccaacagcttttcaaacggccacccgggccaacagcttttcaaacggccacccgggccaacaactttcaaacagccacccgtgcctagctgatcccgtcagctgcagattttcaaacatcgaacccctttccacaacagcaatttcacaagcagtagtcaaacaaaactacgctaggaatcacctcacatccgcccatgaccgtgggcacggctgttcgaacagtttgttaacctctgcagagggggtacactttacccacacgacattactaacccggatcacccagcccgtggggatcagccacatcgggagacctccaagctttcatgacaaggcatttccaaagccgacacaggtttaccatataccgacgagaggggtcccagatcaacaacaggttaggtcccagaccatactgtgccaggaagcccaggggtcctccccgacaccaccccggcgaatccacatgtctctcggcatcaaggctcccctgataagctagttactcagccaggggtgtcccattccacccatgtggtcgtatttgtcttatgtttggatgaaattccaaggaaacggtccttaagtgcaagagcgggaaaccgtacacccggtacgttccccggtccgcggttttggaaattcatttagttcgcaagcaccgacccaggtgtcgggttttccaagtcttttgcaaaacccaagttttacccaagtttttttttcagattttaagtttgaaggcgtccgtcgatactcgcacagggtgcacgaatatcgagacgcaactagatggttacaaggggacatgatataacaattaacaaagaaaggatcaaatgcaacaaattaggtaggtccgccaatctgccttgcagacgggacaaacagattaagtgcgatcctatcaatgcataatatttttcaagcaacataattaaatttcaaatataggctcaagatgttcaaaggtggcttgccttgctcgagatctggagcttgatcctcgaaatcctcgcactgcgggtcttcgggctccgaaactacacgcgaaacgggataactcaacaaacggcaaaaataaagccctattaacgacctctaagcgtgccattagatagatctcgatatttgaggaattttggaagttgaacggagtcaaacggatttacggttgggaagatattgaatttctaagattattggatttttggtctaaatgaaaaaggatttatttaaatcctttttgaaaaagaaaaagaaaagaaaagaaggagagagggaaatcagacttccatcgggcggctagggcgcggcccgagagaaaggggcggctcggccgagctaaatgggccggccggcccaagaaggcggcccaaagcgcgcgcgcgggcggagaggagagagggagccggtggaccgagtccatctcgcgtggtcccgggtgggacccgcttgtcagcagctcggctcaccgtgcggagggagcacgcggcgtggcgctagggtgtggagcggggcgcgatgcatgcgtggttcgcggtggacgcggatgcggcgggcccacgcgcagcctcacggctcgcggtggaacacgcgcacggggaggggctgaccggggtcggctcgacccggtcttggccgagctggcgccgacgtggcgcctacgtggctgccacgcgggccggcgggaggtagacgacgatgtcggccggaacggacggcggacggcggctgcgaaaggcggggcgaaccacggcgattcaggcgaaagcgagcacactgggtggttgcacaggacaaggggagacgagccaacggctcggattcgccggagggagcttgacggcggcgaatcgcggcggcggcaaccggcggcgggagaagggggaaatggcgacgaggtcacgaggggccgattcccggcggcgagagcatctacgcggctacgggaatccgatgctagcgttggattaggaggaaacgcatcgagggaggccggcgacgagaggcgcttccgagctcgggcggcgacggcggcgagcacatggcgagcggcggcaacggtcggggcggcgccggctagctacgaggaggctactcgtgctactacccgagtctaaggggaggagatggaacgaggaggaagaacgggggaaggcactcccgtgcgggcgggcgcagtgacgagaggccgacggcgcgggagtgatctctccggcctcgggccgaggaagaggaaggagagggcgcgcccgaagtccccttccgtgtccttgctcgtgccggctcctccgacatgcgcaacgacgaacggcgacggcgaacagagcacgggaggcggcggcaatggcgtggaggcgaatgggagaggaaaggaaagggggaggcttgggtttataggggcggcaatgtcggtttgggacccgacttagggtggtcaaaggagagggctagcgctcggcggtcgcggccaaagcggcgacagggaggagggaggaggatgacgccggcggg

SEQ ID NO: 66205 - DNA, 7637 bp, Oryza sativa
  unsure (1)..(7637): unsure at all n locations
catgttttctcgcacgtttttttgcttgtttttttcgaatgttcttttttgccttttttcgatacaggagaatatatgacgaaataaaaccatgtagtagatggcaaaaaaatcgatggatcctatccaactcaagcgtccattaatttagcttttttctgacagttttttcagagcgatttgtttttcaatagatggtgttttttttcttgcgcgattttgccatttatatgaatcagattttttttccgttcggatctacagtttttttcgccacttaggggaaaaagacttttgttgttgctgtttttctttattttcttttttgtacggcttttctttttctttttatgcccctttctaattttgttctctctcttttattatttttttaacaaaaacgacctcaagtatcttattgcaagattatagggactcaaatgtaaatataaaaattacagggacttaaatgcaaaagtacagacccaaaaattaaaatcaaataaaaatggaatgctctcgacttgtatgttccgtttttgcaaacagatctccaatccgacacatcaattttttttcaccaattagagtcggacttttttttcccttctaagagggaatcggatataggagttggactttttaattttttcgctatttttttacggacgaaggaagcatctcttattttttaagtagtagagatatcaacatttttttcctgtcctatatattatataggaatgttttccgaaactatgtttatcatttaaagaaaatgctatacatacttttaaatatttattaaaatgtctatgtacaacaaacttacgaatattataatcacacaacaaatttctatacttccaacaatatagtttacgaatttctacatatccctcatgtattgaagggtaaaactgacttttctatacctattaaacggtcaactaacagacaattgatggcaagggtatggaagggatccaaatcaaaattcagaggntatacaagggagtgaagaaaattcaggggcatagaagagatcagctaaaatttcaagggtatggaaggaattttctcgctgatataactatatggagtatatggagtagtttgtagccactagcaattattaaaatctaaaactcaacacgtaaacatatcaactcaccattcactagcaatttctaggacattataaatctcatacaagtatgacacatatcttccccacatcatttcacaacatttcaatattcattatttatataataattcacatatatttatctctgaatttcacgggaaagcctggagtatcatgtggtatatatgtacttacttactacctccgtcccaaaatatagcaactttaatttatagataagaatacttatattttaggacggatggagtatttgtttgcagcgacccaaggccagagacttggtggtacgtatgcctgttgactagacttaagggagtgtttgaggagaaggggattgaggagattaggaagatacgtaaaacgaggtgagccattagctcatgattaattgagtattaactattttaaattttaaaaatggattaatatgattttttaaagcaactttcatatagaaattttttgcaaaaaaacgcaccgtttagtagtttgaaaagcgtgcgcgtggaaaacgagagccaatctcccctatcacccctaaatgaacgatgccttagcatcttggcccgaatgcccaatcagtcccagaataatgctatcaaagcactgagatgcttcaagctcttttttctaaaaaagataacgagatgctccaaactcttggagactttcttagaggatggtacctagctagttgggaatgagatggaaagaacgtttcggttaaaaccggagcttccaatcacatactggaaattccgatttgaaccgaacattttcatcattctaatataatatgaagttgtgataatttttaggagcgcctattcaccccctcttgacgacatcgagatccttttagtctcataagctgcaacctctcttttattataatgtgtaatttttggggggcaagtaatataaatataagacatagcatataaataaattatctaattctagacaatagataaaatctgatatttctttcaacagaaactacaatcacttattacaaaattattggcgcaaagccaataggatggaaaagaagagaaatattaactgcaccaacaaaaagaagatatacaaattattcagatagtaatcctatcagtaatttttcatccaaagctggtcatatatattactaacctaatcgatctgaagcttgacatttggcccggtaattttaaaaatgaagaggggcagtataagaagcgccggtttgaaccacggttgcctggctacgccatgcaggaaggcccgtagtgatggcgagaggtagttgagcgctagcattgcacgttcaacaacgggttggagtaagttgagtagaaactcgcggatgtgctgctcgtatgtttccattaaccatttcagcacgaaacaggccatggcgccataaactcctccgttgagctcgatcgctaactgccagccgtccggactgtgaagatgtatcgcggtcctccggcgccatctgctacaaaggataccccataacgcagcatgtttctcctcgctccctcttgccagtcaccggtgctatcgctctcagaggtgtggcttcccatgtcgctctgctctctgttggtttcgacttgtccgctgacggcctccatgaactcctcgtcggcgatgagcttcgccagcacggccggagccaggcaaacctccagcgacatgctcccggcgccgtccggcccctcgtacaccgtcaccttcccgtcgaacttgttcgcgccgccgctccgcacgctcaccggcctcccccacccgaagtcgttgcccaacacgtcgaaccgcggcgagctccccgtgatcagcgccacgccgccgccgccgccggactgcagcttcgacatgtacgtgaactccggctcccgcacccaccgctccagcgactccctcgtgcccgcctcgtcgaacgacgccacggcgcggttcagctgccatgccgtccacccgagccccttctcctcgatctcgccggccgtcgcctccgccttgctcagcgacagcgcgttcccgacgtaccccaccgggatgccgttcacgcgcccccggcattcgaccatcaccgtgtagaacgtcacctgctccggcgggagtcgccgggcgcggcacacagctcgccacaggtgcgcgagcacggcctggagcgacgagatggtggccgtgcccgtggccgtgccggccatctcctcgttcgccctcgccttgagtttccgggcttttgttgccgagaaggtgaagaagcattcctgcacttccggccgctcgagccgccggacgatgtgctgcagtttgccgaccggcatggggatcggcaccgggctggtctcgacgaaccaccgccggaacaccggcgccggcgtggagatctccctgatcaggccgtcgctcacggcgccgccagcgcggcggttgatctccgaccatgcgttcatgaactcccagaaggtggtgccgtcgccgacggagtggttcaacgacatgccgacgaacaagccgtcggcgagctcggtgacctgcaccgacagcactggccgcgactcgacggcggcgtcggcgccgagcaccaggttgtacgagtagaacgaccatacctcgggcggcgtgtagagcgacgagacgacgtcggacacggccacgccgggcgccgccgcgtggacgaactcggcgccctcgccggtgcaccgcagcgtgacggtgacggtcaagtcgtcggtgcgctcctcggcgacgagacggccggtgaacgggtggaacaaagcgagggcgcgcgcgaaggaggacgcgagggcgtcggcgaggcggtcgccggagagcggcggcttgggcaggaggacgcccttctggatgtagtcgatgctgaggaggcggaggtcccacggcgtgaggtggatgtcgcacggcggcgcgtgaccggacgacgacaacgacgacgacggccggacgaggcgtcgggacaggacccggacacggtcaacggcgagtgctacgtttcggtggtcattgcttcccatgtcacgctgctctcttggagtccgtacgccttcttttttttttttttgaatccgtgctactggggacaccagtcacaccacgtcttgtgcgtgtgcataatagtgtattttatgggcaataatatatagaggtccaactaaagtattactccaccagtagaccctaccatattttagaaaggtgacatgggatttctttctcttcatttttttttatctcttctcgttaactctagatgttgacattttaatttagaaactattaaagtaatttctatactcatatatatatatatatataaattatatacctagtgggttgtttttttggaaacaaattattatccaatagcctctcgtctctctcttttcatccaactattcaattgtttccattgttggtacctaaaaagagttgggttttttttatgagaaatgatttttttcagctttgttttgctctctttattaactcttttatcgcatcagttttttttcttacacgacaacatatttaatgctatagaaactagctaaggtgaatgattggtactgctttaaaagctagatctaaaatgttatcaaccaccctaatttgaccatatctttaggatactccaatatcatatataattaacaattcaattttagtgttggatctcaatccagaggatctcttccatcccttgaaactgcattgttgacatgaggttttcaagaagaaaagcattagactcaaactgcattgttgacatgaggatttcaaactttgttgcaatatttgtctctttcggtccctgtgcagtggagcatagtgtcggtcaaataataactctatgtactacctccatcccaaaatgtttgacgccgttgacttttttaaaaatgtttgaccgttcgtcttattcaaaaaatttaagtaattgttaattctttttctatcatttgatttattgttaaatatacttttatgtatacatatagttttacacatatcacaaaagtttttgaataaaacgaacggtcaaacatgtttaaaaaagttaacggtgtcaaacatttagggaatgatggagtatattttctatataattgtgccaaatttggaaccaccatgattaaataatgcacatgcttatctggttctctgacaaacgtggtcttctaagccttccggactaaatgtggttgctcattatataaagggcatatcttgagtgggcacaaaggattaagaagagtatataaaccaaggcaaagttgagttaaaattaacatatcctatttggatacattggaaatagagaagagtagttaggtcatttacaacctaatgactaagatggtgtccatagtattaaataagttgtcacttgggatgaaaaatgatatggcaagtgaataaatgaggaaagagaaggaaaccatgtcttgcatgagacatggtttctacacaacatccaagacatcatgtgagataagtagcattaaattgaagtatggaatagtggtgtttgcattggaaaagtagtgtctagtactagtttcttgatgatatggagtttatgaaaactatgtctagtgtcataggttgggaatggctttagtgagatgtgttttaggaggaaactatataataagtagggacacaaggaaaacaagcaagaaattgttatgcatgccttacattttaaaacaagataagaaaaaccatatgctttattaaaacacggattaaaatataatggatatattaaagaataaaaccataatgatatggctgcacttggaacattgcaaaccaaacttggctgtcaagatgctccatgtctttggagatgtgtataactagtataaaatatatagcccagaacacgagactgccatctctcagtcttttactagtattttaaatcattgcatttacgacttaattatacacgtgagccaccattgggagactagcaactttctatctgacctgtcttggttttctcttcggttttgtcttgatcatctctttagtttagccgatgtggttgccaatggcgtgataaaagaaaacctacaattaataagcctaaaaaattacaattaatgcccctaatgaaacccaaaaattgacacgaacggcgtgtgagttagcaagacttaagacttgcactcagtagtcaatatatcaataaataaaattaagggtgagtttgaggagagagggattaagaagattgaaaagatacgtaaaacgaggtgagccattagtatatgattaattgagtattaactattttaaatttcaaaaatggattaatatgattttttaaaacaactttcctatagaaattttttgcaaaaaatacaccgtttagtagtttgggaagcgtgcgcgcagaatacgatgtccttttgtcacccaatcccccagaactcatcacaacgaacgcagcctaagagcaggtacaatagcagggtataaactaactgcaaacatattttaagaagataaatgaggagagagaagagcagcgggctacagatttgtagccagctgtagcacggacttaaagacgcagtgtgtgtatgacaggtgggaccatgtattaatagtgtagtatgtaactattatatgattgagctattagattggctatagatgaattggagctagtagttaggcatactattaaacttgctataagaagattggtacagtggagcaaaagacaaacatagtctggcacgatatgtcaacactttggtgacggtatctggtgatctactatgtgtgttcgtgactccctttttctaacccctctcccttatttttcacgcgcaagtttttcaaactgctaaacgatatattttttacaaaaatttctatacaaaagttattttaaaaaaatcaaattaatcttttttttaaaattaactaatatttaattaatcatgcgctaatagatcactccgttttccgtaaatactattcggttggaaaagtctactggcgaacacagcataggaccgcagcgcgtgaccggacgacgacggccggacgaggcgtcgggacaggacccggacacggtcaacggcgagcgctacgttccggtggtcattgcttaccatgtcacgctgctctcttggattccgtacgcctctactagacacacaacaccttcagcatatgcttcggcacataaaaccatgtaatccctcgatcaaaaaaaaaaccttaaccggatatgaccttcttagtattacgaaccatctccagattcgttatactagaaagggtcccatcttctagtagattaagttttttttaacagataaagtatacactaacacatactcctaattatttaatttttttaaaacacaccaattagtttgataagcatgacgtacggaaaacaagataaatgagttgagaaact

SEQ ID NO: 66206 - DNA, 2226 bp, Oryza sativa
ttactctcttaccatatcaatttttttcttacatgacaacatatttaatttaatgctatgaaaactagttgaggtggatggttggtactgctctaaaagctagttctgatatgctatcaaacaccctaattcaaacccagggtttgatttttttttgatagagtagtatatctttagaatactccattattagatataattaatattggatctcaatccagaggatctcttccatccttttgactatattccttctccaaaaccctgtgtattatattttggtgctaccaccttgccaccacactatatttgtttccacaacgctacctacttgcaagacatcatcaccgtcttctctcccatgcgatcggagatgagggtaagaaacctccaactttgcatagggttgacaatgagggagaaaaacaagttattataatataatataatatatagtggcaattctaacttaatgcaggattgacaatgagaaaaagaatgagtttgttagaaggtaacatggggtacggtggtagcaggctcatatatatctaggaggcgaaacataaacaatgggcaagaactgaagaagcaatggttggccgccgatatgaaaggttgaagaaatcagccatattaactgacataatcgttggacatgataatactaatgactagagattacctattggctggcgcacaaatcggatctcagctaatgatgcgtattctcaactcgagatgttgacattttgctcatttgtgatctgcggctgttgatttcctgatgagcccttatcatattgaaatttataattaggtatgtacttgattaacatattcatcatttggacatttggtcttggtctatttaaaagtgtgttagaggatatattaattcatgggtatgtgtacttgtagatcgagtaatgtgtgtatgtgtttcactgtaatcaaaataagacaaaacgaaaaggtgtcatcgaaaatttacacgcattcccatatctataaagttataacccactaattttaaaactcaacatatatacaaacatgctacctcatcatccactagcaataattacatacaaaaattatgcaagcatgcaacatcatctataattcattgaattctacaaatcaacatccaatcatcttcctttacattatttttcattatatatatatatatatccatcatttttatagtaattaacatatattcatccatataaccaaagtgagggatatcatatttcatctataatctcatacagagtttactaaatttatttctctcttaacatagtttgataaaccagatttatttgttgttaataactaatataatttatacttttagcttgattattaaaaaatattaaaagttactcagtaatttccacagcaaagcgtggggaatcacatagtattataagcatactggtgtttggttttaaacggttgaggaaacccggattaaacaaccttaattatatggaagctattgtcaaactggataattttcgcggggccatcgtcaaactagattgtgtttttaggccaacggcctagcgtcgtgattttatatatagaatgcaaataaatttaaacattagactcaaaacattttttttgactgaaagtatcctagcagtgtgattttcatttattgaaggaatatttacatggaataattacagggaaaaacaagagaaaatgaaaaagctctataaagattgtaaccaattaataacagcttgcttgaggggatccttcattctgcagagatgcagaagaatttcatttataaagagagactttcaagattggaaggttggctacaaattcctgaagatgaggccatttctttatttccagatgtgccaagcaaccacgaagaagatttctagaaaaccgggctgattgaactgccatcttgtgagagctatcctttggtaaaattcaagattggcattctatttaattcccagaaactgccaacaagcattagactcaaaacattactatctaagaagaaaagcttagctttagactcaaattgcattgttgacatggggatttcaaacttcgttgcaatatttgactctttcggtccctgtgcagtggagcataatgccggtcaaataataattccacgtatacgacggaaatttttttaaaaaaatatcaaatactccctctgttttgaaatgtttgaca

SEQ ID NO: 66207 - DNA, 2247 bp, Oryza sativa
  unsure (1)..(2247): unsure at all n locations
gtgtttgaccgttcatcttattcaaaaaatttaagtaattatttattcttttcatatcatttgatttatcgttaaataaactttcatgtacacatatagttttacatatttcataaattattttgaataagacgaacggtcaaacatgtgctaaaaagtcaacggtgtcaaatattttgaaacggagggagtatgagcaagaaaagttacggaaagagggttcctcccatatatatcctttagatcctttagagacatatacctccctattatttaagagaaaacaaataaaccggttgaactgatatacaattttgtgataggaggaaacctcattccgaggttctctcatccgaggtatacacctcccattatttgagacaaaaatattaaaccgattaaactgattattagaaaataagtttgttatttgcaaggagctagctagacttttctggtccacaagctgtataaataaggatatataccttctggctaatacaaatatctatacctcgtaaaaaaaattatatacaaagacgggctttcaaaactattctaattttatttagataatggaatataagattagttcaatactattctaatttataagattggttttgatatctactttttataggtatgtatacgaagtgtcccagataagagagaacgacttgcagttgtttggcacaaatccaccttacactactagaaaaatggtctttagcgacgttggccatttattttttcaggcgggtagacacctaaaacacgcaacaccgcctaggaagccagctaccggggccatggttgctttccgcctgcgaagatagttctttgcagacggaccacctaagctagccgcctgcgaagactaagcttcgcaggcggaccacataaggggccgcctgcgattattccaggcggtcttgttatgtggttcgcctgggaagctcaatcttcgtaggcgcccattttatgccgcctgggaaatttatcgcaggcgacatattttaccgcctgtaaaaatctggccgactatatagtcttattcctccccgagctcctgttcatacccgacgattttctctctcttaaaggcaccaaaatataggggggaggttttaaactttaaattttcaagggatttttctacggtggttagatatatgcctttgtactctatatacataatttttttgtaatttaaactccctttttaccatggatctatgcatcaggtcgtcgctcatggcgccgccagcgcggcggttgatctccgaccatgcgttcatgaacttccagaaggtggtgccatcgccgacggagtggttcaacgacatgccgacgaacacgccgtcggcgagctcggtgacctgcaccgacagcacgggccgcgactcggtggcggcgtcggcgccgagcaccaggttgtacgagtagaacgaccatacctccggcggcgtgtagagcgacgagacgacgtcggacacggccacgccgggcgccgccgcgtggacgaactcggcgccctcgccggtgcaccgcagcgcgacggtgacggtcccgtcgtcggcgcgctcctcggcgacgagacggccggcgaacgggtagaacagcgcgagggcgcgcgcgaaggaggacgcgagggcgtcagcgaggcggtcgccggagagcggtggcttgggcaggaggacgcccttctggatgtagtcgatgctgaggaagcggaggtcccacggcgtgaggtggatgtcgcgcggcggcgcgtgaccggacgacgacgacgacgacgacggccggacgaggcgtcgggacaggacccggacacggtcaacggcgagtgctacgttccggtggtcattgcttcccatgtcacgctgctctcttggaatccgtacgcctcgatctactggacaaaccacaccttgaagatgtatatagtgtattttatggttgggctcttactctgagattctagtattcgaggagctaacgatccaataaacagaacctactatatggagtattttagaagtgcagaattaaaattgtatgaaattgaatattgttagagtgaagtgcatgggtggtccttaaacttgtacggatgtatcatttagatccctaaactctcaaaatgtatttttgagtccccgaacttgtcatgagtgtcatgtaggtctaaacggactctaacccgcttcgtgagatgatgtggcatgccacngtgacgcttac

SEQ ID NO: 66208 - DNA, 5201 bp, Oryza sativa
  unsure (1)..(5201): unsure at all n locations
acatgtcactggcttacaaaatacaatttacatatagaggggagagagagagagagaggagaaaataagttttttaattttgaaaaaaaataaatgaaaacaagagaggataaaaaatgttttttatttttgtatatatgactgacatatgggttccaatgacacataggcgccaccatggcatgccacatcagcacacgaagtgagttggagcccatttgaacctatatgacactcgagacaaattgagaggcctaaaaatacattttgagagttcagggatataggtggcacacccgcacaagtttagagaccgctcatatactttactcatattgttatataaggacaattctaattcagaaactactaaagtaatttccatactcaccatgtcatacatacatacatatatatatatatatatatatatatatatatatatatatatatttatatatatttatatatttatattatatagtggtttgttttttcgaaaaaaaattcttgtctaataacatctcatctctctcctttcatccaactattccattgttcccattgttggttcctaaaaagagttggttttttcaagataaatgatttttttcagctttattttgctctctttattaactctcttatcgcatcagtatttttttcctatatgacaacatatttaatgctatagaaactagctgaggtggatggttggtactgctttaaaagccagatatgaaatgctatcaaccaccctaatttaactatatcttgtcacgaccggaattaacccaacgggcgttcctttcgtgcgtgtattattccttgtcccaggaggcaaggtacaccaagagttgatacaattcagagtttaacaagcggaagcgtaaatagataatttattacatgggcgacgaaggcccagcacacacaaagacaaacgagaaacagcggaagacaagggcgacgaccacaggcgcttgacggcaggcacgagctagacaccaaagccttcatcaaccaggggctcctcttctgggttggaaaaaattaagcaagactgagtacaaccaccgtactcaacaagacacacccacaagtgcataataaatgcaagggagtacaagggagttataatataaagggttagggttgcagtaaacagcatttaaagatgcttagttgctcaaagctattttgtaaacacgattctagaactatgcaatattatttatcaaggccgtgaacccacacgaacctgccttaacccaaggcctacgatgattcaaaccgaaccggcaacccgaccctgggtcctagctcgtcccaagccaacccaggccaaccattccacattttagttgttaagcaggttttaagaattaaaacactaacttgggtacattgctcggcttgcccataaccgagggcgcggctattcgaatagattatactctgatcagaggtgtacatctttacccacaagacacatcttcctcacgtgcaaccacgtgccacataccaccacggtatacagacggaagacgtgacatagtttccaacccatcctagccatagacaagagtaccgacccaatcccacctacggccggaacccccgggacaggcaggcaggactgagcccctagcagcaggacaccggccctgtgccacgacatctcgactaccgggccgcagctcgtgtagccttcatttgccctggagatgtccatcgacccccgacttcgtccatctccatccgtgtacttttgtttataaccagactgagccacaaactaagccttacccactagacatgtggaagtacggtagtgctttgcaacagaggcccgaagaccggtccttatatggccgaggtgctactatcaaaaccatgcaccccgagcccagcctaaaaccattttggggattttgaatagagggggcgatgtgaattcaattccacaatactccaacaattccaaagtgtccaggtgatatgaatatcccaaagtctagagttgtaaaaccgcctaatgttacctaattaaatagcgaagcatctacctaacatcatactagtggtaccatgagtagagtgtccactagttggggttttgtttaatctagggtgaacaaggaaataataacaataacaataataaggtcataacaaaggtaaataggcatgctaaataaaacagtgataacgcgggaatttaaataaagcgataatgcaataatttaaatcaacataattttataaactgggattcaatatgttcaaagatgatgtgacttgccttgctcgctttcccaaacgtcggcttcaacctccacgaagagcggatcttccgaagttgcagcgtctacacgaccaacggaaaagaaaaggcttttactctaataaactccatataacaagcagaaacaaagcacaaaaatgggttcttgacttcttaaggaaaaattagagacttgaacggtccaattccgagttcaaatggccaagttatggccatttgaaggttatatgctctttaaatgaatatttgcgaatttcttcatttaaattttaatttaaaatggatttattgcgtcagccgaggggaggggcgcgcagaccgggtccacgggagtggggcccacgcggcagcctcacggtccacggtggaccgggtgcacctggctcacaccggccggcgccgtgggtcccacgcgtcagccgcacccgagggcgcgggcggctgacggccgggccccacatggcagccgcggggcgcgcccgaaggcggccacgccggcacagccgacgggaggcggcgcacccgcgccccgatggtcgccgccggcgaccaccggcgcggtggagcggcgcccgagagaggggagggaagggggaaacaaatcggcggtccacagctcaccccgggtcgacggcgacgacgggaacggcgaccggagcggaggaaggcggcggcgcggctcgggtagacggggacggcggcgttccggcggtcggcgggcgaaacggaggggtggacgaggtcggcgaggttgcggcgaaaccgaaggaggcggcgccgaagcgggagaaggtccggggcgacgacggcggcagaccggagctcggcggtgacggcggagagagagagcgacggcgcgagctcgattccggcggagagagggagcggcgagtggcggaaacggtggagggaggcacggggagtgtttatatagggttgggagtgagagagggtggccggatgagggggaaacgggcgcggaagatccggccgccattgatgcgccggcgaggtttagggggaaagtttccgaacgaatccgagggagagagggagggaaaaatggggggaaagcgggagggaatcacggggaatatttcccccctcttgattgcacgctgggcggacgggagcggcgggatttgcagcggcggcggcgctagggcacgggcgatgcggcgggagcggcgggaggaaggggatgacgggtgggccccacccgtcagcgaaggtggcgggcgggcccgcccgtcagcggcgcgcgcgcgggggggagaccgaatgggccgcggggaggaggagagagagggaagaagatgggccgagccggcccaagagggggaggggggaaaagactttttaggatttttctttttataaaatcattttaactttgtttatttcttaataattattatttgtgctctgaaaattccactaaaatttatttacgcattttaggcttttaggaaatatacaaaaatcctccaagccttatttgacttttaactttgcacattttaattgtgggaggctttcacaaggattttaattattctaggcataatttcgaggatgtattttagagtcgttttgggacgcgacatatctttaggatactccaatatcagatataattaataattgaattttagtgttggatctcaatctagaggatctcttccatcttttgactatcttccttctcccaaaccttgtgtattatattggtgctaccaccttaccaccaagctatatttgttcctacaagtctacctacttgcaagacatcatcaccgtcttctctcccatgcaattggagatagatgagggtaagaaacctaccgtttcgcagaggagcggcggcgcagctgtacggcgacgatggcagcgcgcgccgtgaggatggaggggcgccgtcagcggccggcgccactagccggagccgtcgccgcggccgctccgccctcgccctcccgttgcctccgccggccagacctcgcctgcccaccatcgtcgctaacatgtgggatagagagagaagagattagagagagaagtgaagaaagggatggagagagaagtggaggggatagagagagaagagattagagagagaagtgaagaaagggatggagagagaagtgaagggggggatacagagagaagagagataggagagctgacatgtgggcccaagggcatttttgacatttcacatgatttctctctactcttcaaccaaaaattattactttaatgcgtgcggtgtccactagcaaaaatccaacttttgggagtgttttcctccaaaagtcacttcgtgcgatgtcctacagctaaaactgcgaagtcacggtgtcctgtagcaaaatttgcctatctaataacctctcgtctctctcctttcatccaactatttcattgtttccattgttggttcctaaaaagagttggtttttgtcaggttatggatactgcataactaatggtaatcgactaagttcagcggggcccaccatataccaagtcttatatggaatcataccacgtatatagaagtagttccggataaagaaggacgaatagagttctatatggaaacaacaatgactacttggattgtatctatattggtctccctagttctacttggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 66209 - DNA, 7871 bp, Oryza sativa
actttcccatctctcagtcttttactagtattttagatcgttgcatttacgacttaattatactatcttcatctcaaaataaacataatcatgagttttcatatctaactttgatcgttcgtcttatttaaaaaaattataattgatatttttattgttattatattataaaacatgaataatattttatacatgacttatgttttttattttttttaaataaaacgaataataaaagttggacacagaaacttatagctgtgtttatttagggatggagggagtacatgtgagccaccattgggagactagcaacttcgcatctgacctgtcttggttatctctttggttttgtcttgatcatctctttattttagccgatgtggttgccaaaggcgtgataaaggaaaacctacaattaatgagcctaaaaaattaaaattaatgcccctaatggaaccccaaaattgacacgaacggcgtgtgagttagcaagacttaagacttgcactcagcagtcaataaataaaattaagaagattggtatagtggagcaaaagacaaacatatatagtcgttgctgacacgatctgtcaacactttggtgacggtatctgctgatctaactacatagtttgtagccactagcaagtattaaaagttaaaatttaacgtgtaaacatatcatctcatcatccactagcaatttctaggacattataaatcttatacaagtatgacacatatcttctccacatcatttcacaacatttcaatatgcattatacaataattcacatatattaatctttaaattccatagcgaagcgtggattatcacatggtacatagtagtatgttcttatttgtttgcagcgacccaaggcccgagacttggtgatacggatgcctcttgactagacttttaaatagcttcttggcccgaatgcccaatcagtctcagaatgacgctatcaaagcactgagatgcttcaaactcttttttctaaaaaagataatctcggggaataaatctgaatatgcacttatttagattcgccgtcagaagtttgttttttcaaagagataatttgatgagagaggcttgcgggttggtgttagggatggcaggttaatttgatgaggtatgtatggaacaggcagactgtcgttccaacttagaagagcgaggtgtgcccatctacgtacaaaattaggccaacaatacttgattgtttcatcggtttttatatgtgtcaatcacatatttttatctatttgtgatagacctaaacttaaagctcagtctaaatttgtaagaccgtaatctacagttttaatgtaataagtatgtatttttttaattcacctagatatgctattccctttatatttttgtttacactagcaaaatgactgtagttgcagtgggtgaagaagaagaaagatggagatgattcgatgcctttagtgtgagttgtcaatcacactatctagataaaaatatgtgattgacaatattttgttaattattttgacaatatttgtgatagacctgaacagtgccaaaaacagtgccgcccagtgataaatcgatggctactttggtgctgcattttggagccgtgggaccgtcgctgtgctgctcgaccgtcccgcggacccttagtctcgcgttttggagctgcgggatctgagtatatttatgcaaatccttcctatacaagcatataaacgtaaattattaaaaaaaaagtatattcgtaaatttttcctgattaaaatgtacccatagtggttcggaattttcttctccgaacccacaaaagatatttttaatggtactcgtaaatactactccatcccaaaaaagaccaatccagttaggaaatgaggaattttcatgggatgggtggtagacatcaaaatgagggatttttacttgttgcaaccttcagttgcatatttaacatgctttaaaatggtaaataataattttaaaattgattggtactctcacaatactaagtttgatgaactctaataattcagctgatgaagtagaccaaccctaatacttcagggatggagtagacttattcctagtaaataaaatacatagttctctcttcctctcataaaaacaaatctaatataaaatgcgacattacaaaactacgaatctagataggacagtggacatcccgtactagatttgttttgcctttgtctagattcgtactagaattaaccatgtgtcgccgttcagccactgacgtcagtgatgtgtcggcggcggcgcagtcaccgcgctcatgaactcctcgtcggcgactagcctcgcgagcgcctccggtgccaggcaaatctccaccgccatgctcccgccgccgcgcccctcgtacaccgtcatcttcccgtccaccttgttcccggcgccgctccggacgcccaccggcctcccccacccgaagtcgttgcccaacacgtcgaaccgcggcgagcctgagatcaccatcacgccggcgttctgcaggtccgccaccatcatgaagctcggcttctccggccacgccgccaccatgcgcctcacgctcgcctcgtcgcccgacgccgccacggcgcggttcagcagccacgccgcccagcccagccctttgtcgaggagctcgccggcggtggccttcgcgacggcgcccaccaccgtgttgcccatgtactcttgtggcacctccttgacccgtgctcgcaatcccacggaaaggccatagctcgtctccatctccggcgcgaggcggcgggctcggcacacagctcgccaggtgtgcgcgagcaccgactggagcgaggatatggtggccgtggcggcggcggcggccatctcggcgttcgccttctccttcagcgtcctcacgctctccgccgagaaatggaggaagcactcctccaccggcgtgtacacaggccgccggaccatgtcctccagcttggcgaagggtagagggatcggcattgggatgccgtccacgaaccatctgtcgaacaccggcggcggcgtggagagctcgaggtcggcgctgtcatcgctgcggcggctgatctccgaccaggtgcggaacaagtgccagaaggtgaacccgtcggcgacgccgtggttgagcgacatggcgacgaacatgccgtcggcgagctcggtgacctgcgccgccaggacagggcgggactccacggcggcgtccgtgccaagcatgccgttgagcgggaagaaggaccacaccacccttgggacgtagagcgagtcggcgatgtcggcgacggtgacgccgggcgccacggcgtggacgaactccgccccctcgccgttgcagcggagcgagatggagatggtcggaacaccaccaggcgacgccgtctcggcgatggcgaggcggccggccagcgggtagaagcgggccagtgcgcgagcgaacgacgagacaaggtgttcgacgacgtgctcaactccgccgggaggcttgggcaggacgacgcccttctggacgtagtcgacggtgatcatctggagatccaatggcgtgaggtggtgcaccgtctcgtggtccggcagctcgccagcgtgctccgccgccggtcggaccatgcgccgcgacatgatgtggacgccgccttccatttcgactagctctcgagctcagtggtacgtacgtgttggactaatggtacgtagtagcttaggagtttatatcaaggtatgaatctgtgattgctttggctggtgacatgatataaatgcatgtcgagctctcagatgttagagcatctctaacaacctctctatcagcctctccaagccaaattttggttattcaaccaaaaaaggaggtccaacagattggctaaccggatggccaagccatccagcagaccaaaatcgttggctggctagctagatttggccagtcaaaacgtctcgccaacggtggcccgcagcaactgtactcctcgcgaggtcgtcgggggcgttgtcgtcgttgtcgaggtcatcgtcggggtcgtcgtcgaggtcgtcgtcgcaagccgctgccaccatcgccatccccgccctgagctccaccgccgcgccccccaaaccgttgtcgccgtcaccgcctcccgcctccccgcgccaccgcaccaccgcgccatgcgtcggccgcctcgacgggaaggaagggggaaaagaaggaaagagaaagaaggggggagagaggaagaagaggagagagagactcacatgtgggtccgattttattttggagaggattaataaagattctgttggagtaagtatatagtttgactagctaaatcagatagagagttggctatatgggtgtttggagagttcgatttggagaggctgttggagatgctcttaggccttgtttagttcccaaaacaaaaccttttcacctatcgtatcgaatgtttggacacatgcatggagtattaaatgtggaaaaaaaccaattacacagtttacgtgtaaattgcgagacgaatcttttaagcctacttgcgccatgatttgacaatgtggtgctacaataaactctaatgacggattaattaggcttaataaatttatctcacagtttctaagcggaatctgtaatttgtttttttattagagtacatttaatacttcaaatgtgtgcttgtatatccgatgtgacaaccaaacctaatttgtttcccaactaaacaaggccttaatattgcttgctagatggaatgtatttttttcatggcactgaatctctactacttaaaaaatctggattagtgatggtgaagccaaagtagacatgcgatccaacgtagtaacgtagactagtttggagcgacgaaaatttaaaagaggtacacgcgatgcggaacaaaaaagcgtaaaaagccatgtcgccccgcaacccgcgccccctcctccgcgcgcctccatcgccgccccgcaccctcccctcgcctctcctccgcgccgcccctccaccagcagccgtctccacactgcgccagcgcccctctcctctccacccgcgtcgccgccgtccccactgcgcgccgccgcccatcgccttcccaccacgcctccacccctagccggagaggcgccggccgcgccgcccctccacctccaccagaagccgtccccacaccgcgacggcgaccctcgcctctccacccgtgccgccgccgtccccactgcgcgccgccgcccctcgcctccccaccgccctcgacctgcgccgcctcctcgcccctcgacgccctcgaccgctcaaggtggtcacagacgccgtcatctgaaggtatgtatcccctcctatcccctcctgccccaccatgtcgcccgacaatatggccgccgcatgttcgatgaaatgtccagtaagaagctccatccatggactcaatctgctttggggaaatgagcaccaaatgaacatgcacttgaatattgtacagatcagttgcaacatgtatggtttcttttataattcttcatgtacataggttgaatatgaaataatacctcggttaccatgtgcctgcctcacttccaaacctttcaatcagctgacacatgagctatagaacaaacaacgattcatgctttttacgcgggttgttctatatttatcatgatgactctcagttcaggttaattatattgaaaaactatggtgtcaagagtagcatgcttgagtgcttaggaatacaacaatatttttagatgaaagatgaaggttgaaaaatcattagtttacaaatgcagacttcctttttttctccaacccacctcactgttttgctaatgacatgatgattggaggagggcagcgttgcaatcattcttgtgtatatattattggtatatacttttgacggatgatttcggtaggcgtataaatgaatgtactgacatataatatatatatatgcgatccttcattaccatatcagttcgaacagttgcttcccacccacataacctccttccctgcattgaaggtatatccaattaattcgcttaatttcctttactgtgtgttgccaattttcaacgtttttataatactaccatcagcaccactgggattctgcctgatggtttgtactggattgaactctaataaattttgacttgtgcatttcagggttccaatggatagcaactttggggcctctcgaccgacatcgttgacaggatcaggtgagtttttcaaaaaatataataataggtcaatagctcaacctttgccctatgttcttatttgttccattcatatattttttccattcttggttcagccggtgatcctccccttggagttctttcagacattactaatctcagtgctgctgaattaagaaggaaacgtgctagagagaggtacgctttgttgagtgtggacgagaaggaggcgaggaataaaaaggcccgtgagaagaggcgccaaaagaaggaggaatgccaaggaggaaatcaatctggtgctgctgtgaaaggtaactacaagccaactcaactcatcttgggccatctattctattgattaacccacatagcgagtgaccaaagatatccacaaaaaagccatctattctattgatttgcatctcttcaccgaatatgaatgaagaacccaacagctattgcatcttatttttgaaggggtgcatgcttatttcctttagctttcacacacttccaatgccagacaatgcaatgcataaccataaatttaatcaagcaaccatttaaggcagaaaaaaatacttactgcaagtgtgtgggataagtgtgttaaatgcctcatcaaatgataacaatcacgcatgctggacagagctagcccacatggcattccaccttagaaaaaaagaaaaactattagccttcttgctcaactccatgtatcctcggtctctactctatgatgctctcctcacccattgctccctcactgcctttcttcttgttagaaagtataccacagaaaaaaaatagaatttataaaaactgacaaacaaatgatattttgcatgctccatggtaccagccaccaaaaaacacaaaaaggaaaacaatatgatgcaattttagtgttatggatgttcgcatcagattattgtttgcatttcatgttactaaaaaatatatggccccatgttaagaggtaaacaactgccttcagtatattttgtggcttcgtgcacatttggtagcatatattagcatgcatagatataactataggatgactgcagaaacaaagtgagaatagggaaacaaggcatgaaagcagaaggtgatacaattataatctccatcttcatgtactctaatacccagaggatcctccgtcgcctcatatatttctctattctttgctgtaatatgtatcggtactaatgaaaagatattctgccaattatgccaaacaatcttctaatttcgcggcgtcggaacagccccacttggcgatattacaaatataagcgctgctgatataacgacgtgccaaatggaagtgaatgattctcccacactgcatcaaggtaagaataacatattattacattccgcatgctataagagggcggaatgcaatgccattattgttgtgtacagtctgataacgtgatggttctatgttttaatagaaagtgaagcttcccatctcaacatcacacctagacgtctcccatttacaatcatcaacaatgtagctcactatggtcccaatgaagtacctttgagctgcgtaattcaaacaacccaaatatatatatatatatatatatatatatatatatatatatatata

SEQ ID NO: 66210 - DNA, 5154 bp, Oryza sativa
ccatccagtattacaaaagaccatctacagtcaaagctacctcaatgtagcgacaagcctgcgactcttacaacggagcagaagcaagctaaggtgaaccggcagagatcacgacatcaatcactaacaaaagaacaaagattagatatgaacgcccgacgtagggtagcaaggcaaaatatgccagatgtggaaatacatgatatgaatgcccgccttaggtcaagacgacaaagtgttactccaggggaaaggtctgctcttttggcacgacgtaatgcactctatgcagctaggcgtgacaaaccatgtgctgaatcaattgcattggagtgccctgagggtagcagcccgtcgttgctagatccaacgccttgcttggaaacaaccggtgatgtgccagctacatcgaacctgcaagctgagcatgctgcagatcatcttgcacgatcgagcaccttcgaggatggtatcatatatatatgttatcgttcatacttgcaatttgtaaccttccgcatactaacttttcattccactatagatgatatggattccttcatggatgatgacaccgacgatgaatactacttgtttgctaggctaggtaccatcgtcgttatacctgaaactctctttcacttcagtagatatttgaaactaaactacttcccactaaacaatcccaggcgatgatgaggatgacgatatggtacaatccgatgacgacgacacgcaagcaccgacctcttcgattcctgatccatttgactgtgtgtatagcaacatcccacaaagcacaaatgttctgaagcctgagcctgactgtaaacattgtggcgccaagaggttccagtacgaaccgtcgggcttctgttgtcgggatggcaagataaagcttgtagaaaacgagacaccccctgaactgatgaggctctagacaagctcggatccagatgccaagcatttccgggataacattagatatttcaacggtcacttctcgttcactacccttggtgtaagccttgacaaggcctttgcaaacatgagctcgggtgtgtacacatttcgggcccatgttcagatctatcataacatacattctttcggtcctagagagtctagtccagagcatctcgagttgtatttctacgatgacgatccaaccttgagtcacagattccgtcgttctccgagccttgaccaggatgtgatcaggactgtttcagacgtcctttggaacaacccgtactcggagacatttagaagtctggggcaggctgatgacctcgcgaactaccgcgtgacactaaatctagatcataggttggaccaaaggcgttacaatgtgccggtgacaactgaggtcgctgctgtctgggttgaaggaaacgagagaaggaagtttgagcctagcgtgacaatatacggtaacgaccgtacccgtaaatgcatccaacctttctacggatgttacgatccactctcgtatcctttgttcttccctagaggagagagtggttggcatcaaggtcttccaaaggacaaaataaccatggaggctgcaaacacgcgtcatggcgatgatcctagtaagtttatcttcgtactgtgttgactaaaacaattgataattgtccgttacatgactgcactaacccagacgtttctcacgtgcagattgtaacagcgggatacgagtttctgtaagggactactactgctacaaattccagatgcgtcgtgggattttcaatcctatacttcacgggggacgcctgttccagcagttcgctgttgacatgtacatcaaggttgagagctcccgtctggactatgtgaggaacaaccagaaggagataagggccgacctatatcaagggttaatggacagcatccaggctggggagagtcgagcaagcgcggtcggcaaacggactgtgttgccagcgtcgttcgtaggtggtggccgaaatatgaagcgccgctacatggatgccatggccttagtacagaagtatgggaagccagatgtattccttacaatgacaagcaacccaaagtgggatgaaattactcgtgagcttgagcctggccagacaccacaagatcgtcctgatcttgtggtctgtgtctttcgagccaagttagaggacctaaagaagcagttgttcgagaaacacattcttggcaaggttattgcacatgtttatgttgagttccagaagaggggtctgccgcatgcacacttcttgttgatcatgagtagtcgatacaagctaacatctgcggaccaatatgactgcatcatctcggctgagcttcccgataagaaaaagtatagagagctgtacgatatggttgttaagcatatgatgcatggcccttgtggtccactcaatggtaaatgccaatgcatgcgagatggaaagtgtaggaacaactacccacgagagttcaaccctacaacctcgcaaggcaaggattcatacccgttgtataggagacgtaatgacggcaagagtaggatggttagaggccaccctctcgataataggtgggttgtcccgtacaatccatatcttctaaggatgtacaactgttacatgaatgtcgaggtttgttcaagtatcaaggcaataaagtacctctttaaatacctatacaagggacacgagagggcctcgatatccataaacgaggcagataacaacggcgaaatcgatgagattcagcgctacagggatgcgaggtgggtgacccctccagaagccttgtggcgtatatatgggtttgacatatgccacatctcgccgtctgtgaggcagttgcaacttcatctgccaaacatgcacatgttggcttccgatgcagacaaggatctccgtgatgttcttgataaggaagacgcaggcaggtcgatgcttacagcgtatttcgaggcaaacaggcagcatgtctgggctcgagatatcctttatagggatttcccaatgtggtttacttggcagacgccaggtaaatactggaaaaaaagagagaaaggaggccaggtcgggagaattgtgtgtgcccacccggcagagggggagcgttactattttcgggtgctgctaaaccatgtggcaggctccacctcattcgaagacctacgtattgttgatggcgtggtcatgccttcgttccgtgctgcagctgaaagaaggggtcttatagaggcagacaacaccctcgacgagtgccttacggaggccggggtcttccagatgccactgtcgctacgcaggttattcgctaccatattggtgtattgcgaacctagcgatgtccgtggtctttgggacaaacatctagatgccatgtctgatgactacaagcgtaacaacacatgccctcatgttgtccaacagatggtgctgatagatatccgaggcatgctacaatcaatgggaaaggaaatcacatcgtttccgctccctgaaattgacgaatcacatgatagtaccagaggagatcccagagagattattgaggagtcatccattggtgtggagacggacgatatgaacctctcagaccagctcaatgatgagcaaaggtctgcattcaacaaaatcatgaatgcagttggcagtgctcaggggggtgttttcttcgtagatggcccaggaggcacgaggaagactttcctgtatagggcgctgctagctacggttcgcggcaaaggagatatagcggtggcaaccgcgacgtcgggtgttgcagcttctataatgcctggaggccggaccgcacattcgcggttcaagatccccctcaacattgaggaagggtcttattgcagcttcaccaaacaaagtgggacggcgaagcttctccagatggcgtcgcttataatatgggatgagacctccatgacaaagaggcaagcggttgaggccctcaatatgagcatgagagatataatgggttgcccgcattctccgtttggagggaagacgattgtgtttggaggggatttcaggcaggtgctcccggtcattaggaagggcactaggtctcagataacagatgccactctacgcaggtcctatctttgggattgtatggttcaattgaagcttgttcgcaatatgagggcgtagagcgacacgtggtttgcggactacctccttcgagttgggaatggaaccaaggaggtgaacaaggaaggactcataggccttccttcggatatttgcgtgtcgtgcaaagggaatgaaacagacctcaaaaggctcatcgataccgtgttccccaacctaaacgataacctgacggacccaaactacatcacatgtagggccatattgtccactcggaatgagttcgtcgatcgaataaacatgaagatgattgagcggtttagaggggatgtgatgacatatcatagttttgattgagtagaggatgaccctcataactattacccgccagaattcttgaactctctaactccaaatgggctacctccgcatgtgcccttaagctgaagataaactgccccatcatgcttttgaggaacattgacccagccaacgggctttgcaatgggacaaggctggtggttcgtcagttcggaaaaaatgctattgacgcggagattgttgtagggcagcatgctggaaagagagttttccttcctcggatacctctatgtccttctgatgatgagatgtttccgtttcgcttcaagaggaagcaatttccggttagattgagctttgcattgaccatcaataaggcgcagggtcaaaccattccaaatgcaggcgtctacttaccacagcctgtcttctctcatggtcaactatacgtcgcgctgtctagagcaacctctagaacaaacataaaaatactatcgatgccggtagaagacaagaaacaaaataaaaagtctaagcgtactggcgtgaaggacaatgagaagaaaggaaaggaattgtctaaacaggctgcaacatacacaaaaaaatattgtgtttagagaggtcctcacggattagaaaaggtatattatgtgactaattaaccgtccacaatatgcttgcttaaattccattcttactgctgagtgtttcttcacagtttagttcacgtatggctttgtat

SEQ ID NO: 66211 - DNA, 18826 bp, Oryza sativa
gtgttaagatcctttggttaattttggttttgaaatgcagctcaaaagatcaagtcattgtggattgcagaatgagagggtcacgttttgaagtaactgcagtcagcatgaagctattgtgtagatactagatactggtgttggattgagagggttgcattttgaagttactttggttggcatgaagctattgtgcagatactgtatactgtttttttttaaagttggatactggagttcctgtgactaattgaaaatcatagctctcttggattgagccttccaagctttgacaagttagatttgagcgtgtttgcatatttcgtatgagtacaggaaaatatgcattacatttccatgatactagaatatggagtaatctggaattagatggtttacgaagaatgtggtgatattttagtgctaaataattttatcttttctctctttttctttatattaatctttaatctatctcgtggattagcaactgaaaaaaaaactttttgtatgcgtgcctttaccgattaaaaagggcatactgtaaaataaactacgacaaaatacaacaaattcaacttcaaaattaagttttgaaattttaattttagctttcaagcataagacagacgaagctgatattgtttttttatttgtgttattatatagtcgttacagtcgtgatgatcagggaaaccacttaggtgttaatccttgctaatatagcctggtgatatgccatgttttgtctaggaagagtttaccaggatgtttactacgcatacatgattcaggtagttctctatggaggaacttgtatatgtagtgcactatggatgtttgccagcttaacatgattgtctgggatgatttgtagaagcgggctatattttactcaacttgtttctgcgtagcatgctgataaactaagtgtctggtggtttagggcactacgcaacattgtgatgagtgagccattgccactatgctggtcatggagcagcaaagcagagactatatgttaaggtgatgtcctctgttcataaatcctcaaataataaagatttgagtgtgaaatttgagtcatatcttttaggatgaatctatttatgtagttgcaatgtgtgcttatggttttgtgattggttagtgcaatatttgactactgatttgctccatccataaagagctcgaaataagattagttaaatcttatttgagttttaaatttcagtttgttaaatttgctctttttcatgccagtgtgagaaggaatatgatttgtgcattccttaatatacttatcagtggtatttttgaggttctgttcggatgtattatatctttgtgtccttggataaaatgatctcctatttacttattagcgtactgaagattttttttcttctcacaaattcatccatctccattcattatgtttcttcatcacattcgatagtaacacaaacagcaagacccaattatcttccttaactgatcaactaactttggatcaacacattgtcgctttcaggacattggcccttgtagtcctggaaattattctggaggtggctgtgacctgagcatacagtacagactggatcctccctctaaaccatgttatttcagtttctgacttgcatgctctatgctatttcagttggtgacttaaaccttggtagaaccctgcacaaataggaggcgtcatcttaatacaatgaaaaattatgggaactccatgccagatttgtcaagacaatcaagtctattctttcgtaagttatatcttcactgcctatctataattaataggaagaggcacaccaagttattgatcacataatggtttgatttgagttttcccggccacatgttataggaagaggcacactggccaatgtaacaaacttaactgctgctgaggttagaagaaagcatgacagggagaggtatgcttcactctctaaaaagcatgtggtttctcaatagtaagggttcatattgatctgttctatggaaattcagggtcttgaggtcaaggtcattgacgagagcatccaattaaggttgtgggaatttgacatgacagtatttaagtttgtcaaaccaaaatttcttttcaaaagaagcgaataatgtcaagattgtgtgataagacactatttgactatgaatgattgatgaattaagctatattaaaaggatcaacaagaaatcttaataaatatactgcaatatgatgaatagtgtgaaactcactcatgttatagcttatatgttattatctggaatcaactggcgaaaaaatggaatctttatcatgtaagcctgatttgcgatttttcactacgtaggtactttcatgaaggtaagtagcagaaattcggtgcccgtatcctgttgtttctggttgacgtcttcagatcctcaacagaatcgaaggtaaacaaactattttccctgttttccttgtgtgaatgatatgaaaaaatattttgcacttgttcagtaatttgtgcaaactggaaatactgaaaatactaaggacgaagaataatattcgaagccaatccaaaagcattgcaaaatgtcgaaggacaaaaactcccagtaatgcttgcatgaaaatagattaaaacaggctctccgcgaacaaaatacatttcttaatattgctcatttgataacgaggctggaaacctaagcttttttttgttatcaaatgttgcacatttgataataatccatatttcttaatattgtctgcacctttcgtttgcaagctccaagttgtaaaatccaatcctgactgcaagcttgtttacaattgtttggctagcagtttgaagcttctggagtattaccactagcaacagtaggagcaaggtctgatcgggtgctccctgtgcatagctgctattggttcattgttgttccaaagtgagcaatagtatactttagaaggaaatgagggtgttgaggcgattgtcaagcaccaaacttcttccgcaataaccctgacttccatgggaaccgttctgttatttgttttgctatagaatgagaaccattgtgtagaattttgtaaacaactttaaccattgcttctcagcatgcaaatgcagatccattcctttccaaaaggattaggtaccatttagttttttaaatatatgattagcaattgtctataagcattaggaatgagaagtagatgaaactatagacaaactttctaatttgtggtccttaatgtgccgttccattcattaattttgttatatgtggtactagcatgtgaatactataaagatgtgaaaattataaatatgtgacatacttatcattagttctatattaatgtttttgttacatccgatttacacccaatgattatttaacatcatttcacttggtgtgattttccctgttgcaatgcacggacaccctactagtatttataatttttaaacatatggcatataactccgcgaatacacaactttaaatttgtctttaacaaatataaccatgaacacggatactagtcagagtttaattcattgttttgttacagcttgtaaaaatccaatttaaccacgcatatttgtgaactgatatatctcatattatttaaaatatttttttatatctagataaaatgcaataaagcgaatgagaggacgcttgaagaggaaaaatcattattattattattattatttattattattattattattattattattattattattattattatttttattattattattattattattattattattattattattattattattattattattattattattattattattattattattattatgttgttgttgttgttgttgttgttattcagagctcatttcattcatcaagaaactgcagaattacaaccttcagtcactaggtgctcgatacaagctgggactgaatgccactcacccagcctgtcatcagcttcgctaaggcatgagctacacgattacaagatcggtgggtatagagtaaagtaaaaccatgaaaaccggagctaagctgtatggcatctctggtaatcggcgcagtatatatgccatctttggatgccaccctgcttccaaagttgtacttctctcgggaaattaacttactttctctcggccggcaagttgtacatcccatcccggcaagcaagggcctccatcatgtcatcgatgagagcatccaggccatgggaatgccatctagctacgccggccgccctagctttgaaccacttgatccaccctgcgggcggtggcctccatgtttgccgctcagcagtccgctttacgtacggggtctttgaaaaacaaacgagtaacgtacaatcgtgaatgaatgatttgatatgataaagggcatccgaggaggcttacccgactttacacagggagatccacaattaaaagagctaaaagatgaaatataagagaacaatgatggggttaaatagtagtggtgtcaatattccagtatccaaaactaaaactatagatggccaaacgggcggcacggcccaggcccagctgtgcctgggccgaggttagtgatcagggccgtggcgtgccagcccaaaggcacgacggtccatcgtggttttccacagaataagtctatttttcttccctcaactctgtgggctgggtccatatggctggaaataagtctatcttgtattcctcttctctttgggccctatctgatatggttcattaagtctattttacgtccctctacttttttaattcggtcatgccgtgccgggccagcccaccgtgccgagggtgcggcacgggcacgaccccgagttgggccgtgccgtgcttgggccaggccaaaatggcgtgccttgggccgggccacgggcctcgggccatatggctatctatatccaaaacacatacaattataaatttaccactgatttaaattgcacgttattaaatccgctgcctacttataatccaaggtttccttattaaatccgctgcctacttataatcccaggtttcctttgaaacgaagaaaaagggaagaatatttggtgggatttgttaagtaagaaaaaaaatccaatgaaatccttttcataaaggataccaaaggattgatccctatatattattttgcaatttctctactgccttccgtttcccctcctgtatatatatagggataaattcctatgaaatccttcaatgtccactatagggataaattaaggccctgtttgatttagcttaaaattattataatctagcttattaggagtaagctgaaacaaacaagtagattattatagcagattattataatctataagtcagattattataatctaataagctgctctaaaagagcttttttcagattattgagtggctaaaaacccactgcccctacatacttgagaaaaattacccacctatgccatcaaccgaacagatagctgagggcattatagactttagactttcaaacccaataatccatgcctccaataatccagacaaacaaacaactcacagcttattttatatcagcttattataatccagcttatagcaatctggtttaataatctagattataataattataagctgaaacaaacagggcctaggtctgatggaatccttccgtgtctcttcctcccaccacgtgcaacacgctctcaagcgttaagtatacataagcagatccaatgttttgtccatattgaactcatctctatttatatgggcctaatcctttaaaacgtaagagcatggcatgttacacccatttataatgagccaatccataaaaaagttttgattaaaaagagcacgaggttatgccttagttcctgcttgtttttctaatgtatcatccaaacattagtttggaaacttttctatggtttggtttctgtaatactccgaattcaacacgcatgacattttattggtacatttctattatgtttcagtgtttgaatcctgcattctaatggtgttttaagaatttgcggatgagaaaatgtgataaacctttaatctttgcttaataactaacgggaatgcccttgtgtgcgggggagaaaatgggagtctccggtgaaggaccacatgggcaccgccccctgtcatccgatggcctggtcgaggatgtcagacgatagacggtactccatctgtctcataatataagaaatttcagaagcatataatatatcctaatactttgaatctaaactttaataccagtctagattcgtcgtattaggatatgtcaaatccctccaaaatcctttatattttgggacagaaagagtaagacagaagccgcagtgtgcgggcaggaaaaaaagtgaaaatatatctctttttattggttttacataaatatacatgtttaaaagggattcatagaagtatgttgttgtcgtagaatggaagtgcgaaatcatgcattactgtacaacttcgcgtgatgaggacgcgataccgcttggggccacgcggcgagtgtgtgagaccgtacgatgctagactagtagaatatgtgcaatgtaggttatccatagcattgtgcagtgctacgtatttgttgcaagttatagaatttaaatttaaactggtatatttatgaagtgatatactccctccattatacaatataaggatctagcaatatatgagaaatactctagtactatacatgaatctagacaaacctcttatctagattcgtagtactaggggactgtttaaattcgcattattaggatgcgtcttatctaatactaaattattatattataggacgaagcgagtatcatatattcattatcctattatgtttctaaatatgttcataactattataatgacatgcaagcagtgatactaattggtgcaactgtgcaagcaacagcaacagtagcgtaatttaaatatgttcataactattataataacatgcaagcaggattactaattggtgcaactgtgcaagcaggaatagcctaagcatggtgatgaaatttgtcatagtttaagcaacaatagtttaagagatcattttccatgatctcctgatctcctccattgtcaaaggatggccacccaccacctcacatggtaggctataccattttctctgcatgccgcccatggtgatgaaatttctcaatttttctgctcagtttagttcacaccaaacttctctccaactcccaactttccatcacatcacatcacatccaaaactttcctacacacataaactcctaacttttttccaaactatcaactttctccaaacttctccctaatttcataaactaaacacaacctatgagataggagtacatgatattgacaacaatgggcagtaagtactcccttcgtcctaaaatataacaccttttaggtggatgagacatattctaatccctattttctataaagttaatgccattctctcttctctcatgaagccacatcacctcaattgcatctcttcacatcacctcaattgtttttagcctttggatgattcatcaagggcaacatatcctatgcacacaggccctcacgtgtacacacgtgcacactaactaaaaaatatcaccaaaaaatctagaaaaaatcatacacatactttcaattgtatcacacctagggttaaaatcttaacgtcaaattcattatattttagccataacaaaaaaaaataaaaaatctgacagttttaaggttgcaattttatcagaattttatcttttttgttattctctatgtagaatgaatttgaagatgcgactttgcacgtagatataatactattgaaagtacatgtatgaattttcctagaattttttgtgatgatttttagttggtgtacacggtgtgtacacgcgagggcctgtgtgcataggatacgctcccttcatcaaaagtgtaaattacatctcttcccccaaaagacacaccatacaacataaccatttataacctatggataattgataaagggacaaagatatataaacacatgaaaaaaatcatatagtaggtaagaaattttttttggaattcatatctactatattattacacagttctcccgcatcaacgcgcagggtatccatctagtattataaatctggactgccatgatacgacccgtccaggcgttccccctaaaattgttatactccctccgttcattttttatcattatattcggcttgtgcaacaataccaagataaacatcaattagcactatcaacctttcatgtccttgcatgcctcattgactgtccaattagttgtgattgcataaaatgcttgaccaaaatttctattaatagagctgcaaggcatacacgcaacgcagtatacgaagcatttttgtcacagtcccacctaatatgacgatcaaatatgaatttttatgttttgaaaatatgatgattaaaattgaacagagggagtattttgtacggagggagtagcttgtacatgcatggatgcaactcacggcgtggtcacagcgcccatgaactcctcgtcggcgacgagcttccccagcgccgccggagccaggcaaacctccagcgacatgctcccggcaccgcccggcccctcgtacaccgtcaccttgccgtcgaacttgttcgcgccgccgctccgcacgctcgccggcctcccccacccgaagtcgttgccgaacacgtcgaaccgcggcgagctccccgtgtggacggcggtgcctcccgccgccttcgcgaagttggcgaactccggcgcccgcggccacggcgcgatcgcgccccgcatggcggcctcgtcgagcgacgccacgaagcggttcagctgccacgccgtccacccgagccctctctccatgacctcgccggccgtcagcctcaccgcgccgggcacgacggcgttccccacgtaccccggcgagatgccgctcacgcgcccccggcaaccgatgaccagtacgtacgccgtctcctggcgcggcgtgaggccatgagctcgcgacaccgagcgccaaacatgagcgagcagggcctggagggaggagatggtggcggcggcgccggcgatctcgccgttcgccttcgccttgagcttccttatgctctccgcggagaaagcgaagaagcactcttgcaatggaggtggtgggtggtcgcgtcgcgggatgatgtgctcgagcttggcgaacggcagagggatcggcaccgggcaggtgtccaggaaccacctcttcaccaccagaggtggcgacggcgagatgtccagtttgcttctgcttcgactgatctccgaccatgtgttcatgaactcccagaaattggtgccgtcgccgacgacatggttgagcgacatggcgatgaacacgccgtcggagagctcggtgacctgcgcggcaagaaccggcagggagtccgccgcagcgaccgcgggaagcagcccggtgagcgggaagaaggaccagaccacccgcggaatgtacagcgaggcggcgatgtcggcgacggcgacgtcgggcgccgtggcgtggacgaactcagcgccttcgtcgttgcagcgcaagaacacggagatgctgctcggaggcgacgctccgtcctccacctcggccacggcgaggcggccggcgaaggggtagaagcggccgagtgcgcgagcgaacgacgacgccaggtgtttgacgaggtgctcgccgccggtgggcggcttgggcaggaggacgcccttctggatgtactccgcggtgagcagagggagatcccacggcgtcaggtgcaccgtcgtctcatgctccggcggcaactccggccggatcacgcgccgtgacacgacccgaacgccgccggtgttgccttccattttttggttgcaaccgtagtgatgagtgtagcttctagctaagcagatgatgatgatttagaacagcagcaaacttcttatctgattgatgagcttatggacatcaagtgagacaagtttattttttaacacttaatctgatagcgaatacaattgtagatcttgcatatttatgttatggcttatattatcataatctatctggattttttttttgcacaaccatttagttaagtcacatatatacacgatactttctgattctgggctgtgggggagaattgaagcaagtcgttttcatcccttgtgcgaatgttttctgttttttttacaaaaaatctttataatacgaacatatcttagtaggaatagcaggcatttttccacttttgtgtacaagtgtattgaaattcttgttgtgataatgaaagtgactcaaagcatagagatatcagatatacatgatatgatattatatcagcatatgcagcatgctgtgacagcaaccggagatgttttaattcgacagcatgttacgagtattaggctattagccaatgattagcaatccatttcaaagacttaatagtggatactggatagtatcatgtatataggttgcagaaagttcagtgccatgcatgcatcaatcaggtttggagttcagaacagcacacatcaaacaatataaactgcctaagaacaatccattttgtgtttcgttcacgttgagttgatgacattaatcacactgtctcatcatgtgatctaccgtacatcagattagcaaggtcaagttgggtcccatgaggcagtgacttacttttctgcatgtgggccaccaggaggctgttgactcgtcaactctagccatccgtcgttcccggcattcatgttctgaaactcatctcaaccatctaaatttgcagctgctgcaatatttgtacaagcatttgctaccagacgtgttatataccattggaaagttcgtagatcctaatttcgataaaggcaatttacaatcgattttgtgttctatgcaccaagataaggctgcttgaagatgggccgcggttcacggttcaggttcaggacacagcttgatgacaggaagacgattgttggtttattctcagcacaagctgcaagctcatttgaatccatctacagtactccctccgtttcagaatgtaagtcattttagtatttctcacatttatattgatgctaatgaatctagacatatatatctatatagattcattagcatcaatataaatgtggaaaatgctagaatgacttacattgtgaaacggatgaagtaattactatctactagctgataatatgaaagtttaagatgattgatcatcagaaagtccctggcatttgaatcctctggttgaactctggcatttctgaccacgacctcggcctccgtgggcatccttcaattttccttcaaattcgtctaaaaaccattcgaaatttcacttcacaaacatattgatttatccttgtttgatacaaaaggtaatccagtgatatctctgatctatcagctatagctgttgatgaattcatcacctttctactgacaaattgacataaatggattacatgatgtcgatgtgaatgtttttttttaaccaattgagctcgcaaatcgcaatgaatagaagcatgcatggatgcaactcatggcgtggtcaccgcgcccatgaactcctcgtcggcgacgagcttcgccagcgccgccggagtcaggcaaacctccagcgacatgctcccggcgccgtccggcccctcgtacaccgtcaccttcccgtcgaacttgttcgcgccgccgctccgcacggtcgccggcctcccccacccgaagtcgttgccgaacacgtcgaaccgcggcgagctccccgtgatgatggcggcgccgccgagcaggctcaggacggagaagaagtccggccgccgcggccacgacgccagcgcgcccctcatggccgcctcgtcgaacgacgccacgtacttgttcagctgccacgccgtccacccgagccccctctccatgatctcgccggccgtcagcctcaccgcgccgggcaccacggcgttccccatgtaccccgacgagatgccgcccacgcgtccccggcacccgacgaccaccacgtacgccgtctcctggcgcggcgcgaggccgcgggctcgcgaaaccgcgcgccacacgagcgcgagcagcacctggagggaggagatggcgacggcggcgccggcgatctcgtcgttcgccttcgccttcagcttccttatgctcgccgcggagaaagcgaagaagcattcctgcaccggcgcttggtgctcgcttcgcgggatgatctgctcgagcttggcgaacggcagagggatcggcaccgtgcagttgtccaagaaccacctcttgaccaccagaggcggcgaagtcgacgtcgacgccgatggcgagatgcccagttcgccgccgctacttcgactgatctccgaccatgtgttcatgaactcccagaaattggtgccgtcgccgacgacgtggttgacagacatggcgatgaacacgccgtcagagagctcggtgacctgcgtggacagaaccggcagggattccgtcgcggcgtgtgcagcaaccactccattgagcgggaagaaggaccagaccacgcgtggaatgtgcagcgaggcggcgatgtcggcgacggcgacgtcgggcgccgcggcgtggacgaactcagcgccttcgtcgttgcagcgcagcgagacagatacgctgctcgcaggcgacgctccgccatccacctcttccacgacgaggcggccggcgaaggggtagaagcggccgagtgcgcgagcgaacgacgacgccaggtgttcgacgagagtctcgccgccggtgggtggcttgggaaggaggatgcccttctggatgttctccacggtgagcagccggagatcccacggcgtaaggtgaaccgtcgtatcatgctccggcggcagctccttgaactccggccggatcatgcggcgtgacacgacgaggacgccgccgccgccgccggtgttggcttccattttggttgccaactccagagcagtgtgggtggctaagtagaggagggaagccagagcagtagcaaaattggtatctgaaactccggtgttttgtgaaggcaaagccgtgctacttctgaatttatctgaaaggaacaactcatcagcattcattcagaagagaaacagtcataatttctgactattagtatgctaggctgcctaaaagaatagtatggtactacatatctcaagtagaaagatatcagctttcaaaagagttggagaaagagcaaattccaaaagctgtcatttactgctgcaaatttcagtagtgaggaatttggtctggagggttgtgccagcttaatcctcaatctgaaatgaacacaagtgacataagttgcaataaaacttagcattgagcaatatttgttctcatagtaaatacaaattaatattatgattgaacagagacatttgctttgagatgaaattggatgcttctatctggattattctggcaatttaagcattgccaacaaactagagaaattagttgctatgaccattcatgaaagagaacaggaaatattgtttcacaacaaataaacagcaggcttatcagttcccttcaactgcctctactatttgatcgaagaggccaaatgatccttgctttctttttctttgagatcattcccgacttgatgcgaagggtagctgtctttccttagccgccggacagatagtaaaagtcaagagctagaggtgataggtcggatccttcctcttattcaagtcaattgtgaatgctgtgtacatacgtataaaccacttttttaattcttaatatcagacaagtaaaaacaattgaactttcattgagtaagtgttatcaagttttcctcaaaaaaaaaaaaccttggaaaaaaagtgtgattaggattctgttttgatgaggagaggtatgaacatcaacatatgcagtgacagtaacacgttagcaaaatgagaaacatgtcaaagggtaacagctaaacagtaataaaaattgtgtaattgtgatatggagaggcaacagttgataatacttcgtagctgaagaagagaagagcctccagttaaattcagtgcctgcgatgcgcatgcgtcagattttgcatttcagatcaatcgattctgccccaattctgtcgcattcatccgttgaacatttagttaagcgacactgtgtcagtgatgacataataatacaagtacatgattggagctcgcagtggatgtaattagcctgcagctgacgccgtggtcaccgcgtccatgaactcctcgtcggagaggagcttctccagcgcggccggagcatagcatcatcaggtaactgagctctctgatggcatgttcatcgccgtggcgttcttaaccggaaaggagtccagtccagccattgagcgggaagaaggagcagaccaaccgtggatgaagagcgaagcaacgatgccaggtggcgcagaatggacaaactccacgccttagttgttggagcacagctagatggagatgctgcttgggcgacgcacgcaacatccttcacctctgccaaagcaagtaaatggattataatgcaccagagcccaatactatttgaaatagtgaactggaatgattagatgctatgatcatttcgcttcatgaaaagagcaggaatattattaggcttaccagttctcttcaaatgcctctactgcttggctagaccctaaacataatgtcctcggttatcttgttctttgaattctttcacatcctcctggttcagaatatcgcagaaataaatcaaaaaaagttgtactaggcaactcaaatacaaatttacaaaccacagataaattgctactacctatgtctcaaaatataaggtatttttggctatgcaaaatagagtccagtatggtaaactagtttacttaatgatgaagcggataaatatcagaattcgaattgttacctcttgaaacttttcggaaagttccatggccttcacataaaaagcagtccaaaaataacctattccattcttgctctattactatccaccaaaagcttcactgcacttcacttcctcgctactagaggaatcagtatcagtcaggtggtcagatgacaaaccatatgtgacatgattcaggaaattatcttgctcgactggacacacgtcatattctgactccagcaaagaatgactaggaatcatatttagctccagggtgctcattagtgatctcactttagctagttctggccagcattttgctgctatatacatgtttgcaatcaatctgtaatgaccagggttgtttgtcctcatagccagcaacttctttgcagcccgatccccgatttccgtattaccatggattcggcaagcctcaataagagttgctaacattgcagcagttggttgaaatggcatcttgtcaattatcacctcagccatcttgagcaaaccttcacggcagtacaaatcaaccatgcaagaaaaatgctccactcttggtgcaataccaaatatagaaaccatcttggcaaatagtagctgcccctgagttactagcccagagtggctacatgctgatagaactgcaacgaaagttacatggtccggctctatactgttcacaatcatctcatcaaagagcttcagtgatacatgtccctctctttgcaatccataacccaaaaccagtgatgtgtaggcatgcttgtctcgaaattgcatcagttcaaacactctctgtgcaactaccatttgtctacatttggagtacatgtcgacaagtgaattttccattagtttagagctatccagctcatgcttaaggatgtagcagtgcagctcccttccatgacagaggtgtccaacccgtgcaccaagggaaagcatagttaagacagtaacaccatttggacagacaccaaaaccgatcatctctctgaaaatcaaagaagcttcctcgatctgttccatgaatgcaaatcctgcaagcagtgagttccaggttgtgatgctccgaactgagcatgctctaaacagaaggcaggcagagctcatcatcccacatcttgagtacatagttatcaacgaattcaccacgcactcaaggctatcaaagcatagacgaacagccaccccgtgcaactccctaccaacactcaaatacccggtcctaccacacgccttgagcccaatcacgatggtcacagaatccacccctgtcccatgatatcctctcacctgagacaccaacctaatcacttcatcgtagttccccgccttcaaattccctgctgcaaccgcattccacgtgacaacgtttgcaccaggaacctgctgtaaaagctcaaatgccttattcgacttccccgtcgacgcatacgcggacaccatcgtattccagctgacaacatctctcacagccattccatcaaacaccctccgggcatcctccagctccccacacttggcatacatccccaccaaagcattccagacatacatgtccagaccatatctacacctccgaatgcgctgctcaatgttccggccaatggtgacctcccggagctcgccgcaggcacgcagaaccgacgggtacgtgaacctgtcggcggcgacgccccaccccaccatcttctcgtacgacaagatcacgtcctcccacagcccacggccggcgtagccccatataagcaggttccaggggaacgcccgcgccttccccgccgcctgctcgacggcggcccgcgcggccgggaggtcggcgagggctaggtagaaggaggcgagcctggggaggacggacgggtgggcggccaggccgagcgtggcggcgcgcgcgtgggccagctcgccggggcgacgggcgcgccgcgcggtgcaggagtagaggatggccgagagggaggaggccgggtgcggcggcgagggcggcggcgattcctgcgcgggcgcggcatttcgccaaacggatgggaggcagcggcggatgcggaggaggtgctgcttgggcggcgaggtgggaggtcggcgcatcaaacggccgccgccgcatcacaccacggcggcggcgggggcggcggagatggcggggcgcttcccggcgtttggtttggcggcgagggcgccaaagagtaggcgattcctggggtttggagttcggatgtgttcttcctttttcaactgaaaaaaaaaaagtttctctctctctctctctgctattaatggtttatcacccgggatccatgaggactaagggtgccctttttaacagaagtactctctccgtctaaaaatggaaaaatgtaggattgaatatgacacagtttacaatgaatctcgataaagatatatacagattcgtagtactagaaatatatcgcattagtactatattggtttttttatgaggtaggggaagtatctacttgcattgccatattttggtaatttcccccaagaaactggtgaacatttgaattcatgtcaaaattttagtaattacaaacacttgttatggtattgctcattccaagtttccaactttggctttacccaaatttccaaaattcagtttgtctatttgtgttggtagatatggagatcggaccccaaacttgcctgtaaacattcaggatagcaggaatgacttacctttgctccaaaaaaaaaaacagaaatcagcaaggatcaagtgaaacattatagttgaacaaacaaaataactgaaacaaaagcaagacatacaaggtaaacaccagagggcaccaatgatctgtacttccattatattattttttctcttgtcatctgccaaaaaacaggtgtaagaatcaatttcaaggggaggatactctctcgagatatacaattggtggctgtggacaaccaaatcttcagcaaatattttcgacgccctatgctaagcttggacaggcggtgaatctctacaggaacaggtttccttttgctggtgaaaaccaaaccactgcaatgggtggaacatctagcagaaagaaacctctccgctttgacggcgcagaaacatacgctactttctattgtttttcatggctgaaatgggggctccacaacacattgaatcgcgatcctgagcgtttttttcgcctacggtctgccattctgggtagtgtacagaagcgattccgactggtctctctcgacgtgattcttgccctttcccatgtcgaggcgcgccctccgtacagcttgttggatctgccgctcgtgctctcgaaggatttcttccatgtttactccaggaggcattaatggtcctgagtagtggatcctgctcttcttagcgccattcacctgcacatacaggtttaatttctcagcatatgacaaaaatacaatcctgcactttggaagcatttttttccattactatcttctgtaagaaatagatcgttgaccttgataaatgagaatgtctcataatattaggaacaaagaaaaaacagtgcactccatatccaggacacaggccatttgtgatatttctcaggaataagaaagggccattctgtgaagagatttaggtaacatgtactctacattccctgataaaaaccatactcacatgttcactggtcataacttccaagaatgcttttaagggtaaatttcccaaagtttatctcagctttcaaggcttgaatactatggatcattctcctgatggatgttaggaggcaagac

SEQ ID NO: 66212 - DNA, 12695 bp, Oryza sativa
cttggaattggtgtgtccattcaggtctgtcagagggttcagcagcagcaagttgactatatcttgaactagatcgatgctctctcaaatattgtctcctggcactctccccaaggttggaggacagcttagtggcattgcctcgctgcccaccagttgcagtagacatctcagcagcagcaatttgagatgtgtaaaacctctgagcattctgatcagtgccacttgatcggcccagagtagaggatgaacgaccagcatgcatcagaggcgcacgctgagggtaaacattgtctccagctcttcctggaggatcaattgggaagccagtgacagcatcctcctttggaataaacttattactgctgctttttggattaagctgaacccgtcgttgctgcaaagatatggaacagcagtcatttgagaaagaagaacaacagagtttatatttcacaatcttgcaatgtcaactatgtgattaattgcaatgtttaaactgcagctactgtactggtaaacttccaaacaagtcaagagtcgattacattgaatcacaaattagttctgcaagactgctaccaagtactaactacacaaattcatgtatttatgtattaaatgaatacattgaaccactgggaactagcatatagtatttgaattcccataaggtttcaaaattctgcaggaattaataatattttggaagctcaatagtgatagtgcgtcagaaaaccctcaactctggatatccttaagaatgacaattatcatctaatactaagagaagtttataatctaaagataagttttcattacctgcaattcgttgttgccatttggtgctggaagttgctttctacgcccagcttcagattcatgtcctttaactgcagctgctctttgcctgtgggcaaaacatgaacttaggtcaaataaagaaatcgccagcaaaagaagatagataccatatattccatctagtcaaaattcatctttagttctccacagggtttaccttctagcctcctcgtctcgaagcttagcatcatattccttgcttggaggatatttaggtagacttgatggatcacaagcataaggctttgtcgtgaagaactacagtccaaggtaaaagggttaatattagtgcgtcacaataaaaaggccagttgtagattatacaggaatagccaaatctctatgaattaccatcaagtaaaaaggaacagctcaaaatgttgttgctcatatcaacttaaaagatgtttcacttctctaaataattccatgccattcacaaacaacatatcatacgagaagtgacaataaacagattcataattaagactcatcaaacgaatattgtgacaatgaaatttacagggagatggacacaaaaggcagatttaacataatgtgtgtttccacatgtttttttgagagaccatggattctccttagcacaggcatgcaaataaacaaatttcagggccagaacttacttcgcttccaagggccgaagcagcagtacccctattctgaggttctacagcaagtaaacaatccaatagcgctaaagccggaggagggaaatccttgtatacatcattcacacatcgacgataaggatgttgtggcttgaatattgtagcacgtgacaacttcaaattagcccagaaatcctctgatggtgaaccacaaagcttaaatattttgtgcaattgttccacctgaaagaatgtggacaacaaaaataaacatcgcaaactcatagattattaaacatgataaacaatatgaccattcaacactaaagtagaaatttaatgtggaatattgttaaattttattggtattcgtccatgtaaaaatagatctggtaatatgcagtgattatttatcacactgaaactagagctaaccattttaatttataattgtacatctggctgtacaaactacaagctgatagatagtaactgatcaaaagatctcaaatgcaaggttcatagtgtcgagtattctgtattcaacaaaggtgcattcaccttcagcagcttcattttttttagtccagcataattcaggtttgtccggaagtgcaatacaagaaatggcagatactgatatactttatgcaaggcaacatcaaaattatctcagtagataatactgtgttaatcttaggttgcaagtttgtccagaatatgaatagctaaacaatacctctgttcgccctggcatgataggcttcccagacagcaattccgcaagaatgcaaccagcactccagagatcaacagcagcaccatagttagtagcacccagcaatagttcaggaggtcggtaccataatgttaccacacgacttgtcaaatgttgcttttggttaggattaaagaatgtggctagaccaaagtctgctattttgagaacaccattgttgtcaatgaggagatttgcgccctttatatcccgatgcaaaacaccacgattatgacagtgttcaagtccagagagtagttgttgcatgtaacacttgacctaaaatggacattttccatagtgagtacaacatcgaaactgacaacacaatgaaaaccaaagaacatgtcaagagggaaacctgaggctctgtgaactttatgccaggtgtagctgcaagtcccgctagatcatgctccatgtattcaaatacaagatacaagctactagacatgcgcgacgtcaccaaaccttcaagcttaataacatttgggtgatcaagtcttcttaagatgtgaatttcccttgccatgaaccgcacgctctcagggtccatgttggcaaaccgaactttcttaagtgccacaatttttccactctcaagatcacgtgctttgtaaacactactgtatgtaccttgccctatctgaaatatttaaatgtgaggatgagaaaaggtgtagttgcattgaatcagtaggtcaatagcaatttgaattctcatcaatcgctgcaatccagttgacaaactacaccactctatcaagaatgtcattactaaaatagttctagagacatgtctagtttagctcataacagtcatatgccatcggtaaactcaagcacttataaagcgagcgatgatactcaaccactaataagcatggaccacaatatacatggcaaatcaaggtcctaacattttatgaaacaatatagtgaatttgttacaaaattaaagatcggcatagagatatgaaccttgtccaacttctcgaaagactctgccttccgaggttgccacccacggactgcctctgctgcgacctctgtgagccaccttggccagccagctgccgcatgccccccctgcactccattgggcacaacatctgtaatcctcggtttcgcctcactccttgtaccaccactcctaggctcttgctccgccgcgccattcggagcacgcctccaattcgcaggcgcggcaactggcctctccacatcaaccacgctaaccgccacagaagccgcctcatctggcaatgcagccacaggcacagccacagcctcaaccaccggcgcggggggcttccggatgagcctagccgtgctcacatcattccctacacgatgtccagcactggaggaggtggctgacacaaccacaccttcttcatcctcctcctcaaagtgctcatgcctcttgctggaattgtaactaacaagacgcctcagagagttgctagatgggcgccgccggggcttcccctcgccgccacgctgctcctcgccatggaattgcttcgaactgacacagcccatagaacgagtgtggcgatccgggcaagagactccactccaaggaaaccccccaaacaaaccaaaaccaaaaaaaaaaaaacttcaagagatcttctcccaatacgcctcccgcatcaggtcacgcatcaagaaccctcattgctcgcccgaattagagttgaaaacacccaacacccgctcagatccgaaccagaacactgcacccgcgactccctccagtccagcaaccgccgaatcgcccaaaaccagaagcagaagcgggcgggccacgaactgccactgttaaaatcgggatctttctctatcacttgcagaaaccagcgaggccgcgccgcaagggcaaatcggggctgggcgaatccggagacggggatcaaaatcgaacctttttgccgccggaaatcgcgaggcagcaggagatctctccctcctccctccctccctcccttccctctctcactgaggtggccttttcttggcttgtttttttgtttggttttctggcaactactctcgctctgcttccttctccttctgtctgcttctctttcctttttctttttcttctttttttttttgcttctttttttttgtctctcaaagtcagcaattacgatggttggtgaaaaaaaaaagaggagagagaaagagagagagagagtaatggtcagagagagggaggagagagaaacgcgttagtataatacaaaaggaaaaatagttaaggcagtagagtactggagaaggtctcttggtgctgggacggcttggaatttgaatttgactgtcactactatctccgttttttaatagatgacgctgttgattttttcttacatgtttgatcattcgtcttatttaaaaattttatgcaaatgtataagatataaatcatacttaaagtactatgagtgataaaacaactcataacaaaataaattataattacgtaaattttttgaataagacaaatggtcaacatgtgagaaaaaatcaacggcgtcatctattaaaaaacggagggagtataaaatttgggatttttgattgggtttggggactcaaaaatgttctctcagtttgcttagctaggttagctttgattttcttgtggttttgtcaaaaccttagcacctagtaagaagattctaacttgaagaggaggtggtcaaaggtctactgcatccattggggattggcttggttatggatataataattaattaattactggtactagtataggaggaaaagattaacaagctagctacagcaagagaaacaaaagttggactccggattggaatatatttctttctaaaaaaattggaatatatctccaccttttcaacatccatccagctatctttgttactgattatctataaaaaaataactttgttattgatttccagcaagagaatttaattatgtatctgttaactgatccagctatccggcaagagaattttatttccattatctattaaaaaataactttgctatatgccattattgctatgagcattttaacccatttctggataatagtaacaacaacatatgacaatgataatatttttatttaaggaataataatagtttttttctgaaagattggacaataaatatggtgacacaacaccagatcatcacacgtttttccaggacaaatgcgacgaacaatacatgtgaccaagcaaccactccagagccatctggccaagatgcaaatgtcatctgacagcaacgtcctcttatcaatatgatcaaggtgtaagtctccagtagatttccactgcaaaaacacagattaattagagggccgtgcaacgaaaagcgagtcaaaaaagatgtgcatggtcaaacaaattctacgagccactaaggctgtaataattgtacttatagtgctgatgattaagatttttctgcggtcatcacacgtcgttgcaacgggtattacagtcttatttctcttggttgaaattgaatatgaacttagctagctagcattgcgaagaaagatttatctttctttggatagaagattatttagaggaactaggggatttgaactagttcctacaaaaattacaatttttttcgctgtattaattacatgaaaatgtattgattgtttgctcttcaacttcaacttattggctgcagctaaaattaaattttaaaccttaattttagagttgattctgattttttttattgttgttaatttttcagcatgacggttgcattcgaatgatggtcactagtgtcttgttttggttacagttaattatggcttgcaagcaaacagataagcctttttttctagtggtatgatcagtgcggtccttgcttgtgcttgcaaacaactctttgtgattgcctgaaaggaaccaacacaaatagtagtagtagtacgagtgcagcatcatgaagaatcaagtggttaattaagcagtggttagttaatttaacgccaaattatgtttaagcgaaaggaagcatgcatctgttaactggtaaacatctgaaggagacgtaaggccagttagactgtagctatctaattatgaagactaattccaagcttaggaatcgctatctatcacgacaagaaatcaatgacaattaaggtagcctgccgctcctgggcctgcaaatccatcatcagtatttgggatatcaatgcataaaaaagaaccaacactagcatactaaaaagaaagaaagagtagtttatatcaatgttttgttgaactacactattttttaagtgtaactttgtaataattggctgtaactcgttttgatcaaattaaaagccggaatattctatttcattatctaaaaaatgaaatcgagagagagagaaagagtgtgtgtattttttttttgtgatataagcagaagagggccatcttttgaagaccttaaaggcccacaacatctaacatggtggcccagctcgggccactcttgtggcctgttgaggggatgcattgttcgggtgattagaacgcctcttcatttttagagttcaattttggttggagcaataatagtagcactaaacttccgaagtgaagtggacaatttgcaaacatgctttcctcgtgtccacatcccaacactctaacatcacaaaggtaaattttgtacaacatatataatattcctctacacatgagctccaaaatatatggtacatgttatttggtgatgaatttgatatgtagtgaacgaatgcttccagcaccgatgatattgttcctaatcatatcttgctccatgtctgtccggggaaaggacaatggcgtcacagtactcgcaaggcttcttgtcatgcaggtacaagtcctcagatgttgtcagctccgaattaagttgatgatccggaggtcggtaatggcggtgtcggcgaggagatcgctcagcctgaatggctatggcggtgtttgccagagagagcgtggtgagacgacgagggagatggccacccaagtgcaggggcagcatggagccgagatttggaagctagctgacgagctaggtcgggaagccattggaggttaaccgtggagaagatgcagtaggtaagcctgaaaatgatcacaacttatctcctacagcgtgctcttctctatgtttgatgtttggcacaaattcgcgccgagggcgtatgacaagagagctgaaaaataaaacatcacgagaaattttttttaaaaaaatcctacgaaagaagagaagcaagcatcactgttcgtgtggatgagcttttcagagactgtagacttagggggttcggagtcaaaatcaccgaccctcctctgatcataaaccgtttatagccacacttaaatcgctgtaaaattatttgagagatactatcatagaatgttgcaccatggtacaaagtttctaggtgggatataaaatgtacgaggagaaattcgaaggcaaaagatgagcattgctttgcatcttcttcttccatcgatgttaaaggttcaaaagcactggaaggcagtgcaggttgatgcaatcgacctgaaacaaccaacaagctgaaacaaaacatttaaatttgatttggttggggtgtgcctagcatgagctttagtgcaacgctttgcaagccactatggtgaaccctctccccacgaaaaataaatttaatatcaaagtagacacatggcccacatatcagatattaaactgataagaacagatactacacttgatcttagccaaaaggccgagaaaggtatgagttgcattgttggatacccctgcttttgtagcctctccctggtactactctccttgatcctgcgatatggtacaaaacaatactccttcctaacaaaacatatagattatagcgtcattgctgtgtttattctcaaatgggctggcggcctgcatgagattagacccacgaaagcccaatacatccttgttcgcgaggacggcccagcccagcccggcccggcccatgagagcccgaagaaaccaacctcatcttctcctctcatccccttcctctctctctcgccaaggcaacttcttggaggtcggagaggaggagaggtcgaggagcgaggcgaggatggggcgcaagaggaaggagctgctgtcgtcggcgccgtggaggacgggggaggcggcggaggacgatgacgaggcggcgaggctgtcccgcgagggcaaggtgagcgtcaccagcaaccccggcgagacgcccaccatgcacgtcccgcgcaacaagcgccaggacctcgacctcgccgtcgacgacttcgacgaggacgagatcgaccccgagctccgctactccttccagcgcaactccagggtatcccatccacctttctcttcttctccccccacgcaatctttttttttcttttttatctctttatctggtgacgtcgcgctattggtggttgtcgaattatacacttgcttgatgtcgattgaaattgtaaattgaaaaatattcgtcaaaacaaacacaacaggattagtttgtttggttcaatcgactggtgaattgatacctgaaactttttgcacaaacacaataatgcccaaattaaaatatgtgaaatatattgtctcaaaacaacaggatttcactttgttggtaccctcgccgccctaagcacaggaattgagctggaggattaaccggattgctggagaaacttataaactgttatcccctgaagggattcacacgattccatgtagcctttaatccctcacgatggtgaaatctgtatatgccctcttcttgatgttttcatcttcatggaaatgcatggatatgaactattgatcttcatccacagttttcaatttcatgatctaatttctcaatactgtgttccagaaaatctttagaatgcgattgatatataatgtcgaatatgctatcacatgtactctcttcgtcccataaaaaaccaacctgacgtgaaacatgctagttgtactagaatgtgtcagatccaatcctagattcgttttttatgggacggagggagtatgtcactactatgttgtagtatatttgtattagatcgaaaggccatgttctgcatactctaccatgcattgtgtgctacttattgcagttatgaattatcattaaaatttatgctctcttgtgcattatatagtccctaatcgcctttttttgttgctacttgatctatcccatcatcagagcctgaaaacaggcatttaggtatctgtttttcctcaagcccccagaatggattttttgccttttttgtccactaaattctgctgtgacgtactcatccatgttttgtgcaaactctatgcgcttcacacagcctgaaagtcaccaatcacatatgttggccccaatggacacaatatgtgtttgtaggtctgcaaccagaaaggcaaaagtgccacttggatagtaacaccatagtaccgcagtgcattgtcactagttccaaccatggtccatgacatatggtccttgatgtttatagccaactgtgtttttttattgcacacaacatatgttaaaccaccttgttaggaaaagagtacttgtctacatgcttatattctttttccgcggtgtactcttaagtatttaggatcactttaaaagtttaaatgatatcactgcatttgtttgggataatgcagcaggataagcaattacaggtttttaatgtcttagtggcagtacctccattacatgttgaatcgttgtgcatgggttgtattcagtacttccaatttataatcctatatagaagcggaaccatgataataaataaatataaaacgtcttccttattggggacaattacttattctgaatacttattgcctcttcagtgacttcatcagttcttggttgccgtaagtaatatacagtgcatatttgttgaattatctgacaggaagactgctgtttttgcagtttctgcggagagtatttagtgtggatacacttgtcaagcctcttcctcctgtgatggcatacagtgtttctcgcaatgtgaactttttcttcaagatcttcacacagttctggggtaagctctgtcaaatgttattagcagtataacattggatgaatgctactggtgctccctgtttatttttatggtcctattctgcttgttgttttgtttattgtaacttgtttgccttggaattcccatgtattcttaagaataagggacagatggaaccaaaagttcttttgttcactgagcttagagcattctataatgtctggactatgtgagataaatctgcttatagttgttaaatatattattgatgtccttgtccaaataccaagggaaaaatatttcataagcaaatattacttattattcttaatttcactgatttgttgtttgcagatcaatatgtactcctcccgtcccaaaagaactcagcctaggataggatggatttgttgtcctaggatatgtcacatcctatccttacgctgagttattttgggacggaaggagtagtatactatagcagcataatatgtgtgagaaatcagggatacctgcatctagcccacttctacaaaacccaccaccttgtgtagatcatcaatttgtttttcgtttcttgttaaatcttttggtgcatctcttgcagatgaagagggaattgccaatgcacagaaatcccttggactggggaatgaggatggctcccggcggcgttgaataccattttgtagcaaaaccaagctatgcattgagagatcttacgctagattctggaggcctttgttgtatgcctcaaatgacacttggtgtggtctgtctaagtttggttctagtgttcgcgtcttgcattttgtgctagtaaagttggttgcgtcatatattcagatgttgtaagcttcgagacttgtactcagaaatctcgttctggcttctgtttaaaaagttgaaaaggggaaataatggcgtgtagttcatttcctattatgatttctgaatcagtttttttttatcaatctgaatttagatgtcatattttacaatcttcagtttctgctgatccttcatgtcagtttgctcactgggcatgttatttttggacgtcaatataaaaaaattgctaatagtgaacaagctcgttgtgtttcatacatatatcgtgtgtgcagcaatgctgatagcgtctcttactaacatcatccctgatggttgcatcaattaacgatttataaaatgctgagcggaagaaagctagagtttctattgattcgggcatttctagagcttagtttctgtagctagagactagtatagctgtataggacagactaaattcaatgaaactgaaaaaatatcctgggaagttcagtcaaaactgaagagctggagactagtgattagtgaagagctagatactatagcagtaactcccaccgtcccattttaagtgtaatcatggttttcagcgcctaactttgaacgtccgtcttatttaaaaaaaatttgaaaaaaaattaaaaacataagtcacgagcaaagtactaattataaaaaaatttcaaataagacggacaatcaaagttaggtacaaaaacttatggttgtacttaaaatgggaggatggagtatatgacagactagtaaattcaatgaaacgaaaaaaaatagatgctgggcgtttctgtttcttagttttttttctctctcgaacagtttctgtttcttagtcaaatgaaagaagatcatttcgctttttcttttttcctttttgttctccaaacaatggtttgaggggcaaatcatattgtccacatttgttggaccagcaagagtctctaactagaaaagctaaactatcagcataatcattcattataagggatcagatcatcgacaattctgcatttcataggcaggcatatatttttttttcctgctttgtactaattaaccgaccctgcaacttaacaagccctgcattggttgcttttggtgttccaagattcagagcagccaaaggcagtggtcctgaatggttatgcactctctgcctttgcatcctacaaaaaggccctctctttcagtctttgcaaggctaatcactcactaggttttgctgtcatgtcttgtaccattgtacgtcgatcatgcataacaaagattggagaaaattcagtgtactatggcagacattagtgagtgtgccactagcaatactggcaaatctttgtttgtttatgtagggagattagactaggttataggtcccttgtggattgtgcatgtgattgatccaccatttacctttactccttgcatagagaactcacaagatgagaa

SEQ ID NO: 66213 - DNA, 2355 bp, Oryza sativa
  unsure (1)..(2355): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnatagagcatctcctccacacagtgtagtccatcagaattctcatgcgcatgtgaaccgtgctggtcatgaagcctccattaagcaatcttcagaaaatgctaatggttctgcatcagatgtttcaaggttatctcttgcaggttctgaaacaagagagtctagtctggaagaaagaaatgctggttctatcggtcaaacttcagaacagtcaattgaggaagcatttcaagcatctaatttggacagggattcacatgaccatgtgggtagttcttcggtgaatggtagccttccaaatagcggtcaacttgatgcagaatgtgacaatgggccaagcgaaaggacaaattacagtagtgatgcatctggagaagttacagatgggccttcagcatcttctgctcctcagagggagcatctaatcccttctagattggctgatgttcgtagtagaggccaatttgttcggcgaccatctgaaaggggtttccccagaataatatcttcctcatccatggatacacggagtgatctttccgccatcgagaatcaggtccgcaagttagttgatgatttaagaagtgattctgtagatgttcaaagatcagcgacatcagatatccgccttttagctaagcacaacatggagaacaggatcatcattgcaaactgtggagctataaacttgctggttggtcttcttcattcgccagattccaaaacccaagagcatgccgtgacagcccttctgaatttgtcaatcaatgataataataagattgccattgcaaatgctgatgctgttgaccccctcatccatgtccttgagactgggaaccctgaagccaaggagaattcagcggctacattattcagtctctcggttattgaagaaaacaaagtgaggattggaagatccggtgccatcaaacctctcgtcgacctactaggaaatgggacccctcgaggaaagaaagatgcagctactgcattgtttaatttatccatattacatgagaacaaggcgcgtattgtgcaggctgacgctgtgaagtacctagttgaacttatggaccctgctgctggaatggttgacaaagctgtggctgttttggcaaaccttgctaccataccagaagggaggacagcaattggtcaagcgcgtggtattccagcccttgttgaagttgttgaactcggttcagcaagggggaaggaaaatgcggctgcagcattgcttcagctatgtacaaacagcagcagattttgcagtatagttcttcaagagggtgctgtgcctcctctagttgcattgtcacagtcaggcacgccacgggcaagagagaaggttagccatttctcatcatttcctctttcaattagaaatgcagctaagcacatcctgaacatttatgcgaaagccagacattttagtcacaatgttttgaacatgctgcttggtcttacaggcacaggctcttctcagctactttcgcagccaaaggcacgggaattcagcaaggagatgaccttctcagaattttttgtaggtatacattaagcatctcctctgattccttcaggcatcggcttggctcctcatattgttgttgttggctcttgggtggccctatgtattgtttatagtcaaattgagattgtgctcatgtcatacaaatgttgtgagcgatgggttgggtgtttgttgttgagatggtgtaacttttggttctcttttcttttttgaaggatatctttgttcttgtataggttgtccattggtagcaacttacctattcaatgggattttgctttgtatatgctattaaccctgacattatgattgttttgaatggttgtaaaattcgatattgccctgcatgttgtaccagataacaaagcttcatctgctccgatgcttttcgtcatggcgacccttgaaatcgggatatgagaatttcatggcagtcctgagataattataattacagtctaacgcaataaggccgtgtttagttcccccaaatttctaactttccatcacatcgaaaactttcctacacacaaactatcaactttttcttcaaactaccaactttctccaacttttcaactttttcatcatctaaacacaagcttaacatcattttgcaacgtgctcctagtatgtggtatccccataaaaccagattgatcaactacacaggaaagtttgtattcctgttccaaccaaaatatctactactcttctgaacaactactacttatctag

SEQ ID NO: 66214 - DNA, 5893 bp, Oryza sativa
ctagaaattaattaatgagatgagctaattatctcgagaagtcaagatgatccatcacaaaccaagaaagtcctcttgggtgtgctcacaagcttcttcttctgctgcctctgccactgcaagtgggccccaatcaacccccctcctcctaccctacggcctagccctagcttcgtcacctccatgccgccatggccgatcggcaacaccatcgacctgcccttccctaccacctgcccatagctgcaaaccctactgccatcgccatggccagacctcgagctccagctcgtcctctcttcttggaagacgttggtgaccacgacgatggcacccatggggtccacgtccacggccccgagcacctcgccgcagcgctccacgccggcgtccacgacggcgaagtcgacgcggcgcagccgccggacggccgccgacggcgacggcgcgagctggaagtccaccgcggaggtcgccaggccgaggcggcggaggtggcgcctgacgccgtcgaggccttgctggtcgtcgcggacgcagaccaggcggcctcccgtccgcgcggcggcgatggcgagcgcgacagccgtggccggggatgacgacgacgacgacgaagcgccgcccccgccggcggaggaggcgacgtcgaggaggtggcgcgcctggttgccggcggccagcgcggcgatgtactccatgctcctcggctccatcaccatgccactgccacgagcatcatcttgctgctgctccttgcactgaaattattaacaaaaattcaattagtttatttacacataaataaatacttcttttgtttcataatgtaaaaatttctatcgttgctcatattaatatatatgttaataaaaactatgtctaaatttattaacatatatataaatatggataatactaaaagacttatattatgaaacggataaaaaaacttatattataaaacggaggaagtattgatcaagctaaattgtctttggttgcatttgcaaatgctatgtagtacgtaccagttgcagggtgtgcaggtaggcatccatggcgagatcaggagaccaaccagctgagactagcttggacattatcaccgggagaagatgaagctggagctcaagatcgatgcagggtcaagatactagtagtagtagtagtagataatgtgacacaaggccaaggccttttataagcaacggcgtaattaagcagagtaaatcatggcagtttggacacgtttgcatctagcagtctccatcaatcgctcacacatatgtccacgtacgacttcttttgatacagctgaccggagtactgtatatgtgtccgacagcaggccgtatcctccctttcaaaatagattttttttaaaaaaaaaacacaaacatcgtcacgaatattaagcctcacaccttttaataacactattgagctaacaaaacaaaaggactccaacacctcacaaccaaaccatcgttaataaaaaccaaccaacaaaaagacaatgaaagaggatagtagacctctaaaacggtatcagctctattgtactccttctgtcctatattaatattagttgtcttcctaccatttaaattttgtcccataatacttatcactagcagtactacttatcccattaatcacatcttattcaaatttctctccattctccccctcaaccacccatccatcctcatccataaattactttataagggtattatagtctttttgaactttttttcaaaccttagaatataacaaacaatcttaaaagacaagtaatttatgatgaaggaagtaggaacctactgcccgcttaaggcaaaataaatagacactagttaggtcccttttttatcgagatacaaattttattccggttttcgttagtgtactttttaaattgctaaatgatatatttttgagtgaaaacattttatataatcgttactttaaaatgtcaataaatttgttttttaatttgtaataattaaaatttaattatgctaataaacatttaatatcgaacgtggccttagtattacgccgtatgaattctcgttaaattaagtgatgtctaacgggatgccaatggagtagcagcaaaaacgactcaaaggaatcccaactaaccgaggctctcgtggcagcttggcaatcaagtggatatctccatcgactatttgtgatgtggtggtcaatgtcgacacgctactctcgtggcggcgacgccgtccaggcccggctcgccgtcgccggccgtatgcatgtaacgacatgtgaagttgtgatcaatcgatcatgtgatgctgctaagccgtcttcgtcgctctcgatctattagagcagttagaataggagtctattagccagctataaatatattttaataaaataaaagatgaaagagaagagcagcgggctacatatctatagccagctacagcatggactctaagacgcagtgtgtgtatgacaggtgggatcatatattaatagtatagtaagcaactattatataaattggttattagattggctatagatgaattggaggttgtagtgggctatactattgaacttgctcttatcggatcatgcaattaatgaggctgcgaaattattgcgtctggccggcgcctcccttccttcaaagggggaagaacgcgttatgcgtgggtgccactactcacatgaatcctgatcccaacccttctgcgatgaaaagagatggtcaaatttagactgcaaaatgcaaattaatcgcgtcaaataaacccagaatattgttaacttgcgtcttctagttaagacgaggcaaaatcatgtacatatctgtcttcatagatgctgcttttagatgccaagcagttgggttgtttagaaaatgggtgtaaagttttaatgtgtcacatcagaaattatatagggtgttatatggggtgttcggtactaattaaaaaactaattacagatccgtcagtaaaccgcgaaataaatttattaagcctaattaattcatcattagcaaatgtttactgtagcaccacatcgtcaaatcatggagaaattaggcttaaaagattcgtattgcaaattagtcgcaatttgtataactagttataactagttatttttttaggctatattgcttcatgtaggtgtcaaacgttcaatgtgacaggatgtaaaatgttagtgtggaatctaaacagagcctcagcttactgttgttcatgaggtagtatttgatactcaaaaaagctcttctaacttttcctacttttgcgtacagtgaccaatgaccagtataaagcatatcttttcaacaatttttagttaaaacttaccaaattaaacttgcaacacataaactgatttccagtttgatgggacattgggttcctttcagacattgatgcaaaactaattagcccgtttcctgtgaaatttctatgctaaagcattgtacgcttgggtggactcccctgccaattggtcaaaactaatctcttttctttttccatttcctatatagccttatttgtacatgtacaacattacattttctttagtttagatacaaaagttgcacggcaaccgggcagattttatgtacaacattcacccgggtgctccgattctgtggtcaagtatgaactatgaaccacgcatctctttatctaagtgttcctccatgtctagaatctaccctctcagtgagattatcatagcatatcctgcagaaaagaaagagatgtcgcattgtgatttagtatcattcatcaagagatgcaaaattaagcaggttccagccaacctgccaaaagatcagcatgaccatatcaacacgcctgaaaagagaatgaaaagaatacaattgctcatccataccatcaggaagattcacagcttgaatcgttctcagattttcttgaataagttctcacttttcttgagaattccttaactaatgaattatctgaaaacgtcaagggagtctcttcagcaattggatccctcacataaaacagtcgaataggcatcctttcaggatcatcagttggaggttcttcaggtatatcacggtacagatgtttgagaatgaaaagagcagtatcatgatctcgccaataattgctacaagaataaacccacaggccagttaaatggtgaacaggcatgttaaacaattagcaaacaacaggattgattatggaacttacgtatgagatcccagggcagataagtatgggtgttgaaatgttttctcctgaaatcaaatgattcggactgtaagctacaacatatttgtactgacataaataatatacaataagccagaaaaaaaaaggggggggggcgcaagggaattggtcatgttggcaaaagggttcgcagtcctgacacagtaaccactaaaccagcggagacaggggaaccagccaattcaaagcttagccagtggttatatgatttccactgtcagttcttttaggccacagtagttggttaagataggttagctaaagggttactgaacaaattaggcatattttaaatcatgtcctcactcatttggtatagaagtgcatttaatagtatttaacatcttggatttatgtgctcttttatgagccaaaatttaaccaacttcagagtttatgggtttaactctcttgtgaagattaaccttgaagctaatttagggtgttaaattaatcacttatattggttagaatgatttaagctctcaccattcatgtcaaaagcaatgtacagtacttttcacatccaaagcagagtacacaatttcaatgcctatacatacaccagcagggagtgaaattgaacttgctttaataggaaaagtttaataacctgaagtacatggtcaatccgaccatctggtgaacctgtcagcctttccatcatcatgtaaccatatgacttctctttctcattattgctgtcaacgtcctctgaacaaccaaaaacatactcagagcattgttttttgtgacttgcaatgtgtagaagacaaaaaaatctactatatgcataccgtccgtgtcatttctgctcagtgatagcaaagcagctactgctttaacctaaacacaaaaaaggagattaaagtcccaactcattaagaaagagctacgtgagcagctatgtttctagatcattcacaggtaacaaagtgtctatgtaccaaggcccgcctaaattcagccatgtctcatattaccatcaccaaagagcaaaccttaccttcagtgacttgaactggcgagcaacagcttgagaccttgcagcaatatcttcagtgaattcctgcatgacatgtcaacctaaatcagataaatcagataaacaagagtaatttactataacagacacactcgcctaaaaggtgtccaagaatatactgaatcactcacctgcactcctacatgtatcctctttccccctctatggtagggtacaattacagggcgcttgcttatgtaatcttcacatacaagtggttcaatcctgtataaaagccaacttagattcatgagacatgctcctcgctttgcaacagataaggacagtcttctccagtacataaagagaagtgatgaaaacatcattaatatatgtacgaaagctgcaaacctgtatgctacaggatcaaagggatgaaaaatgttgaacatctgacggcagcatggcatctcttcaactatgttctcattttgccaataatcttgccccctgcctttagaagagattacaaacttcagaaataacatagcaaataatcaactgtcaattgccaggaatgataacagatcatgaatccactagtcaaagcactggccag

SEQ ID NO: 66215 - DNA, 4010 bp, Oryza sativa
tttcagccattttactgggcagtttttatgcctcctgaacagagcacagatgatcttgtactaacatttaaatctgcatctcaataatttctaaaagccttgtattagtcgtaaaaggaacagggtatgagcactaagaaatattatgtagactagagaaggactataaaatggtatctgagtttgtgtaaatgtaaaccaaagctgagtttttatgcctcctgaacagagcacagatgatcttgtactaacatttaaatctgcatctcaataatttctaaaagccttgtattagtcgtaaaaggaacagggtatgagcactaagaaatattatgtagactagagaaggactataaaatggtatctgagtttgtgtaaatgtaaaccaaagcagacatcacaaaaggttggttgctagtccagaaaaaactgcatataagcagaactattgtcaaagttaacataccaataccaatgcgaacattccgcagggacaagaaaactcctaagggggatccaacagcatagaatgtgtcaacctgaatagccaaaaatggtgtaagcagcataatgatgtacaagtaaatagattattggatattgatttaggacagactaccttaaaatttagtttagtgtatctgatgtgtggtgtgtaggactcactcgtgcttccttgccctatgcggtttttgcctgatgataggttcactgcatgagtggcacttttacctgatataaacatgcaaataaaccttaaggaagtgcaggtgtattgaatattcgaatataacagaccaaacacaaacaatcaccttgatgagactcagcactgctttcagtcaccaaatcattatgttgttcaagttgtgctaatctagctttaaggcgttccacctacagtaagggcagaagtgcagggatcaatttgatatgcaagtttatctctcgctgttactttgcttcaagataacactatcagttagggtgttgcaatgagttcttgcattctattttatacattactgttgaccatttctcccaaggcaaccaacatttagcttgcttatcaagatagatgaatagaagatggcaggtacattataagttagataaatttgataatgccacacctcttctttcaatgatgatatcaatgtatctttgtcagggacatccgcatggactccctcagcagatcttgaaatgatacaactgtcaatgtcttttgctcttacagatgaattgtccccttcttcactgcatgcaattttatgattgtcgacctgtttttcgacttcaatttgttctccatctactgctgtaggtagtgcatctgtggtaagtttcggtgaattttcaagtgcacatgttgggagggtggtgtcctctgtacatgaagtgccagttctggtgctcccttcatcaactacatcatttacattatcagcacaagaatgcccagaaatggaagatgtatcttgctccttcatgactgattcatgtgcagtaactgtgtcaggcgattttgctatgtgaccttcatcagaagaaacttccatattcatataatctactggaaatggtgcagaagaagattcttggtggcaaagtatgtcataagatagaacacttcctaacgagtgcccatatattgaaacctgcaaaaacaagaaaggaacacataagtttttttgtttaaccattagcagaaatgcaagtgcactcctaaagatatttccgaagggtgatgtgtgcaaacctttccactataaccaggatttctcttgataaactttgtgtacaactggttcaactggtttgagacctgttgcagacttaaatcctcaattttatataacgagtaaaaaatatgcttccagtcattacgatcaaaatttttgaacagtacaggaaatggcacataattatttagcgtatttttcggaaagggtgaatctgaaccatccaagtcattagactttacttttttcttcaaatttaaattaaaccataaaaatgcatagagaaatcccactattacatacaggcccacaaggctcctaacatagtaatatgcacttaagggaaaagaaggaaattggaacaggcagatgggatgactgagtagaactggatgttggcaatgttcacttcagatcatatggataaacagcaatgtcaacagcaggggcatcaaacattcaatttaacattcacatatttatcaattaataaaggatatgtgtcaaaagcagtaaatatttcagtaagctgatttgtttccaattaaggaacgaacgatgattgctaacctaactgagttttccatcaagccaaatgcccatgccatgcaacataatacgatatgttttactatagtgtattaatgtgtacagaatcattggactacatatattgggagggtatatgcagagaagttcaccagaaaatgcttaattggtgggaggtaggtgacaggggtagttattcatttcatttttttctgagaagtggggtttggaatgtggatattatttaggcagagaagtagctggacaacctccctctttgtaatattagatagaaaagtaacaactttccatatgagaaaaggaacacagtgtttgattcatttctgaaatcttactagaaaaattcatcagcaatctattagttccacaactccatgacagtgtactctagttcacctattatgttcccacccaacatgtgggctttaatgcatgtttttatgcagcatttatttgaagccggatgctagaacagcaaatatactcataatgcttgaaaaaggactactaagaaaacctaaaacaccgaaatactatcaacgaaactacagaaatggctaaaagcagtgttacaataaagcaacataccgagtcaattatgtgctgacagtatataggactcatgtaatacagaacatcatgaactgtggcacctaatgctacacgaagacctttaactccatccaaagtgattttctcaaccgattgttcaccactgagctttaggctctttctccactgcaataaaacatcagggttaaaaactcaagttgccggtaattatggagatgcagctagatgccaggtgccatatgatggtattttaatctgaaaaacatgcttttattataactagatacataaaagaaatttctggctaacttaacaactgagttcagatgcaataaagatcatgacatgtgtgcacaagtgtacaaataaattgtggtgcccgtgagcatttgatagtaaaatatatctcacttttctgatcaatgaccaaaattcaaaactacaatttgcatctctcgcttttgttcaatggccaccattcaaaataaagactgtcaagttattgtggttatagcgtatggtaaagtagttcaaaacgagaccaagcatatgtcaactcacttttctgatagtaataaatatatctcactttcctgatcaatggccaaaattcaaaactaccatttgcatctctcgcttttgctcaatggtcaccattcaaaagtaaagactgtcaagttaatgtggttgtaacgtatggtaaagtagttcaaaacaagaccaagcatatgtcaactcagcatgcctgaatatggagttaaaggcttgctttatcatgctaaagcaagaacaagtatttttcttatctgaaatgaggcacaagaatgacatacatttcaaccaaaatgagtctatggcatgagtaactttgagttcttacctgacaaggaataaacagaaccctctgggtacttctttgataaggagttaagtatctttcagctaaattagcagttacacggcggaaatcaacaacatcatcaacaagattagctttctccaacctctggccaatgccatgaaccataaatactagatgaccaactggaacctaccaagagacaaccacaacaaataatcaatttgccaaccttgtagattatggatgagaacttttatgta

SEQ ID NO: 66216 - DNA, 2704 bp, Oryza sativa
aagctgatcccacagttttgtacatggctccgccactctatattgcacttcaaaattagaagcaaaaactattgagtaccaagcaagttcaactcctaactaattcaattatttaccaaatgtttctcacaaaaaaaacagcacgagggtaccatttgattttttttttaaatgcaaaaaaataatgcaataacgtgctagaatagtttgtcacattgttggccttcagctggttgtaaaaaatgatgttacatattgactttgtacagtttacctcaggagtagcaagatagcactatcagattaaattctcaataggatatggctgcaattagttttcaatcatgcctctatagctctattgcagtccacacagaagttcccatttagtgtttgtaaaagaatcaagatccaacctcaatttgtacattctctcagtcattcatgcacaacagatgaaaatagtaggtacaaaaaataaaatactgaaacatggcaaaagcatcaacattcaacagggcagctgacctgtgtaggcttcgctgatccagaagatgaaaacccacgccttaatttgattgtgttgccacctagcttaggaccagtatcaaagaccagccaagcttcccaggtatcatcctctccagtaaaaagagcatgcaagtcctgcacagattattcagccttgtcctaagttgccattctctcttttctgagcaagtcatgctgttacaacagtatatcacataccggggtgcttccttggagatcaacacgtgctgcaaataagcctgaaggttgaaatttacggcgatgccatacctatttttttttacaacaaaacaggatgttcaactgctttatgggcatggaaatcaaagaggggagtatgataggaaccaaaactaactcaagaacatgataaaagcaaaagatggtatatccacaccgcagatcataccatggcatacatagctaaattcaagtgatgattatcttcatctcattgaatgcatttacagtattcgactggagaagaaagtgtggtatctttttctagaacaagtgtatttgtagtgatagcaaattggcattccatgaaatggctttctaatagtacaagaaagatgatagcgaataatattctcatggcatctttttacctgacaattatatgctagctcaagttgttcagaaacatcttcacgcaaggggatccaatcaagccctcctttgcgagcaaaccagtggcccctcaagacacgcctgttctccccattccagtacacagggaagcaatgacgtctcattaaatcgacctgcaacagtgtatgttcttataacaaagacatattcaatatctagcatgctagtagtaaaaaagaacagaaaagttatacagtattacaggtgtgtgacagagctaaaaaaattcacttagtccacaatcttacttctactagatcaacaataacaagtacagtgtccactaaaaaataacaagaagaatgtaaatatgtataaatagctttgcttcggcgaataactaacaaaactcatgcgtcgtgaatccagttgtgaacaaactacaagacaaaaaatacaaacctcataaagtccgcctttcacaggaaccccaacccgttcttcctccaccttatacagacttttagaatccgaagcatcagctgcaactaaggaaccttttggcccttcgctgcactcggcgtactctctccaccagtatgcaagcagagcttcctccctctacaaaccagtaaaccagtattgtgatcctgaagttaagtggtttaaaaagagtgagagaggatataatcccccttatattgtagagggactagtacagctctcttggaactagattgtctagtaatatcgcttttcaagcggattgtttctattactgttactacagtccagtcttaccatataaatgactaaaatgagtaaacactaagcaattgacaatggtgttaaagagagaacctccaagaaggacgcctccaatgcaagagagtctctcatgctgaaccggaagtagtccccttttcccactatctctgtccgtggaactgaagcagagagcgctgcatcaacagcgaattgcacaaaacataagatcagtaagacatttatcacacgcttcataagtttaaagtccaaaccgatgatcaatttaattgagcacagcagttctgaagtatgaagacatgccacggtcaaatatgaatctaatgtaaatgagcattgcttcgaatggcgagttcaatcagcgaattcaatagcgcatgcatgtgaacacttgtctaaaccacactaccctatcaattagtagattcaaatcagcaacagtctcacacatcaaacctacattctagctaccgctgattaaccacgagtgactgaatcggacggttaaattggtggcactgggtgtagcattccgaagcagacgagtctgagaggtgagcggatgcacgcacctttgtcggcgaggggcagcttgcagaagtaccagcggacatcctcgccggccgaggggctcttggtgcgggcgaggtacttgcggcgagcggcgcagtgctcgatggcgtcctccagcctcgcgatgttggagggcgtgttcctctacgagtccggcgacgcgccggcatccacggtcccgggggccgcctggctcgtg

SEQ ID NO: 66217 - DNA, 3460 bp, Oryza sativa
gtaaaacgaaaaagctcattattatatggttaattaattattaataattataaacttgaaaatgattttatttaaattttttaaacaacttatatatagaaacattttgaaaaaaacatatcatttaatagtttgaaaagcgtgtaaataaaaacaagatagttgtagtttgaagttgaagagaagaactaggcctagtatatatgaactgctaaaataaactagtattcctagtactatacaacaccgactatgtcataaagtaaattatcttgcttatagctattatgcaactactaattggcctaaaactatgattttttttcctcaaagtgtcttgtatatcgagttgtaaaactaaatgctggatcttacgtacacaaaagaattgtatgttttgaaatgtttgaataagcttggaagccatttacgtttgttttgaatagagagaaaaagccatctccaacaatgcttacagaggaaaaaacagcatgttatctatttttcgtgttcaatatataaaagtatatggaaaataaaagttaagagggctagagaatattatgcgggcaaataggagtatgcatttatactgataatatataagtattttcatttattttcttatggttgcacgtttatacggcatccaattatgatgtttctttccatgttggtattaagataagtatattttgtgcgagttattttaattgttattgaaatactgtttagacagcaacatagcgtgtacgcctcatttattaggctatcatgtatgccaattaggtcaatgaacaataaacctatacatatttgtgacttcataaggagtttattttttcaattatcattgaaaaaaactctcattcatctgtttttaacactggctcgtgaatataaatgctcaatcgcacaaggcttcatgctaacaatatctccacatgcatacaactttatatgtccattttagttttgcaccaacaatctaacacgcctctcttcttagttcttaggaaatactacttggaaaaaaggcacgggctacaaatacaaaataggtgtattctagccatatgcatcaagcaatcctagcaaactccatattgcatccagtgttacgtgtccgttcgttcgtttgcagttggagacaaaatacgccttcgaattcacttcgcgcaagaaaactgaaatacgcctctctccctcatacacgtattacaaacaccgcaaccgcaaaatacgcctaggtgttccctctataaagcggagaaggcaaagacacgagctctctcttccaaccccacacaaagcggcgcctccgcacccgtgtgtaaagaaaaaaaaatcggaggcgaaaacctctcaaaccctaatcccctcgtcccccccatggcggagtcggacgcggcggcgccgccgccggaggtagtcgcccccgtggaggagcagacggcccccgcggtcggcgcatccacgctggaagaggccgagcccgccgcggccgcggccccggccgccgagggcgagggcgagcacaagaggagctcgaggaggtcgacgccgcccccgacgcgaacggcggcggcgaggacgccaagcggccccgcgtggaaggcgacggcgaaggtggatcttctccctccttccccgcgtctgtttgcgcatagggttttgcatctcagaggggatgatgcttgtgtgttttctaattcattcggtgcttgaataatcctcgaagggtttatgctccgtgtgatctgattgtgttctctctttgaatcaggtgtcgtgcagagcaacgagtcctccgcgaaggtcgatgagccggtagctacagagaacagtgacgctgcccctgctgaggcatctgttgatgctgtgaatggcaaggttcctcctaccgaggattcgcagatgggctctggggagaagcctgcagcagaagcagcagtgactgaagccccgccgcaagaaggtggtggcgcaccaggacaggagacgtctcggataatcaacgtgcccaataacaaggtataattactggcatggggcaaatatggcaacctgtttggtttcatgtagaaatctgcagaacattctgtaactatttatacatggcctctatgaagctgcgtaaaattcaggacgaaaaccacggaaagttattaatgagtgcagacattcggacttgtggtttgctaatgctagccatgaaaattcatgcaggtcggagtcctaataggaaaatctggggaaacaatcagaaacttgcaaatgaactcgggcgcgaagatccaaatcacaaaggatgctgaggcagatgcaaatgccccaactcgttctgttgaactagttggaacccttgagagtattgacaaggccgagcggctgattaagaatgttatagctgaggtattccacgtgctaaattaattagccgtgatttccatactagtttgagctgtattttcatccaagcaacttaaacttgtgacattctttattacttccacttcaggctgatgctggtggttcgcctgctctgatcgctagaggttttgggtctggacagtcaggctctgagcagtttgagatgctagtccctgataataaggttggcatttccttttcaatgttggcaacgaagcaacctttcctttaaaatgcaaggagccataacattttatttatttaaccgtttgctttgacctataggtcggtttaattatcggaaaaggcggcgagaccattaaaaccctccaaactaggtctggtgctcgtattcaggtagagaaggttacttgttacgctgtaatggctgttgcttacatcaactgagatttgagtgtgatcataaatgttcatgtagttgattccccaacatcctccggaaggtgttacattgacagaaagaactgtacgtattactgggaataagaagcagatagaagcggcaaaagatatgattaagcaagctatgagtcaggtaatgtgattctgtgtttcgctttcaactgttccttcatgctgtaaataactagtgatattagatgatgctgtgatcacccaatgattgtgcaattcaatcatgctgtgaagaactgggcgatgctatatgatgatgagatgctaaattcctactttatgcgtttccattctattcatgctgtgattattttttcattgaaactgaatttctgttacctgctctggaatcatggtgtgtattatcgaacctattgtctctagcatgaccttactatcttcgtattatatgattggtataatccaatatgttttcctgttctccctgataatagaggtcttagaaatatagaaggtgttttttggttcttgttgagtaaacctgtgatttctttcaatcagcttaattaaatctgtgccctcttatggtttgtgtagatgttattttattgataccttctagaactggttc

SEQ ID NO: 66218 - DNA, 10333 bp, Oryza sativa
tgagagtattatgtatggttatattaatacttaatttatacagaataatttgtctataatatttcatgagttataatctcctcgtggtcaattatttttttgtgggaatatttgtcatcttccatataattcagtatcttgccttgctgccttttcaatggcaaaatttattccatgtccatgaattttaaggtttttgcattgtcttaaattacaaatgatgcatatgtttagtttcccatgaaaatgttgttcattcatggattaacaatatggaacatggtgtgcatgatcatcaatgttaactatgaatgaagttagaataaatgatttgactctgcaatggatagcttttgaggatttgtgagatatattcacgttgacataaaaagatagtttagtctcggtggcttgatagttcttcatagttcgtctagaagcagaacttaccttcgtgtatgatagtgtggttggacttcagtacttgatcgttaaaaccttggtgctgtcacatgatcaatgaacaattactgtggtactagtttcaatctttagtcggctagtcttttgagttttggtaactgcttactgctagatgagatctgattatgtttcctacataagaagtcagaactgactcatcaaggttcctctcgcttccagtttccatgatttattttgtttgaaggtgccaatttggagttggttgggtatcctaatgcagatacagctaggctttcatcatgggctccacatccttcatccattacatgcacagaagagggatattgaccattatcccttgcccttgcatggtttgtgtagttggtaactggtaaggctgcttattgctgaaatggaaagaaaaaaaaacaatgtggcattgggagactgcaccaaatgtttcattgccatgacaaggatactgcatcaccatgtctaggtttgctgaactaaattgttgccactaatttgcaatagctgaaaaagcagcaagttttctcgcatcacatacgtcagttatttgatgtgttagctttccaactagaatattcaagttggctgacagcctatattgttggagttaaatcatatatgtgagctatgcatgcaattttgctatgtttcttttttttgaattgctgcatgtaatatcaccatggttatgtgatgatgtcataacgtgcaactgtaatcccatttacttcttacttacccattggctctgctaaaggtgatggttctgttgatatatgcattcatcacattgatattttgtgtttgtctattgttcagatcccctggtccttttaaaaattcttgtttagatgtctgaaggaggttgtgaaatgccagtattaattagaatccttttatctaacaatgtttgtgaatgcttaagcataaattatgtttttagtgaatcatggtgccatagcttatatgcaggcttattttgttattgttggtatgctgcaagtatgaagtgaaacactggtcatcctttttaattatcttacaaaaatgcctttattcttctgtgttatatttgtaatttgtaattgtactatttagtattttgtttttgtcatttagtgttcttgttttgtttctaacgttccttcttaaacagacattttcaagacatggggctcaatctggtggatatggtcagcaaaactaccgccctcagggtcatggtgcagcttctcagtggggcccacgttctcaaccccagcctggatatggatatccaccaagagggcctccacctcagaacatgccatactcccaaccttatggtggctacccgcagcagccaccaccaagaggtggcatgggctgggatcagaggcagggccctccaccccatgcttcccaccatggtggcggttacgactactataaacagggttctcaaccatatgaaggccagccaccaaattaccctcctgggcctggaaactacaatagttatgggccatcacagggcccaaattatggacaacctcagtatccgcagtctgcacctccacagaactatgggccgggttatggtgatcctagatacaatgctccagcaccaaaccagcagtactatggacagcctccagcgggtccacagcaaggctaccctccacagcaagatccctacgctaggccttatggtggacctggacaatgggcacccagaggtgcaccagccggagatggcacttaccaggcgccaccacctacatcttatggcccaccatctcagcagcctcctgcttatggtcagacatatgggccaacgactggacctgatgggtattctcagcagagttacccacagcaaggtgcacaagcgccagcaacatatggtcagagtgcaccagcagggccagggtatgctcaacaaggcgcacagcaaggtggctatgcacagtatcctcaatcccaaccagcatatggtgatcaagcagctcaaaacaatgcaaactacggctaccagggtgctccagcagatcccaactatggaaatgcctacccacaggcaggatacggttctactccggctagtggccaggctggatatgctgctgcaccggctgctggccagccagggtacggtcagccaggatacactcagccacctacaaatccaccagcttatgatcagtctgcccagccaccagctcagagtggctatgctgcacctcctgcaaacccacagcctgctgttgcaaagggggtgtcaccgcagcctgctggatatggtggacaatggaccgcttgaggtttgtacctcattattgacagcaatgatctagttgaagactatgttttgcctcatgatgctgccgcttatatgaagtaggcggttgaatccccttgggatgttcattcagtaagcggtagacttttgatatgcctataagggatgtaaccccttgcctctccagttgttataccggatctctgtagtagttagtagtttgttaagatgacataaaacctcctgtttagtttaaaagtgaaccgaattatgtgttattctgcagcatgtcgactgatgtttggatgcttagtcctatccctttgcttcaagttgtttgtgctatgcttgccgctggttggttgcaatgtgaaaagatgttttgcctgctgctaccaacacgcagttagagatcatacttgtttgcgccattggctggcaactggttgacaaactttctcatgttactatgaatcgaaccgtgcagtatatacatatgctagaagtggtattgatgaactattcaaatctttactatgaatcgaactgtgcagtttatgcatgtaatagaagtggtattgattaaatagaggtttttacctgtatgccattaaaaaagatgatgtctgcctctgtgccactaaaaaattcgagcctccctctgtgccatcgttgaactttgtcgcgccctccgcaccattccgtcgctattctgtgtgggtttaaccgtttgataggtctgacatgtgggtccgggtaggaaaaatgtcgctcttaccctttcagagagaggacaggcggtgtggcagacaagcggccaggcgcggcggcaaggcggccatgcggccaagaggggcggggtggcgcggcgagaccggcgaccggcgcggcggcatggccgccgccgcagggagcgatggccaccgccacctccatccacgccgcccaccgcaaccaaatcgagatccctccccgtcctccaagccggcgactccttcctcgtccggcggcggcatccgccacctacaactccctccgtgccgccatcaagcgccactcccgcaagctcgacaccatgaaggccgactcctcctcctcatcctccggcgccggcgccttcggatcatcccagcccgcgggctcctcctcgttgcgaaccaagaagatggacgaggagcggcggcgtccggggagggatccctcctcccgccgatccgggtttcggagtgggccggcggggatgagatgaggaggagcggcggcgacgacatcttccccacatgtacatcttccccagggcattctctggccgctccttgaacacccacatatacatgtactccatgtcgtgctgcactagaaaagcatctagtgtagcattattaccgttcccacggcgatgggggccttcgccttgccgttcttgtcagccaacatgaccggcttgaagtagtgggtgaagaagaaccacgcgccccatatggtatcgttcctcttcacacacttgcaggcagcgctagaattggagcccttggcatgtgatacgacgatcgtggtggtcgccgccgccggggcaggggacacgccggtggcagcaggtgagtccgagtcgtagagctgcgggccgctgaggccgacatctagcatgtcgacgttggggtcgtggagggcgtcggcggccgcacggtagctacctcctcctctccttctccgtgctcgccatcgtcgaccaactcgtcaatttcccactgctcttgttcactatccggccggatgccctcgagcacgccaccatgtacctccacctcgctgtgtacgcgtccgtggcgctcaccgccgacgggtgttgcgtcttcccaccacggcggcgcacaggcgcagctcggggacgtagtggccgcgctcgccgcgtcagtgttcggccaggagctattcccctcctcccccttcctcggcgccttggggacaaacaaacgaacacgttggccccaagaacgaacggcaccggcaagaacgcctaagggcaactaagtaatttggctgcgccgttacccaccgttaggacaaaaacggacggaatggtgtggagggcgcgataaagttcgacaatggcatagagagaggctcgaacttttcaatggcacagaggcagacatcatctttcttaatggcatacaggtaaaaacctcgattaactattcaaatctggaaccaaagcgtatcccagaagtggtattgattaactattcaaatctggaaccaaaccgtatcccagtgataatcttgtgaatacatgctattcaatctcatgtactatgaatcgaactgtgcagtttatacatgtgtttgaagtggtatgatgtaactaattaaatctggaaccaaagcgtattccagttgtaattcaattgcaatgataatcttacatcagttgttatgactcatgatcatgatgactcatgatcatgatgggagcagcaattggcgaagagtatcatagagcgcccgaaggatccccttgtgctgctgctcctcaggcagcctcagcatgctcgctaccttgtcgaacttctcctgccccagtgcggcgtcctccggcgaggccgccaccgccgccaccctgtgctccttgtggagcaccggcggcgacagcgcccactgcatcgcccagacgccgagcgggcgcatgtagtgcagcgcccggtagccgccgtcggccgtccacgactccggcgtctggaacgcgtagccgaagccgtgcttgccccagccggcgtcgtggatgcccttggccgtcttgaacgccgcctccggcatcccctcgtggatcatcgcggcggcgacggcgtacgtcaccccgggccacacctccttggactgcgtcgacgacgcgtccacggcgccgtccggccgcatcccgttgacggcgccgatggcgccgcccttcacccgcatgacgttgtagtcgagcaccgtcgccagcgctcgccgcgccttgtcgccgtccacgatcggctccagcccgcacgcccgcgcgtaccactgaccggcgagctggtcggcctggatcgacgagctggtggcgccgccgctgttgtcgtagttgaagtagccgccgttccagagctcgtctgtgtacacgcgcctggcgcggtggtacctcccccggaagtaggcctcggcggcgccgtcgccgacgatgcccgccatggccgcggcggcctggagcgccgccacccagaggccgccggtgtaggcgctgacgccggacaccgaccacaggtcgtaggtctggtcggggcggccctcgttctcgaccatcccgtcgccgtcgcggtcgaactggtccatgtacgccatggccaggtacaccgccggccacgccgcctccgcgaagccggcgttccccgtcgccaccacgtcgcggtacacctgcagcacgaactttgggttgaggtccttccacctcaccgggtcgtgcagcatgtacgcgttcacctcgaaccacgggtcgttcagccccatgtcatgtggcaccgctcccaacacctgcatttttgacaccccaaactagtcaatgcatgcaactcaatataacgtactcttcacgcctaaccgataaactcatataactcaatatacaacatactctttacgtttaattgatcgacgtatgaagcataataccgacgtataacttcatgtcttattagtcgatacataaaaccttaaaattactgtatttttatatactcccttcgtttcatattataaaactttctaacataaagtcttagaaatggatgaagtatatattttattcatcggtgtatgaaactcaatactactaaatggtagaggaagtatgaaccttttatatttttactaatcagtgcatgaaacttaatacttgtccctccgtctcattttaagtgtaattgtggtttttcgtgtttaacatttcaccatctgtattatttgaaaaaaatatgtgattagtgtttatgttttattatctaaaaacaataaaaatattattcacataattttttctaagactcaaacattgaatacggaaaaccacagctgcacttaaaatgggacggaaggagtactgaatggtagaggatgtatgaaccttgcgcgccacggtggcgccgtcaagggtgcggcggaggcaggggtcgtggaggaggacgccgcggacgaagtcgcgctggaggttgagctcgagctcggggaagagggagaggagggcgaaggaggcgtagaagtggacgtcgtaggtgttccacatgttgtactccatcccctccaggtacagcacctgccccacgttctcctcgccgtcgcgcagcagcgccgtgcccatcgccgccgccgccgccgccgccgtgttcgaccgcgccgccgccaccgccaccgtgctcaaaatgccgtcgaccgcgctgccgccgttggcgactgtactgaacgtgtcgaggttgaacggctcagtcgctgacgaaaggctggtgttcttcggaggctgcccatctgtgacaattttgttttcttggtcagtttcaagtttctgaatcgttttgggtttcagatcagtgatcaagttattttggactttcagaatggatgtttaagaatttgggtgcagaagattatattgacctgtccaaatggtgcctccagcgttgaggtagtagagctcgttgaacagtgtaattggatacctgacaaaaacaacattaccatcaacgaccactaatccaattagtcaattacttgctccgtaaaaaaaaactcaacctagaagtttgtctagattcgttgtactagattatgtctcatcgaaatactaggttgagtttttttggactgagggagtagtgattagtaattgatatgcaaaatctgaaaaattcgatcaccattcaggtaggctcttgtcctgcagaataggcctctgccactcctcgatctgggactcccatttcatgtgttctacatgcagacaagaacaccaaacattcgtcgtcagaatcttcagacaacaaactcctgactcttgcgtaaattcagaaattaaatttgttatcttcaccaagaagagcatcgtgggccaggcgctcagcagccgcgtcgcgatcggtgccatggaacttggtgtacctcctgctccagccatgatcagacgatctcatcatgtcagtgttcgagaatttcagaaacagcaaagaaccaacaagagaatcgccattgctggctgctgatgagcatgagctgtgtcactgtcacagtgtcacttcacctgtggtaggttctccccgccgggaacttcacctcggggcacgaccacgacagcgcgaacgacaccgcgcgcgcgccacccgccgccaccgtcgtcgtcgccgccaccgccgctccgatggacgacccgggcctcgacgctcccgtcgccgccgccgccgcattgccgtccccgacgaacgaaccattctgttcgccgcgaacatgcagtgttcgtcagcctgtcagagactgacagtgaagcgtatgcatggtgtccgtcctccgtaccttgttgatctgatcccacatgtccttcgccgtgacatcgccggagttggatggtcccatcgtgaagcgcgggcagccggtgacgcggacgccgtcggtctcccgcgacgcgatcgcgaacgtcaccggagggcgcccatccgccgtcctgcatccatcgatcgacgacatgtcatcatctcatttgcaaaagagtttccgacacgagagcatgatgaggtgatgaactacgcacctgtgatggaggaggacgccatggacgccgtcgcgagctctgcgcaagaaagatcagcacagttgcaagaagcaacgagtccatgaattaactgattaaaattggtgagagacatgatggcaagatcagtaattacgtcattctggagttcttatgattcccggtcagttcagatttccctccaaccgaattctgcatgatgaacaatgccagtggtgaggtttttactggaaaatgctgtctttgttttatgaagaactaggtgttggtttgcacttactgcccatgtgaagagcagtgttacatctgcaggtgtgcttccagaattgtgtaactgcatgcacaggaacagaagttcagagaaaacaaaatgaacagatcaattggagttattttcatctgcagcagaaacaaaaaggattgtaagaactgtaccgtaaaagtgaaaactgcaacagggaagctgctctccttgtagttgtgaggaatgaacggtgatatctgacggcaagttattttaatttcagggtcaggttcacctgcattgtttgcaattttagagctcagattagtaaggatttgcacaattgatgtttttccaggattcgtgatcaatggtctagtgatactactataagaaatcagtgtgtaccattgtatactgtccatgatcttgggaacaagccatggtaagtgcaattcttctctttcagcttccagtcccaggatccaatgccagctttatcgattcccctgaaaatttcacatttcatgatattcctagcatgcaaagatgcattcaaataggctttgatataaattttgttgtttacttgaggacatcggcattcggtgccgacaacactgtcgagtatctctttccgtcagggcgcgaaatgaatgcctatacaattgaaccatgatcgtgatgattagaggatttctaggattaccatcaatgttcattttatattagaaatacaaaatgaaaagcactaactgaaaattgatttgctaggataggcttctcttcatatatactggggaatatctgaaactgctgaaaatatcccctgtagcttctccctatgctccctgcactgataaaacagtgtgctttgaacaaagttgtcatctattgttcaatgaattcaaatttagctatgaccaaaaggtaatagaatatcttgatatagttcctaatcgtagatagtaaggaaacttagctgaatttttagtaggaaaggcttaatttgcttacccaatcccaccgaggggtacaccgcggtagcagttgtccatccatttcttcagtggatcatacactgaagcctttgcaaaagtgaaaaattgtcagtaagtttagcaattcctgctgatatttcaacagcctgcaaaacaattattgatggattagctggatcttcaacagggtaagagtaatcaccaggccttttgcattgtctttcaggtttagtcccagcattttaatcatcaacggcacctacaataccaaaagcaccatgacttcattgcaaatggaatgcttcactgctaatacctaatttagactacttttcttgaaagcaacgagtgtcgttgccctttttgctaaatatgcaaaagaaacaaataacaatattaaacaaagttagtgctcatgttattaatttaacaacttttcttagaataataacagtgttcttgctcttctctgaaaagaaaggactacttttccttgacaacagtattgaatattgaaattt

SEQ ID NO: 66219 - DNA, 3248 bp, Oryza sativa
aatgcttacaattgccatcatgtcattcaaggtcatgctaaacattgcaaccttctttccttcatcggcccaaaaaaattggtttgccaccttacctcccacgcaaaagatattgctggtggcttttcacaatccatgtgcaggactgcctaaagcaagaacagtactttcagagtgagactggctaactttctcaacaaagaacataatgaaacactgctcagatacaatccatataaatagtggcacaaatcaaggaaccaaagaaccaaggtgaagaaaacagttcttctaaacacaggagcacatcatttgcgtgttccattttccaaaaaaaaaaaaactttttccacaactctttgttaggttcagaaggtaccttggtttcctccaattctgaacttcccatcttgatatgaactccggttggattgcggctgggcagctaatatgggcacaaggacaagatgtaaatttaaagacttgtcgagatgtcaagaacatgactaagcaaatatcaagatttctgaatgtaaatcagcaataaaaaacacagcacaacacaaatactcaggtatctgaatgcaaagcatgcatttcaggaatctgcagaaaactaaccgagaactatcaagtatcaactaaggaggaggaggaggaagagagtaatacctgaatctgaacagcactagacacttagactgctcttctcattcagcagatgctaagattttttttcgaaagccggccggagtatatattaagaaggagagagtttaagcaaactgtacaagaaaacaatcagagccaaagctcacatacagaacaaactgtacaagaaaacaagcagatgctaagattagcttttataaaacattcgcagggaaacaacaagtggaagcaatagacagcacgggaagcacatgttagcatcaggttttctcttctttaatttttaggtgggtggaaaactacgcagctcacacatcagcgttaattgattaattatttcgatggtctccaatccccatggtgatgcctcttttgttctcttctgtgtggatatcgagatgatgtctctaattcatctagagcaagtttaatagtatagccaactaccggctccaaatcaattatagtcaattttatagccaattcatacaatagttacctataaacatatactacacaattaatacttgggcccacctgtcatacacacatgcatcttagagttcgtgctgtagctggctataaatctgtagttcgttgctcatctctatcctattttatatcctcgaaatgtgtttatagctggtttatagtctgctattgtacctgctcctatagccaatctaatagctcattcatacaatagttatatactacactattaatatctggtcccacctatcatacactcactgcatcttagagttcgtgctacagctggctacaaatttgtagtccgctaccattctttctcttcatttatctctttaaaatatgtttgctgctattgtacctgttctaacaaaaatgttctaccttgtatagtttaaatttttttttggaatagagcacatcattatattaagagaaatatcgaaatatcttttatgtacaagccgaaggaaaagagaaaagagaaggggacaagaaacaggagagcccaacggtttgatgtgaacttttttgatcaggacgtttggctcaatctgaactagaaaacctatgatttatatacgatctgaataatttgacatgattttttcgttggaactcccgcattcgaaactagggccagtcaatttattgtcgacgtgatgcagaacgggaaggaccacgaggatctcgaatcccaaatatccacatattcattcagaaggtacaattgaacaaaccacgagtaagtttgctgacgctaataaaaaaaagtttctctttcttttttgaaaaaaagatgctaatcaagaaagtaatttttttagagaaaggtattttggtctaatcaagaaagtaattttttttagagaagagtgttttggttttttttttttacctggcctctacatccaaccgatatatgcagcatttttaaattaggaacttagcctatcgaattgggaacttaggcgtcaaataacccaatctaaaattcgctcatataaagatttgagctcaggaccttgggtgttactcaggtcactgtaactattaggctacatcctttcacatcaagaaagtaaattaaaagcgtaaactatgtgatctcttcatatgtcagacaaaaccaacgaaacttatgtttctattgttctttctatcttgattagcaagtttgatgttttttttttgaagttagggctaaacctgtggctactgctcttaaaaccagcaaattaagctgcttgtatttattacctatgacgatatgcttagagtcaatggtaattttaatttcagccattacaagcagatagacacccatggcccatgggaatttgggaagtccactcaatttggtcaaattgtcgtatagtcattgagaaaaccaaagcagccaggctgcttgcaagtccatggtcatatgtttatggagtagcaagtaaccaagtcactcatgacatcgacatgctatctagaaggcaaaggtcatcttctttcaatccatttgctgaattgcagtgcaggcaatatccgtgcatgtttcctcctcaaattcttattggctattcagtacagtattcagataaacagcagtacatcgtgttcagaactcagaagtactacctccgtcccaaaataagtgcagccgtgtatatccatgcccaacgtttgaccgtccgtcttatttgaaaaatttgtgaaaaaattaaaaatatttagtcacacataaagtactattcatgttttatcatctaatagcaataaaaatattaatcataaaaattttttaaataagacgaacggtcaaacgttgaacattaatagtacaaaactgcacttattttgggacggagggagtagcaatttgtcttcctcactgggtcctctgctctgaattttgtgagaaaagaaacaaaatgctctgtagaagaaagatggagtgcacagtttgaagtgatcgtaagcacaacaagctgtcaggtttgaagatattgcccataatctcgcgatcttttcacatgtggtgggtatctgtcaattataatagttgaaagctagttcgaattttataatattaa

SEQ ID NO: 66220 - DNA, 10557 bp, Oryza sativa
  unsure (1)..(10557): unsure at all n locations
gcctatgattgtttgaaaggaatagcatttttttttgaattagagatgacagagaggatagatcataactactgtaggggtactgtatatagataagcagggacattagaggttgagaacacgttcggggatttggaggtgcatgtgcatgcagcagctgcgagatgatcttcctctaaaaataattagaatttggttcctaaatttgtgacctaaaaagaattagaatttggtttgatgcgcatgctgtgctctaaaaagaagaagatttgtgaggattagaatttggttccttgggcatgaattttcacattcatccagtcctgtccaatccaacaaggcaagaagaacaagattctacagctatcacatgtagctagaagtatatttctagctgtaggcgaagagactgaagagcagtgagtggggtgtagagacggaaatttttttttaacacctactactccgtaaaaaaaagatttataggtaggattgattttttttttgacggagagggtaggtgcaatcgcatctagggtgtgaatgtgatgtaaatagttgataaaaaaatatgaaaaaaagatatattgtgataataacgctttgtacacaaacatgcaactacaaattcaatatacatttgaagaaataaaaataacaaattttgtccgtatatattctgccgtgtcaaattctgttatttttatctaaccatgttggtatacactcctagcatcacagtcaacactatatatttttttaaaaagaattgtaagattatttagatacctagcccaggcgtagcaaatccatatccgggaatagactgaagagcacccttgaatccaaatccatatcagcagcacagtaacacaagcgctgtttaggttcctaatgtcgtccagctatgtctcctgtcgccggcatctgaacctctctctgcccttcattgatgcctttgttctcgccggaatgtggtgctgtctccggcgacaagacaacgtgacgagccatgtaaaccgtacttgggcccccttacggcccaacaaaaaaaaatgggccgcaagcggggcggttatgtatcaaatatctacatgaaaaattgttttaaaaaaatcatattaatctattatttaaaataaaatactgtagttgataattaattatatgctaataagttacttcgttttacgtgcgtgagagattagtttccaactcatttgagccaaacacagccttccctttcagacaaaccgttctcatttcggccttatcgaaagataacatgtacatgcctctttattactttcccatcaccttgaacagttaattttttttaattagaaatgttggacaggataaatcatactactacagtagggagtaatgtaggagtatacgttaagaggttgagaagacgtttgggaatttgtaggtgcatgcgcagcagctgagctgcaagattatcttacttatatataaaaaaggaagaagaagattttgagttgatgttcatgcaatccaagaagcaaggcaagaagaacaaaagattttttttcgaacggctaaacaaggttgctctggcgttatattaatggaaggaatttaagtactactacacagcaaccagaaatgagataacttattagcacataattaattaagcattaattattataaaattaaaaaatatatttatttatttatttaaaaaacttttacatataaactttttataaaaacataccatttgatagtttaaaaaacgtgctaacggagaacgaggaatttaacgtttagagttgagaaaaagaactaggccttagacattgttgataaattgtttgagagcaccttcaaatccttgttttttcttattttgcattctattgtgctaacttaccctatataattttacatatataaattgcagttacaaatgtagtaccaaaagtagattgttgtttttaatgttcagatgctagtattttcagcagcagcaaaacagtagtaggttttttcagaagaacttgttgtgcgcattcgtgaaaatctttcgcaacaagaagcacggtatgatgtgggctgatgctttggtggtaggaaatatcataatcctaacttcccttagtattctcttatgaatttgctcttcgcagctcttaaattgtttcttgctagctattactcactaatttcctcggtttctacatatgataaattgaatgggcagagccattgccattgtcttatgatttatagtgtagtctccttaatcaaatggacatgcccactaatgttcttaaaagtatattagcatatttgtgtaatgttgtcaggtgtattttttagcaggtcctcgtcatcctcgtacagtagtgcaacccatcgctgggactctgcctgatggttccccaaatttcagtacggtctgaatgatacacatcccgcaaacttgtatttatctgataattcaaattgtatttacagttttttctccttgcaccatctctttcaccaagccttgtcttctgttgcatttccacctgctttatatttatctgtgcgagtaatttattattctttgtttttgcagttctttgagattgggatcctacggtgagcacctctttcctcagataagtcgtattgtgaacctcgatgtctctcgaccaacacctgctctccgactccgaccaatctgcgctccacggcttcaccctccgtccgattcaaggggacattatgtttactgctcacacggtgagttttctctttggatttcaaatctcattgccattgcttcactcctagtgcacctaatgtcctgtttatttggacttcaaatcccattacactgcttcactcctagtacacctaatgttcggtttatttgacattgccttgcttgactactatgtttaggagattgttgaattacttgtttgacaacacattttgaaaatctgaaattttatgaacattgttaattaatttgtctgacaagacctcttaaaatccagaaaatatattatagaatttgttaatcaattgtaacacattttgagccgaaaaananncctttaaattgggggaagnaattgnntttatnntatttggtatgagaaaacctcttaaagtcccaaatttatagagattgttaattatttgtgtgagaaaatatcttgaaatcccaaaattatatggagacgattagttgtctgagagcaccttgaaatctttctttagacaaggtttaggtcaaacttttatattttttactataaataatttcaaaatatttaatttaaaaacactataaattgactataaaagcgtattcaattcaccaggtttactacctctaatatcataattcttggcgttttggacaatgttgaggtcaaaattttatatttttgactatacactataaattgattataaaagttttgacccagtattgctataaaaatatttgatagcagttctttttttaatgtaattcttttgaattgtaacataagtttatttctgaccttactcaggaaaacaattagattttattactctatgagatatctttaagagggattttaccgcttctgcgcttaaaaaaaatctttgtgctgcaaaagattttctgtgggattgtaaacctcctaagagcgatatggtggtatgttattacgaattaatttagaaccttttaataatggcttaattgatgagggtttttttttatataaaattttatttttgtaataaattatataagtataaatgagctttagtcttggtatatgggtcgacacaaaataaatctaaggaacaatttcttactaattaatctaaggaacaatttcttactaaataaactaggatgtgtagtcatgaaaacttaccaattattatttgggtgactttaatatattacacaacagaggaaaagaataatgataattttgataatagatgacctttttttaatgctattattgatggtctgagcctttctggtagaaattatgcccgggcaaataatttatcattgccaacttataaaaaaaatagatagagtgctaatgtctagtcctttactcttaaatacaaattcatcttctgtttataatagtcataagaattttaagtttaagttaggttggctattaagtcggtctgactgggccctcggtcggtcttaccttatagtcgtaatggcagtatgacacttcgagtacgagtccaattaagacagttattgtgtaagtttctacagtacttcgtcttgaggttttcttttaagtcctatagatcactaagttcgagtacgaatccattaagacagttattgtgtttctacacttcgtcttgaggttttctttcaagtcctatagatcactaagggcgctatggccctgttaaggcaactaatccttttataagagctgttgattcgattaaaaccctgacatacaccaacaaataatcaaatcattcttttacatcacatttaaccatgttattttgtctaccacgctagtccacaggccagaattaagtattattaattaaaactcattagcgtatgattaattaagtattatttataaaaaaactttaaaaaatgcattaatatgatttttcaagcaacttcatataattttttttaaaaaaacacattatttaacaattcagaaagtgcgcacgagaaagtagaaattgaaacggtagttccaaacactagacatgttagaaaaaaaagatgacatattcaggaaaagcgtacgccatattatgtgtagtcacatcacactcaccatccatgaatatagggcccacgtagatactgggatataactatatgagtggaattgaggttggaacagttaagacttaagatgaaataaggtgagaagaatgaacatctagggttaaaagttattttttgatggatgggaaattatttctattcaaatgaaacctatgggatagtatataaattctatcttaaaattattttccattgtttgcattaagtttcttcggttcataagctgcaacctctattttattataatgtttattttttttggtgtgtcaaggagtgaacgacgttagtttttacatatctatatatattcaagtaatctaaatataagaagtaacatataaataaattatctattgctagacaatagataaaatctgtcctttccttcaacagaaattacaaccaattaattatcacaaaattgtttgcgcaaatccaaataaaatgtaactaacataggatggaaaataagacaaatattaactccaccaacaaacaaattattcagatagtaatcctatcagtaaatattcatccaaagttaacgaaaattgatatgaccattgtatccatgattttgcatgcaagaggaatggattacatcttctcgtcacatctttgttgattgggctaaagccgaaattaatatatttccctaaagagcacctgcatataagatttagttggaattttatcaaaccatagagtccagcataaaatagaggttcatattaatataagtttttttttgtttttgtcaatgccaacaagccaactttcaaaaatataggagaaactacctatgtattgctttcatgccaaaggaaaaaaggcagttctgccaagaaattcagaaaaacagtaataagtaaagaatagatgctgcatagtttcctcatgcatacaattaactatatactcccccgtctcaaaatataagtatttttggacctcgacctagtcttcgaaatgctaccttgaccaacagtatctataagaataaaatattttaaataaaaagagttgcatattataatagtttgattaatgataaatctagtaacatcaattttatatgattgatttttttattttttttgctattaatagttaaaattacaaatggttgacttggcactatgctaaacatgcgtatattttgggacggaggggtatatgtttaacagcatattaatgtgatattattggaataggaacggcctgtcggtaccagagtattccattccaatagctaaaccgggataattgtctaaaatagaattgattggtgtacatagaggaccaacaaatttgaccatttcgagataagccagatgtggtggtggcactatataaagaggcaatgactaatgaccaaacaaattcatgacgacatacgcggttagacctgatccatgagttgacgccattacgagcagcatggccagtctcccatatttagtgttttattactgtattaattataatttaatactgctctatggaccatcatcactgtagtactgaaatttctgacgctaccagccaactgaaaaaaaaatccaaacagctactccctccgttttataatataagactttctagtattgcttatagatacacatatatgtctagattcattaatatctatattaatataaacaatgctaaaaagtcttatattgtagaacggatgaggtacgtaggagtagcaaataagacatgagacgcagtgctatatatatatcaacttgtcaagttgatgcatgcccatttaaagtattcacccatgtagagaagaattagaggcacctagctactcacatctagacacataaatactccaaatatattggaggtcacatgttatgttttttgttacatggaagacatatacatatacaaacttaagaaatgcgcgatagcagacgttcaaataaacggagatcatggtaaattctaacctcactaaaattcatattgaaaagtacgtcctactaaacacgcatgcttgtgtatacgaagctagacattgattatctgataagtcgatctctaagttttcaggagcctaatactctacccaaatgatcaaaccaacaaaagttcactaccaaaatatacattcaaaagattgaaagcgtagtaacttctataacaccaaatttattttattagattcaattgaatatattttacagtaaatttattcagtattaaaaatgttactatatttctctataatctagtcaaacttatgaaattttacttcaaacaaaagaaaacaaaacaccttacactatgagtactgaagcagagagtgactcggagagtaccaaaattttgttagtaataaggtgttttgacatgatatacgagaggtggaatggaaatgagtggacaaaatatagagttaccatattttggtagagcaatgaagtttaatcacgatgaggggagggtgacggcgtccatgaactcctcgtcggcgacgagcctccggagcgcgtccggcgcgatgcaaacctcgagcgacatgctcccggcgccgtccgggccctcgaacaccgtcgccttcccgtcgatcttgttcccggcgccgctcctcaccgccaccggccttccccacccgaagtcgttgccgaacacgtcgaaccgcggcgagctccccgtgatcagcgccacgccgccggcatcgccggattgcagcttcgacatgtacgtgaactccggctcccgcacccaccgctccagcgactccctcatgccggcctcgtcgaacgacgccacggcgcggttcagctgccatgccgtccacccgagccccttctcctcgatctcgccggccgtcgcctccgccttcccgaacatcagcgcgttcccgacgtaccccgccgggatgccgttcacgcgcccccggcatcccaccatcaccgtgtagaacgtcacctgctccggcgggagtcgccgggcgcggcacacacctcgccacaggtgggcgagcacggcctggagcgacgagatggttgacgtggccgcgccggacatctcgtcgttcgccttcgccttgagcttccgggcgctcgttgccgagaaggtgaagaagcattcctgcacttccggccgctcgagccgtcggacgatgtgctgcagcttgccgaccggcatggggatcggcaccgggctggtctcgacgaaccaccgccggaacaccggcgccggcgtggagatctctctgatcatcaggtcgtcgctcatggcgccgccagcgcggcggttgatctccgaccatgcgttcatgaacttccagaaggtggtgccgtcgccgacggagtggttcagcgacatgccgacgaacacgccgtcggcgagctcggtgacctgcgtcgacagcacgggccgcgactcggtggcggcgtcggcgccgagcaccaggttgtacgagtagaacgaccatacctccggcggcgtgtaaagcgacgagacgacgtcggacacggccacgccgggcgccgccgcgtggacgaactcggcgccctcgccggtgcaccgcagcgcgacggtgacggtcccgtcgtcggcgcgctcctcggcgacgagacggccggcgaacgggtagaacagcgcgagggcgcgcgcgaaggaggacgcgagggcgtcggcgaggcggtcgccggagagcggcggcttgggcaggaggacgcccttctggatgtagtcgatgctgaggaagcggaggtcccacggcgtgaggtggatgtcgcacggcggcgcgtgaccggacgacgacgacgacgacgacgacgacggccggacgaggcgtcgggacaggacccggacacggtcaacggcgagagctacgttccggtggtcattgcttcccatgtcacgctgctctcttctcttgtaatccgtacgcctctactggacacacaacaccttgagcatatacatatagtggcgctcttgggcatggctccagatccaatttgtttttcttttgcatgaaaatttaaattttaggctccgtttggcacagctctagctcccaactccaacttacctgtagcaggagatatgctaaacagtccaaatcctctgtttttgggagcggagttgacagagctgctacacgaatttgtactacgggggtggagctgggtttttgttgctccacagctccactccaacccaaaagacccactaccctttaaattttttacatatttataaaaaataccactcaactacctctaactcatctctcacctctctctctctccctcccgtcaccctcactctccaatccaacgggctcgacggcagccggcggtcagcacacggttggcggcgaggtcgacggtgggcggcgggtggtgcacggcgggtggcggggtcaacggcgcacggcgggcggcacgtgatgggcggcgtgcggcagtggtgcgcggccggcgtgcggactatggcaggcggcggccagcgttggggacagcgcgcagccggcgtgtggactgtggcaggcggcgcgtggcaggcggcggccagccgcacacgaggacgatgacaacgcagctgctgcggacgttgcgattgaggatttttttttcttttttttaaattttagatctggagcttaaaacctaacaaacacttttcagcaggtctccaactcccttttcagcaggtctccaactcccacagaagccagctccctctggagtggaagtttagagctctgagttggagtttggagccctaccaaactactataatttaacatataaacatcaaatttatcatagatctgagatctagagctctgccaaataggaccagtgtattttatggttgggctcctattttgagattctagtatttgaggagctaaagatcccagcaatcagaccctactataatatttttgaaatgcagaattaaaattgtatgaaatcgaacatagttataaggacaattccaatctagaaaatattaaagtagtttccatactcaccatatcatatagatactatatatatagaaattatgtacctatagttggttgtttttttcaaaaaaaaaaattcttatctaatcacctctcgtctctctcatttcatccacctattccatcgtttccattcttggttcctacgtagagtcggtttttatatgagaaatgattttttttcatctttttctttctcttcttattaactcttttatcacatcggtttttttcctacatgacatcatatttaatgctatagaaactaactgaggtggatggttggtactgctttaaaagttagatttgatatgctatcaatcaccctaatttgactatatctttaggatactccaatatcatatataattaatagttgaatattagtgttggatctcaatccagaggatctcttccatcccttgactatcttccttctcccaaaccctgtgtattatattgatggttccaccttgccatacgctatatttgtccctacaactctacctacttgcatacatcattctctcccatgcaaccggagatatatgagggtaagaaacaggccatttcgaggcttgatgctactcttaggaatattattgatacatcgcccttcaagcatctcgtagttgagaggtactgccatcaacagtgttgagcatggataggcgggagtcgaactcgctagtcactcttttcatgttagttagga

SEQ ID NO: 66221 - DNA, 9966 bp, Oryza sativa
atgtaagtaattattaattcttttcctatcatttgattcattgttaaatatacttttatatatacatatagttttacatatttcacaaaaaattttgaataagacgaacggtcaaacatgtttagaaaagtcaacggcgtcaaacatttagggaaggagggagtagttctcattttgtctttaggaaccgaataggttaggatttctggaaaaagggttttgtagggatgcaaatatccaacccatgttttcgagtacttatgataaaagagttcattttcttcagctaatggtcctgcacccttgttgaatgatatgcttttgtcctactagttggatctatgatagagcactttcttcttcaattatataagacggtctctcttttagttaacacatctttgctaatctaagatcgggtgatgttataattagctgactttgtgctagttaattagttgacttcgatgctagtagtgtcaattaacattgttttatgtatgttagtctgagtctctcagcctctcaggtgaggaatgattccttccaatagccaagggaagttctttcacggtgaaatttctatttggggatgtaccttttctatgaaacagtagctgttgcactatagagtatagtctagtgtttaatctgtatgagctaggttgagatgttgcatttctacattgtatttttcttgacactaatttacttcccacaggaacattttgttcaagtatggctgtgtatgtaaacttagtcttaacaatgtgtatctaaaattatattgtataggattattagccgaaatgtaaaaccaattggggccctgacaataagataagtatactggtccaaactccggtgtagggctgtcaacgagccgagctcgagcgagcttagatcctcaggctcgagctcggtatgaactcgagtcgagctcgagccgagcctggactaaccttcgagcttgcagtcaagctagcctcgagcctaatcgagctcgcatcaacgcaacacaagcatgtgtacatatttcaaaaagtagagaagctgacagaaagctgtagctgggcacgttgtgtagagatacggccatacgggagcactagtgtactgtactactagtactagcacaggagtagtctgctttgctactactactagctttgggagtagtgttcaagaattgattgcttctgtacttcacatagaccaatgttggagtagtagcagaccaaggaaaagcatcgatgattttttattggagaccaaggtaaagcatgagacatgacagttactaactaatactcgagtctttaccgagctattcgagctcggctcgttaaagtgcacgagcctcatttcaagctcgagctcggttcgttttaggctcaagccgagctcgagccgagcctataacgagtcgagttctagtagcttgcgagtctcgagcttttttgacaaccctactccggtgcggtgaaggccacgcgctactgatgtttggttggaggtatcagagttggcgggcgacggaccacagcgacggggtgaagagggtctcaggcgaaacctagcctagtgctttattgggccggcagcggctacgccttttggtgcagtaaccctcttgggggcgttgtcgaggaaccttcctccctcgacgaggatctctaggtgaaaaccgtgtccaatttctttggacgggcgacgacagcgtcttttagcgtcgcaaccttcgtgaaggcattgttttcggagtatcctttctatggtgttgttgtatacccggcggcgaccggtctcgcatagcggtggccggtttggcgttcagctctcctctctgtagcttgtgtctgtgtggttggcgtgtggtgtcggggcgtgtgctttgctgcacatcctttctcgacagctcgctgtcgatgaaaaactttcttgtaaacatttttttcctctatcttaattacatttgatgatctccttcggtaatcccgacaaaaaaaaagtatactggtccaaacagttcgatgttatagagtatatttctcttaagccaaacatttccccgggtggcaggactaacaatgtcaactattattcatttcaatgagaaagggaacaatacactagctgtatatctgcattcgtataatctgtatgaagattttaagtctgttttgaactgcttgagaatattgagatagctcatgtcttactttcttttctctttagcatccagcttgtttaaggttccggttgatttcttttgccagatcaacagtagactattcagttcaagacatcaaacagaactttaaagcgtgttgttctttcttgaccgagttactgaatatatctgtggaactggtgtaacgactcacagcttttcaagacatgatgctctacttatcttcctttttttttaactttgggcctgatatacatgcgttcaaaataagtatattgtctatcaatattttcccaacgcatttgattagctggtaactggtaagtacttttgctgaaagtgtttggttatgtagacttgaaatatgctaagttgatagtttgcaggatcataaaaacaatttgcagctaagctgttaccaccctggttagcaattccagttatttcaaactctaaactctatttagagcacatgtgtttcaaacgcacacttttttcatatgaaagttttcatataaaagttcttcgttgaatgtttttttatgaaaattttgagataaagtttttttggatgaaagttttgcagatgaaagtctttagaaaaaaactataagctaagaatgcaagtgcgctaaatagctgtaccccttgtattgtgttcttcccccagatttcctaactcacttctctcgttttccgcacgcacacttttcaaactgctttgcaaaaagtttctatataaatgttgttttaaaaaaacatattaattatttttttaaaaaaatagttaatacttaattaatcatgtaataatatgtattttgttttgcatgccgagaaagaggtttcccaacccctcatctcgaacgcaacctaaatagagtttagagtttgaaactcctgcaatgcattgcttggctgcacaaaatacctcaggctgtgtttagttcagcgtaaagtttggattttgattaaaattagagatggtgtgactgaaaaattgtatgtgtatgacaggttgatgagatgaaaaagggctgaagtttggacacaacctcagtcttcttactcaacagagtagctgtagacagtacaatggtctaaacagatttgatacggaaatcaaatttacgtgtcctccgcatgcaagttgatcaaaaaaaaggaagtcatggccggaacaattcactgaatattcgcactgggaagtagtatttttttttcgagaacgattgctgttgaagaagaagaatatcatgcgtggacacactgattggcctgacaaaacatagttagcaatttgcattaggccagtcacaatggctagtgtcattgcacggctacccaaaatattataccatcttctctcaaatgaaatcttttatgaaacaatccccacagtggaggggtttcactttgacgtttccaagactaagcaaagcatttaattgatacaagttgctgggatcatttgtacccaaaatccggcgcggcgcgggagaatgcggaggtcgcacggcggaggcggacgcaagagatccggtgaatgaaacgaatcggcctcaacgggggtttcactctgttaccgaggacttggaaacgacgctgacgagtttcaccaggatgaaactctttccttctctctcatccccatttcatgcaaataatcattttttattcagtcttacccctattaaatgtgcatgacacaccagtgaaacccccattgtgactggccttacggcaacatttggatatcgaattatgtccaaagagcgaaggtatctgttagctaatcatccgatcggactccttttctttaactcatattctcttaattattcctgtgttttgccggaatcctgactatcatttcactttctgctcaaatgcagtcgtcaaaagacatgtttaatttgctgttctagatccatcacttaactagtaatacttaactctttctcaaaaaaaaaaaaaacttaactccactaatgcaccactaactcacacgcttagcaattaatggaaagcataaactatatgtcatgtgtgttctcatcctgtggacacctgtcgatcgaccaagtgacaacaaaacttctatacgattgctaatcggttgtgactcttgtaatgaaaaagagtacgtgttcttgactggatatagaggtcgttttcttgcaagcaaatgatggtgattggtggcgtactggtttgagcatcggggtgcacatgatggtggtggcgtccaagtgcatgagcagtcaaccagacaacactgttgtctgtcatggaccgatggacgtagaccgatcgactaagcaggctcagggctcaacttcgtgcgccaagctgcacgatgagaaaatcaaaataccctaacgttatgcatgttaacttgttaagtacttaagtgcatcgtctcttattaggccctgttatttttaacttacggacttgtgaataggtgtaccacagatatcaaattacgatttctccaaaaaaaaaataatcatatcgacattactcgaataactagttctactatttttaaatttatattcactccgtgttcatattcatgccacatccactcaatatcgtttatagtatggtacagagggagtatagaataggtaactcacccctataaaaaaaatctaaatatgaaaagaggagtttccatataaatggtaataagaagggaggtgaatatatatatatatatatatatatatatatatatatatatatatatatatatatataaaagaataagagaggtgaacacatgcgacgacctctgatagggttcgaacgcaggtggacacacatacactccaacacactggtcatctgcattactctagcttaaattcatccttctaatcatacaaaaaatatccataatatatatgtcgaatcatctataaagaacatagccatagtaccactagtgaacaaagagtccacaatcctaggcaaccacttagggtttattcgattcacaggattttcaaatcataggaaaaacgtagaaataatgtaggaatgcacgtgcaaaataaaggattggaacataggaatttttcctacactgagctaaacaaaagaggatagagtagatattttcattcctatggaattagtacattttggaggatttttggaggattggcatagtattcctatggaaaattttcctttaaatcctacaaaccgaaggcatgaatagtgcttattccaaaggaattgagatttcctttagaaatccttccaaactaataaggcctaggttcccccacttcacctgtgtggttgtgcgtaataaaaagagtgagaggttgtttgggtagtggccgcagtttgctacaccaaaccttagacgcgccacaatttcttaggctagtggctggttgagtgccatagttgagttaagctacactttattagcacaatggtccacgcgtcatatttttattttctagccaaaatttaccatggttgtggccaacaaacactttgtatggcttgacacagttataggcttatggtaaataaagttatactgtggtaaagttagcctccatccaaatagcccctgaatacatgaatgagccataccgtattttagaacggatgaagtagttagtagggcttaaacaactaaagattcaaatcatatcacaaattctattacggttgtgtttagttccatgttaaaattggaagtttaaagaaattgaaacgatgtgacggaaaagttgaaagtttgtgtgtgtaggaaagtttgatgtgataaaaaaattgaaaatttgaaaaaaaaagttggaatctaaacaacaccagggtactacctgatacgtcgtgtgcaccagggtagaaaaatgtagcaaaggccgtggcacgcctagtagagtagtagtgctagcctgctaggctagtgtactacggccgtttgccatcgcagcagcatacgttcgctagctttcgatctggcggttctgcactcgtgtgcaagtgcaaccgagcatggtggagataattttcttttcggtactgtataccccatgggcggagctaccatgattcccgggtattcccgggaatacccaacttttttatcgaaaaacaagtatatttctaatatatacatatgtacacatattagtgcacctaaatcctcaattattcgatccaaacatagccctatacacatgtacatatattagtgcacctaaatcctcaattcttcgatccaaacacagcccaaccggcctatatgacccatcagacatcagttgatccacttagccaccactcttccagacggccccctctcgctctccctccatgacccatccctccctggctcggctccctcgcgccgctccccatttccaaaccctaggcggcggcgcggcgaggcggcaactggcggcgagaactggaccgcgctaccacggagggggaggctattgccgcggcgggcagcgggtggcgcccgccactccgccaagctcaggcagtcaggccggttgggtggccggcagccgcgaggggtagaagcggccaacggctcaacgcttagacgggaatacccaactttaaaatcctggctccgccactggtataccccgctagaatattaattattgatggaaggagaccaaacatatggcttcgattttctctctgattgtttttagttttggtttgttggacgtggttataacgtggctctaatttgaatatatctggtacggctctgttcatgtttcttctctctaactattctccatctctttcaacaaattaatcttttcttttttttctttgcaaggaacaaaataaaaaatatatatatttcggtttggggatgcaatgcgaatttgctgcaagttttttttcaaaaaataaaacttggctccgagcctacatatataaaattgtataaataatttaaaattagaaactcagcgactacaatgtgttttctaaggacatatagtctgaataactatatgaagtatacaatatctgacagcttagtttctgaagaaaatgaaaatatccccatatattttgttttcctttattcttgttttttaaaaggaatcggcacgaggttatgctatttcattaaatatagaaggagaaaaatacaacccctaggcgtaagaatgaaaaaaatctatacaaatctatccgaggttggaaggagctcctggagctttttttgctcctgctagggtccatgttcttgcttcctcctttattttcgccacgaggccaggtgtcgctatcttcttgtgctcgaagacttgccggttcctctctgtcgagatttctcagacaaccaacaagattaagctacgcatgcctttcttgggtacctcctttttgttagcaagtatctcccaacaggcttggacatcgaggcaaggctcccattggtttggatccaactgttgataggccacccaagaggctaggagtctccagactcttcctttattcttgttaagccctctatgaatgccttttgaagagaaaaaaaattgaagcttttggtccattaagagtctatttggttgaagggatgaaaatagatgaaagataatcatcccatttttacatgtttttgtttcatgggcgagagtggatgggatgggatggacactgaagagaatatatattctcttaagatgttggatgagcccccatctaaattgattgatgagaccatccacttttgtcaacgcaaatgattagacatagttagttttttcgttaattaataattttcatttcaagatctattatattattaaaacaactttgaaaggaggcaccacgttcgctgtggtgactaaaaattcccacattaatcggagaaaaagaaaaggagagtccaagcagaaatacaatttaaaaatagctgaaattcggaattaaaaataagcaatattgaaataagagtccatataagaacccaataggagattaatcaaaattcagaataaaaataaaataaaatatgaaattagaaaagaaaaaggagagtccaagtagaaatacaattttaaaataattaaaattcggaattaaaaataaggaatactgagagaagagtccatataagaatctaatacgagattaattaatattcaaaaataaaagtaaaatccaaaattagcaaaaagaaaagaagaattcaattaggaatacaatttaaaattaactgaaattcggaattaaaaaataagaaatattgaaagaagaattcacataagaaccctatacgagattaattaaaatttagaataaaaaataaaataatatccaaaattagacaaaattaaaagagagttcaagtagaaatacaattttaaaacaattgattttttttaaaaaaataaaaatattaaaagaacactatgcgatattaattaaaatttgaaaaaaataaattctgaaataagaaaatgaaaaaaagattttaattaggaatacaatttataaagaaaagaccatctaaaacacatgacaagatatattaagtaccaggcctataaaagagtagagtgttgacggctgatacgatatataaaaactgttaataaaacaccaaatagaatcctaataacgattaaaaggagggacgacatgcaggccgtgaagcaaatgggcagggcggttgttgggacttctagaaagttaaaaagtgaacctcattgataatcatattcgatttttaaaatctcaatgacaataaaaaggtgaagcagcgggcggggtgtataggagtatagctgcaaagccgccgacggttggcgggacttctagaaaataaaaaataaattccaacgatagttatgctcgatttttagaatcccaatgacaataaagagtaggcggcatatgggccgtagaggagtatagtggcatcgtttaacgggacttctaaaaattaaaaaaaaaatgaaacccaacgagacaataaactctaaaaactacgaggtccaatttttaaaggtttggaacttctaaaaagtaaaaaaaaaaccaataataactatgttcgattttaaaatctcaatgataataaagaatggaggcagcgggcgagccataaaggagtacaatggcaaagccgctaacggtttggcggaacccgaacgataattatgttcgatttttaaaatcccaatgacaataaagagaaaagacagtggacgggttgtagaggagtataatgacagtgtttgactggacttctagaaattataaaaacgaaacccaacgagacaataaactttaaaaattataagatccaatttttaaaggtttcaaagagaatgaataaaaatagtgataaatcgagtaagcaaataaagaaggatatgacagaagtaaggggtagcagctggtgtgacttttaaaagctatataattagaaatacgtggatgataaggttttgtctttcaaagtcttaagacaacgagatagctatttaataaattttaagtaaaatcagactggaaaatatatgattttgtttgggtgctagccgcgcaattgcgcgggccacccagctagttagtgtttattaggacaattaatctgttttattactaattattatgaaatacaataagattaatgataattactatattttgtaattagagtttcaacagagcaaattataagagtttctaaaaaaaacaatgcatgtactatttggagtttggaatgtaaggaatca

SEQ ID NO: 66222 - DNA, 11241 bp, Oryza sativa
ctctagtatgtaagtcacctaatcattagcttagtctctcactcattgcaccccaaattcaatcgccctcattgcacggacgaaatggtgttttttatgtgcgattcgcggccttgtgttttttctattcgtctttgcacgaatttcagcggtttttgttagctgtctggcatcgccaactgtgcagtagttttcccaaaatgtttcgaattaaattatgaatggtcagaattgtacgctcgaacattctgttcctgaactgatgaaaaaaaaaatagtgcccctgctatataaatactaggacaggtatggccatctacgagatcatattttgttacagatttcttcgccattggagatgatggagtcctcggaggcgagctggcactcgttcgatccgtcagtcgcaatggaggactcggaggcgatggcgcagctgctcggcgtgcagtacttcggcaatgaccaggagcagcagcagccggcggcggcggcgccgccggcgatgtactggccggcgcacgacgcggccgaccagtactacggctcggcgccatactgctacatgcagcagcagcagcattacgggtgctacgacggcggcgcgatggtggccggcggcgacttcttcgtgccggaggagcagctggtggccgacccgagcttcatggtggacctgaacctcgagttcgaggaccagcacggcggcgatgctggcggcgctgggagcagcgccgccgccgccgccgccgccaccaagatgacaccggcgtgcaagaggaaggttgaggatcacaaggatgagagctgcacggacaacgtcgcgaggaagaaggcgcgctccacggcagcaacagtaagtacaaaaaaaatgtacaattaatgaactgattaatctttcgtaataatcggattaagattcctgacgatgtgtgcatcaggtggtgcagaagaagggtaataagaacgcgcagtcaaagaaggcgcagaagggcgcgtgcagccggagcagcaaccagaaggagagcaatggcggcggcgacggcggcaatgtgcagagctcgagcaccaactacctctctgatgacgactcgctgtcgctggagatgacttcgtgcagcaacgtgagctcggcgtccaagaagtcgtcgttgtcatcgccggcgaccgggcacggcggcgcgaaggcgagggccgggcgcggggcggcgaccgatccgcaaagcctctatgccagggtaggtagaactatgcgcgagttgctgcacatttttgttgctcatctgaatctgaatttttttttaactgtcttgcttgaacagaagaggagagaaaggatcaatgaacggctaaagatactgcagaatcttatcccaaatggaaccaaggtaagttacttaaaaaccatctgattccaaaaccgcatcaatcacaatactccacaaaagcctccacgatactgaattgctctgatcatgcgaggacttgttatttttttcaggtggacatcagcacgatgcttgaagaagcagttcactacgtcaagttcttgcagctccaaatcaaggtaaccataagacccctgattcgaatccaagagcccaagttttgcttcaattcgcgcgttggtctctaatcttccataagctaaagcaatgggattcatcgttttgcgcagcttctgagctcggatgatatgtggatgttcgcgccgatcgcgtacaacggggtcaacgtcgggctcgacctcaagatctctccaccgcagcagcaatgatccacgtactccagccatggcgccacggacgctagctcaagctatggttctttgcagctggcgcagaaatacatatttttttttcttctacttctgttgatacagtacatttttccatcctgaatccatttgattcattcccaaaggatggccaaccttaattatatacctcattgatcgagttcttttttaccatttcgctccttgcctcctcgtacagcagatcctgccatggaagaacttatttttgggcaacggaatgtgaaaactactgagaaattggcagaacaccttcgctagtcggtttactattcttaaaagaaaagcaacgagagagatgaaaggaaaaagtgagcgtgaggtctcttatcttgtcatcaagtttcaaaatcatccctaaaccgaaatactagacataacacatatctaatcttgtaaaatcagatcacattaggtcccaaggcaatattactcctcggttttgatgatgtggcggctgagtcttattccatttatcttctctctcttcccatctcaacccaaacctctggggcatccgacaacaggaggggagaagagtagcggccgttgggcggcgacgccaagtagaagcctgacggtgacggccggcaatgggtgggagaaggctggcgaccggcgagaagcttgacggtggcgggtggcgggaagaagggcggaagcgttgaggatgacgcgaccacagcgtggagtaaatggagttgacctcgaagatgatgcagtggagctgtgcgtgcgcctccgcgggggagagacaaagctcgaggacacctaaacaaatcggcttttgagcagctcagtggagatggctctgagtttggggaataagagcttgggcagcatgacgtggcggaagccccagcccctgtgtgtgcaggtgaatacattgcaattgcagttgggtgcgcagtcaggtacatgacacgagcactcccggctattgggagccacactagccggcagtctccgccgtcgagcttgtccccgccggctggcacccttctccccacccgttgtcggctgccctagaggtttgggttgatatgagaagagagtcgagagaggtggaagaaaattgatggctgacatgtggcgctcacgtgggccccacactgattcaaccgccatgtcaccaaaatcatagagtaatactgccttgggaccaaatgtgacatacattgtatcttggtatttcagttcaggaacggttttaaaactcgacgtcaagaaaagggaccttaggtgaactttttccgagatgaaaaatttcttctttccagcctcatgggcctgtgcatatgacccacaggcaggcggtagcagagcgctgcacggccccgccccacaatcgacctcctgcctgtcttgacttttgagcacggtgagccagagctccaacgccgccgccccgctccgcgccgtcgtgcacctgctccgcctcgcctcatcgtgtccgcggccggcgagcagatcggcggcgcggtgagcacggtcccctcttcttcctgaactcgccctagcctgcttcaggcttccaccccgtgcggcctcctcgcgcgcacggccggcctccatcgctgctcgaatcgaactaaggtattattggttcttctctcgtatccctcctccctcctcggcgcccacttcatgagtcagcgtcgcgtagataggagatcgattttttttcccccagtttccctccaattagcccatccccttcatacgccgattcctgttatttagggttcatctcaaccccattgcccccatgttagtcccgccattgcccctgcagattgtattgcaactgtgcctataggatattttggacgcatgatattctcaaaataatactatactactatgatttatgaacagtggtgttaataactcgtgatgtgtccatgcccccacgaaaatttactgggcccgtgtagtatgtaaactgttctctagcacctcaacgagctttgtgttccgttgaaatatagccatgtcaaatagcagcctgccatgtccatttgattacatgttgttttttttttcatcttagctatttcttagttcttttaaatttccaataaagagagaacaaaatgtgtcttgattctagaaaaccagaatgacaagatgacatcggactatatgtgcaatgtttttagatgtcaaatcaaataatcatgtcattcatgtgtcgttcattgctgaattgagccttgcatcctagggtaccagggcagctctcctatgcgtaagaaacaaatacaattgcatatatttgtttcatttttttttgaatgagatcataatgtagcagtacgattccatcctcactgcaccctcaaggcgtgaactcagaattcctcaattaatataaaataacggtcaactttctagcttgcttttaaatgatttttaaaatgtaaagcaatttgcaggaactggtatcaggctgttggtgagaatggaaccaaagcattcagctgaaatgtccaagtaagaatttcttttccgtcccttaattcttgaggattttagttcattacactacttacaagggatctgcaggcatttggacaagcaaaatcaagccctaatggaaacttaccgagcaatgtcccacgagttgcataaagttcaggtgagctttatatggagagtattggagtatgaggcgtcactatgtcttggaagtaactttttagatagtaatactttgaaaatgttggtctgtacaggtggaagaagaaacaatcatgcgcaagttatatgagctgatgtctgcagaaggacttcttccgaaggtatgccgctcaccgacatgctaatactttgaaaatgaaatgttacacttctgatgctattttcccctaaatattctcttggagctgctgacctcatcattattcttccattaagtgatctgttgatatttcaccatgaaccaaatgctgtagttcattatagatgcaagagaaaaaaagaactaattgaaagatgatgggagattaatctgtcttgttattgagtgctgaatctcttgctgttattaactggttgcagttattaatgtctctattgcttaaaattcttgtacctttcttttttggttgatacatgactggcagaatagcagttctttgtaagagtttgtcatgttttactaatgataagcatttactaatattgaggagatatctaaattcatccattagattgctgatattgaggagatggcgacagcggtagataggtttccactgtgtgcctgtgacttcaagaactaaaccacagttttttaaaccagaattaatcatatatatatatttgataaaacagcacctgaggcccttttagctctctgtgctgcatgaactgaatccatgggatcttttattaaattattggcagaattggttctagagcatcgtaagtttacatgtttttgttttatagcaccgaaagttacaggttcactttaatagcaccgaaaagttccctccgttcccactcttagcactcccgtttcttttcttgcatgtgacgtcagttttgaccgaaattgactcattcaagcacctgaaattccaaccctatcctcctttcaactgaaatagccgaacacatcttcagatcaactaaatcaagcagctggaaccccatctctcacccaaagaaacgggagtgctaagagcgggaatggagggaacttttcagtgctattaaagtgaacattaactttcggtgctttaaaattaaaacacatgaactttggatgctctagaaccaattttgccattgttatttgtttatgtggcttatgttctccgcttttctaacttctgcacatagagcttaggctagatcaaattacctcaattgagttctgctttgcctcatattttttttctctctaataatcgatgcagcgcaagaaagaaagtcaagcacagaaaactgggaaatcaactcaggaaaacaaagagcttgaaccgtaggatgtaaactgtgaatattgatacgatactcatcttgatgcaattaacgagttgagctgaagaatcagatggttactatctccacgacatcctatatccccacaccttggaatttccaagtgatggatttacagtagataatgtgttctaactatagatgttaagtgtgctccagaggccagagcaatgcaaaacgaacaattgaacccttgaatcgaattgttatgtgaggagccaacagctggctagaatcagaagtgtatttttcatctgagatttctatattttcatagtattagttttgctgtagtgctagttgttcccgatgttttgctatctgagttataaattacgcggacttgtattcttatgaagtctgactttttgtataaaaaaatgcttaacataccaaagcactgtaatatcgtccttgtactttttcgcttttcttcgagcatttatgggagatatatagcattcgattgttacacatcgcaggctgtgctcagttgacaaacggaaaaaatctgagatagaaagttcttatattatatctgaataccgaatgattagtgaagttattatactgagaatgatgagttagtgttcgagaatgtataatgagttagtgttcgagaatggataatggatgagtagtgttcgagaatggatgagttagtgttcttatacctaataatgaatgagttagggagtgtttgaggagaaggggattgaggagattgggaagatacgcaaaacgaggtgagccattagctcatgattaattgagtattaactattttaaaatttaaaaatggattaatatgattttttaaagcaactttcctatagaaattttttgcaaaaaacacaccgtttagtagtttgaaaagtgtgcgcgcggaaaacgagagccaatctcccctatcacccctaaacgaacgatgccttagtgttcttagccgaatgattagttatagagcattgtttaaattagaaacgtttaacatcctaaacaacaccatcagagtggcgcagcggaagcgtggtgggcccataacccacaggtcccaggatcgaaacctggctctgataattaatttttgacttcttaatcgtctaattttattttatttattcatcttttttgaatcgtctaaatttattttatttattcatcttttttgaattattgcttcttaatcttctacgctagctctatgcaaccacaatctcaccaaatggcgaagtaatattagtgtctttttttgataattaatttttgctgatttatcattcatttatcgaatttgttcttaatgcatacgtacttaacctatctcatgagcacctctaaaaaaattggtccgtatatcttgagctcgatgaaaacatcacagacatataagctcactcttatataatacacacgtgtacatttggttctaatgaatacttttgaagattgagttagtaatatgttaagattgacgaggttaccggtcaccactggtgtctgtatatacctacaaattttgagttcgacgaagtcaccacaagtaatatggtacgttgtccaccactaaaaataattagctataaatacaagcacatcatagactcgctgtcaacatgtatatcgctaccagtgaaaataattactccttccggacatgtctcatgtccagattcatagtcttagatgggtctcatcccatcatagtttgctatattttgaaacggaggtagtagctgtaaatacaagtattcgtgctaaaattagaacttaaacttagattagcaggttccatcataagaaaccttactagtagctaaggtatcctcaattcgccataaatatcaggcaaaaaaggatcctcaaagtttatggtatttgttgtatgacatccaaagaatgtgtatttattacatgacaccactaaaaacatggtaattagctggtggatgctgaacgtattattttattatatcggatctaaatggagagagaaactttcaaaaaagacaactttttacctatggtgcatgtttctttttaacccaaccagatctagttcggatcagacctacaccaagagaaaagttacaattttgcccttgtgtcaatcggcttgtaagataactttgtttgaaccaaaccagacctagtccattctcactccctcgatagaagagtccaacaaagcgaaaagtacaaatttgtaatgcaataaatacacgttttttgggtgttctacgacaaaggctataaaatttgagtgtcttagagcacattttgcctaaataatagtagtactgctcctactaatattcagatatgcactctttcataaaacatggcttagtattttgattttctacccgacagggtgaacagacaaaatacaaactataaaccaaatcatatgaagagcttgagacgaaaaaaaaaacaaaaatgatcgaaatacgccccttccaatttttacaatttttaaaggtggaaattgtcacatggcaatttaaatattgtacattgtcacaagaaaccttgggtctccccaaaattccgggaaacccctccggaatctacaaagcctactcctctccctgtcctgaaacgccgtgacggcttctccttctccctcctccccccgatccagccatgtcgtccgcgccgccgccgcagcaatccaaaccctcctacaaccaccgccgccacaacaacgccgccccgaggcaccaccacggccagcagcagcagcagccgcagccgcagccgcagccgcagcagcgctacgtccccaagcccgccgcacctaaaccctcgcccccgccgacgctcaccaccgccctccgatcatcggcttccccgtctgcatctggcgccggcagggtgggcggagaggccgatgggttcgtggcgtacctgccgcacgacgaggtggtcgcggccgggctcggcgggcccgacgcccaggagtcgcaggccgtcgtcgacctcctcaacgatgccctcgccgcgctcctccgcgctaagccccgcgagttctggcgccagggtaaccgaaacgctcgcttgtgcattactgtgctcatgaaaccgtgtagctggaaggcgtgaattgttattttgggattgggaaatcagagctgaaagcttggaagcgataactagttaaccacttaatgttcggtgtttactgcttgtttgcttcaattgtgtttgttgaatgcatcttctgatgcttcggtctctgtgattatctaaggctacggattatgtgtaaaattctagtgtatgcttgttcaaatgtcagtttgcacttttaagcgcaagataaaatgcgtgcagttaaatttattactacatttgcagttgaagtggctagtagttgcataagcaaagcaaagcctatgcaatcatattcttatcactatcatgacctatgatcctttgaaatagttttaatgggaaggaattaatcctagtcccttcagattgacaggaacttcagattgacaggaataactaccctacaatcagaggaatttggcattttttcttatgcaaactaagcctgaacaataattgagcgagtagatgagtcaacataaaagcttgagttgaggacacgcctagatctgtgattatccattgtttcactcctagaatttaacttatgaataaatccgcgtgcatttgaactttaccaatggtttcctaatgcttatcgttaccttttcccagtggcacagaatacttccctgcatgagttcctggacagttacctacaattcaggcatcggtggtatgacttgcctcatcgtgcacccaaagggacagttgctggcttagttgtcggggagcttgagctttgccgtcgagtctttatggtcctgtaccgcatgtgagatttataccatttcgctatctttcttgtatacatatttttcataagataatgcacactgttcagattcacatgagatttgtcatgatatggctcttgtttgggtggtagatcttcaaacaaggatcctggagcattcaggggtgaatcccttagcatgaaggagcatgcaggtgagattagaactactcatatgatcactgtttgagtttacctttttttagagcagaatggatagtgaccattggttcaaatatactatattcacgttgttcggttgtagccctcctgcaggagaaaagattgcttgatttacccaagttgttggacatttgtgctatttatgggcatgacaattgcaaattgacaagttcactggttggttcctgaagtgtttattattgttgttgtttttctccttttcattttgcagacagatgctaacttaaatgcaaattctaattcattcccttagtctcagataacctttttctattcattggcatgaatacttttataattttattaataacaagtgcacattttctgtatctgtaggttgaaaacgctatcaatgtccagccaaatattctggatggcattaatattgtccttccccaattcctgggcattttccacacaatgcaggagaggtgcatgaaatcattacaggttattttgtgatcttcttcataaatcactgcacatagctgttataggattctgtattcctttatctggtatgaacatccatatgatatcattataacagctgttttcactttagtctgtagtcccaatcgcatatgctaaaacttttatcgttttctgcaaaggattcaggttattcatttgtgctattgacgaatatacttgttattacttgttatatctgttattgtttcaaatactttcttcccagttcctttcaacaaccatgatacattgcttggtaggttagatagaaagtgacgattatgatgtttactattaatttgtctctgtttcttttttatcctaaattgagattgaagtatgttttctcaccacgattaaaagttgaggacctatgatattgatataaacttgatcttgtagtttcacaccttcctgatctgatgacagtttagtagtttacagaagatcttggagaactatgcataaaaagaacttaaccataataaattcattttaggcgctcacttcatctggaccgaatgatagtggatatacccaacttcagaaagatttctcagaggcaagttttacctatactgcatagtttatgatatgtctgctgtcctttcatctgatttttctatattgttgtaaatccaacttccttcaggtgttggattttgtaaacgatgcaattgtcactctggatgcctttgtcgatgcttatcaacctgctgctttattattttgtacctcttttgagacgaggtgcgcttctactcatccaacacaatatttgttcgctgttcccttaataggcaatggggctgcagga

SEQ ID NO: 66223 - DNA, 1519 bp, Oryza sativa
agggcatgaaatggatggtagtacaactcaagacaactaaattagcggctaaattgccacaaaaatacacttctaaaaaaatcgaagtgatgcaattcattaattatattgttcatgcaaggggaacactatcaactatctttgaggaaaatcacctcagttccagcaatgcccattgcaagtccaatatcagcttcatgaagagcaggagcatcatttgtgccatcaccagtaaccgcaacaacttcatcaaaagtggtccggagatgcttcaccaaggtgtgcttgtcaagtggtgaagatctagccatcacctgatacatgaaaccagaacacatcagcaaatgaaatccagaaaattcagttaaactgaccagcaaaagcaacgaaaactttacttgtatttttggtatcaactcattcagttcctctgcactcttggttctgaaatccggtccttcaatggcaatgccaccttcagtcaaaatgccgcattcccgcgcaatcgccttcgctgtattgatgttgtcacctgtgaccatcctcaccatgatccctgccgacctgcagatggcaaccgattccttcacaccaggacgaactggatctttgatccccacaatgccaatgcaggtgtagccatcttcaggaatctggtcattcgccgagaacccgtcaccgacatcgacgtaggcaaggcacaaggtacggagcgcctcgtttgcaaagctgttgatcgtggcgttcaggtgagcaacggttgcatcgtcgagtggcacgacgttgccttgatcattcaggtacttgctgcaagatgccaagatgatctctgacgcgcccttgctgtgtgcacgcattgctcctccggggagctggatgaccactcccattctcttcttggccgagttgaatggctccaccttgacgagggtgctcgccttgcgcacggccaggaagtcgccgccgagtgagaggccgaactcgaggatggccgtctcggttggtgtgccaagtatctcgcgactcccgctcttgttgaagacgacgtcgccgccggtgttgttgaagatggactgcgagagcagcgtcatggcggactccggcagctcggagaacaagctcttggtgtccgaggcgctctccacgtctttgatcttgccgcagatgcaggccttgacgacggtcatgtggttggtcgtgagcgtgccggtcttgtcgctgcagatggtggtcgccgagcccatggtctcgcaggcggcgaggtgccggacgagcgccttgtcgttcatcatcttcttcatggcgaacgcgaggctgagcgtcacggcgagcgggaggccttcggggacggccacgacgacgatggtgacggcgatggcgaagaactcgagcagctccatcgcgtcgtctccggtccagctcaggtacgaggcgtccatgatcttgcgccggaagaggccctcggtgagcacggcgaacgtgacgactgcgaagatgaggccgatcttgccgatgatgg

SEQ ID NO: 66224 - DNA, 4302 bp, Oryza sativa
atcttgttcttctccttgtcgaggtccttgaactgcagcgactgccggtagtcgctggtcgccgtgacgaagacgacgagaaggatgctggccacgatgccgagcccgtcgtgcgcgcccttgggccacccctcggtggcgatgccgacgacgagggagaagaaggcgcacgccgcgaggatcatcagcgtcatgtcctggagcgcctcccagacgaacacccagaagctgcgcgactccgtctcggcgaacctgttgatgccgaacagctcctcccggacggcttgccggcgcctcgacttcgggagcccgtcctccggcgaggtgcacagcttcgccgcgatggcctccacgccgccatgggacttgagcttcttgatgtcgtggctctccacgatggagctcagctcctcggcgcagatgccgtagcccgccgccttgacgtcgtcggggaccgtgtactcgctcgccggagcaagtcctgcaggatcgtgccaatgtcatgattgggctccatggaaaagagaaaaaaatgttgatttcattctgggatgtgattgtgaactggtatcagtatcgttcataccttggatgaactgaagtgcagcctttgacactagcacagcaactcgcagcttctcctgaaatcggtacagaaaaatgtgcattgatggtaagcctcgtgaattttacagtggaacaattgcatgaaaattcatgaaaaaaacatgagtttgctggcgtttaatcttccagtgctcaaagaacgtgcagttttagcagcagattgcacacaatgaatagtcgagctggctgaaggtttgtcaacacgcacactgacgcaggacacaggctgagtttctgtgtttagtacatgtgccaaattttttttaagtatatggacacacatttgaattattaaatgtagactaataacaaaataaattacagatttcgcctgtaaactgcgagacgaatctattaagcctaattaatccgtcattagtaaatgtttattgtaacaccacattatcaaatcatggcgtaattaaactcaaaagattcatctcgcgatttacatgtaaactgtgcagttggttttctttttcatccacatttaatgcttcatgcatgtgtccaaacatttgatgtgacggaaaagttgaaagtttgaagaaaaaagtttgaatctaaacacggccaccatgctcaactgcaatgtgttcggcacccaattttcccaacacttcttcctcgttttccacgtgcacgctttttaaactgctaaacggtgcgtttttttgtaaaacatttctatacgaaagttgcttaaaaaatcaaattgatccatttttagaaaaaaatagctaatacttaattaatcacgcgttaatgcaagcatcgttttgcgtgcatgggaggaggggttcctaactggaaaaaaaattagctaatacttaattaatcgcgttagtactacttgattttacaaagtgatgcagaactttgtcctggaaactgttgtggaagcttcagtactgcacaaatgctgcaccttttacatgtgtatatgtgttgcagacttgcagcagacgtgtaacgtgtttatactttatacttgcgattttgccagaagaaacatagtgtggattgtattattgtaagtttgtaacagaggaacatgttactcactataaattttgtttgccagaggttatggaaaattttaaatttaccatgttcaagggaggtgctaaacaaaatcttaagttttcagttaaaatgatcttttttttaagatacaaacttcacaaacagctcaatggataacagtgaaacattcaaactggataaagattaaacagtcaaacaggtacgtttgaatatcatcttttttaaaaatatttttttcttgatcaatgcagaatcaggttcacatctgaaacagtaaaatctaatcgaacggcctaaaaattgcagcttacactcagtaatttacagatgaactaataaggcctgacagccccagcccgtaatgattttcattatatatatatatatatatatattacgatagtttacacatccgaagtatgccaagaaaagcggtggcaatggcaatggcaattacgacgccgatgcaacacacgaacataacatatatcggcgttgaatgcggcggcagttacctggttggatcgcttcatggcggcggcctcggatcgcttgtcgaggttggcggtgaagcggaaccgccgcttggggttcttgacgacgccgaccaacctgcgccatcgccccagcgcctcgtccgacgagtgcttcgccttcaccccgccgaaattctccttcaggtagctctccattgcgcctcttcaacctttccctttcaattgggtcccaatccaacgaccccctcctccgatctcctccccaccgccaacccaaaccctttctatatagccaacgcgggcattggtttcttccgcgaagaaacgcgtcaactcgcacaatggcgttcgtgaaggcgactctctgacggcaacttcagcgcaattttttttgtggggaaagtgttcggctggtcggaatcatgggagtttttgcgtagtttcctgtgtttttttaggaagtgacctgacggatgcgaggaggaggaggagggagcagcagcgggaggggatgcgtgcatgcatgatcgcgcgcatgcaggggcagctcctctctcctatttcgttcgctactggcaatgcgccggcaattcaggggtcaaaactcgaaccgagtcttggggggcaacttttcaagacattccatgcagctctgctgcacgtacgtacatgcgtaggagagacgttcggtctttttggtctcttgtacggccggatgagaaagccccaaacgtttccttcaactttccagtgacttgagcattacttgagcatctcttgtaggcaatatttgtgccattgtcatcattgtgtcatcgcgaggtgttgccttcgtagaagtgtgcaaattggaaaaaccaacggaaaattcattccttaccggctctctagcctcatgtgcggacgcgcctaacattgaatattattgaagagaacacataaagtcttcagagagagagagaacacataagttgaaggctgaacgctatttctcgtggcaaacaacttttgatttttaccgaaacagaggaaaaggtgaaccctctaaacggggcctcaagtaactagaacatggtcccacgatggcacgattttacaatcctcgcctgatgaggtcctcgaatccgcgtcgtcgtaaacgtgcaactaccatagaaaatgacttcgcatttctctagagagggtccaggagatcaggacaggactcccgggaatgcataaattggaaactccaaagcaaagctaaaccatacgagcatcttacttattctgtaaataatcagagagacaaggacacaggaaaatgtggttagagcaccgattcccatttatcctcgcggagtattttagccggaatccaggtccagcggtcaacgtcgccgtccgacgcaaatgggaccgcgctcgagaggaacgcgcaccgcgtcttctccgcggggcgcggggaggcggaaagaaacaacgaggccaccacgcccacgcgacgcgcccacccactcctcttccgtgtcgtgcctcgtgcgttcaacgagccggtcgttcccccgcggtggtgtgcctccctccgcacggtcgtaggcccagaccaaacggccgaacgggaggtccgcgacatatggaataagttcattttagatatctcgtccacacgtcgagtttgaatactgtcatgaacctcgataccagatatagggagagtaccagatcgattagcgtccctaagtggtttcgatgacgggttcatcctaagtggcggcctatgtgacattttagttaggaaaaataaaaaaaggtggtggccctaacatgttagtgacacacccatctcccccttctctatgtgtttgtctctaccctttctatgcccttaattcagattccactgccgatgctgacggtggctggtacatagcaactcggtaatgtgtgtttggggcgggatccattggggtacttgcggtcgcgcatgcagaagaggcactgcccccgataccctaacaacgtctcagcgatgatggggacgggggcaggcagccagcggcatgcatgcataggtagtgcaccactagacaggtttggcaccactcccaacgcccaaacaatatctaggtgatgatgaggacgggggtca

SEQ ID NO: 66225 - DNA, 8696 bp, Oryza sativa
aggcctccccctccccctcctcatcctgggaaggcctatattcgaaactccaaggcgagctaactacacagccacaggcatctataccctgtacggcaaatctgagagacaatcaggaaacaattacaaggtgtcaatgacgacatagtacaccagttcctgtctccttttcctcggggagtgttttagcggaacataatcttttgcagtcgactgcgccgtgcctttattattgacatgtggatctgatgatctccggattcacatgttagtgataaagtcacggtgcactcaaatgttgaggatctcaatcctgttttagcaggactctcaaggtccagggtcaacgtcatggcgacgatatgcgaaggagtactgaaggaccgcgcttttgataggaacgtgcaccgcgtcttctccgcggggaaggtggtggaaacgacgagaccacccaccactgcgctgcacggtctgcacccccacgcgcacacgttgcgtgttctggacttcccgtcgttctctgcgatgggaaaggccggaaagtgaacggcgcatcacggtgacgggcctccactccgcacggtgtgccgggaccaacccgagcgcctcgcagcgaggctcggtccaaccaaccggtggcttgagtcgttcgtgcatcgtgcattggaataagtccactttgactcccttaaaagtgacccgaatctaatccgtgaccctcaaccataaaaccaaataagacgactccccgaactattcaaaccagtgcaatttgactccctcattggttttggacggcggttttactgacgtggcgctgatgtggcgatgttgacttggtttgtggtactgacgtggcgcttaggtagcattagaattaaaaactatatgggccctatttgtcattcacacaaaaagtaattataggacccacatgtcatccctatgaccctatctatccttctttctcctccctctctcccttgagatttgaaaactttcagctcgagatttgaaaattttcatgtctaaatttgaaaaatttaaagttaaaatttaaaaattactagtaaaccaaccactagtaaaaataggaaactaatctaaactaattatatttttttcttttatccgtacggcaggaacaacatacggcgaaaaaaaagaaaaaaaaaaagaaacagcggcgttaaaaaaaagagagaagcgcaaaagcgcgcgtgcatgggtcttggtcttgtgggccagcgtgtgcgccggcagcgcgcggattagcctttccgcatcgcttcagccttcagaccgtcgaattcgatgtacaatcggacacaatcaacccttactacgttttaatcagaaaagaaatgatcttactgacatcgctttagtcgctttactagctagctaatcactttggagtttcagtgctagtgttcaaaaagcgcttgtactggcagctacagtacattacatgatttacatcttatagcacactagtatatacgcctagtaaaaatttccgtaattttgataaattgaccctttgaaaaaacttattttgatattgagccgtgtcaaaaactaattttaaaaatagaccattttctcgcgccatcgtacttggcgctgagctacaacgtattagcgccactttctttggcgttgagatgcgatccaacgtgtcacgtaaatcacacgtcatgcgatgcgatgtcagcgctaaagaatttggtgctaacctccatggtatagttgtataaatagtatgcatgtacattctagccttatggaaggtctatcctggtggtgaagggctgcctctcataacaagaggtcaagggttcgaaccccgtaacttcttatttttcttttttttccttttaggatcaatactgcatacataattatgtagcaaaatagagggtgaaaaaaaatgaaagatgtaattttataccaactattaagctataaataccacatacataattttgctccttccatatttaaaaataaaataaattaaaaaacatccatatttaaaaataaaatgaatttgaaaagcatgtgagatttttaaatagaacagcaaaagatgcttatacttgcttggctgaggatcgaacccattacctcgcagtatttagcacctagagttcaccaagctttcttgtctttgtgtgtgcaatggaagcttgtagataactaatatttgtaaattgaacaaagagtatttggcgatgacctcggatgacgtgtaaaatccgtgacacttcggatgacatctcggcgctaatctatatggcgctgagaaaacggcctaattttgaaattagtttttgggatgattcaatttcaaaataagttttttaaaagggtcaaattgtcaaaattacggtaaaaattatccacattcacgaacaatggatcaaaatgccgtctctcacatcaatctcatgcaccttgcagtgtttcccgccggctccgccgcccgtgcgcgtgtgcctccaacacattacctgcatacttgcatagtgccctactgtacatatgactgtatcactggtcactgcatgtggcgactcgacatggagatggggggcctctcccagcctcccctctcttgggctttttggccgcgagccaacacaggcacacagcgccgcccgctgtagcgcgacgtgcggccgatgaatgtggcacggaacgtcgcgccgggcacgacaaaagcggaagggcctcggactcgagagatggctcgccgtcggttgtcgcctctacgacggggaggataagctgcggctatagggcaactaggcacaaccaaggcgatgtgtacgtacgcggcacgcacgacgccgacccggttcatggcatggccccatcttatcgcgtacagggatcgggattccttcgataccccaacggagagggggcccgctctagagagcaggctagagagcagagaaccttactcccactctccccatatatgatggcatagtattatgaatttgatgtatcttggaattaatcaaggaacgtcaaccccacctctcctgtcgccctccccggggatggctagggaggcgagctccggccaccccctctcccccacctctctcctccgcctcgccgccgcctgagcggccgccggcttttgtcagcggctgcaaggatggcggcggcggggatcgcttctcgccggcgggaccacgcttgggtaacctagggagccgccctggacggatccggccctcctgagggcagatctggtgtggggcgagcttgcggcggtggcggtgctgcggagctcgtggcgacagcgtcagcgtcaacggggtgaactcgtggcgggagaggccgtcgcagcggcgacagtggcgcggagcttgtggcgacggtggcaacagcggcaacagcaggtggctggccgacggcagcatcggctgctgtggcgaccgtggctgcagtgggaggaggcacggcggtggcgaccgtggttgcgatggaaggaggcacgacggtctcgaatggctagtcgggggcgtggcagacggccgcatctggccagcgtgacagcgattggaggaggggtcggaggctggtcctcggcacagagaggtacggctgatggcagtggagaccggcatggcgcgagaagcatgcccgactatggtggatgccggcttggcgtgagggacacgaacggtggtgggaggccggattggcgcgataaggcgcgtccggtggtggaggaggtcggcgcagcgtgataaggcctgctcacggaggaggaggtgaccatggtgcgaggagctgccggtaggtgtggcgcggtattcggcgtacgaaggctggccggcggggggggggggggggggcgccggtgaagtggtccgacatgtcggcagagttgggtgatggtggagcatcggtcggtggtggagcaggtggtgagcggcggctgaaaacctaacccggccttggccagactgacaacgatggtgtcattccctctcctgagagcgttgtcgtgctgtctcatcccttaagggtggttgccgggtgaaagcccagtcttggctcttttgagaccctgacggacgacgtcagcggcttttcgtcgcttctctccttggagacgtcgtttaggcatccccttgccgaaccactcgaacaattggtgcatgcacgctctagattctcatcctcttgtggcggcgtcctagtttctacaaatttgccacgtcggagagcctaggggcggggacagatgttcttctctctcaccctctctccctaaatctggaagacgtggatagagttgggctttgtgttggttgtaagggtgtttttttggcgatctcgtctatgattcgttgttggcgtagtggcgaccggtccggtgtcagccttctcctggacctgtgtgttggcgctgtcggtgtgtgggtgatggtatttttccccttttttcttggttacgatctaccaaggttttaatcctgtattttttttcctattctatcaatagaacttcgcaccgtctcgtgcgagtcgttcaaaaaaaaagttgtatcttgctccatcctaatttcgatatcttgttcggtctcacaagctaaacgagctggcttgagccggcaaccgagtcaaccttttaactcgtttggataagttatcctaacgagctagatcgaggcgagctggcttgatatctactcctaattatgatttattcatatttatagtttcatccggttctaagttactatatattgagatgaaaaaaattaccttgtactttcttctttgtttcatatcatcacaaagatatatctgaacaaatatttgtccatatacgtctgtagaagattagaagttgattttttagacgaaagtgtatgcaccaaattgcaacttggtctcatccaaaatggccatgtgtcgtctttcccaatccctctcctttcctttttcacctatcctcttcgtttctttgccaccccccttgtccatgcatttacacatcgctaaatcataccggtggtcaggttacaagtccacaacgagtcaacgaaactacccagctgagctaggcttgatttcaatccaacaaatatgaaataatgaaagtgcactgtagcaacaggcttgcaagttgtaacactgcttccccgcaaaaaaaaaaaaagttgtaacactgcttatcactgtgctggtttctctgccgcaacacatccagcaagatgatccatggatcatactacatggataaccagggtgtgctcacagctcgtgtgtacatgtgtgtgtgactgattgatgtggcttcgatggggctcacaaaagttggcgttacgtgacaattggctgaaactgtattacggagcacgaactcgattggattagtttggcttggttcgttcatagtagcaactagcaagacgctgattgcagacataatccatacttatcacttgtggataagaatatgcggactactagataggccaaatgctaatactccatgatcaactgttatttatccatcagcattgattattgtccacaagcttaaaggctttggtttggccagctaacaacaccacaactaccgtatcaaaagctaggcatcacgcagatcatcacgttggctccccatcaaggcccccacccacagcccacacaaccactctcacacacagacgcgcaccgtagagcatcctaaaacagtgtcaagattgcccacatcgtctgaaagaaaaaaaaacacgacaatcaaattcagatagtaatgctactccctccatagtccatccacgtgtgtagagcatttctaagattgttatgacattattaagaaggaaaataaaagacttttgatgcctcttattcaagtgcggttgccatcttctgattagacaagatgaaaggctgaagcctgtggttcgacgagaatttagtgataggtggttgaaaggagatagaatactttataaatttcgtgtacaaattttaaaggtacttacatcgttaacggagaccgttcaaaaatatagcagattcttctaaatatatcaaccaattacttataagataaaaaaaattaccacttaacttaattatagtcccaacaagtctcgatctatattcctcacttagagcaaggttaagatagcatgttattagctgaccgtgtcatctatagtaagcatagtaactaatacctataatatgaatattataacataaatattttattgttttatgggatccaccatcttttttcttcctcatacctcatcatttcctgtattattctctttctccttttcttaccttcgattcgtcaacgattttgggcttgagcagtcagcgaggatggacgatgacggtgatctggcggatgcaggtgactacggcggtctggcggacgcaagagacagtggttgtcgtgcaagacaaaggcggctgtgtggtggaggcggaaggtaacggtgcatgtgcggcggacgcaaagacggtgacagctgggctagacgagctcagttgtctggtgaacgcgagagacgatggcggctagggtagatgcgggagtcggcgccggccaagccgagggtgacagtccaatggacacgatggacaagggcgttagccatggagtatcgaggagcagcaccaacgcaaaccatggctgatgtaggaatgcttcttcatctacaggcgagccccacaacttctttaagcagcgcgtgcggcgacaaattagtcgtgggcgctctctcttcccccctctcctccaattcatcacaaaatcctacgtgaaactaataccgttcattattgtacccgctcttattttatagagcaatctttttatccatctcgttttatccgtgtgaaaggctaccaaatttttgagatggcaggtgtaggtaaggttagagcataggaatctctcagcaagaacatacttcctccgtatggaccgtaccaaaaaaaactaacataggattgagatgtaacgtaacctaacataacgaatcttggcagaagactatctagatttgttgtgctaggattgacatgtaacgtaacctaacataacgaatcttggcaaaagactatctagatcttggcaaaagactatctagattagttgagctagattatgctcgtacttatattagatcgcatctttttaacaccgagatagtagtgcccaactggggcatacaaagctactggtgactaatcaggttggtacacgtggcgacttgtgatttctctggggggccgtaggctgcggttagatggcagggtcaacctccttatcggcgatataaatggcgataagatgggccatgcatgtcgttgacaatgatttgccatcgcttagctgctaccgctcccacaaccgacgattccttgagacgttttaaccgtacaaaaaatgaagggtaatttctacagcagcagtagaaattactgcctaaataaacattttcaaaaatttatattatcaaaaatttgataaattgacaacattattaagttttgataggataaattaaatatgatgttgctaaattctctatataacaaagtaaatatcgttatatatttgttaataacaaataatgatacgatttaaattaattgaacatattagtactacgaagaaaaaattactgcggctagatattgacaaatgaaacgacaagacgtcaagccgggacaaggaggaagaagaaacaaacaaacgaacccgtgtgcgccgtcgcgaacactcgccgtgagaaggcccacggcgtcgtccatcaatcagaccatcaccaatcggcgagtgaaaaaatacaaagaaaaataattgtatgcacgaagcactccagtaatgtaattttttttccaatagagtaaggtaggtaaaaatcgagcactaatgctacagtacactctcggtcttggcaggtcgcgccgaaatattttctaggcctgagaagaggagggtaaaaatgcagtaaaatccgacgcggtaaaaaaaaaaaaacagtagagggatgcgtgtccccctactgggccacacgtaccgtagccgcagctgcggtggtttttttttttctccttcgttttgactcgtcgctgcggctacgcgcacgcgcggcgcgccgcggtggcgtgcggggggcgttggattagtaccgggcgagagcgcggcggagcacctgggcgaggaggctgggggcgctgaggtgggggaggtgaccctcggtctggaggaactcgacggtggtgcggccgccgaggtgggccttgaggtaggcggcgacggaggccgggacggagacgtcgcgggtggtctggacgacgacgcagggggcgcggaccatgccgagcacgccgcggaggtcggtcttgaagacggtctggcagacgtggagggagatgtccgggcgcatgttgaagagggtgcggctgaactcctgcaccgccgccggcacgtcggcgcccaccgccagaggcgcgtaccccgtcgcccacgccgagtagttcgcccccatcgcgtcgaacacctgctgtatctcctccagctcgaacccgccgtggtagtcgctgtcgttcaagaacctgcacacacatgtccgtgctccccgatcgcccccgatcagattcaattttaagagcgagaaagg

SEQ ID NO: 66226 - DNA, 759 bp, Oryza sativa
cattgtgaaacggagggagtagttcatatattgttctgacttctgaggatgaggaagattttggttcagacagtgtagtttttaagaatgtgattgcttagaaaagatgaaatatgataacaatgagaaaaacaccgatggcttgagagaacttaggattcacgaaacacaacaagtttagttttccaatttgttttgtttccaaaggaaaagttgtgcaattcgaatttaaaacaggcacaaccaagataactgatagttttctagctgccgttgatgttgtcaatattattaactcgataaattttgcagctgtatactgtatagagagtagtattactattacctcgacaacgacataaagaaaaataatgttcaatgtaacatatgatggatgtttcaaacttccaagtcactgtaagttctgttgaggtctttattatcaagacctgactttttctgttaattcaacagctcctaagtacctagcactatcaaacgggcatgccaccaagaaaacaaaacaaaatatcatcgaaagtacggaccgagcaacaaaatctgaataaaacatcctaccaaagcaacaaatgtgctaaacaaacacaactaagtactattaccaaatactatatcaaatcagatagcgactactattaccaacaaaaatgaaatgatgattctatcgtggtacgctgaattaacaatgcaatgtcaaaagcagtaaactgaactaagtactcaccatccaacagtgca

SEQ ID NO: 66227 - DNA, 1194 bp, Oryza sativa
aaaaattacagcacttttgtttttacgatgtaactcatgcaaagtttcatgcaaaataaccacaccttccataatatttctcccaggaatgaaagcagtttgagtaggactaattgccttttgggcaaccgtcatgactctatttgtggcaactttggtaaagatcttaaaactaacattaagtaagcaaataggcctatattgctggattttcatggcctcaacatacttaggtaaaagaatgatcgtaccaaaattaagagagtataaaggcaaagtatcattatgaaattctttaaaaagatctaataagtcacattttatgacattccagaaaacttgataaaattcagcaggaaatccatcaggacccggtgctttgttatgttccatttggaagatcgcctcattaatctgtttttcagtaaaaacatgcgttaaagcctcattctccaactgagaaacttgaggaatgtcagcaaatttattctcatcaaactgaagagtagaatcattaggaggcccaaataaacctttataataagtggtaatatgcgatttcaaattcgcatcaccatttattaattggtcaccatcatgtaattgaaaaattctagtcttcctatgttttccatttgcaaccaaatgaaaatattttgtgttagaatcaccctctaaaatatccttagatttcaccctctgataccatttaacttcctcttctctcagaattgtagataatctatttctacaaaaccatctaaaatccaactcctcctgactcaaaagcatagtttctgcctttttatctagcaaatccaacttatctaaaatctccttttttttcttttttgtacaagccactagtatgtttagaccaacccctaagatgctgtcttaaacgacgaattttcgcctgccaccgctccatggcagaattgcgttcatcaacactagaccatatctcctttaccatatcaacaaagccatcacgtaaaagccaaccaaattcaaacttgaaactatgttgagcattactcaaagaagaagtgtttgtatttaaaagtaaaggagtatgatcagaaatatctctattaagagccaccacagaagataaaggaaatttatgttcccactccgtgaacattaaaaccctatcaagtttctcatatgttggattcactaaattgtttg

SEQ ID NO: 66228 - DNA, 1389 bp, Oryza sativa
ctatgattctatattctgttactatgcctgctctcgccatctatgcatgagtggttcttagaaagcttaaaacttccagcttgatccagcatattgatctcaatgaatggaaagagaaagagccaaaacagaatcttatctatatttatatctatactacttaaaatgtatacgtggtggtgtctgttctgccacaccatccttaccactgacatttgggtcccacaatctatactattacatcaccctccaacaagtcctcctatttcactgctggttctccccaaattttgaatcacctacttgttcaataaggaaaatcataaaagtactacttggattaactatgtgcttaattgacttaactagaaactcaatttgttttccgttgcaacgcatggacttttggctagtaaaaggaaaagatgctctagcttctgttgttttgttctcataaagttcaccaataatattcccgtattaccctacatttgattttatttctgctcgcgtttgatcattctggcacttttgagttgtgttcataagacatcactttttctgttttggctagattctgttgtgaagactgaaagagtttgctaaactgtcagcattattctgttgacatatatgctgtattttcttgttatctcaagtttattgattgtgtcatagttttatattgatgccaaaacctttggttgatgtattcaatatgttcctccaatcgtaaacaggatggatacacatggatgatgagcagttccagttcattgcacgcttgtgtggatctactctgacatcttggaatagtgtgcctgatttgcctgtctcttcctatggtggtgaactacaacataagaatgaggatactgccatcactgagtccaagattactcaaataagggacctctttcctgattatgggaagggtttcctcgctgcatgcctggaagcctacaaccagaacccagaggaagttatccaaaggattttagatggaaccctccatcaagatcttctagctctggatacttcattagaagagatgccgcagctaaagcctgcagccactgttgggaaagataagggcaaaggaatacttgtggagactgagcctcaaattatgaacaaaccccataaggttaatactgagatgcatcgctatgttgaacattcttcatcttcttcagttccatcagcatcccagggaccatcctcatctgtaccatcagtcccgcaaggtagatttacaaggaagaccaatgacgacgtgcctgactctgcaactctagactcacagaaagcaaaagatgctgttagatcagctgtgcttgaatcccagtatgaatatgatgatgagtatgatgactcgttcgatgatct

SEQ ID NO: 66229 - DNA, 2547 bp, Oryza sativa
aggaggctcatatccccgtggcgatcatggcagaagaggtggaagggatcacggcgacccaccgccggagggcgagaacccaaacgggccaccaggatttggccgtggtggaagaagagggggcagaaatcacggcaaccagccagaggcaaacgagaacccgaatggccaacgtggatttggccgtggcgcaacaagaggaggcaggaaccatgaccatccagcggaggaccatgaagatccagatgcagcacagggcttcgctcgaggagggcctgcacctcgtggaggcagaggtggaaggagaggtggtggccgggataaccatcaccggagagaccgtgcgatgaagaagcatatgcaaggattgacagggctttagttgatggttttcaccatcgtttttcattgcgggaactgtaaatgtgacagtatttttttttgacgtggtctagactcggccaaagcatacgatgccttgaagcatccttatgattactactcgtatattttacccatagcatgtggaatcaaactattgatgatcatatttcttgtagcttcggacaaaatacaaagtttgaatcttcataaatgaaagttaaatctgtgttgctctagtttcttgtggtgaagaatagttataaatcattaatcatttgcgtcagctaagaggcccggtgctaaaggtactcgaagccatgtgactaatgctgtgctaatgatccagatgggccagcctatatagctacgcggtaccccagacgccgcagaagcagtgcgacgttctgccggaaaaaccctccgctaaggtcgccgcgcaccgtgtgcccgcatccgccatatagacggacagtgcatcggttttctgggtgtacggtgtaccccacgtgttaggtgacgtgacgtatcggttttcaatagcggccgcgcgcggccagggcaatcgaatcgggtatcggccggcatcggtcaccggagggatctcagccaaagaagtacgcacattgtcgtcggtaccagctgcagctagcccaaatcctaaacctcatttcaacgtcgtcgtcggcgtcgccacctccagcggccacttcaacaccgatggagcagctgtgagccggtgaatagcgacctttcaggttcaaacgtgaaagggagaaaaattagtggctgtgatgagccggcgccattgtgtctgaatatatctgatgacacaggagagttacgttctaacaaatcgtccactgtttttcatctcttagaacaccatcatcactcagggctctgaaaataagtccaaagtaatggtggcatgatgcatgcatcggcttggaaatcctgttgccatgaatcatggctgatcacatgtttgcagcacatacaagtatagtgccaacagcaatcagcgtatcaaaatctctccacactcttcactttaccactagcaataattcaatatcgttgcaaactagctagtactaatataatcacgtgacggatttttctggtatgcataaatcaatttaaattcaaccgcaacgatcacgcaaaatatcacagggaacaaactaatgggccgggacctgttcaaaggccggaccacaggccggcccaatagcaagagtatatatatagtaagacctcgtctcctcgaagtgctggcccgtgtgagaacagagagcagtagtgtactggtgtcccgacagcgccgcctccattcctctaaagtctaaacctaaaatctccgcggcgcccgctgccgctgccgtcgtccacctccggagtcgcgatggggcggtgggcgagcccaaagacccggtaagaaggcctcgcgcgcgcgctctagatctcatctggtttcgcaggcttctaacccttgtttcgtttcgattcgtttcagtggcgtcggagggaagccgtaccggaatgacagctcgcaaaaggacgcgacgcggatcaaggccgggatcccaagcgacgatgagggcgacgtggatcgcgaggacgtccccttctcagagaaggaagaggccgccatgaacaggatccacgcgagagccatggccaagaaggctgccgcctccgccgcgatcgcccccgcccccgccgtcgtccccgccgcgatcgcccccgtccccgccgacgtccccgccgcgatcgcccccgtccccaccgacgcccccgacgcgatcgcccccggcccgtgaccccgtcgacggcctcgcccgcgactccatgaccaccgccatcgccactgcgtgaatccccatctccactgatgcgatcagctattgtctaattttgcttagggatgctagtcttatgttgcttaggagctaccgttgcttaggaactaccgtactaactatcccaggttatcgatccatggatgctgcgaagtacaatttgcgatgaatttcctatctatgacagatatctggttgtgatgatgttgccaagtgatatacctgattgtgatgctgatgttgccaagtatctgatatatctgttttgtgatgcatttcctgtctatatcagatttctgat

SEQ ID NO: 66230 - DNA, 6331 bp, Oryza sativa
tttgttagcagaaaattatttcaacagggcgattcatcccggctttgagttgcttcacaattgtgatcttttcatcattattctgtggaaacatggatattgaaggataaattgggttgtccattgcttcacagtcttcacagggatctgtcttctaaaataactgactttaagtttggagcacgctcaatgatagctcttatgaaatccaagtgttctcttattatttggttgaatccaccaaattctaacctctctagttgcaaataatgtatcgagccatccaactgtgcagcatcccacaaatcatttctttcatacaattgttttctattctcagtaccctcgtcacatgcatggttccacacctacattcagatataagaaaacatttgacatcatgcgtactaatcatcagaaagacttgaatgagaacatagctgaaaccaaatcatgataaaaaaacaagaaaaaatgacagcataaccttgacaccaaaaaccttaacggatggtgcggattcaaggagaaccaatgtccataggagatcaaatttcacatagatcccatgcagaaataactttgttatcttgttcaaagcggagcgtagcttttttccttcaggtgtaatccaaatctaggtaaaattaacaaaataaacaaggaattatttctatgcacaaaaagctcttaatcaggccaacacttgtgtactcaataaccctggtgccaatagtaaccctggtgtactctaaaagataatctgagtatttgagatttggtcggggaaaaaaaggatcaaacagtacctgccattaagatcaaatcacacacaaaaaaaaaaaagcttttaaaatgctctttcagtttcagtgcaaatttcatagcaacatgtagccaacagccaccaccatatgacattaataaagatgactttccatgtaattaaattagtaaattacttaccacctctccttggaaatccaaagcaatatcctgtacatttgcagtaccatgaagaagatcagtcaatttgaaccccgactggatacgtgacgtcgcaaacaaggcgtagttcctcaaggcaaggaactacaccaaaagataggggagcccctgataagcgccatgagtcacagtatagctgctctagtttaggtaggcagagaaactctacggtcttgacatagcacgagttgagttcaacgaagcggagttttgaattcggcatatccagcttcaatgttgatgaatcccgaagttcacaataatagagagttagatgctgcagctgatcacagctgattattagttgatgcagatcttgttcagaaaaccttgccgtacacaggaggagtttcgtgaggcaacatgacagactacgagatatattaaaaaattccactaagctctttgcatgcagcagcatatcactagacgtgcaatctacactccgcttctcagttgtgatcgcaagctccacgctctttactttaccactgtcaatagcattgcaaactagctcaccgatgttaaacaaataatctaatgatgtctccaaatcagtgagcaagcagaacctgaggtttagctttttaatgatagattcgctccgaggagaaccaaataaactgctcatcaatttaactagaacagccatcgcttcatcggccgacattgaggaattttggtggatgaattcatctgcatctaagtcgacatcagagagcaaaagaggcaggtgcttccaccgtgtcgacaggacactggtccttagaactgtgcgcatatcaactctttctaggatagagagtaagatatgatccggcaattggttgaatctaccttggtcctacaccaataaagtgctcaatcatttaaactgaagtttaaaatgttctcttaattttacaagaaatactaaacatataaaggatggtattaggtttatttacactggaaaaactactaacaaaaattactaacagagagagggaaagagacttacatagctttggatgctattggactgcatgactactgacaatggggcttttccactcggatggtatgcaaatatgagatcagtgttattgtcgagcttatttataaagggaatttcaccagcctcagagcctgattcgaattagggcacttacttgtatatgctcgaattggattcatactgaaattgaaaaaccgacttggtaattaacttatgtcgaatcggtttatccttggaaaaacaaggaaatttaccctcagaaaccaagaaaacaagggatattccattgatttctatcacttcgatcacagaagaagatcaatgcttcttttctcctgtattttcttgagaacccgcagagagcatcgatgcatattctgaaaagtgaaaaccagcagcaaaagatgaatttaaaacacgcccaggaaaggacgataaaaatacgaactacctgtccgcaaagccactagatcatcgatcctacgaacgaggaaacaggagagagaggacggcgacggcggcggcggcggctagggcaaccggcatcgaacaccggacaccggagttgctgctgaaataggttgcagtcgcacccatccggggatagttttgggccgtggcctaaacggagttaaagcccgtgcgaatattacggttggaaaaagtacaccaaaggtccctcaacttgtcatcgggataaaaaacgtcctcaaactgtaaaacagatatacggggtcccttaactatacaaaaccggtaacccgaggtcctttggtggttttgaccccggttttagtctacgtgacggctgagtcagcggaggacccacaaatcagttctccacgtccccctctctctttccctttcttttttttttctcttctttttcctctcctctttgcggggctgagcggcggccggcttgcgagcgcgtggcggccggcgaggcggcttgcgagcggaggcgcggaggaggaggcgggaaaggaggagggctctgcgccggcgtcctgctcggcgtcaccatcatcgtctacctccaggagaaggtcggctggggcgctgccgccgtcgtggccgtctccctcgccgtcttcctcgccggctggcgccactaccggtacagggtccccgagggcagcccactcacgccgctcgtccgcgtcacctcgcacggcggccgcgccgccggctggttcggcaaggacctgaacaacagcaggctggacctcttctactggcttctcgcatgcatcggcatcgccaacctcgtcttctacgtggtcgtcgccaccagatactcgtacaagaccgtcatggccggcggcaaggtcgtcgacgacaaggccggcgacattgagtgcgccgccgccgcagctgctgcctactgatcaatcaagcagctgatcgattagctagctagctagaaaatcatggtaagaaagaaaatggcatcatcatgtaggagtatatatggtatgcttcgtggtacgtgacaaccaaaaaaactgtaatgattaagtcgttcgtccatgtatatgcttaatctgcttgtgattgccatctgatcgtgtgctctactgctagctgatgttgccaagtcctaaactgttaacttatgcgtgtcagcgtgtgcttagtgcaagaggcggcttgcaagcagaggcgcggaggagggcggcgcctgcatcacactggtagcggccatccacgtgcgtgacccgtcgcggcgctacgaggcgttgggcgcgccgatggtcgccgtcgtgcagtcggcgaggctgctcggcgcagggggaacagccacgggaggttcaaggtaaggagcgcagaccgccggaggaggcctcgggcttgaaggagaagagcgcatggaggccgtgcttcccttggatggctccgacctggaggcggtcgtggcgagggcccaccagggccgaccgaaagacggccaccgggctagcgccttgccggtagagctcgactccggcgaagccgaggataaggccgggccggcttagactggagcgtcggcctccatggaacggccgccgccacgtagaagaggaggaggaggacgccggccaccgcgccgcggcgtgatctggcggggacgagagggacgacgacgccaacgaagaggagaggagacgagggggacgacaacggcgccgcccgcacgccgcctccccactgccgccgccgctggcggccgccgtcgcggcgccgccctctcctttcccgcctcctcctccgcgcctccgctcgcaagccgccgctcagccccgcaaagaggagaggaaaaagaagagaaaaaaaagaaaggggaaagagagagggtgacgtggacacctgatatatgggtcccacgtgggtctcttgctgactcagccgtcacatagaacaaaaccggggtcaaaaccaccgaagaatttcgggtgaccggttttgtatagttaagggaccccgcatatctggttttgcatttcgaggacgttttttatctcgatgacaagttgagggatcttcggtgtacttttttctattacggtttaattgtagtataatgggctgggccggatagtttgctagtttactgaagtatttcttacgtcttatacgtttgatgtgcgacagtgcgagttaggggtgggaaaaaaagctcggacttgtgagcttggttgacttggctcggctcgtaagccaaacgagccaagtctaagtctccttttcagctcgttggtgaaacgagccgagcccgagctggctcgcgagccgtttgatttggctcgcgagcttaggccatcatgtgtttatatcgattatttatttttttatggagttattatttgccaacttgaaatttttctttaagattttgaagaattgaatatataaacttatttaaattttacaagttgatgatttgttcttgtttttttaatagttacaaaatatatatgaagaggtgtttcaacaggaagacttgcatgccagctcgagctggctcgagccaggaaacaagccaagccgagctcaagttttagcttgtttccctaaccgagccgagccaagccaagccaagcctagttttgttgcgaaccactgcaagccgagccgtcgtttccacccctagtgcgagtattactgaaagtatatacttcaaatataaatatacgtaaggacagtattgggtttatttactcgggcaacaaacaaacaaacacccataatattttaaagaatattgattgccgacaggtagttttgtggagcatcaatatctaatcacattttaatcacggatgttttgtggaactgctgaaacctccgatcatttatttttcagttctcaattatctacatactaatgggatttgaatacttgagtggaccatttacaattcacttctcccttatctacgtactccagctgttacaattctggaggggcaagtagtagtgttcggagacttggagtagctgctctgcaatggtgcttgcgcactacacccatctctgtgatagtgcaagtgttagtgtgacctttaaggatagtcgattttgttcaaaaaccaggatggttataagtaatttttctcagggatacgtaaatctgttaaagcttaggaatacggatgcggataactcgatcctttattactccctccgttacattttaagtgcagccacggttttccgcatccaactttgaccgtgtgttttatttgaaaattttttaaaaaaatttaaaaacataagtcacaagtaaatattattcatattttatcatcccataacaacaaaaatacttaaataagacggacgattaaagttggacatggaaacttatgattgcacttatgggacggagggagtacaacgggaggagaaagatggttactcgccggagtcgatcctcggggaagcagatgtcgccggcgaactcgtggttgggctgcttttctatcgcctcatgggcccaaaatttgggcctagtgtggcccatacgaacatttccagcccagggtttatgggccggcccaatacgatggctatatatactacctcgagttgctggtccgagcagggagacacggagagcagtgagcagtgtccaagtcccgaccgcgccgcctccattcttccgccgccgccgccgccggagtcgcgatggagtggtcccggagcgccgagagtcggtaagaaggcttcgcgcgcgcgcgcgcgagcgctctagatctcatctggtttcgcgggctgctaacccttgttgcgtttcgatcgtttcagtggcgtccagggaaaaccgcatcgcaagatcat

SEQ ID NO: 66231 - DNA, 12489 bp, Oryza sativa
atcactgcattttatatagcctaccatgcatatgttggactcccttggattttttttttaatttttacacattagctttgtgattacatacagttatatgtcaatacatgtcaggttgtaacaggagtaatatttcacaatattatacttgatatataatacatttttaccatattgttctcaagcccaccttgcgctacaattgtttagtacttcagtgcagtaggatatcttaagccacgcaagcatttttttcccctctttgatgctatcacaactcatgtacagtaaagcattgtgctgtttcattagcttacactctagtcatgcttctctggcattctttttcctaccctgttgatgaggttcctgtatattgttaaaaatccaagctttgacagaggaccttctaattttccagcttgcgaatagaaccgatgtacaatgcttgcacaggtggcaattaaaaggttctacaccctgaattggtcaaagggccatggtccaaagaagtaagcatgctagtccatttattttcatttcttatataatattggttagtcatcttatactcacaatgacatgttccccttttcaggaagatgagatcattgttcagatggtaaacaaacttggaccgaagaaatggttaaccattgctcaagctttgcctggacgtataggaaagcaatgtcgggaacagtaatgccatgaaaattacttatttgtatttaattttagtccatctagcttgcaccgaaaagaaaatgatataacaagaaattttaaggggctcaatagagtagcttctttgtgctagcaactactacttacttctagtcctttgttctgcagatgaatgcaagagttgaacgccgttctgcaacaaaagtagctactacttatgatgatctgtcaggcaatttagtaattacttccagtttctgatgatatttagcttgtttgtagtaccataattcattgaggataaaaggtagcaacacctttataatttatgagatggatcagttggaagcaggtgtaagtccagtaaatttagcattacatcctaaactaaaccaagttaatgccctgagtgtctgagtgtagcaagtgccttttaaccatgttggcatctatgaaatatgggggatgggcagactggggcaaaatggcaaataagttttgccgatgatcttgttcttatctataatgttgtttgttgcagcaacctgcaagtattcttattgagcacatcggtgatgatctcgtttccccagattatggctaaattgccatgaatcagaagctgaacacatatatggaatctttgtcatcagtgtgtaaggaaggaatgtgtgctaaatcaaagcccgcagaactcatcatggaaaaatcttcacactgcataaatgtgcattatgaatatgtgagcatgtaagacttcacactatcacatattcttttgttgttttgcatcagattcttttgtttggtaatcttcacatttctcagattacgtgaaaattaaatcacattaattttatggaaactgatctctagtgagtgatgagttcctccttttcttgatattagcaagcatcaatgcattgaattcgtactcctgcatgcttctgaagagttgtgaagtctgctaaaccaaaacttaaactgggacttgcaggttcagtggtggcatacttcactttactgatatctacttagatacctaatccaatacaaaacttacgaagttaatgcccattcttatctatgatatcaaaatattccttcaagagcttccatctttagtcagaaactagaaaacactttcttatcagatgaattatcataagccttttaaacactattttactggaattagcacctgaaatgttgaatagaatcctagtgatgaagaatacattagggaattaaacccacttgtttccaactagtgaagcctgaagagattgttatttgatccttgttccttcggttaatttgtcattctgaaattctgaaccgtggctcttgttagattggctgataccccaggtatcagcacaggctagaatctcctttagcatggaagccccttggttcgtcgatatgcaatttcaggtacatttagctctttttcaattatttttcatgttcatgtatttggtggaatatattttgtgcccgagatttttttattattaatccctcatgctgtcacacatttgggaccttgctgaatgttattttatttggttaggttctcgtgcccatatgttcctcccaggttcatactttgtcagcccagctgatagaacttaagatgctctaggattggtccagactactgctgctttggcagaggcccgtgaggtgctgcaggcagtggccaatgtgacaacataagctctgatgaagaaaacatggagaatccagatgccaagaatgacccagcaaccaaattgcaaacaaaaatcatttgtacgcggtagtaaactgccctcgcgttaatattcttagctatgtagctcttgcgacttgcgagtcttggtttgtgagtgccaaaacgcagcagtttgagttcgagaagaaagaggagagaagaggggggggggggggggggattgcggtcgtctctctgtaactgagcatacattaacatcatcagtaatgtgtcattgtttgactgtattatcactattgatcataattcttgtgaaatgcaaagtacgaagtagataagtacttttattgagtgtactagctagatttcagtttgctatggtggcaagcttagttgtgatacaaatttgcggacgttacccctcaaaagtttggaactttggattgtgcatagcttgaaagcatggcatattgacatgaaaccaggggcggatccaacgtggtcccccctgcacccataaaatctatggatacccccggaacactcccccctcgattttttcaccgtgaatgataaagtaaaggttcttaaatggctagagattgaagatactatgtaactgagcccctccaatttttttgttcctggatccgccctgcatgaaactatgaccgcatgaatcttgtagtgacaaaggtagtcttagctgaaattttgccacaatgatccttataaaaagttatttttaataatgaaccgtgccattcagtgcctatatttgtagcgctaaaacgttatagttaagcaccatcaagacaacgattcatttcttcaattagtttttggcacgattcatttttttaaaatacaattcttttaaaagggttagtttgtcaaaattttgggtaatcatagtcctggaaaatattgtgccatggcttaaacaaggtgcctcgacgtcgattttgggaatataatgcatggacatatctgtgcagagtctcaagacacgagttttttggcatatgtagtatcacaaaaaatctgtacagaacctcaagataagctctctctcaagccaaatttaaactgtaaacgaagtgcaagtttataaggtaaatcaaggcaacatgtgccctgtttgattcagattatcaagcagattattgcggtggatgcaggtagaccagctaatgggctatgagagaaacaagagtcatgtttgattcagatcatcgatcagattattgctgtggattcaggaagaccggctaatgggctaccggggaaataagttcagacacaagtcaaaatttataattattatggcctgtgaccaatcatcaatgtagtagacaagcacatgaaacatcatagaaataaaaaccatcattttaaagggtgcgaggatatgttttacaagtactccgtaggggactcctagcacgcagcccgtcacactcctagaacccacacaatcgcctatgcccatgttcattgtgcacaccaagcccaccatgaaactctatatatatctaatatagaactagattagaacttctagtgataaatactctacataaaaaacactgttatatggaattaaaaagtttacactgtaatactatgcatgaataaaaaaattccacccagaatcattatgcaaaactaaaaaaatcaacttaaaaatttatacacaaacttttcatatagaaactttatacacaaactttccatataaaaactttatacacataaaatttttgcatagaaactttatacacataaacatttggtatacaaaaatgaaaaactataagttgaaaaaatgaaaaactatttttgttgcacccaaaatcggtccagcccagagtggccgcgcttgctcacgcagtcatgcatgtcgttcaagtgcatcatgggaaagtataaagcattttcgtactccgtaccctataacaaataatccatgttttattagcaaaagattatttcaacagggcgagaggtcccagctttgagttgcttcgccactgtgcttttctcatcttcattttgtggaaacatggatattgttgaaggataaattgggttgtccattgcttcacagcctttacagggttctctatcttccaaaaaaactgactttaatttgggagcacgctcaatgacagttcttaccaaatccaagtgttcttttattgttggattgaacccaccaaaatttaacttccctagctgattataatgtaccgagctatccaactgtgcaacatcccacaaatcatttcttctttcagaaaatatttctctgtccacagtatcctggtcacatgaatggttccacacctaaattcaagacatgagaagaattaaatatttgacgtcatgcatacttatcatcaaaaagactttaatgagaacatagctgaaatcaaatcatgataaataaacaatgaaaaaagatataaggtaccttgacaccaaaaatcttaacagatggtgcagattcaagtagaaccaatgtccataggagattaaatttcacatagattttttttttctcatgaatgaatgtcccgtgagggaactctctcctggcccccgcgtcgccccccgcgtcgggcgactcgggcggcggaaccctagccgccgccgccgccgcccttccccgccccttcctctgccttgccgtcgcctgagcgagcggccggcaaagccggcggctcgcgaggacggcggcggctgggctcgcggcggccatctcccgagctcctggcgcgggtggacgcaaaggctgtggccgaccggagcggcgccggcggcgaggcgcatggcggcggatccggcgtcgccaccaccggatctggcgcgctcgcagctggatccggtcacggaggcgcgggcacggcgtcggcgaggcgtgggcgctggcggccgcgacaggcggtggcatacgcgacggtggcgcaggcacgggcggccgggcggcggcgtcaggcgtgacggcggagcaagcacgggcagcagcggcaggctcggaggcgcagctgctgtggccggtggctcgatgcctggcggcgacggcagcggtgcccccagatccgtgcctctcggctggatctggaggatgggagcagtcggcgacggcgacgacggtgtggcgacggcagcggcggtagttggccgatggcagttggcgacggcggtggcggctgtggtggctgccgtgtcatctggcaacggcggcggaagacatggcgtcgggctgctagctgttcggtggtggagggcgacggcggagcagcgatttgcagaggcggcggttggcgtcggtggcagcggcgacggcggttatgactctggaggcagtggcgacgtcggcggcggggaaggagtcgggggcgaggtggctgggtgttcggcaaccaaggctgtggtggtggtgaccgtgtttgcggtcaccggaggcatggcggcctcggttgactaaccgagggcatgggagacggctgtagctggccggcgcggcatcgttcggtgaaggggtcggagaccggcttggcgcagagaagtgcagccgatggcagcggaggccggctcggcgcgagaggcgcgggcggcggagatggaggccggctgggcgcgagaggcgcggccgatggagggaggccggattggcacgagaggcgcgtccgttggaggaggccggcttggcgcagagaggcgcggccggcggtggaggaggcgacctaggtatgaggaggagctgccggtgggtgcggcgcggtcttcggcgcacgaagcctggccagcgggggacgccggtgcaggggtcccacatatcagcaaagcttgtgcggtggtggagcatcggtgcgccagccgtgcctttgttggtctactagcggtcggccacgcttagcggcggccgatccggtactagccttctcctgggcgtgtgtgttggcgatgtcgtcatgtgggtggtggtatttttttcttttcctgcttacgactctccagggttgtaatcttatacttttttttcctgctctatcaatagaacttcgcaccgtctcgtgtgagtcgttcaaaaaatttcacatagatgccatgcagaagcaactttgttatcttgttcaaggcggtgcgtagttcttttccttgaaatttaatccaaatctatgcaaaattaacaaaataaacaaggaattaattgtaagcacaaaaatctcttaatcagtccaatcattatgtactcaataaccctagtcgcgatagtaataacacaaatatactctaaaagataatctgagagcatgtattacatatttgaaatttgatcaagagaaagaagttaaacagtagttgccatcaacatctaatcacataaaaggtgcttttaaaatgctctttcagtttcagtctaaattgcatataaacatgtggctatcagccaccaccacatgacagtaaatacgatgattttgcatgtaataaaataacttgcctcctctccttggaaatccaaagtaagatcctttacatttgaagcaccgcacataagatcagtcaatttgaaccctgattgattactatacgcagcacaaacaagctttaacccctcaagacatggaatcacaccaaaagataaaggggcaactgaaaagaaccaagattcacataatagatgctctagtttagggaggcagagaaactctacagtcttgatactgcacgaatagagttcaacgaggcggagttttgaatttggcatatccaacttcagctttgacgaatcccgaagtttacaaagatgcagaattagttgctgcaactggtcacagctgattagtagttgacacagatctgcttcaaaaaacattgtcgtagatagaaagagttttgtgaggcaacatgacagactacgagatatattaaagaaatccactaagctctttgcatgcagtcgcttatgaaaacctatgaaatttatcctcggaaaccaagaaaagaagggagattccattgacttctatcgctttgaatcacagaagaagatcgttgcttcttctctcttgtgttttcttgcagaactcgcagagagcatcgatgcatatattctaaaaaatgaaaaccagcagcaaaagatgaatttaaaacacgcccaggaaaggacaaaaaaaaaacgaactaatacctgtccgctaagccgctagagcatcgatccggcgaacgtagagccaggatggagagggaaattacagcgggcgacggcggcggcggctagggcaaccggcatcgatcgccggagttgctgctgaaatgggtggtagtcgcacccaccaggggatatgtttgggccgtggcccaaacagcgttaaagcccgtgcgagtattacggtttggaataagttaactttcgatccctcaacttgtccccgagttcgaaatccatccctggaattgcggtctaatgggctgggccggatagtttgctagtggctgtcgccctcgctaaattactcctcgatcaaggcctaacacaatggtccataaacactgtaaacttgggtaataagtcaggttattagtgacaaaaaacgagacaaaaatatcgcaaagttaacactactgggcttacaatactccttatatctgattgtgatgttgatgatgcaaactactccctccgtattttaatgtatgacgccgttgactttttaacaaacatttaacatttcgtcttatttaaaaatttatgtaattatcatttattttattgtgatttgatttatcatgaaatattctttaagcatgacataagcatttttgtatttgcataaaaattttaaataagacgaatggtcaaacgttagttaaaaagtcaacggtgtcatacattaaaatacggagggagtatctgatatcacctggctgtgatgttgcaaagtatttgcaataaattcaggacgcgttgtgcttgtgatttggcaaaaccaggatgatgatctaacgagttctgctaaaacgtaggtggtatatcatggtgcatcagggagatcggctaatgttcagaaagtcagatttcagaattacgacaaatcagcagtgaagaacatgttgggtgacgtctatgccaatgataactgtacccaatcaaggtaccagactagcccattacacatcgaatgaaaaataaaaatcatcatttttacagggtgcgagaatctgttttacagtgtacccaatagcaaagaatccattctttgttagcggaaaattatttcaacagggcgattgatcccagctttgcgttgcttcaccattgtgcttttctcatcattattcccgagacatagattttcacatcattgtgcttcaaatacaagtttatagacaaatatagtaatatttataatattaaattagttttattaaattaatatttttttaattacatggtacaacgcagatactcacaacacacacgcaaaccatacccctatgagcatcttgccatcttcgaagactgggctggcaaatctatcctggagattaatgaagtcaccacagacgcctcgctgtagacaggtacgtcacttaccactgaaagcacaaagctattaaatcctggaaaattcgctcccattttcttaataaatttgtcttgggttgaaaatgctattatttttgtacaaacttagtcaaacttgaagcagtttgattttaaccaaagtcaaaacgtcttataacctgaaacggaggtagtaaaagataaattggattgtccattgcttcacaatccttatagggatctctgtcttctaaaataacttacactcgtcctccgcctccacttcttccccttcgcgtcatagtccggcaaccaatccacgatgcggttcagcgtctccgccatgggcacgtacgtcctcctcgccgctgtgcgtggcatgggctttgccatctccttagttcggccgccaccgagcacgccataggaggagactaggaggccttccaatccgccgtggaagccgctcctctccctgttggtcgcggtcctttccactccgccgcgggaagagcgagcgacgtcgatgctcggtttgcatgcggcgtgcctccgccgactgttgagcctccttcgccgccgtcgttaggcacgccgcacaccggccgccatctcctcaccccgcacgccgccgccacatctgtcgccgccgagactcgagacccgaaggatggggagagaaataagaagaatactatattgtttcactgacatacaaatctcacatgggtttttatttttcttatagcgccacgtcatccaaagtcaccttaatattgtcttgggacccaatataacctgattttataagattatggatgtgttatatctggtattctggttcagggacgattttaaaactcgataacaagataagaatcctcaagtgaacttattcctattatgtttagctgcggtgttatgggttgggtcggatagtttgttagtggctatagcccttactaaattactcctcacggcctaacacatagatcaaattaaatattgtaaagttaaaatataacttaaatcgatatttaataaatttaaataaaaaaaatcatgccatttagtaactcgagaaccgagtgaatttatccaccattctaatcctttgaaaagaacacaccaagtaatcaaatactcaagcatcaaactactttcctcaatgagcgcaagtatgtaaatcccctccaatccattacacccacatatacaactaaaatattactacttcaaagggtaggttatcatggcaccaccattcgaaatggacccatcaagccttctttttcccattgcccattgcttccctatgttgcagaatggcatgcttcctttgttttctctcccagatgtagagcctctgttcatctgcagacaagaatacgagagggactcatcaaagtcgatcatgagtcctggaatcattctcacgagaagaggggaaaaatggtcagatggatactttctccgtagctatgctggatggatgctgacccacattgctttctttacctctacgcaaagatggcatgctcgattcatcacttattatctactatctcctgtacattgcagagcaaaggccgtgacagcgacgaagaaggctgggcgctggcgatggagcagattatgatggtcgctttgctggcagttattattcactcgactgctactttacatccatcacaaacatagtgatggtttactttttcttttttacctttgctttgctagaagatatctggaaggatggccattgcagcccatgttatgcagtacttgtgatgttgatgtaaggcattcatccactgagtattgtcgaaaaatgagagagatttgctattgtcccaggctcccagcatatggccaacaaatctgaaagagggaagtgcagagaaggcctgaatataagttgcttcatttttttaagacaacaacagattatgggcacagactaaagattaccatctgtgaatggtctccaggttatagttactagttggcaaactagatgaatataataattacataagaagattgcagttatcttgcaagcaactgcaagatactactgaagtgagactcttttctcagcctgctgattgcaaattactcaacaaaaagagctttgttataattattattcttttgtacaaaagaatttccacatgatccaagtgtataaacccctgatctctcctaaacatggtgttccccacggtacacatgtgcttcctttgtcatcgtcattgtagcagcaatgtagcatttgctgcatctgctataagctgtaaaagtttgtgcgtctatgttcattccaaaattcagtatgttccttatccttcttaccctatgacgatgaactatcatcatcggagttgttttctctccgttgtccatagagacttagaactggcaatgaggatgttgctgagatgcggaatgacctagccgatccaccaatgactgttctgtcctgctgcatccggccaacctccctgcaaacttgatccaacgttgacaggaagtccctcaccaccatgaatatcctcagaggatgcgcttcctctttcgcggtgtcgccatggaagtactcagtgatgtccttcactctccccaaagctctcctctcctcacctctgactctctctatctccctttcagcttccttcagaaagtcttgcattgacataaagaatcgctggccttgagtgcattttttctcgagttgcaagactgacttgatcttttcaagacctgtttctagcttattgacataaccatgaagcacatcgaagtccatggtagccgctttcttgacgtttccaagctcgctgctgagcccagatacaaccttgagaccatgcttacggtcatctttagagctactaatcatggcactttctttttcagattttgcgtcttctgaccgaataatttcttggacgacaaaatggagcaatgtggttttaccatcagtgcccttgacatctgctagtttcaggagagtatcaagcttgaaggctttagcctcacccctatttgtcccaacattcatccggtttccggttctcagcactgcttcaaggagttttaggaacaacctactgcctctaagatcttcacaagcagcctaaaaagtaaaaacatgacaagaaatgtcagctaattgtaggtttaatagttgaaaatggtgatgatattcaacatggaaaactaaaagacttagcatacctccagagtttcaaaagagtttcttaggtaatttatttcagtctcaaaattggctcggtatagcattgcatcaactcttttgaaggcaaaaggtatatccaacacagcctttagaaagcgctcggcagaaccaagtttcgataagtcaccactgtagtctcgtagtttcagttcttcctctttagtaggagccatcttgactaatgtttccaaaagttcactccccaggcattcagcattgcctgctcaaaagaacaataga

SEQ ID NO: 66232 - DNA, 7831 bp, Oryza sativa
agcccgtggagaagcgcgtgcgcgggggcgtgcggcgggagcgcgcggggggcggggcgggtggcgcggcgatggcagcgaccggggggaagaagtcgctggtcatgctggggaggctgcggcgtgaggccgtggtggtggtgggcgggctggacgcgctcgccgagctccaggcctcggcggcgccgcccccaccggagcccccggagagctgccgcggcgtgtagtacccgtcctcgtcggaggagcccagcgttgcggcgcgccgcagcggcgggagcgggcggagctccgggctcgggtggtcggcgtcctcgtcgcggctcaccccgcgccgcgcccgctcgctgcgcagcttgcggtacggggaccccacgagatcggcggtggtgggcccgtggtggcgcgcgggggtggtgggctccaccgtgccgacgtagaggaagtcggcggcggaggtggcggcgctgcgatgcgcgccggcacggtcggggccgagcagcttctgcgagtcgccgcggcggcgggcgcggccggtgatcaggaacgcgcaggcgaagccgagcagcgcgacggcggcagccgcgcccgccccggcagcgactatggtcgccttcgtagggccgcctccgtggtgtcccgagccggaccccgacggagttttcgagacgtcggcggcgacggtggtcggggagggagtcgttccggggctcgtcggcgtcgtcgtggtcggtggcgccggagggaagaagtcgccggaaggcgcgtcaggcgccggcggagtgctggggtcggaggtaaaatccggtgcaggcggcggcggcggcgatggtggaggagtccactcaatggggaagaggggctgatgcagcaccctcctcgcactgccgccgccgacaccgccggactcagcggccaccgcgacatggccacacagcaacaccgccgcgatcgcgacgaatcgcgcgatggcggggggcattgacagcagaagaaaagaaaaacaaaaaattaaaatcgagccaaccaaggcagctgcagcagctgctgctgctttctagagtgagagagagtgagcgaaggggagggaggggagagagaggaagaaagccgccatttttcggtttcggagttgtaccatatgcaatccatcggtggagatcaacggtctccctcacacgtggcatcagaatctgctttccgttttgcttcttttccctcttttcccctctctttcgcagcatttcctcctctttttatttgtaggtacccactcagtcactcactcaccaagaaaccatactttagattagatggacctttatttttcttctttaaaaaaaactcaacattatgtagctggtagtgtaaaaaacttagatggtataaagatatcatgtagtcctgttgcctctggagaaattaatgagttaaacaattaggttgtggtaggttggtgctcagcgaaggaaagaaaatattccacacaagacacattctgaactggaatcctatactttgcgtaccaaccatccagttgatgtgaacatcagtgtcgccgaacagcattccggtggcttaaactaatcaggttgcgttcactgacatgtggggcttcccggttaaagcctgggcctttcctaccgtgtttgggtcgcgcgcgcaatgtactgatttattactagtacatttttatttaaagaggatgtactgattgacaatgcacaaagcaatccgtcgttggatgctgccctggggttgcttagtgcctgcttcttttctctctttacagaaccattaacaatctgtatctttctcttgctgggattggatcttcaaataccaatctttattttttttcctcctttgttagtgctcgattagctttagtcgaaagcgttttactgtgggggctgcatgtctcctgcgtatcgtatgtactgaatcatcacgcagtactacattaggaagaggagaatataatttcatagaggagtattttgttttcccatgttgggtcccacgtgtagcatggtctgctggtcgcttggccttcggcttctcttttgtccgctttccagtcctcttgcgggtagatggatggaatggatggatggttttgtatactctaatccgcacgtcaagcatctgctttgccttggctcgcgccgtcacgtgcaaagcggccccgatcccggagcggcgctcggtcgtcccgcgcgcaccgcggctacgccacggcacgaccggtttggttgccggcgcagcgcgcgcaggttgtgtaggagtacttccttccacttgcgtggtggtggtggtggtgagaatgtgagtgagatcgtgcagggggatttaccggtagaattagaaaacggagggggatttttcaggcgtggaaacgtgggcaatgacacgctgcgcggcaggtcccgcgtggtggtggtctcgtgctctctctcctctccgcggtccgcgggccatcgatcgggcgcaattggtcgcgcgtgtctggctaggcgaataggtgtgcgtgctgaggaggagacacgggtaggtccggttaatcccgcttctgtactagtctagctagtgataaacttgggaaatgcgtttagcaagcaccggctggctgctaccctggaccctgaacaatgtcctcaattggaaagttggcatgagttaattggtagcccgaacttatggacatgtatataaatatcaacgtgtacaccgtttctcacgatggtaccgcagaacaaaagggggtggagttcacataaacaaaccattcacaaaacttggtccagtgtgttttaaaaattttggctacaggtgaaacacaaccatctttttgtcaaaaattaaaattaatttgattattttataaaaaaaacttctgctaaaccgagtagtttgtgtcctcgagctggaccaagaaatctagttctcatgaaaaccaacaggttctcgttagttttgtaaatccttgtagggagatatgtgatcggagatcttaggactcatttggattgaagtgatttcaacacaagtttggtggatctcaattgtttgggaaaaaaatcctatcattttatttgaaatgaaggaatatgattaagccattccctaatatccacgtcttttttttctttgaaacgaaggaatatgattgacaaaaaaaactaacaatttgcttctcataccaaactaaacgaattcatacttcatgcttttatttttatatgagaagccccatgcattctctctcgcgcacacactcataaaaaaacaatttcttctaaatttctatatttcatttcctacatatcttccaaacacaaactctttaattcatgtgttttataaaccacacttcaagggagatctaattaattaatgtctttatagtccattggttctcaacccttccaaattccagtatattggcagtaaaattttgcactaccaaatcgttgataggggtaaagttttgttgtcaatgtttggtttgttaacaatattgagccaaatcttataatagagtgaataaagttctaagaccctgtttagatgggactaaaacttttaagaccctatcacatcagatgtttggacactaattaaaaatattaaacgtagattattaataaaacccatccataatcttggactaatttgcgagacgaatctattgagcctaattaatccatgattagcctatgtgatgctacagtaaacattatctaattatgaattaattaggcttaaaaaatttgtctcgcgaattagctttcatttatgtaattagttttgtaagtagtctatatttaatactctaaattagtatctaaatatagagactaaagttaagtccctagattcaaacaccacctaaaaattgtgtcaaataaagcataggcattaccaaataggagtagttgacatcaaaccaaactatcacatttatgatctgagctaccgataaatttatagggtatgttttggcatcaatctaaaacggtcatctgactgactgaacccattttgaaatgtgattttctttccaagtctttcttttttacaaaattcgtgtgattcaaaagaatcctagttttgttggttcatccgatgtactccggagtactaaagaggtggttaggagcaatatgcattatttctgcctacacgaaataccagctagtagatgccaattccacaattcccatttgcattagtcccagaaagggacagtgcagaaatgtcggtggccaggagtactactacttgtactatcaacagtgcagcatgactgacgataccgtggcactgtggcagcctatgcctgcagctcgatcctgtggatcggccgtgctactagtatgactactgtatatacgtcgcaatctcgctaattccacgcgtttattatgccatccaagaaccgacctgacgctctgacacatttatgcgtatgtggacagtagatcggtgagcctcaacggagtaatcgctgcttgatgccatgtcgtattgtctttctggtccttgcatttaagccacgtgtttcgatgcgttgcttggtgttcatgcagtagtatgagtatgtgggatggatgatgcctcaggttatcttcaggtacgatgctttgaggcaatcttttcatttctgaactttctatcagtatgcctttgcttcgaaattctgctcctattaaccagtttatgcgcccaaacatactccaaagcgtgccccccaatgagaatgacgtcctgaagctccagctccttgtcctcgttgtcgtttagtactattttttagatcagtccagcaaattcaacagacgagaagtttgggccatctgattgtgtagaataactttgtcttggttggcccttggcccttcggcaggttgttaccaaattgtaaaggaataagttcgttttgggtctctctatttgtcgcccagtccgatattcgtcccttagaccgcaaaaccgggtatgacccatccccaacttacgaaaaccgggtagacgaggtccctcggcggttttggctgacgtggcgcctacgtgacttgtttgactagttctccgtctcacgtggcattaacgtggcgcttacgtagcaattatatcttaaaaaaaccgtggacccacctgtcagctacacacaaaagaataatttaaaaatagcaaggcccacgtgggcccacatgtcagtctaactcaccctcctcttctgcttcctctctccccttctcccctcttcatctttcttgcgctggaggatgcggccaacgatgacgacggcggtggagatggagaagagtggtcgccggtaggccagggagctcgcctagccatcagccgcccttctccccgatggccgtcggcgggagaagagggagcggtgcgcgacggcgtcggcggcgggagaggagggagcagcacaagctctccgccgcaacccgcctccaccaccgtcgtcgtgtgcgctcgtggcggaggacggcgagagcggtggccgtggcactcacggcggaggccggcaaggacgtagaagctggagcccttgtgcgcgacggcagcggcgaggtcggtcccctcctcgagggggacacgacgaagacgacgggcagcacggcgggtgcctgctctagctccccgtggctcctctacggcgggtgcctgctcaccgtgatgctggccggtcctggcagcggccgcgtgctggtgctggagcggggcggcgcgcccacggagttcccgccggcgccgctctgggagagctagtaggaaagggaatgatatgtgggcccacgtgggtctcactatttttaattttttttgtgtgtagctgataggtgggcccatggtttttattttttttttaagatataattgccacgtaagcgccacgtcaatgccacgtgggacggagacctagtcaaataaaccacgtaggcgacacgtcagccaaaactaccttcaaaatcactgaaggatctcgtgtgcccggttttcgtaagttgggggacgggtcgtacccggttttgcggtctagcgacgaaaaatcgaactgggcgataaatagagggatctcatgtgaacttattccaaatgtaaatgcaaagcccaacccattcgtttcacaaaattagaagaaactgggccgaggcggactcgccaagcaatgatgggctgggcctttctcctggtagtgcacgatactgcacatgattgcatcgatatggactaatcggcgcaatcagaacgcgtgaacgctgaacacccaatcgcgagaatcactacttcactagtacagtacccatttaagcctggcagtgacatgttttctactacctccgtcccattataagtgcagccatagttttccgcgtccaactttgaccgtccatcttatttgaaaaatttttgaaaaaatttaaaaacataagtcacgagtataagtcacgagtaaagtactatttatgttttatcatctcataacaataaaaatactaattataaaaaaatttcaaataaaacgaacgattaaaattggacgcagaaacttatggttgcacttataatgggacggagggagtactttctacgacatgtacatagcattgccttctggccattgtcgtatccgttaatgtaatgggcagctcgtgtggctcaagtaagcgcgtacgcgcactgcatattctctcctcttctgtactctcgccatcctcatgcacctcatcttcaaactgtactgaaaccttcattcaactcacgcacatgtactggctggctggtaaaacgtggtacaaaaaccagagaaaaacttgacattgtccgtgagaaaacaccgatctgtcgaacacgtacacgatccggccggcccgtctcgcggcggcgcgcgcacgacacgagatacgtatccgtcgctaacttccacacgcgcacgcagccgctccacgtacaggcgtacagtacgcacaaaaccaacaggtagatacccttgactatactaccttgggggtgcatgcaccggtgtagcgaccgtacgtacgtacatgcaggcgatcggagaagcaaccgcatgtgttgacgcctgcacggcacactcttcctcggctataattactcgtgttgtaccttggttgcctggccttaatcgggctttggccttaattggggttgctagtttcatcggatcctgctacagtatacgtaggcagtacacatctgacgtccctagctagaataaagaaacaatcttaattgacagcaagcgagaagccagcagcggcattgttcagatcgattaggtccaaatcgtgtagtacctgttgaaccaagcagcgacgagacgacattgatcgtccaaatccaactctgtccgcctgccaattgccacaaagtccccaatccgccaaagacccagatcatcacgaccctgttggcgcgtcgactagcacaagctcacacaactcatcacacagccaagttcgcgaatcaatcagcagccatctctggcctctggcggcatcgcacgagcctcctatcctaccacgtaccagaaaacgccgcgcgcatatgctaagctccgagcattattcttcggaatcgctccccgcgccgcgcgcgacaagagaaagctttggctttggctcgagcccgcgcgcgtcgcgtcgcgtcatgtcgcgcacgtacacgtacttcttccctcgcgaacaccgcggttggcggcgtggtgaccgactagctccggcgtgcgtgcgcggtgcgcctctcggctaggcgcgcgcgcgccacctgtgaccccgtgaat

SEQ ID NO: 66233 - DNA, 3656 bp, Oryza sativa
ggggggtctagctgctagctatccctggcagtgacgctgcagtactgggtgccccggccggagtgatctgtcgtccagtgcaggtacacgacgagttccaactaagacgcaggtggctcgagatgtacacagtaacacactggtacgtcgtaccacctatccatcggtagcgagcacgtctccgcgccgcgcggtgctgcatgcatgtgtctccatctgcagccttgcaggtttttcgttcagatcaatcagggggggctgctctcccgttttccttcagggtgattgatcacactggccgtcgatttccaaaggttttcacaaagcgcgtattactattaccacgtgccgattggatcgagtgaacactagaagtaaaaactgctgtccaagtagggagttaagtaacacatcgcgagatccaatgacccaacaaaaccttgcagaggtttttgcagttgcatgcatgagtggcaattggctcttcggtttggtttgcatttactactatattcgcatcatcaaggattgacttcagactttctgatgagttgcaggtgcgtgcgtgttcatatacgtttattactgtcagttgattttctttgagatgtactggtctggttggttggaggaatatcgagtgcacttgatcgatagataagatagattggaggaatatcaagtgcactagacggatagataagatagattactggttacatcttcacagcttgtgcaagcctctgaacagagaagacgatatatggagttagaattatggaaaccagtcttaccggaaccatatgcgctttatgcagtgcacttaagttttaggatggaaaaatgggggagggaactggccgtagtaatgcatggtccctagttactgacaggatggtcataggatgcatatactactgtaaccgtttggtgcttggattgatccatgatacatcagtgagggcaggtagcagatcgatcagtgcatgccggactgaacaatgactgcaagtctctgcaactagcaagcagtacagtcgtacttcagtttcttttgtaattgaattaaccatcacataatatagcaagccccatttgcaattaaacactgaaatagtaaaacacgtgattttaatagaaatgtatatgcaaaacagaaaattataaaacacaacaagataacataggaataagaaataaccgtttaaatagaatatagaaaaaaaatataggaaccggaagagaataacagactagaatgaaagtttctaataggttgaacctctactgagatatttctgaggaatttcataggatttaggaagcttcaaccctatgtttcaaatgactaggtagaaaatttttctataggattaaaactctacaaagttagtacacattgtttccaaaatagaccgatagtgtattctgtagggtaggatctgattgacagattagataatgcatgcggtacagcacttacattgcaaatttgcaattagggccctatttagattccaatttttttcttcaaacttctaacttttccgtcgcattgaactttcctacacacataaactttcaacttttctattacatcgttccaatttcttcaaacctctaattttggtgtggaactaaacacagcctagctctaactctctgtgcgctcttcttaatcttaattaagtagccatagcagcgtggttgctagaatcgccaacaacatttatagaaaacatagaaacatgaaaaatacggaattttaatatgaatatataagtggaaaacataggaaaatctatgagcgactttttgaatagtccgcataaaaaacaaaaagaaaaaaaatcagataacatagatagactaaatttttttttcaaaaaatgaagctcttgctaactttcttcaaaatttataggcattaagtcatttcttaggaattttgtaggatatacatgaaaaatacggaattttaatatgaatatataagtggaaaacatcggaaaatctatgaacgaccatttgaatagtccgcataaaaaacaaaaagaaaaaaaaatcagataacatagatggactcaaatattttttttcaaaaaataaagctcttgctaactttcttcaaaatttataggcattaagtcatttcttaggaattttataggatataaaagcccaaatcctttgtttcaaagagctaaatagagaaaaaaaaccattaaaatttgaatcctataaaatttatatgtaaatccattgtttagagggggtcttaatcgatatatactaaggctgtattcggcacccctttttcccaacaactctccctcgttttctacgcgcacgcttttcaaattgctaaacggtgtgtttttttgcaaaaaatttctatacgaaagttactttaaaaaaatcaaattaaccctttctaaaaatagctaatacttaattaatcacgtgctaatggaccgtgccgttttctatgattactgttccggatgggagcaagaatgcccgaacacagcctaattgctctagtctagtgagatacagtatatatataactagataagcttggaacagatcttgtttgcaatttggagcaagtgagatatgcaactattcactaactgaattgtggtcctagcgagctcgggggtaaaccacaaagaaatcagaaaccacgcgaagttctatccaggcagcaaatggcgtgcatgtaatggcgatctggccagtggacagtggtcctctccaagatttctctattatatactgcacatcgatacaaatatttccttactcattgaattatttctgtaacaccggactgcgcacgatcacatgagtgacaattttgtaggctccctcgtagtgggatggcaagatcggatcagtaagacagtaatgattccaaacatagcaagtaaggcatggcattttcttgtagagaagtggtagtagggattttattagatttttttttgaaattattatttattttatttgtgacttactttattatatatataactttaagcacaacttttcgttttttatatttgcaaaaaaaaattgaataagacgagtggtcaaacattgcaatcaaaaacttaaaatcccttatattatgggacggaaggagtagtttttttaaaaggtacgaattaccctcttgaactatagtagtcgaccgaattaccctaaactcgtaaactcgaataccagccatttacaccctcgactattaataccggatgaataactccatgaacactgttttggacagttttgacttgagtttgcgtacatgggcaccaacatggcaatccaatcagcaataaaattattaaaaaaacaatgtcatctctcccacagcctaatccttcccccctactatccctctccctctcctccctccgctcggtggccggcacgccatcccagcccctaacctccaccttgctgccccctcccccaacctgcgccacactgcaccgtgctgcccccatccccaacctctgcctcgctgctctctcttcccttcacccgatggtcggtgccatccccgtcctcaacctccacctcaccgcgttgccccaccccgtcccccaacattcgctgtgccatcccttcctccaatctctacc

SEQ ID NO: 66234 - DNA, 7930 bp, Oryza sativa
tacgccatccccacctctgatctccagtgtgccatcctcgtccccaacctttgcctcgttgttgccatcccaaccaccgtgaccgcgacacgtgagggtgtagcggatggtggccgtttcgagctcaacctccgcatagctctagcttcgctttggcccaccacctccgagagccagcttcgcgtgcccaggcgagcttgcgttgatccgcctcctttcgagcaaggtccctctctgtcctacttctctagccaaaggtgcacagagagagagagcccattgatttgcacctgaaatggggagtggggaggattggcttgaggaaagatatacaagtgggcccattgattttttttaaaaataattttattgctgacttgattgccacgttaccggctatttatgcaaactcaagtcaaaactactcaatacagtgctcagggggttatttgtccggtatcaatagttaagggtgtaaaatgtctggtattcaagtttaggaggtaatttgatcgaccgctatagtttaggaggataattcatattttttttcttttttttccattacacaaaagacgtgtatgcaccagcacaattataactatacatggtagtaaatgtttccactaacaaacgtttaaaaaaaaaggtgaaggccaaactacatgtccttgttctaactaaactttattaataatacaccgcatgtattccaatgactctacacactaccggtgctttccccttgacaagctaatttctgaaacaatgagataagggtttcgggatctcgtgaaatttggtcatatgattcaggaaaaaaaaagttgtttcccacaagaaactttaacatgaattttgatttttgagttctacagtccaaaagctattcgcatgtaaattttctataggaacttgttggagaatatgtgacacaacccagccttagcaaaagttggtacgtgattccattttaatcacgcctaaagtacttgtacataaagtttgataataagaataatcactaccttggaacccttatatcctcttaatgagatttttaaaaatcacacctacgtcgaaattatttgattaataccaatataatggttcattgcaaattaaacaatcgatttacctattaactattaaggtttaaatcgatggacaagattcacgcatttattcttagtctttgtctctttgtcatataaacgtgtattaaagagtgtgtatttgtggacatgtggccaccatgatatgcacatatatgtgttttgtccgattgaccaaataggtaaaaaacttttatgtatgtagtttgcatgaccttggtcatgtatatatcacacgttggtagtatggctatatctacgaattagaggcccggccggtgccttaaatattgtaaaaataaaattaaaagtacagttcaccgctgtacgttgctctttatactcgatgcctattatgggtggtgtgccatgtatccgcatcagaaaagtagctagcgattaatctaatgttcttctctttagctataccttgttattagacgaacatatttcaggcttttagcataatcgccgaaggagaaaggacagcttaaaagaaattgagtgaggaagttctaaaacttgaacaaattggtttggtgtggacctaaacaaaaattttagaagccctcactcattctgcacaccatactgtacaggcttgtttggtagcaacagacgcgcgtcgtggattacttgactagcgaagctagcagcatcagggacaaggttacaatacaagcgtcaaggttaagcaaacccgagaattttttttaataaaccttatgactaagctactcgacataatagaagataacatcataattcaaagtatatgtatcaattttaaacttctaaacttctcacatatgacggttgatctcagagtagagtggaactatggaccgaaacacagaagacacgtgcatacgtacaaagtaagacgagaggagagaagagcgagacctagcttgtcacacagcacgagcactaccaccagtagtatgctattacgcacgggagcatgcaactaggccagcggagcagcgcagagacgctactcgtgtgttactaaaataccttagagtatatttattaattttggacatctaaacttgtcacacggcggttgatcttatagtagtgtggagcatggagtaaaacacatataaaatgtgtacaaacgtatgaagtatgtgcggtaagacgagacgagaggagagcagatcctgcaagtcacacgacacgagcgttaccaccagtagtacattgctacacacgcgagcagacggctaggccaacgcagaggagaggcgccactcgcgtgtcgttccctataggaaaaccctctttatcaattttggacctctaaactttcacatatatcagtttatcttacagtagaaatagaccgtgaagcgaaacacacaagatgcatgcatacgtacagagtactcccctgtcccaagctataagggattttaagtttttcctacaacgtttgatcattcgtcttattcaattttttttaaattattatttattttatttatgacttattttattatctataactttaaacacaacttttcgttttttatatttgtaaaaaaaatttgaataagacgagtggtcaaaagttaccagaaaaatttaaaatttcttatactgtgggaacggagggagtacatgtggtgagacgagacgagagaagagccgagtcctagcagccatcacacgagacgagctttaccacgagtagtatgctactactactacgcacgcgagcacgcacgcagccagccaggcaggccagccgagcaccgcagagagcaggcaggcgccaactcgcgcgcgcgcgtcgccttctccatccaccaccatccaacccccccacgcggccactcctccacgcacacacctctctctctctctctctctctctctctctctattccaatccagtcctgaatcagtccacccctttccttcgctctctctctctaactgcagatttccctcccctttcaacgcgcgcgcgggtggtggggggaggcacggcacgaggcggaggcggcggaggaggtggtgggaatcgatccctttctgttccggccgcctcgatcgcccgctacccgcacgccgccttttcgtcccggtggatttctgcctcccttttctcgattctttcctttttcttcttcttctgcatgcgcggcgggctgtgacgccgaccatgggggacgcctcggcatccacctccgcgcccgcgacgcccacgtccacgctcatctgccgggaggatggcaacgacctcttctccgccgaccccgccgacgacgatggcggcggcggcagcggcggcgactgggagttatccattgctgacgacgaccatgtgttgctcatggaccgggacgatgagtacctcgcgctgatgctgtccaaggagaggtgtgccggcggcggcggcggcggcgagcgtggggatgaggaggaggaggagatggtggaggagtggatgaagaacgcgcgcgcctggtgtgtcggctggattgttaaggtcgtttcgcgtctcctcctctctttgtcgcccccttgacctgagattactctccacacggtttcgcggagatcggatctttgtattgactcttgttttcggagggggggggggggggcttcctcctcgctttgctggttgcagacgaacgcgggattccggttcagcttgaagacggcgtatgtcgcggtgacgtatctcgatcggttcttggcgcgccggtgtgtcgatgtaatgacgatcctccctgcttgccttgatgcgccgcctcactcttgttgtcgtgatgccgagtgcgtgttcgacgtaatgcctgactccgtattgccattttttttgtgtttgtgtgtgggggtgttttagagggacaaggagtgggcgctgcagctcctctcggtggcgtgcctgtcgctggcggcgaaggtggaggagcgccggccgccgcggctgccggagttcaagctggacatgtacgactgcgcgtccttgatgcggatggagctcctcgtcctcaccacgctcaagtggcagatgatcaccgagacacccttctcctacctgaactgcttcaccgcgaaattccggcacgacgagcggaaggcgatcgtcctgcgcgccatcgaatgcatcttcgcctcgatcaaaggtcgatcattccccccctctgctttcatttcaccgaatcggatcgcaagaatctcatttcatttccgcaatctcgtagtcattagctcggtggggtaccagccatcaacgatcgctctagcagcaatcctcatcgctcggaacaaggagacggcgcctaatctagacgagctcaagtcggtcgtgggctcgttatggcagcaactagacaccgtaagcactcccaactttctcttttgcgagatctcatcccattaggtttaagttcttggtagaaatgacaatgtcgagagtaaattctgcaacgctgttgttctcttgcaggggcatgtgtattcctgctacaacaagatgatgattcaagaggacaggtcgatgcaatcgacgacggaggtagcttcctcgggtgtctctgttgcccacattgggggatcggaggacagcgccatgggaggggccaataatgccaccaccttggaggcaaccccggacaagaagaggaaaaggttgcactcgcctcagcgccagtagagggaggagctggaggctggagctggacagcatgttggttggagtccagctctgcaatttttagttgatcattttcaccctttttcttttgtttcagctgagccctagtcagtgctcttgcaagttcagggggggttggccaaatggaggggccaacatttgattcttcttctgattatgcaattgttacagttgattgattagttagcaatggaaagattctggttttgtggagatctttccctggcccagaaaggtactagtgtaaagagcagaggaaaaggcctgaaaactgataaagagctcttgctcaaagtagggaggaagtcctcactgagatgtggagacagagagagggaatcccaattcccaagtattgagtagaagtcattttttgtggatactgtatggttatctgttactctctgttgagtcatgccattttggttcattagcaatttcctgatgctaaagccaaacagtggtagtacatttttgttgcaagaactgattgatagtagttggatagccagggggcaggggccatctctctcactgtacttcactctactctctcgtgtctcgtgtgcaattgctgaccatgagtggttgggaattgtttattgatatctgtgggacgaaaggaagaaatgcgtttgctcggtgcctttctgatgttgcctttgtgccgtgtcatcaaatcaccctgccttgctatttctcagcaatggctttgctgttctttgccttcttggaggtgactgccactgttggtttgtctctctcgcatgaaagcagctgtaacgctgccttctttagctctctctgaattgtgcatcatgcaatgcaaatcactactccagtagtagtacactccactaggacacgtggaacaggccaaaagaaagactcttcttcactcttcagcttcctctcaccagctgccgaggttctgatgaattgctcatcttggggagcatgtgagtggatctgcttctttcccctttccctccaattttttaactgcctccaagaagacagtgcgtgtagtgtagcactgtgaaaacctctgatgaaagtggagtacaagagctgctgtgttttgtgtggtctggatctttgaagtttttgaccaagggggtgtttgggaactagggactaaatttagtccctctcaaaaaaacataagtccctcaaacataagtccctaccacagggagggacttatgtttttttagagggactaaagtttagccccaatttagtccctccaactaaacaccacgcaaagaaacaactccccatgaatgatctgaatctgattcagatggctgtggatgaccaacccttgcactggattcctctagcccctggtgactcgtcgtgggcggtagcaactggcattgcggtcaaaacccaaaagcgctgcacaagcatgacatgagaaagagagagacatggtaaaattttttttttcatgtactgatctgttgtgttgggctgtcttgtgcctggcagcaaggtaaaaaaatgggttcaccgcggttcacaggggcatggctactggtggccgacgctgttggaattttatagtgggcagtaacatgcccagtcactggcttgactggtcagcagcattttgtattggcactggtgaagtggtgcagtagtgatggaagcacaagctgcctgttgattgtgtgtgtcaattgcatgcgatgtgtgaagagagaaaagcctgggatgccaaaaggaaggtaactgacagcctgccaggcccatgcaaccagtacatattatctgctgatgctggcatttggattgcaactgagattcgtggtcaaagttaaatgtgacgttatatcttggatcttggaaggtagcggaggcatttcacaaatcctactacagctaaccatgctgaaaattgcctgactgtaatacggagtatgtcgaatgaatgagaacatggcagatcatgacacaaccaaagatagcatctgcagacatgcagtccagtaaagcacgttttagtgacaaccagagtgtagtttccagtacaatgagtaaagaacaaagattgtagtttccagtacaatgaaatcgattgattttattgcaagtaactttgctacagtcccagattggccacaaaaaaacagtaggatggcaacaagggaagaaacttacacgagtcaattcatacaccctgtcaaggactcaagggtgtagaatcaaacaaatgtcaaacttatcaagcgatccatatacaattgcaagttccaacattccaaggaaagaacatgaggaaaatgacatgaaggaaagatctacacgagtccattaaacaccatacaatcttggatcatactctgcaagaaaaaaagggggggggggggggggggcagaggttcacatctaaacaagcgcataaagagaactttgttatgcccatggtactgcctctaatccctaccgacttcagtcccgtgtcttgaattagttctgctttcctacttagaaatcaactgggatcagcttgaccgcagcagcgatcggcatccctatgaaaccgatgaaaatgcagttgaaccactgcttcaatgtgagaggagtcgtgttggcgaaatcacccaggaactgtactattatgaactggaagatgactgtgctgccgaggacggcgacgaacacgttgttgtctagaatgccttcaaatacatttatcctctccatctcccttgagctcacctcattgaacacctgcacaacaatgaaaattttaatgaaactgcacactaatattggcaaaatatagtctgaaatttttcattcatcattttacagctgaagtactacattcatgtgagtattgatccttggaaaacatatttgccaacatattattcaagagctaaggtctatttttgcaaaaatgtatgcaagagaattattttagacactaaatagatgtgacaagcactttcaaattacctggcagaacacaaagcaattgaagatgagtgtgttcaagactagatcggaattttctccctttagtccaaatagccacttcccttctgtctgcagataccatattacaatgaattggtagaaggcctgtcccaggatgttt

SEQ ID NO: 66235 - DNA, 1385 bp, Oryza sativa
tgatctctctatcctgatgaatgctttaaatttcccgtgtttttaaatcatgtttatgtggtattcttcatgttagagcgcaaggtcctatatgctatgtgaaactcgctaaagttatcatgcaaattgtggatcgtgtaaaagaaaaccttgctagatgatgtgtcttaccataatatttctgtgaacctgtaatgcagattcgctggtaaaatcgttggacgctactacgacgatgaaggcaaccctacaaaatatctcaagggtatagagatgaaggcaaagagaggtgctcagcttcttgagaaacagaagagtgaagaagctaaaatacccaactgtaattcgaaatggagccagcaagagggtggtgaagtaagtaccctcatatcgattttcaactgctgctgttttcagtttgattttttattagaacatctcatgaaaaaattaataatgaaattaaacctcgcattaccaattgtcagattcacacatgaaaattgaactgaattgtgattttccctaatttgacacacaaaaatcatgtaagttgcactgttggccattgggagtatgctcacagttctccatacagccattcgcccattggcagggcagtagtgcactgttttgtactaggatttatcattcttctagtgcactagtcttctcaagcccatttttggactggttactaatgggtctttgcaatctcgatgagcattagcaaggattatgctctatccccagaattcaaccctgctaattactgatgttcaacaaagctggcaagtggcaacaaaataaatcatggagaaatgtgttgtagccagaagaaaagcaaatgaagcaacgctattagggcctgtttagttcacgaaaagaaaatttttaggtgtcacatcggatgtttgactggatgtcggaaggggttttcggatacgaatgaaaaaactaatttcataactcgcctggaaaccgcgagacgaatcttttgagcctaattaatccatcattagcacatgtgggttattgtagcacttatggctaatcatggactaattaggcttaaaagattcgtctcgcgatttcctccctaactgtgcaattaatttttgtttttatctatatttaatgcttcatacatgtgtgcaaagattcgatatgatgttttttggaaattttcgcgaattaaacagggccttaatgaaagtccggaatggagtaactattttctcttgagcaaagcaataatgtagcactaacttgatgcgacttgttgagattgctcgaaaaccaaagcctttggggtgctgttttctgatctttcccctgcacttttgtccttgcctacctactgtacgaatcatatctttgatggg

SEQ ID NO: 66236 - DNA, 16975 bp, Oryza sativa
ttacaaggaggaggagttggacaaggctggcctggttgtgtacgaagggtgtgattatttgtctacatcttgcaaagtgagttaggatatgtacatctccttctcttgcccatgtagttgtctacggctgcccactgcttatctgcaaggctgctaatggtaatcatacacgaaaagccccagtatgggcagaatacatcatgatcatcgattttgcaagtagtggatcgatctatgtctgaatttctggatatacagagcaatcgttttgcttctgaattgaagatacgcaattgattggaagactactcaccatcaaaccatatgatggcaatacagtactgccatgctttatacatgtagcgctgcgaaatgcagaggccgcccatgatattcatagccgtgggggcctggggggccttggctatcgattgatcaacgctagcggctagcttgacgatgcagtcaaggaggccttggctatcgattgatctgctgtttggtcttcatgatccttgcacctcgagttcttgagaggactgctcaggagttattaaagtctgaagaagtatcccacgacagatccagatttggctcacgtgagcaagaaatcaactaaccacaatgcccgcaagtcctaccgaattctcatcttgaacgatcgtgttgaatcaaatacgggatttataattgatcatgttgagtagaactacatcttttgttttgcatctccttacttatttcccaagcaagtctttggtagggctccaatttctaaatttgaagcattctgaacccaactctatctctttagtatatttcgttcagttcgcttcactctcttttcgaatgaaattgaaactgtttggctagcatttttaactccagaaaagtttagagttgaagttaaagctacgcccaacaaacccactccctccgtcctataatataagggattttgagtttttttttcattgtttaaccactcgtcttattcaaaaaatttagaattattatttaattttgtgacttactttattatctaaagtattttaagcacaactttttgttttttatatttacataaattttttaaataagacgagtgatcaaacaatataaacaaaaactcaaaatccattatattttggaacggagggagtagaatttagagtcctggcgcacaagcctttcttcttccattaccaccaagcacctctccctctctctcgttattgcaggtggtggcaaccagtactaccaactcgcctaccgaaattattcggctgggtgtgcatcaacccatcgtcccatccgcgcttttctccgagcgaagcacgcatgatgcgtcacgccaccatgggcagaacccgcggaagcgaagcgtagctagcatatggcagcgcgcctcctctgctccgcgatcatctcacccgccaccgctttcctccgtttcctcagatcacacacaccacgtcgcaggcccctgtttttttgtgtgcgcgcaagggccatgatgcccgatgccgatgcctcgcttgccgccgcgaaaggcgcgacgcgatgtgatgtgatgatccctcgcgtcgcgtccatccagcgtccacagggagagctgagaactcccatcccgacgctcctctggtcggtacggcccccgccccccggctctgctctcgccgagacagcaaatcagagcaatttggcattgggctgtgcctgtcacactgccacgactgggctgcatctgcttgtgtgtgtctgtggtgtgcatgattctcccgtgcaagaaaacatatggatccactcagggttgttgccaaactttcaatgcgcactagaagtactcccccggtcgtcagattcggatacctgagcatgatgcgattcggatccacccagtggaaagagaaagaaaaggcaaggcgccgtgttggcattattcgtcctctgcgatccggctcccgtcgaaaaatcaaccaaactctcgatggtaaggaggaaaagtagtttctgaggcttccgaactctggtgttgatgacggttggcgcgaaagttttgatcgggcaaccgaaagttttgatatatgaacacggatcatctgcagtattgcatctacaatagaagtggttgatagtatcgcagacaatctccactaatgatatacctagaaccaataaaaaaccattattgacgagttatgccttgtctacggtatttgtagagtatggagatcgttagtatcaggacatacgcgagattacggtaaaaatagatgggtgacaaggatttttatacaagtttggacaccccccctaactagcaggtaatagttgtactcctattggccaaagccaattgcagcaaaagagacttcactatttgtctaactatttgaatctatttgtatcgaactatcatccgatccaattgtacaacaagcttacaactaatcgtccacagccccatcaacatcaacgatcaaaagcgttcatgctaagtactagcatcggatcctcccgttgattctgtaccaaaccatcgactatcggctatcggctaacacatgcttttgacacactcgagactcgagcttgcaattgtcatcaacgttcgtgtctccaactctccaacagccgattgttccaccgtgtcagctagtcgttgctacatcgacatattgtcagttacagaatcaaactgactggcacgcctgcacctcatcaagatctataatccagcactaaatcttagtcgatctccggggcctcaatgctggcatgattgacacacatctagtacgtcaagcggaaaattttgcgtcaacgcattgaagtaacaaaaaccattgagaaaataggtgaaatgcgcaagggcataaatgatattatttttctttagttagcaccgctatatatgttatcttcacggaataaggttacatctaatcttacctgaccttagtttatttggtgtaaaagttgattattttggaacatgtgagatgtttcttgatctaagagcaggtacagtagcatgttataagtcagctataaacatattttaaagtgataaagaaagagagagaatagcagcggtttacagatttgtagtcagctgtagtacggactccacgacgtaatgtgtgtatgataggtaggaccagatattaatagtatagtaagtaactattgtatgaattggctattatattagctatacataatatgaagctagtagttggccgtactattaaacttgctctgatgttttgatgttccttatcaaactcacaagtgccaaaatttgatgacatgtccaaagaagagccaggatcttgtcaaacacgcatgattgacaccacggagatccagcacgtccgggctaacgtcggtctccagcacgtactagtagtagtcctccactagcttcgcagcagcagcgacgacgtcatgggcacgccctggacggcaaccaacaggagaggagcctccgcgcggtggaccgccacgaaaacacaccgtaattcctcctcacctcctctgcatgcgtgcgagtggacggacggacggagagctcgtttcacccgcctacggctacgtacgggaaaagggggagggaaaaagcagtggtggaatatgtgtgtgcggcctggtgaaaatgccctgccttcgtgaagcgcaacatcatcataggttgtcgcgggcagagcgagcaagggcacgcatcaaaagactggcacccgagggctatcatgaggttaccgcccacgcgctcacgctacgcagtaaatccccaccctagctacggacgtaacggacccccccactgccatcatccgccgtccatccctctctacgacggctaccactgtaccaggctaccacgagcactggcacggtagacggtagaagtagtagtagccgtgtaggaagcgctagctgttgaacctgaaaccccggccaatttcgtgtgttacccaaagaaaatgttacttcctacctctcaaaagatcaatacaataacaagactataaaccagctctaaacatattttaaaaagataaaaaaaaaagagaaaagtagcgggccatagatctgtagccagctgcaacacggactccaaaacataacgtgtgtgtgataggtgagaccagatattaataatatagtaagtaactattatatgaattggctattactcctacattggctctagatgatttggagttaatagttggctatactattagacttgctcttatgtagcaatttaggatgtgttcagaacccagggtccctaacccctttctatcgtattctgcacgcacgcttttcaaacggctaaatagttcattttttgcaaaaaaaaattatatacgaaagttgcttaaaaaatcatattgatccattttttaaaaaaaattttagctaatacttaattaatcgcgcgctaatagaccgctccgttttccgcgcacactgtttcggatgggaacgaggtggtgcgaacacagccttagaatgggatgagacccaacctaaaactatgaatctggatttttatgtctcatgtttaaattcgtagtcggttgctacattatgggacgaagggagtagcgtgttagacagagcgtgacatgatccaatgtaatactctctccgtcccataaaaatccaacttattatcagatgcgacatataaccaagatatgtcacatctggttctaatttgttttttacaggacaaagagagtaatgtattacagcgctcttctgttccataaaaaagttaacagtaggtattgaatgtgacacatatgcagattcattattatattagcatgtgtcacatttaattttagggttttttttttacttgagggagtatacccacagcttcaccgcgatgtacgccccgccagctcacggcatcgtttcgcgcccaaaggccaaagcgcgcggccgtccaagccgcgggtggcgcacggcacgggtcgtcgtcttctcgtcgctggcgacgcgcgtgcggaggcgagacggcggccgctaggcggctcggcgacggcggataaagaataggggaagagagggcgagggcggcggggcgcatgggtagcaaaactcgaaaaggcgggatagctttatcgatcggaggcgcagattattagccatgcgagcccctggttttatgcgatcgatctgggaccagaggaccagcttacgtgtgtaagcttgtactgctacgtacttactaccgttttctaataacacagcttccttttccccacttgttcaattatgtgtgtcaaatctcttcatccaaaataacttaacctcaaatcctaccataggttatatggagagagtagaaagtaggagtctggagcgtcccggtcaaatcgggtccccgtgcaaaatattaaaataggccctagtagcctagtaaattttttatagtaaaattaaaaatgggcgtgacgattaaccgatcatcagcgatgaagcagaagcggaggccggagagaactggggagaggagacgaagcggctgcggcatcaggacttcggcgatacgagacgacgcagactcttggacgagagtacgatggaagatggatcgattcaccttatgcagcgttttgggccttgtgtttgctactatttggactgcaaattaataaaattaaagcctctaatattattatatatagggcatacttaatattttaggggtccttaaaatttgggggccctattcggtcgcacggcccgcacgggccccctggacgcccctgtaggagtatatgtctaagcctatcccaaattatcatattgagctcaacactaagagcatgtttggaggggtttctggcaactgtaacttctcctacaatcagaaacttcccaaacagttcaactttttgtttaatttttgagaaactgtagctgtagattcataaaatgaactagaagctaaaaacacagctttttttaattctcagaatctactccatccttctaaaaatcttagacctatttcattatttggtttttcaaaaaatctaagtcttatttgtagttactatgtgctaaattaaattgttgatcaaaaatcaagaagtcattcgtacttattggttgcatgtccattatttttgccacatgatgtatgagttaattgctttttggtattgatgaaaaagaaataggtctaagatttatataaggagggagtacttcctttgtcccacaaaaaacaaatgaatgtgacatattaagactgtccagattcattatactagaatttgttacatccagttttaaatttgttttctatatgaccaagggagtaactacctagctgctgcttatcttaatcttgagcttcctcaaacagccagcctcttaacttgagttcattttgatagttcagctagaggagttggcggctttaaaaaaaaaacaaatcattagcacataattaattagattagatattgacaattataacattacgaatatatttcacttttcttacaaaactatataaactatcttttaatttataaagcataccgtttagctgttaggaaaatatgctaatagaaaacgagaaaattaccgtgacttcctctttccaactcagccttaggcccaagaccggtccaattcgagcagaaccgaccgggttcaggccgggtttccgtcagttacccggcccaagcccgaagaggacgaggacgagcgcacgcacgcacggacacggaggctgcagctggaaagacggacaggtaggcccaccccatcaccccccatactgtgccataaacattacgctgcgcgcgtacctaaaaaagcagcagagaggaagaagaaaaaaagagtttgggctgaaaaaggcatcgagagccacgcaccggcagcacgtcgccggccatccgtcctactaccaccagcagcaacagcagcagcagaggcaggctggaccgcggcgagagagctttctattcccctctcgaaatcggcagcgaaagacgacgtcgtcctcgtcccacccgcgcccgcataaacgctacagtggtggtggcaccctgcaccgcccaacgaacgccaaaagcaggctgctcatttcaaaggcggaggaggaggaggagaggagacaggaaagccttccatccaaccatcgctgcccccttgccccttcttggcctcttgcggtgagcctctagcttactcctcctcccaatctctctctctctctctctctctctctctctctctatctctctctctatatctctttcttgttctagcctggtcgactcgtcctacctcactgcagcaacactactggcattgcgagggtggcgtggtgagctttgtgtgggcactcgaggaggcacgctggcccggcttcctgactcctgggtgctgcggccattggaggaggacggagtacaccaccctgcaaggccactgaggttaattgccacaccgtcttttctcacaagcatgcacgcttgacaaagctgaagtgagcgataaagagagagagagacatgcacatgtgcaagcacacggcggatggatggatggatgcgcacacttgcgtggctgcatccgggaggaggaggaggctggaggcgccactcgtcttcctgaccagttcttgggttgagattgaggaggaagagtagaggagaggggtgggtctcactgttcctctttccccggtcatggctgatgctgccctttagctttgcctttgttcgtgtgcgccttgttgcgtaccctgttttgttgccttccccgtgttagctataaaatctcgatgcctcctcctcccacatgcctcctctccctcatggctgtcacattgtggccgcgcttgctgtgtgctcttcgtttttaattctccccctctttcttttcttttcttttttaaatttctctagatcatcacatctcaccgtatatactttctattacgcatcctctcgtgtcatcgcgatctcaggctccggcacaaaaactgtgagatcttggcacattggtagtaaaagattccccacacaagcacgcacgcacggagccagagcttgagagagagcaagtggccgttcttggtctctccattgcctcccacaccttgcattataaaagatgctcggtgtctcctgctccaatgcgtgataaagaaaaaaatatatactgacccttgtgttttgccgttgttgttgctgcagagatttgtagtagagagatcacctgcttggggaacagtgttggtggagaggaatgtggactcgttgtttatgagagagcggtgctgcattggacacaagatcttgcgtgattcttggttaattaaaacaaagttgggcgaggtggaagaagggaattatactaatcgcctctcagatcagcaaggacaggcagcaattaacaggtagcagcaggaggaggtggggttgtgtcagctttgtgctttgtgggtgttgtccctcctggctccttgcctccctctctctctctctctctctcttcatataggagtagtttacttccattgaggtgcttgtgctcctcaccattcttgcctcattgcctacgatagcagcagcatcagcccgcataagtaggttcaacttggagtgtgcttgaagcagcagtttgagtgctgtgctgctgttgctgttactggcttgctgctagccgcatcagggcctgctactatctcgtagtctgttcttgttttccgttgtacgaacgatctcccgggcacgttgcaatattcggtcgccgtctcagccgcagccaccagcagggtgcagcaagttgttctgctccttgtacttgtttgctcctgggtactagttgctgttcatcttgtgtagataaatatgggctagtagtggagttgttgcattggttgcagcgttgttgttgtgttagtggtggtggtggtggtttgtgtgtttgggcgtcgatcaggagagataagatttaagatcagcgcgtgtgcgtctgttctttgcctgtttcaagatgaaattcatgaagcttggatcgaacccggatacttttcaggatgatggcaatgaagtcaggtgattgttcgtcttgtcttgttcagttcctttgccttgttcttgtacatgatcttaacttgtcaactgttctcttttttggggggtttacctggtagtagttttcatcagttcttactcttctctgagtgtactactgttgaacgtctgaatatgtccaagaaatgtgtaatacatcctgtttggtatgatcttgaataacttacaaaatgcagatgttaaataacagagaaatattctcctgtttggtttagtactgtaattatagaaactatatttctcgatcccattatataggcccatttattccaaatagcctagatgctagatgcacaaaatctactgttcatttaggcacaggctgcttgttcttttctcgtttcctgacttatcacttacgagaactgttccatctttgcagcattgtggcaactgaattagtgagcgatgtcactgttcgcatagggactacaaagttttaccttcacaaggtaaaaatgtccttcctttccattcatgcagcttttttttttcagagaaatgccttcataaaacttattgcaatagtaatttcttgtggttcagaagataatggcctcatgtaaggtttgatatttgcttgctggcatattctcttctctaaatgctaaaccacttataactagagcaaatgcttccattttttcttcttttgtggtttatctgtttattgaaaccttaagtaatattttaactttatgctacttttttttccttgttctttcaatgtttaatatatacttttctgagcgatgtcactgttataagtttatgctactttaactttatgcttccattttccacccgtgcagttcccacttctgtccaagtgcgctcgctttcagaagatgatcccaactactggtgatgaaaacattgagattcacatccatgatattcctggtggcgccaaggcttttgagatctgtgccaagttttgttatggtatgattgtcacgctcaatgcctacaatgtcattgcagcccgctgcgccgcagagtacttggagatgcatgaaactgtcgacaagggtaatctcatctacaagattgaggtcttcctcagctcaagcattttccggagttggaaggactctatcattgttcttggtactacaaaggctcacttgccttggtcagaggatcttaagctggttagccactgcatcgactccattgcttcgaaagcctccactgacacctccaaggttgagtggtcatattcatacaatcgcaagaagctcccaactgagaatggccttgatttggaatggaatggagtcaagaagcagcagtttgtgccgcatgattggtgggtcgaggatctcgcagatctcgacattgattcatacaagcaagtcataacagcaatcaagaccaagggtatggtgcccaaggatgtgattggggaggcaatcaaggcttacacatacaagaagctcccttccttaagtaaggtttcaatggtccatggcgacgcaaaagttcgggccatgctagttaccatcacatgcttgttgccatcagagaaaggatcagtttcatgcagcttcctcttaaagctactgaaagcaacaaatttgctaaaatgtggagagctctgcaggaaagagcttatgaagcgtattggacggcaactagatgaagcgtccgtgtcggatcttctgattcctacagtggatggggagaccacagtttatgacattgacatgatactcagtatagtggaagaatttgtcaggcaagacagtaagaatgctcagaaacataatggtggtgaagtggacagtcatgtccaagcacctagtgcatccatgatcaaagtggctaaagtggttgatgggtatcttgctgaggttgcaaaagatccaaatacacccattttgaagttcattcatctagccgagacaatgtcgataaattcaaggccagttcatgatgggctataccgcgccatcgacatgtatctgaaggtactcttgcaaatttcaacttccaatcaaaaatgcactactcataggacatgttcacaagcacactgaatatctagcacatagtcctaatgcatttcagctcgtgacatttttgcttcaactcacgaatttattcatatgcattgctcatataaattcttctgtatttacggttgtacaaaatttgtttttaagtataacatctgtttatttttcttaaatgagcaggagcacccaagcttgggaaagaatgagaagaagaagctgtgcagcctcatggactgcaagaaactctcaccggacgcgtgtgctcacgcggtgcagaacgagcggctgccactgaggaccgtggtgcaggtgctgtaccacgagcagacgagggcttctgcggcggtcaccatccgagccgacagcatctgcgtcggctcgtacgagagctcgaggtcaggcgccaccaccaacacggaggacgagtgggacggcgtcatggtcgtggaagacctcagcctgtccaccaagaccaccaccaagctagacggcgcagccaatagccattgcagcaacggcaaggcgaagaaaggcggcgcgtcgacgccgaagaaggcggctcaccggaggacgacgacggtgccaaccggcaaagggcagtccggtgagcgcagcagctcggactcgtcggacagtgcgatcttgcagaagctggagcttcccaagaggaccccctccaggagcacgaagccggctgctgtgtagcgttagcttcctgcatgaattctcagtggattcgtaaggatcgttaggttcttagctgctgcttcttttctttctttcttcatgaatgttgcatagaagcaagaactaatggtttacacgtctgttggtagggatgttataatgtgaggtctgcttttaggtgatcttgttagtagcattgtaggcttgccatgaaacctatgaaaatgttggttgctactttgaggttttatgccatactcagaagttagtagctgttatgaaaaaagtttagaactttgttagaacttggaagcataattcatctgctgctagcctgtttatactggtatagtggtatgatctcagttcagatcgtgcaaagtcttgtgtaatttgtaattagacaatgctgtcctgagccaagaataacagagctgcggaccaaatagggatatcttgttgaaaggtagccagtgatgttcagtgttgtcgcaactgggctcaataggcattttgcagccattgttacctgagcgacttgggcctttttagtatttggattatacctctaaaaaagaagtatttggattgtagtatagtacgtcatactagtatcagctatgtcaagcgcatatcgttgtagagagttaaaattagtgctccttcgttaaaaaaaaaagaaacagtactctgaatatgtacacacttttgtaagaagcataatgtataatcctgtgaacgcatatgcaggaaaggaactatttttaaagtgtgtcttattgaacatagacaattacatcaagatgatagtataactatacagagaatatttttagcctatgtattgcaggaaatcagctaatgttttttatacttatcaaggaatctcacgcacgacaaactgctcaagaaaagacctgaagtcgatgatcatcctgatcgcctaggaattatgatgtgaatggaatgccatattttttaatttttttaatacatcttctctttttttaaagaaaattcataaccattcgagtgaatagttttccagaagttagaggctagtagcaaacaattagtgcaaattaaattatctctatccctaatataccatttagcattcaatagtagatttttttaagataatagaatagaatatctcggctttgcagcaaccaatagtagatactcactagtttgagaattaacgtggatactgtaccccccaacacagtaaaagatcatatccattgaattgcttttctgatccatgtaggaccggctaacagatttgactcggaccatgatccataggctcacctcgtccttcttgcttgcaaatcacttcatcgtgcatgcaaatcacgttgtctggcttgcacttgcagatcacctgctgggacccgttgacgcttctcgtttcgcatcgcatgtcttcctggaattacgactgcacgttagaactgcatgtatttttaaccattcaattttatgatcaatggtccagatcaatcactacagtgttcactatatagtactctaaacaatattttatggtacattacttttgctacagtagacaagctaatccttaccgtcagatttagatccaaagtagcagctacgactgtttaagttgcagtccatactactactcgtcttcctggtccgtccatcacctaacctgttcaaatggctgttccaaatgggtaggactggtacacatacggtttcccttctctttcaatggtggaatatatgtccggtcggtggctcggtgcacatcatcacggaggtgaaattaattcattctacaaataggtcaatgacacttgcacctaggacctatgtgtaaatttttaattacaagtatgttctttctattacagctaggtcatttttgaaagaaaaataaataggccatcgtttatgatattggtgtcgccgtccttcacattaatgatttagcttttattggggttagagggatggaaccgcagtaccaataatgttggtgccgtgaaaaaaattatttatagaataaaatttttagaggtttacttgtagaatatgttttttaaaaggattgaaaaatccagacacacccctgacggctgatttgaccagctacgcgtgcaaaggatccatgcccaagaaatcagtactacagtaggtcaaaggaggtcaaaggagtgtgatatgcctgcaacgactgactgacacaacccataccctgcacaatcatagtaccgcatctcatcacatcgaaagctccgccacaatccaggtcctgttcagaacaacaggaggttaaagaattgtgcctccgttcaagttccgtaccatcaaccatcacgtactccgtcgaaatcgtgtcgtgccaggcgaagaagcacaaacgagctactacctccgtccaaaaatgtaatatttctagcacaatactttgtcttaaaataaagctatttttctacctaccttctcctctcaaccaatcacaactattctttttcacctactttctcttttcaaccaatcacacaccttcttcaattattctcacatactttcttaatactcgtggcaatcttaaaaatacttacattttagaacagacgaagtatcaatcgatctgaactttgcttgtcgtcggattatccagggcccgtccttctcatcggcggcgattttgtctactccttgtcgaccggcgagagcatggcgagacgacgtgcccccaaatctgcaatgaccaatgagctttcggtttatctcaccctggcatgcatgatgcatccatacatgcctcggtcttgggctcttggccatttggatcaactcaccaacagccaaatgctgaaactacgacagttcaagtaatagcagatgctagctgctggcctgctgcctagtactccctttatctcataaaaaactaatataatactgatgtgacacattttaatagtataaatttagatatatctttatctagatttatagatttattgtaatagaatgtgtcacatttagttctagattttttttttatgatagagtagactgaacggacatatggtcatataccctgtgaaaatgcaggggtcgaatggtgcaaagcgtaggctggctgcatgagctttgttgattcttccttatccactcaatctgggtacacacgtacttaacttagccacctaagggcagccacaatgtggccataagaagaggccataaggttttatagtgaccatatacattgtgaaacaaagccataagacattaaatgtaaaagaaaaatttaagcttatggcttgaccacaagcaataaaataatagggtaaaatgaatgtgaggatgaaaaattggcatggctgataaaagaagtactagaatagtacattgtgggatccatcttaaagtttactcttatttcagacattgtagtaataaccataagaatagtgggacccaccttaatactactcatggtaataaacattggagatacctatagtgcaacacctaatatagtgcaacacccaatttgtgtgtgtccaatgagtaagtaccaatgtgattaagggagtagtagtaaagcgtaacacaaacatcaattcgtgcgtgcaatcagtgatgccaacatgatcagattgcaagtcaacgaggttggataatctgctttgtctgctgagaaatgtaagagtagtactgatatgaagaaatgagctcattttaatcctgagattcttaacaggactatttcgttgcacctgtcatcattgtcgctcgatctgatatgtagccgaatgcaacggacaaattgaattattataccacgagaattccaatcattgtgcttcatgtactacagttattaccagtaccccgatcgattggctttccctgttacagtacgtcgctgcaaagcgacgacgagtcgacgacattattcattgcaccatttgaaaaaaaaaattcgcctctgcgtaaacgaagcagctagcggtgccggtgcagagccactgcacatatgcaattctgcatgagtcgaacactactagctcacatggaatcgtacaacacgcggcactgcacagtggtctcgcacagtacacaccgagcgaacgaccatattgcctgcctgccggtcaaaagagcggaacagaagcttggattggaatcgtcagaacgaaaaccccatcatcagacatcagcaaatgcatcacgcacgcatgcatcgctgatgctggtcattcgaccattgttgcacagtgcagaaactcgaacggcatggcgaacatgagccatcagcatgtactctacagtacaggataatcagttgatcacttgttctagcaacatcagtaatttggctgtatttttatgattattaatgttactgtgtactgtgtaaaggtgaagaagatgttagtgcctgattttctactattgacaccgcaacattttggcaaaatggcaagttagatgttttagtaaagtgcttgatttgatacgaaggtttggtaaggttatagagccccaccacacaatctctgcatttccatgttagagctcgggcgggccacgtattctgtcagccgtcacggcacaaatcattacggatagcagcatcaacaagataagagctctcgatattgctatcgattccggcttttttccgattataattagggcagtgtatcctacaaaaactcgattgcctcccaaaacgaaccgtgtaaaaggctcacctaaaccaaaggagaaaaataccgagatgcagaagagaaaaaagaaaagggtttagatcgtacggtctagctacactcttgactctggtcgccgctgatttcttttacttacacttctctggggtcaacgaagatggagaggccaggaggtgacctggcccaatcccagccgtccgattctccgacgcggcccagccgcttcatgcaccacaggtcctcggtgcacgagaggcggcgccagtgcgggatgcggcggcggagcgggtcgcaggccgccacctcgacggccacggcggccgccctgccgcgcgccatgtgacgaacgtcgcgaacagcgcctcggcggccaccgcggcgtcggggc

SEQ ID NO: 66237 - DNA, 8124 bp, Oryza sativa
  unsure (1)..(8124): unsure at all n locations
acagccgctcggcgtcgcgggcgccgaggcggaacacggccgcgcggcgcgggacgcggcggcggtgcgcgtgcacggggtgcaccagcagcgacggcgtccggaacttggagtagccgcaccgcaccgtgaacagccgcagcgacgcctcgttggacttgtcggtggccatgtacgcgtactcggctcccatccgctcgaaccacgcttccatccgccgcaccatccgcagcgccaaccccatcctcctgcacacacagccaggaaaaccccccgagcgaatcacgcgccatttccctttcccgaaacgatacgccacgccacgcgacgccgcgcctccgcggacacaagaaacgaccaagtccgctgctgttacctgtggctcggcgcgacgcggagtccgagaatgtagccgacgctggcgacggcgggggcgcccgggcagctcttgccggtggcgaccgacttcacggtgcctctgatgatgccgacgatgatccgtccgccggtggcgcccgacgtcgtctcagctacctttccatcccaagacacaacacacactacaaaatgaaaacacaaccaccaaaacagcgtacgtactgacacgatatgatcgtagtacgtaccaacatgaggtagtcaggggagtggcgaatgcgggcgacggggtcgccgagcaggtcggcgtggagcgacatgccgccggtcgggccgacgtcgcactcccggtcgacggcctccgtgccggcgcggtctctcgatgggtcgtactcccggatgatgatcaccaccccttcctcctcctcttcatctctcatcatggcatatatccgatcgatcgatcgatcgatcaatctcgcaaccgtatcgatctctctctctctctctctctctctctcgactctgctgctctgcataggaatgtagcatatatatatacaggcacccggctgcagtggggttccggccttctattttctcgcagggataacaataaaactgtgagatttttttaaaaagttgtaacgcacggacgtaatcacgcagatatcgcgcgaatgcacttccttctctgagccctctctctctctcccctgaatcatgtgggcgcggttgacgggagagggaaagtgcgcgcatatacgcgcgggcgcatatgatcggccatgtatgcaagttgcagcaacatcgatcgatcgatcaattcattcaattggcaagaagcatatgaagagcagaggtggcagcagaaaaaggagaggccgagatcgatccaaccgttaattcggcggccgtttggctttgtgattccttctcaagattttatctgcgtggcgttattcagctgaattttatccatgtcgatatcgcttatgttctccgttgctgtaatagtgttgcctatgatcttgccaaaataggcgctagttgggacccgggtcaatccatcgtttggatcgactccttccagaatttgtaaatgcctttgtggttcgtgatatcactaaacctgctgggtgaataaaaaggcatcgatgaagttaaaaaaaaaagattttatctgcgtggcgttatccatccacgactccatcaaaaaaacagttattattggttcaatttaattatgggttgtgcgatgaattaacttgcgtcggctgggagtggagcgtatgattggagtggtggggagaaattaactgcgtgcatgcatgcaccacagcaccactggatcttttcttttgctgtggattgaggcttaaaaatcctgccacgatgaagctcttttgcttagcttttaattaccctgttaacatgattgggtttgtgaatccacctgtgaaaaagatcgataattgtatgcggtgatcagacaaaaggtcggccactggtggcgttacaaagatttgcaacactaaccgtggtcggttttaccatgacgtttccgttgcagagggaatggatttccgagtcagtcaaaaatcaaaagcggcagtgcgatctctctcctaggggagatagggcccacccaggcgcccaactctccaatagttaagcttatccggcaaagttagaatacagtaacagcattttagcaaactgttcgagctagcgttcttctcaacttgtggatcgatccatccattttgcatgggattaatctatccttttctgcgtcaatttgtgccgatacaaacacggttattagttaggcgatacaacttgtcggatgaagggagccaagtggggaaacatttccctatttttctgttctatcctaaatggagcgtgaatttctcaatcgaaaggattatggacagtataaagccacgcctaattctaattggatagtttgatccctgaccactgcacaattttctaagagagctcgaggagatgccccggatacatctctcacactcatgccaaatgcacatgcgtgccttgtgctgtgttgtgcaatgcacccggccctatatgcgtttcagatcgagagttatcgagagaccaaaagcttcgcggaacagggggcgagctaccatgacattttgccctaaacctgcacgtattcattcgcacttatctagcattctacaccttaacaaagtctaatatcattgatctgaaccttagcaacagaatgcaattgatattccctgcagtactgctcactgacatgtggacctaagaggctgtgggatccatatatcaatgagcagtactgcagacgatctgcatcccacagactgatgcagtaactagggcactaggtgtacaagctaatatatatgcacaaatctttcggtgacacagaaacaccggagctccaatgaggccatgaccgaaaagtagtaaagcagtagtgtagaaatcttgctcaaataattccctgaaaagcgatcctgtctgtaagtggatgagcatagatgtgactagatcgatcaccagaaatgcaccgttgaacagtagtcgaaaacaaaccgcatcgtacgtcctccttgtcacgacgacatgcctacggcctctactgttcgataggagtatatcgcgccctccctagctacgggctaccactcgcgaaaggacatgtgaggcgagcgaggcaagcgccgcgcatgcacgaatctgatgccgacgtacgcgcgctcgggcgctcgctcggctccgcgccacgggagtacgggacacccggccccccagcagttaacggcaacagcatccgcccccgcgaccgcgtatccgcgccgaaaacgacgtgccgccgcgcgctcggtgatctctcgtcgtttcctggttgggcgcccagccgggcggcgcgtgtcatcggcggctcatgatcacaaggcggggcgtgtacgcgtcagtcgcccgactcgagcgcgcgagacgcgaaacagctggtggttacccgggacgtaacgacgcgacgtacggcggaggcacggcgcgcgggggtgggttttgttgtgggtggggggtgtgtgtggccaatcgtttcggtggcgcgcgctgttttttccgccgtacaaaccaggggaaaaggccccactttacacagtggaaaggcgagccgtgtctgatagcgtggagcggtttttggcgacgacggtggtgtgtgatttcaatttcgcggtccggtcacgtgaaatgacccacacctgagagcttggctttagcacggatccgcaacccgatcgatcatgcggtttgagtccataacccctttgtttgtgcgtcccggattgggcataggagcttgtactacaaacgacaagccaagctacgtaacctgatctcgatcggtaacatgaggtaaaacccgatgtggtaaactgatcatcagacagcccgccgccggtgcattaaccgtcgaggggtgcaatcaagaagatgcaccgtacatgacacaggaactgacggggaggtatggagaggcggcggcgcagtaggccaccaccagttgccccccacccccccccccccctatacatgcatgggccccaactgctgggaatgtaccagtacagtattcttatcgatcttgaccgacaatgctacagcaaaatcagtcaatcatcagcacgcttgacaccccaacttttggtactatagtagtgccactacacctgttcggcccaagtgcacgtacgtggctgctctctccgttgaaatgaaaggtgagatcaagtttctcagacagttgacccaagatattactagtactgtactgctatactcgatagtggtagctatagctgctagctgctggtggtacgtggacgtagttgtcacgagcatgtccaccagagaaattatgcttgccatgacaggaggggaagcccaaagccccgcatgcacagcgcaggcttccgtgttgtacattctgatggtgacacggccgatcgagccgtgagaaagccaacgccggctcactcagcttgctctctccggccgggccgcgcgtgtcgccgtcgacaagaggtatggaggcgcgagagctgattgatatcagaagcaacaagcgcaagcgatgtaatcagaggcgccgccacctcaaaagagaaaaacagtgccgtgacgagcgcacagagacgaaacagcagagatcgacacaaacacacacagagagaggatagaagcagcgatcagagtcgtggcgaagttgtacatgcatccgcacgcccgcacgcatgcgcctagctagcttgggcaggtgcatccttgccaaagatggtcccaggcagcaagcaagatggatacaacggctcatgcgcatgtctccaactctcgccatgccggctttggcacatagcgagctagagatactgatcgacacacagagactgacccacaggcacctggctagctagatcaagtaaatgcacgcccgtatacgtaggggaccaatggtgccaaactcgatctctcgcaaaacgctgcagtgtgtcaaagctgattggaatgtcagctgtcaagtcctggatgcatgcaccttcatatgggcaatgcggccacgcacggatcgtgaaagcgtacaatcgtgggagccacacggggggatatctatctccaagcaagtgtacttccatcttccatgtgctgtttgctactactagtactagccagttcattgttgtttctatatcgactttgcgttcatttgtatttgtatcgtactcactgtgttcatattcggattcggattcttccagcaacagagatatgcgtgattgtgacaggttatatatggtcgtttaattgccgtttggaggtcatcaattatcaccatggtcagtcgcttgaggctaacttgcaacgggtttgttcagatgagaggaaagcagggtaggcacgagctcaaccgggtcgatcgaccatgcaagcatgcaaaccgcttccaacgctttccaggtgtcgtctccgtcatcagttcgttgcagcaacagaaataacagaacacgttgctttggacgaagtaacttctgcggttcagtactcccaatggagctgctctgatatttccaaatggcatattgtgatgggctgatggcatattggcaggtacaccatgctgttgccgttgtgttacttgctccatcctcgggacaaaagggaggtgtggctcaaagccaaaacagttcagctgaattttcttcagaaacagctcagctcaactgacggaagcaagacaagactcgtaataaagacaacggacaggcagatatttgagatggcgagtcgccgaatggactgggatgccaattttctggagcgtcgatgctctggtctactgattgagcgattgtaatgatgatcaagctaatgcattacgactagatcagaaaaaaaatgttcagtctacaggtacttccagtataattcttgacatgaacttcagatcaaatctttgaatgcttcttttggacaaattgttagaatgtaggataggtgggtcaaaaaagtgcacacaacgcaaggccacgtttttgtagtccaggtctctctgtaagtcttcctttctcaattttgaatgctttttaaaggagcttgagagtggtgaagtctactcgaatcagagtctactctatgcatagacattgtgcagtctactcgaatcaaagtctactatatgcacagacattcggtcgttggcatggagacctgtctgatactctgatctcacagtccagaaatgtttacgaggattgctgaagtgctgaacacttgagtgaaaggaggaaaaacttgaaggcagaaagagtggacttgcgcggttgctacggcaatatgtaatgccgtccaccagaaaaataccacttgggaaggaagactcgggaccgtggatttgtttttctagaggaacctgaaactttgtaggtttggattgtgaaaacggtgaacctagctgaagatgtaaagctaatgcctgctggcaagcaaacttgacaatgccagaattcagggggactgcagccatcccagatcgagctgaagacgttgaagctcaaggcctagaccatccaaaccgggctaactcattctgttggcccaacccaactactgagttgtgacgcagcgtcggtgtgtggccgctgcatgcagagcccacaaatctgcaccggcggctgtggcacatgcacacgccacatcccggattcccagtatcccaaccgctgtcccgccgccgccagcgacggcctcctaccagacgcaccggggggacggtggcctgcgccaacgagagcacgagggggtgctgcgcgctggtcggctcgcctgttcgcctcgtggtgttcccgtcgctctcaaccggaggcacccaggcagttggtggatgcaggcggctgctgccgcggcgcctgcgtcatccgtacgtgggcatgcaaaacgggggcgccctgacttgacggtggcgggttggtttccgcgacatgtaccatcgccgatgatgtgacgatgcgccaaccgaaacctctcgctctcccacagaaccagggccttccatttacggtacgtgtaatcttctcatctcctcggatttttctttaaaagtttttttttgaacatttttttattttaattttaaaaataaacccttccaaattttattttcaaaatctgaaccttaccacgtcagtctatctagcgtggcaaaacaacattgatacgccatctacagcggacgtgacatttttatcatgcgatgcccagaccgatgtgaccaaataacaatcacgccagcgccagcgagatcggtgtaactaaataacaccagtgtaacaatattgttttgccactccagctcagttgatgtggccaaaaagttcgaccgatatggccaaaaagttcggatctaaaataaattttagaatggtttatttttaaaattaaaaaagtttaaaaattaaaaaaaaatctcctcgccctcacgccgccaaccaagtctagactctgcattgcacgtctcaaaatgaaattttggatttcagtgtagttcaacatgtaggtgaattgtgtgttctagggacttctcggaatccccaaaactaaggaccaatacacgtcgcacaaggcacgactcaacaacagcaatcacaacaaggtttagtgcgctacgaattagttccaggataagcatgagacatacatataacgtctgtatactgccccggagcaagttagaatgaacaacttgcatgttaatttgccatgaaaacacccgtatcaaactaacaactgtttccattccagaatacaaaacaccaatcatcaacacgcgaggcacgcaacacagcaaagctaggcacgcaaacgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 66238 - DNA, 4378 bp, Oryza sativa
acgcatttcctgaggaagatgggctccaaaagttcagggagtgggttgaatcaccagatccaactttactgggaaaacttggtatggaaagtggtagcagctcaaagaaaaaaaagtctggcagaaatcattcagacggaaagggaaacagccttgagcctgaatacgctaaaggttatgatgacagccaatcttctaatgagacccaacgcatcaaggaaatatttatgagtaagcatgtaagtatgttgtctttatagactgaattgtcaattgctgtaattgcatggtgattatagatactgctttactaatatttcttttgcacttgttatcatttatttatcagaggaatgtgagcaagaactggcatattccttctacttttcctagtgaagcagtcataaacgcatatatttccccacaagttgatgattcaacagaaccattttcctggggaagaccagattcaggcttactgcgcaagtaagctttcttgaataaccttatgttctcatggatgcgagcaaacaataaaagataccgttcatttcatttccctgcacttttttgtattgaatcagtttttaagagcagcaatgtttttcttgctggaaagtggtggacaatgtagtccaacatattggcagtggcattaaccgctcaaaaacctaaaatatatccgatatgccagcaccagcttgtttctggtaggtgttcagactggtaccgtggagcgcaaaaccctagacaagttttaccagaaagcagagtgttctgttacttttagctgcctgatatgttataatcaatttgtttttatgatgtggaatgtgctttttagctccttatcattaccttgacaatttgttctgatctttttcttcacaagttagttctgtttcaaaactaaggattatgattatgaaaaaacacacatgctctatttcttttctttggcgcaacaacagaagatctaatgttgagttccttcaggttatgttgggaaaggtttgggtggagcaaggaaaaggctgatgaactgctaattcctgttttgagagagtataataagcacgaggttagtctctggaagactgtaactattatttatcctattatagaatggtttgatgtgataatatgtttatggataccattgaattctgttccctaaaaaaatgagttactagtaagttagttttacggtttgagaacatcaattgttaagatgtcagcatttcacctctattttacattttttttggatcggctggtgctggtttgccatgttctgcaacatttgcattttaggcatctgtaaaaagcaagtttttgacaattcgtttcattgtctttaagttattttcatttaggaaatcgctgccttttgaaaatagaataggcatgcttttctgcttggatttcatttaactaagagtgatttaaccggaatgtcagcaatccaaagtctgcaaaattgggttatttaaattttacagtttcatgtgtcacacacatgcagactcaactacgcatggaggcgttttactcattcaatgagagatttgcaaaaattcgtagcaaaaggattaagaaagctatcaagggtattacagggaaaagctttctagagacagatgaacttgatcatgatagtcccagtactagtaataccagcaagaagaaagagagaacctcctctggtcgtggtagggctaaagggcaaagaaccaaagatgttgggcctggtaacacaggaaatcaggactatgacattgctgatagcttagtagatgcaggtgaacatactacagaaaaaagcacgtccagtaagaaaagaactgcaaactcctctggtggttcaagaggcaaaggaagaagaagcatgaatgctgcacatgtgataattggaaatggggaagattctgatgtctctaatttagcatctgatgaggattcccatattagacataccaacgactatgaatcagagggattgacattacgcagggtaagtactccttatggttttctgcacttcttattgtatggttctttctcatgttctctttgatgctgttattgaaggtctccgtactgtaatattgcccactaatttgatgtgatctaaacctttctggcctagaaaattagcttccatttattgctagctgtttagcatatgcttgtagtcctcaaaatatcacacatgcttgtctttgagaatcaattcttttttgaagtaaagaatcagaattgtttatgcatttcttctgatctgcacatgaagagcagtaatatttgcactggagagtaacattattatttttttcatgctgatgttgtttctgcagtcaaataggaagcgtaagcaggtcacatacgcggaagatggtcaggaagctgatgataatgatgtttccatacatcaaatcgatgaaaatcagggccaaggttctttggaggaggacatgtgtcacatggctggacttgacacacaatctaatctgctccatcaggatacgagtgaattaaacatcgatcaaacgcatacagatccctctgatatgaacgaagatccttcgggctttgagttacccgaggattgccatacggacactgcaccaaaagactatctcttcaccggtggtggattctgcatggaagagggtgacgagcaagatacgggagtggatcaatctggtgcagaaatggagcatgaaacacgtgatgcctgtgagggtattgacgaggtttctgaaagtcaaagcggtaaaagcatgagctattcggcgactggagagggcacagagaatgcaaatacagaggcccgaggggcgtcttcatcgcagggacgcaatgcaagccgtggttcaggtgccgtgccgaagcttacaaagcgtaggagaaaatcatgactcatttgcagcagatcatgcctcgcacatcatgccgttttgttcaactgggcaaggtcacgtttcgatttgttcggcagccaatgagttgcgggcttgcggcgttgtcgtctgtaggccaagtctgaagactgaacaaaatgcaggtcggcattctgcacaccgttttcaggctttttcaggtttctgtccattgtttttctaggacagttatcgtatatcggtgtaaactgattgaagtgaacatttaaacctgacgtgattccttgcatcaggatgtatgtgtaacgcaggcttaccaacaaaagcaatgcacccgatgaaaatactgataaaattgaaatacacccaaaaaaactgacaattgttctctatctgaatatgtttattttttcatcaataagttcgattatacagtaatactatttgtttgtttttttaataaatgatgttgttgacttttaaaataacgtatggccgttcatcctattaaaaaattagtgcaaacatgctaagtataactcacatttaaagttttttaatgatacaataagtcaaaataaaataaataactttgatataaattgtttgaataaaactaatggtgaaacattatactattaaaaattaacggtatcatctattattaaaaaaaacggagcgagtacgtcagaataaaaattaaagtgcactactgtcgcgtggatcccgggcccggcccactggcccagtcaactaatcctcccgctccgctgccttcgcgggccgtccccttccactccgacgagctcccgtaaaccaactcgacggtcgccaccgtcgccgttgccgtcgtgtctcaggccctcgagggttcgtcagtctagtactgtgtgagcggtgaggtggcggcggctggtggatctcacgggagcctgaggtatggtgcttggcgctcgcctcctcctgggcctcgccctcctcgccgcgctgctcgccgtcgtcctccagctctaccgcctcaggaagccggtgcgttctctacttctacttctcccgaaattttccactggcttacctgtgagtttgaggttagatattgcgtgttttttgttatctaatgtgtggaagctgcctttgtgcttgcaactgatccggaattctggatccgaaatcgcccgcaaaatcagctggttgctagttgctattagtactagatgttcccagttgcaacttcgcagatttctggtgaaattaatgatatgccccgtaaggctgtaactgtatggtgtatgctggactttactgctgctacatatttagatttactactaccttcgtcccaaaatataataattttttactatgaatctggacacacagttatccagattcatagctaaaaatgcttatattttaggacggaaggagtatctgttttaggcttttggctatgttccttttggggctgcaggaat

SEQ ID NO: 66239 - DNA, 1077 bp, Oryza sativa
cactattttttcttcttccctgtgtaaaactcgccagaggttgtgaccaaggaagagttaccagtgtacaatggaacggacgagagcttgcccatactacttgggattttggggtattcacacttatctcacgtatgcctgcaattctattaacacaaattatactagtattgtagtggcttcaagtggcaatccatgatgcgaagtttgtcctctgttgtttgtggattgtaatacctatatccatatcatagaaacttattgtgttcagttgtaaatgcaaattcttataagcccgttcgctgtttttaagttttgttatgcattatggattcacttagttgttctctgttgtattttccattccactgcatggactatttacaaacttatttttcccttttgtttgataatgcagctcggtgtttgatgtcacaaaagggaagtcgaattatggtcctggaggtggttatcatcacttcgctggcaggttattatctttcaaggcctttggaattctcacaaggagcaatgcaatagcaatgctttaggataattctcaaaaggagttaacatttactagcagtattaagccttgttaggataattccagagaacttatctcatcttgctgatactaaaacagcatttccataacagggatgcatcacgtgcatttgtttctgggaattttacaggtaaatctgctatcttattgcttttggcttgcatagtaataggtttacatagttgatgttcatttacattacccacaagccacactctatatcattatgatatccactgtttattgcacagtattaggaataaattacactggctgtgttgatcattttagctaaatttaggacacctagatctttatcgaattataaatgtttactgcagacatcataaaacattgcttcctagcaaagcatcaacaacatacatctacatatgaaaacagaagtaggtagcacatgggtattgggtacatttaagattgatttgtgtcgaagctgtaaatggggcttggatacataaaatgcagttggtcaggtgcgatgaagagta

SEQ ID NO: 66240 - DNA, 4912 bp, Oryza sativa
gttaagatatggagtaggtagagaagtagttatattttagatagaatttatactgttgaaagtagttatactttagtgagtagtggtttgggactccctccgttttatattataagttaatttaagtttatcataggtcaaaccttatcaagtttgaccaaatttatagaaaaatatagcaacatttataacaagtttaaggtaatgttttggtagtgatgtagataaaacttaagtacacggatgtaaaacaagaaaaccattagcgtataattaatttaatttttattatttaaaacttgaaaatagattcatctggtattttaaagcaacttttatatcgaaagttttcggacgaaattcaacgattaatagtttgaaaagcgtgctaacgaaaattgaggtaaaatctatatcttaatcaaaaacagatgaaaacatttagtagtttcattaaattcatcgttcgatatgtttttatagtatatttacaagtttattccaagttaaaaatgttgcttttttaaacttaagaagatttgatttagtactccctccatcccattttaagcgtacccataagtttctgggttcaactttgatcgtccattttatttaaatttttttaattaatatttttattgttattagatgctaaaatatgaatagtactttatacgtgacttatgttttttattttttttaaaaaattaaataatacagacgattaaagttgcacaaagaaacttatggttgcgtttaaaatgggacggagagaatataaccataaaataatttatgatatgaaatggagggaatagcataatttaggcacacaaatgactagtactcctactacgcgtagctgtttagcatgtactcacctcataccgtaccgtctggtacaatcatacaggattctttaccaagtttttcatgttctctggaatctgaatctgagttggtacactacgatccaagactattcttccaagcatgatgagtggtttttgagagatgaagctggtaccatttccaatcgaactatctttagctacatataaaaattgataatatgatcatttctcgaccaatcgagcatcatttttaaaaagatgctaccgattcttatggtttttatctggcttagtatgtaaccaaattcactagtaaataaggtgattttcctatagggttttatttaaaaaaatatcacctggtgcgctatgcttgtcaaagccacataaaatggaaagagaacggtttacctaaaccagctgctttcttggaccgctcacgctcggccagacttgctgttcattggatgagacttgaactagttgcaagttcattgggtgaaaagttccatggaccagacacccaatcctgaaagatcctatctcgattggtgaataattcagttgattctttgagtccacaaattttcatttatttttcaattacatggaagatgcatcatacacacaaactaccgcacgaacactgttatgcggttcatttctgatactaatgaattaaagatctcgctaaacatcttgaagagagcttcacttggtttttctcatattattggttctatattgagattcatccattaaataattatctaattagattcaaaatgaacacatgaattttgtagaattttcgcgtgagctcatctattccaaggagcccacgaaaggtgtataatatgttgaagacaaagaagctatagctcatggtccattactccattgaacaccgagaaaaaaaaaggcagtgtgtcgcgacgactacggataagaacccacgagcttgtcctggtcataacccacgtgaaaccattggcacgtcgccgtcgatcaatgggagcttatgcgagctcaattgcaacagcatttgttgctgggtcgcaccttcacacagcttcatccaaagataagccaaaaatatttgtttctgtgatccaacgaagtcctctgatcgatcatcatgtattggcgtgtagcttcgcgtgctgatgctctccaagctttgcccagctagtgctaccttccaaaccccaactaggtggcccccttttttttttgtttaatcttaagaaccaataggcaaattgttcgtcaatcgtcagtgctagcaaacaaaactacgatatcgtcatcacgatttcgttttgtttagatcaatttgattgaagttcctgtttggatcttgcaatcgcattgtccaaattttgtacttccaaacccatatcatgggttatggtatgtctattgttgtcgtcgtctatttgttttcttcttcttcttttccggtgaggttagagtaagcccgtgggcacaggaatttttacccaatatttgcaaagaacatatacacacacacacaccatatgccaaaagcttttgactgatttacaccttcagccacacggcttgccgaccgaatcgatcgggaggtaaaggagaaagatcccgggggcgagggcaatgcacaacgctggctcgtgctccacatatgtcgtatccctcccgggccctacaagccttcttatctctacacatgtgtactgaaagctatatatccatggatgaatggatggatggatcaatcctgcattccctgcttcgttttctcgtggatagatcagagatcggcttgtctgtctgaactctgaagagagatgcaggcatcttgggacttgtaatttggattccttggggttgggggtggcattgcagccttttttttttaaagaacattactcttaaatttggtcaggatttaccaaaccatgtaggacgtgggtaccgtcaccccatggtttgacagttaccgcggtaatcgcgaggtatatttcaaaaactgagaagatcaccgcacgtgataaccacgacaacaaccgtacagtttaatttgtaaaccgtgcttcttacatggttggttgatgttatagtacttgtgtcacacttaatttcaaggctttagcaagatcgttgttgaaatgctcctttttaaatacttgtcagcagacactattcgcattcaactttttggacaattttatttgagcaatgcgattcataaaatatttgaaaatacagcatattaacaaagtatgtgtgttcaacaaaatatgaaaatttcttctaaaaatattaacatgggttaagaatgacaagtaaatgaaaacatatctagagttataattaaccttaatttagttgaaggacactaggacagactgtgatttggattaattagattaactttatgcagtgcactgactgtttgacatttcagggatcttttgtaatcatatgatttgtgggggacatggcaattatgttcacacaacattttcactacaaacaataccagactagcacattatgttatactttaaaataggattttatccaccacaaaaattaagaggctaatgagttaaataacaggtgaatgtggcgaccctacaccaccagccttgtgttatctgaaggaaaattctgctgaaagcaactggacaccaccgaataatcctattgtgaaccattttaaagatggaacctatatgtcggctgtcaagtagcgttggcttgagcagaaagttgtttttctttttctttcaagacaagctgtttttctttaaagagaaatatttgttttctaaaaccttcaaaacatctctttctgctctgacacctactagaaataaaaaaactggcagattttttttttctgataatagaaatcaatccagactctgtattcaggatatatccggccaatcaatatctggaagatgatcgtctgatagcattaagcttattagcttaatgtaaaaccaagttagaataatttaggactccagtattactagaaaaaatccatcacatccatctcatcaaagacaactacggctgggaggtacaacaataatgaaagaaaacaataggtggatggcccaaggataagatagttattttcatccgagtcatctgtgatttgattctttcttagctgatgttaccaactactgatgcaaagacccaatttgcttcaatcctcataaaagtcgtagagcactaaagctcactacttctactttatccatcatatagtacgaaagtacttcgaataagcattgccggtacctttgtcaagaaccatcttattactagcacacactcccttttctgcaagacataaacttgttcccctttccgttttactttctttaatgtatataaatactctacatatgtgagtgatcttacatatcttgagatgaaccgaggctagatacaccaaattttgtacttcaaaaaatatgattccttcttataactttcgatgaccgtaaaatttatcatataacaatataaaattgctaagccgttttggtaaaattatcaacatgttctactaattaggaaattcatattatgcatgcatgatgatagaagaggatatataaattgccctttgatcctcataccaagatatgttcagatacagttcacagctgaccaaatgaaaaggggaaagaaaaaagagaaggtggccaagagtacactggtaagctgttgattggagagctctagttaagaatgctaagcctgctttttttgttgctgtggttgttgaggtgtcggcattagggacatccttatcaccacaaaattttcttaagccgcatattggtatatttttatttctctctctctctcattttattggtgatattctttgtccacgttaggagatgtgcgcgagccgctctctccctcactgggcctttgtgccaatgcgttaggtctaagcgctcatgcagcagtccatccagggatagctgacactgagaatgtgatcctgatgaaacgcagtccacaaatcgcagaca

SEQ ID NO: 66241 - DNA, 3518 bp, Oryza sativa
  unsure (1)..(3518): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttgccctctggcatcgatctgctgtccttagctttcccttttgagtttttcgtggatcttttctcagtcctttccatccttctgcttttttatgtaattgcctgaaaaagtccagagcagaaagtttttgggctctgcttggctattttggttggtgtcttttcagtaaatctggttattttcagttggtgtcttccccatgaatagacgaaaaaccgttgtttagtttttaatgagttttaggattttgggagtgaattgtttattttgcagaaggcaactaaagggtgatttaatcttaaattcaactctgaatgaccgaatttgaatagagtgttgtttcatcatcaccatctcatcctcaaagcgacatgcttaaaatagaaatgaaaacaatatagtaactcatctcatttatatattagaccaactagacataccaaccatacggtttaattaaaaacatacaagaaaaatagctccgatatatagtcaagatagtactagctactcgcacacaccataccaaataccaaaaagaaatcatcccacaaaaggaaataaataaaactaaaataaaaaaaaagaagaaaacaaagacagccacccgaggaaaacgtcacgcgacagcatttgacaccaaattagcgaaccgccgcctcggttaaactgatttttacagcggaaaatcccgctaaaaatcccgaaacagctagaaacccatgttccagacatcgcagctcgcaccgcggggcctaaccgtggcggttaaaaagcgtacggcgtcgtcgcgttccctcccccatttcatccctccccttctcctccccttctcctcgccttttacccccacacctcgcctcgcctcgcctcgtctcgcctcggcgctccgctcccctcctcccatctcgctcgccgtctgagccaaaacccactcggctagccaccggcggcggccgatcggacccggggccaagctgcggcgaagcggcgggtcacctccggctgcgtcgtcgctggcggcggccacttggatgggcggtggatcgggggcgagctcgtcgttgtgttgagggcgtctgcgggaggcttgaggggcgtgatgccgggtgtggcggcggagacggcggtggcgtcggcgtcgggatcggggatctggtcgcggcggcgggacgagatcacgttggatcgcctccagaaggtaggctcgcgtgggcaacgactttggtctggtcggggggctgggtttgatgtgagcggtgggaattcggggtgaatcgatggtggtgttatccgaggatcggactgagacagttgcttgcgtgtgggttggattagcgttttttgtttgtgcgtaattcgcagaagagttgtctgcaaatggcgtcggggaaagctaggttgtttggttgatctgtttttgttttatctaagcttgtgagtccatttgagtggtgaattttcatgcttagattcaatcgggttgcacttggtcatgggcatatatcctaattttgacttctgataggctcgattgtactggctttgagctgattctggcggtacattgctctaagctatggtggcaggtagatttgtacgcctggtttggtatataaacgtggggggcaaaatagtgttaccgattacttcctgtatgaattttggaattgaatcagtcattcctcgttttgcaagagcatggggcacttgatttgaaatgaagtaaaaaagttggggactggttttaggtcgttcatgattatttgagtagcctgtaagtgctgttatgctgatgaaatctgatgtatgaaaatgttcttgttaggaaaataaaattctgtcagaataattttaggaaagcaagccattggctcgtgtagaatgttttttttctttctaactctattaagtttttacgagtttctgaccttatcaacaaactatgcatattgtacacactcttcaatcataaatttcatgccttgcatatttgttcaattgctcatcctgttatttattttcttccattggagcaagctgataaactagtatagttgtaaatataatttgattgaagagtaactgctaaataagacataacgatatttgaacttctttccccattttggcacacagatattttgtttgcagctctgttgaagcatctccaatgatgcaccacctctgatgcttaaaatgtgatgctccaatagtcttgattagagttgtggttgattgatactgtcattaaactactgcagagctatctcattttatcgttgaacagtagattatactggattttattgtttttatgactttaaagtagcacttccctttgtgctggaaagcaaaccaaatagcttatttaagtgtgtcttagtgttatggaggtttttgtgatagccatgttgcaaagggaactgagcatgtcatggttgtggattaaacttgtttcagttctggaatggcttgcctcctcaagcgcgacaggagcttctcaaattggataagcaaaccctcattgagcaagcacgcaagaatttgtattgttcaaggtgcaatggattgcttctggaaagtttcatgcaaatagtcatgtatgggaagacactgcagcgtgatgcctcggatattaatcgtctgaacacaactggagaaacaaggattaggcaaggggaacaagaagacccatcagttcatccttggggaggccttgtagcaacaaaagatggcatccttacgcttcttgactgctttgtaaatgcaaaatcattgcgggtgcttcagaatgtaagttttcaacttgggattcatgtctctttttgtgtagttcattggcgattgtacaattaataactaatttgctctgatttttatattgatcccttctgttactttttcttaagcaacctccaagtcatgtttgtggagttaagttaacctagaagtttcaatgctagtacaggataggtttacttgattagcttataccttaatgcattcaacattggtttaatcaggtatttgataatgcacgggcaagagaaagggaaagagagatgctttatcctgatgcatgtggtggcagtggcagaggatggattagccaacgcctagctagttatagcagggggtatggaacaagagaaacatgtgctctgcatactgctcgcctttcatgtgatacactggtggatttctggtcagcattgagtgaagaaactagattatctcttctgcggatgaaggaggaggatttcatggaaagacttatgcgtaggtgagcataatgaagttgacctccatatcatgcaaatttaaattagtgataacaagttgttttgacctgaataggcattcagctcatg

SEQ ID NO: 66242 - DNA, 998 bp, Oryza sativa
ttctgagtttcttacccataaaatatttgcaggaagaagatgccatggacagggatggaaatgatcttgatggtgatggcttacatccacagaagcatgccaaaagtcctgaactggcaagagaatttcttttagatgccgcggcagttatatttaaagaacaggtaatttgtaatcaaagtatagaaaagaaatgttggaagcaatacttgttgtaatgattgtggctgtacaaagaaagaaaaaaaacttgattttctaaaccacagctcccaaatttgggtgcacaacctgcatatcatacattccatttcaataagatatattttccttcaattgctacttcataatgaaggaacagtaacttaccagtgtttgtgattgctatatgaagtcctccacccacatacaccgtgtgatttgtctatcttatcaaatggcaactgagtggtatgttatttccagcagcactactcctttacctaaggttcatgaataaaagttgttttttgttgttcttgtttctacccgtcttgcccccatcatagcattgtcagtcactttagtcacttctgaggttgtgttttctagccactgttgtagccattaagtacatgccaatctagttctggacctccacatatcaaagtcaattttctttttttattattcaagatatttaatgcaataaaaaaattaaagaacgattctccacagagatatgtacataaggggatccatattcttttatcctgtaatattactagtagtggttactgtagttactaagatcaaatcaagatttatttattgagggttttgctaaaatttcagatgcttatgttacaagcttaagcatatgctaaatatgggttattgcaggtcgagaaggcattcagagaaggtacagctcggcacaaatgcacacagtatttttgtgtctcttgcattagaacttttggaagagcgagtccatgtagcatgcaaagaaattatta

SEQ ID NO: 66243 - DNA, 6394 bp, Oryza sativa
aattcggtccctaattccaatttgagctaaatgaagtcacgggcatatgcatgggcacacacctccatcttttattgttcttttccacacttgctttccaagccaagccaattccgttcggttcatctctttggcctcgtcgctttccaaggcagccatgcttaacctaactaagaacctccagaacgttgctgatgagaaaaaaaaaacattattactccaccgcgctcacgccaaagagatgatccaagctttgatcattcactgtagcctgcaggtcactatctgaatctctgaatttcgtaagatccactatagttaattcggtagttgaacttcggtcgaagtgggattaagcgcttcttaattattttgggccccaaagtttctctcagactctgacggctgaaaagattattacactgtcgatcgagaattcgagattgtagcgaattgacaacctgatgaagggatcgatcgatagtgaggtgtgcaatggacacaggaatggcgggccgtcggtttgttgagatggcctctctcccgtcggatactgtcggtagtagctttttgccgtgttctccgtcgccgtaagatggtgtcgtccatgtgaatgaacactgaagaatgaagatctgaagtgaccgtgtagcggttagcagtctgcagcaaacaaactgatcgtgatcggaaactgagggaggtgatgcataaatcaattcaaaatgtaaccgcgtgattttagatctcaggttggaatctgtaaatagatggatgaacagagtatctgtagtctgtacacgtataaatggcttcaggcatggaggagaggagcgatggccgatgggactcacgccgcgcggcacacggattgtggcgatgggctgagcaaagagtcacggggccccgcttcccaggtgggtcccgctctttggccgggtgggccacccacccaacgaccgtttcacgcatggcgcaccaaaacaaaaaccacacgcgtcccgtcgaacggcatacggggaggagaaaatacacgccgcggcctcgtcgtgtggacgccgaccaccggaggcgcccgtgcgtgggtcgggaccacggtacaccgagtccagcaacgttagcgaggcgcaaaaacaaagggctcccatataacgcaagctgcaagcacgcagccacgctcccattccgcctctcctccacctcgccaccaccaccctccactccctcgtcgtgacaggccggacccaccgccgacgatggacgccaccggaccaccgccgccgccgaccgcagtaggctccgacgtcgacggcggcaccggctccggcggcgcgaggacgacgaccttcttcggactgtccacgtccgccttggtggcggcgggggcggcagcgctggtcctcgtcgtcgtcctcgtggcggccggcaccgccaggctctgcgcgcggcggcggcggggcgcgaagcacctgtcgatgtcgcgcgtcgagcacgcgccctcctccggctcgctccgccaggcgtcgtcgtcgtccgctcccaaggagaaggaccacgcggaggccggggcgggcaccggcaccggcacgagctcctccgacgtggccagctcgtcggccgcggccagctacctggagtcgccggtgaggcggaagccggagaggatcagctgcgccgcggcgatggacatgggctgggggcggtggtacgacctggaggagctggaggcggcgaccggcggcttcagcgaggagaacgtggtcggcgagggaggctacggcacagtctaccgcggcgtgctcgccggcggcgaggtggtcgctgtcaagaacttgctcgatcacaagtgagtactcacagtttttgtttttttttgttcgtccttgttactgttcaccttttgtactgtagttggcacggtcaaaacgggcattataatttccagtcattccagataaaaagatggcaactgtaaaagaaaatcaacctaagcagtagcagtaatttttttttttgcacccttgttaccttattttattagagattttttcactagtttaaatatatgaatgcgtacaagtttgttgtattcggcatcatatttggattttggtctagtttggtgtacgtgatgcttttcttgattaattgcatttgttgttaatttgtcacaataagtggggtggtggttgtagttgtgttgttgatatggctttaagtatgccagttattatggtcatatcattgggaagatatgcatacatgtcgacttattagcttaaacgcaaaatctgtcctagagttaatagcaatgcatcattgtcatgtgtactattaatttctctatgggagggttttcatgaagtttgtaaagcctgcttccgaattttagcagccaatggaacgcatccatgacatatgtagtttgtcaaaatgcaacagaattttacggacctattcccctgaaagaattatttattgattactattcagcaaatgtcctagttcaaatactctggaaaaacctggggaaatttcaaggctcaaactaccggatggacggtgcttgagtggatgattgttttctagtaaaaagtgtaatcgcgcaacttatgaaagcagctgatggactgattagcaacctaacgttgttcggtggcaaattgtcaactaatagatctagtgcggttttattcctgggaagtatgaaacaactaactgatgcagaatttattttatttttatttcaaaagtacacccagtaaatattgtagagaaactcttttttgtctttgccaaaaacaaagggtaggtctttgcgagctttctttctttttttagggggggtggggtggggggggggaatacgcaaggagcatttcttttgtattaagtgaaataaatagttatttacatgaaagaaaagagcagcaggggaccgaaacaggaacaaaaattcatagtaatatctctcacactaaattctcgcgaccaagcatccttctgaatagcagggctagacttactgggtttgtttgacgccagagcgctgcttcttccaccattcctctcgcaatgtcgatccaagccctttgttgctgattgaaaacccgattgttgcattctttccatattatccctttcttttttttctttctttctttcttttttttttgccaggcctttgaaagctttcttaaataagtgtggttcataatcttcagttgtcattttgactggccagacaaaagtcattagagaacctattttttcttgcagaaatatatagtaagcaatgcagaggttcttgcaccctgaacttgcattatatataagtatgactatggtagtaccgatgtcctaggtttctgcgaattattgatgaatttcttacattgtactaaatcaagaagctcatgtgaaccagtcaattctgttcagattaatgtccatagagaaatactgctacttttaagtcaatgttgcaaagaatagttattttttcttttcttcctttctagttctctgcttcatttttttccgattcatgtgcctgtgatatcagttggtggctctttttgtgcttttgtgtgatggatagtatatatccatctacttagttggtagagctcgttggcagtcatatgcaccgatctatcctttctttcaagaaaagataaagcaagagaaagccaaagcgatgagccgatgaccatgcttttccttttctgatcctagacataggcaagaaaatttatagggttattagctttgacgcagttttagtttagctttcaagtaaatcaagtgcacgcacgaggattggctcagggacagcaacagtatgtttgttttttctctgccaacgccaaatgtgaaatggatcagtgagatttctatgcaaatggtttataatgagcagcaagagaagttgatgaattataggtttattatatcacgtacggataatcatgtctgaagaaattagggatgcctgctgatctggaattaaactgtcctttttcaggggtcaagcagagaaggaattcaaggtggaggtagaggcgatcggcaaggtgaggcacaagcatctggttggtctcgttggttactgcgcggaagggcccaaacggtaagtgatgccaccagctctgaatcctcgatgagttctgagcattaataattcagcagaagtgaaaacgggggacaatgcagcgatgcaaataatcaatgccatcatcactccgtgctcacaggatgctcgtgtacgagttcgtcgagaacggcaacctggagcagtggctgcacggcgacgttggcccggtcagcccgctgacatgggacattcggatgaagatcgccgtcggaacggccaaagggtgatgaccggtgtcgatttgccctgaatttccatctctcgctcttccgtatcggcaggtgactgatctgacattgtggatgctgatattgtccattgcagaatagcgtacctgcacgaaggcctggagcccaaagttgtgcaccgagacatcaagtcgagcaacatcctcctggacaagaagtggaaccccaaggtatccgacttcgggatggccaaggtgctcggctccggatccagctacgtgaccacccgtgtcatgggcacgttcgggtatgtacacgcacacgtcgtgacacacgctcactgtctcaccgccgctccgttgttgatctgcaattttttgtatacttcgctagctatgtcgcgcctgagtacgcttcgacgggcatgctgaacgagagcagcgacatctacagcttcggcgtgctgctgatggagctcatctccgggaagagacccgtggactacagcaagtctgtcggcgaggtgatcgatctatgtcacagcagatgggggtgcgtcagtcaatctggcatttgtaggtggctgacatatattgtgttggagcgcgccgtgcaggtgaacttggtggagtggttcaaggggatggtggggagcaggcgggtggagcagctggtcgacccgcggatcgaggatccgccgggggcgagggcgctgaacagggtgctgctggtgtgcctacagttgcatcgactccgacgcgcacaagcggcccaagatggggcagatcgtgcacatgctcgaaggcgacgagttccccttccgcacggtaagtgtgtccacgtgtgagtgacggggctcctctaacatacgtaaaagagacgtgtctatgggttcatggggtgaacccacctgttaacgacttatgagtatgtttggatagcttttagctgcggtggcttctcgcagaatcaaaagttttctcagacagtccagcttttgatccagattatgagaagctgtagttatagaatacagaaaatgaactagaagccagaagctgagaaacccagcttttccagattcttagaaactggctttcaaccagctgcttcttaaaattttaagatcgctaagcaggccctacatctctctaactttatgttcgaagagctgcttcagatgcgctaatggcgcaagtcatatactccacttgattgcgagctaaaggcagctgcatcttgcaggagcaccggacgccgagggcgacgcaccggacgtcgccaaacaacacgcggccgttgctcatgtcggagaaggtcggagccgatgatttggacaggtcgatgtggcgatgatgatgatgagcagctgacatttttctccctcgacacacacggtgtacatttttggttcgtttaacgcgcccggccgggatccagcgtttgataatgttgttgcttttggggggggggggggggggggtttaaattgtgtttggcgtaatgtataagtgacacgatgttttaaaaaggcaatgtcgtccctgaccaaacgttgatacgctccctacgcgactgatggcttcgtgttgatctggccggggacggttgagtggttttcgtcgtggcatgtggcggtgctctgctacgcatttacagtgcaagtgctttactccattgtctcaaaaaaaaattacctcctaaactatcgcggcgaccgaattacccccataaacctaaaaaccagacattgcttactcagaactttcaataccggacgaattaccccctcgacctaatctaggagcagttttatcctacgtggcgtatgcgtggtaatccggtcaatattttatttattaaaaaaatatgagacccacctgtcattctcctcttcccctcttcctttatctcttcacacacacacacactctctctcatggggcggcacgtaggggcaggagctggtcggcggcgcggggacgggcggtgcggcaggcgcaggcagtcggcacagacagggcgctcatggcggcacgcgcggtggcgg

SEQ ID NO: 66244 - DNA, 3896 bp, Oryza sativa
gacccgtacctacgcgccgccgcccagctcctgcccctgcgtgccgcaccgtgagagagagagagagagagtgtgtgtgtgtgtgtgaagagataaaggaagaggggaaaataagtatgacaggtgggtcctatattttttttaataaataaaatgctgactggattgccacgtgtacgccacataggacaaaaccactttggattaggttgaagggggtaattcgtccggtattgaaagttcagtgtgagcaatgcctggtttttgggtttatggggtaattcggtcgatcgcgatagttcagggggtaattcatattttttctactttttcttaaatctaaacataggctatcaaattaaaaaatacaaaaaaaagtcaaatcagtgttagaaactgaattgggccgcagatggcatgggatggccacatgtcaagtgaagcccatgcaagcacactgaacaacaaatacaaactcttaatttcccataaaaacaaacctaagacaagttaagacacatcataatagttcatccgttttttaatatatgacgccgttgattttttacatatgtttgaccaattcgtcttattcaaaaacttatgtaattatcattattttattgtgattaaattttttgtcaaatgttctctaagtatgacttactctttttatatttgtacaaaagaatccaaataagatgaatgtttaaacgtttgtcaaaaatataacggggtcatatattaaaaaataaagatgaatgtttaaacatttgtcaaaaaaaagaacggggtcatatactaaaaaacgaatgtagtactatgaatttgtactgttcggattttttataatccggattttagtttagaatatatcgcatctcatcctaagtttgttttttaaggacggagggagttgcgcttggtagggcatcgaaaaaatagaacgccagaatgactacgacgataactttgaggccggttcagctcctcgtcgatcttcttccctacatctcatcttccctacttgttctacaaactcgccgtatcttctagccttgtatcctaaactattttcctcttcaggtacaccaaatatatgtgattttcattgttattagaattagagaaaaagttgctaacaagtacatgcatggtcctaaatgtttaaagcgaggtcacatttaggtccagaatattgtaaatacaatatttagatactttttaatgtattatagtaggtccagtgcacgtctgattgtgttcgacagccgacgtggctatccaccatgcctacacatatgtagttagccccctctatggcgggggggggggggggtgagggggggtaatgcgcgactagtcgcacggctcccccggcgcgcgactactctgtacgtatgttaacaatcaaatttggtaatatctgcatcggaaagaagattggattgaagcggaatcaaacatgagaattatcgcggaaacagagtaagaatcggctgaggtttggatcggctaagtccgagtcagactgggttaagtgatacaaccgattccgacaatacaacttgtatccgatatcgggtttgagttgacgtacttcaagatgattgccatacatggatagagtcctgggaaggcgattaattgtatctattaattaagatattttatgtaaattccttagagataaatatgggtaaaagtctgccgcaaagacttatggtatcttagagtttgttagagataatagtcgtgtccggtatgggcatatcttgtaattctcgggtataaatagaccccgagccctatgtaattttaaacacacgttcaatacaatttcggcgcatcgccaccctttcgctttaattttattttgacaagttcttgctttcgtgttgagctgcatcggtttcgatcttcgacaagaggtaaaacttgttatgacggcttacgttctcgagattcgtcgagttatcatatatcttacataatctttgacaatatcgttatctaacctactatcgactaacatctgttagtagaaggcagccgattaggttaaattttgacgttgatttagattatataagatatctaccactctatgaaactcccagcggcttgattgtctagatattgttcttcttttcgtacttaatgctgcatcagttgagtttgatctattaagtcgtgcttagaatcggagtttcagccgatcttatctgatttaactatatttgctctatatgtttcattgacacgttaaatctgccctttatgtcaaaatattattgcatctaattatattaagcttctgtttagtatattctgcctgttttaacatcttaacatagagtcgtataggagtattagccattatatgctagatctatctgatcggctatgctatgaacatatataatcctgttattaatgtatatttcgatctaagtgatttatacggtctcggcatggcgaccgaatctatcccaatcacttgatttaagtatgtatcgatataaaaattatatattgttaatatctacagccgatcgaatagatttagttctttattacctatttgcaaccgccgatcgatttacatatgacatcggctcagagataaatgatacgtcatcggcacttagccgatcggctatcatttataggtttaaactgcggtttctttatatttatttcttgttgattgcaggatcaaatcaactggcacgctagcatacccgaagacgagttttggacctacactggaattaagcagatctcccaggcctcgtgtttttcgtcatcaacgtactagtactagtctattacaagtagtactactacactaatgttataataatactaatattattactatatatatatatatatatattatatatatatatatatatatatatatatatatatatatattatatttatatatttttgatgtataaaaaatatacacatacaaagtttatatacgtgtcgtatataaagtttgtatacacgtatacaaagtttgcatgcgcgtacacaaagtttgcatacacgtacacaaagtttgtatgaatgtatacaaacttttttataggtatacgtaaatgctaaaaaaccgaaaagaaaaaaacggaaagaaaaccgcaaaaaactgaaaagaaaaaaaaagcaaaaacagaaaaaaaaaccaacagaaaaaactgtaggccccacctctacgcatgcgctgtcgtgtggccccctccgcgcgcgccacgtgcctcgccgcgcggggaggcacgtggcgcggctgaaataaggtcagtgtcctacaaccaaaaaaattaccataattttcgtgtgtagtcaaacaaagtcaacttttttatgatatccttcaataaatatcatatttcttcgagtgtcatgtagtaaatagtttagaaaacaagatacgtatacttatcctgcactcattttcgacctaaaattgcagccattggttcaacacacacacacgagtgcttttggctaaaatttcataaaagtattaattttaagaaataacattaacagttgtcctctggccctgcatttcatcaatattaactctaataaaacacataaatatcaatcttcatcctaaaacaaatgaatgaatacttagggtttgttggcacacttttcaaacatcagtgtgtttcgtgcaaaaaagttataatattagagttactttaaaaaatgaaacagaatctttttaaaataattaatacttaattaattatgctaatcacttttgtttgcatgcagctaagggcagtcccaatctctacctaggattgtatctatgacatttactatattgctatatagaacttttagtttatgtggtactatattaatta

SEQ ID NO: 66245 - DNA, 1469 bp, Oryza sativa
ctatataagaaatcccaaaaatttaacaagttccaaaaaaaattttggcattggttggtaagtttttttttagcataaagtaaacaagccctgcaacttaccaactgttaaaaattaaatcaatacaagtacctattaacgagtatatcaatacaagtacctattaacgagtataatcttcacctaatgtagaccatttaaaataataaggaaaacagacttgccaagcacaaatgatatttggatttgggcctctaaccgcacaaatcccagtacaattggatttgggcctctaacctttaacaggaccttggtggaattgaaccaccttccatccgtaaccggagagcgtaagcccaacaatcaacggaggatctcccgaactgagaaaagatccacattaccgccaattaagcgaactgagattttcgtatgtaacgtccataactattttgtctaatggtccgatgttgtattacaagttggattttttttccctcaaagtaacaaattttataaaccatttcaaataatatatatattagttaaccaaatatgataagatttaagagtattttgaattgaaccgtttacctcagtttgtgcgtgcacttctttaaacagaaccaaaacatcctaaacacactacacaactctgaaaaaacaaaacaatactcgagtgatttttaccaaaacaatagagcccttcaaaatttgacttggtgttttctgccctacaaaagacttcatcagcttacttttagctcattattaactacataataaactcaaatcaaacataaccttgtgaaaaacgtcagctaatatagtagtgtaactcatcgtgtaaaataaaaacgagtgtcttatccttttggtataacatgtagccgccatgctgtttacacgacccaaattacagccatttacctccggattgacctcaagaaaacaaaccttccgcagcagagacggaactgttatccagaacctccatggtgctcaactctcaccgaagaaatttataatgatacatctggcaattagtccaaacaaggttggcaccccagacttcaaagctgcaacagcttaatccagcataccggaaagtcggtccaacaataaccatgaaaattgatgagcaccaacaattaccaacattagacaagtcattcctgaagcaccatgtaatgagcacaggtgatcacagcaaaacatcatcatcttgcttcagatgtcaagcttcagatgtcaagatcccagacggccacctcaaccaagtttgattcgcaagaatactcctttcttcgggtgacttcaggttgaacttgtcttcaggtcaccttaaaacgacgagagaatgctacaatttctacatagtacaaactatgatgaatagacaaatgctaaataactttttgcttcaagaacataaattctcgtacttcaacgtacagaaactaacataa

SEQ ID NO: 66246 - DNA, 2193 bp, Oryza sativa
ttgcgtagtattccagctgctcttaaaccaattaccaagcgtaactttaatcaacttgagtcaatatgtgagatgcacttctagggatgataatactgctgtttatcagggatattaattggcaatgataataataattaagtaattcaagcaatttaaagtaaatccaggaatattatgtgactagggatattttaaggcagtgataattatgaaacgctgaatgatatggaaatttgattacgactaatattgcacatgtagattatcttttgtaccttggttgttgcgctgtagctccacgtttagattcacgcgcgatcgttgaacgatgtagtcgcagtgggatctgaggacaaccaggggacaacgggacacaagattggggggagaacccggggctaaacaaaataacccccgtgcgaactccccccaggacacaaaaagatcatctttattacggtggcctgccatgcgagcgcacccaacatggcaaaggccaatcttgcgatgtcacatctctcgtttttttttcgtctctttttcttttgaccctcagacacaagcacctcgcttgttacatgttctcttaccttgccgccttcatctcagcacacggctccctcgaacaacatctcttagatctaataattatcgaaagttcatcgaataattatcaatacaaagagacatcatcgcgcgaggccccgatggagaggatccaggcgacgaccagcctcctccctcgccccgccgcttcatccacgccagctcgtacggagcatgccccaaccggacctctaagaggtcagatctacacgcgacaacacaaagaaatccacagatcagcacgcggttgcgacatattcaggaaacaagccatgcaagtaaatcgaaacgaaacatctaagcgacacggatgctgaactcaccggctccagatctgactcgccgaacgcgaggacgagcagcagcagcagcttccgccgatagatccatggccgccgaaggatgagcaagtccatccaagatctgaaacctgcgcaacagaaaaaacaaacgcgtgttgtccatataaagggagggaaaacctcaccgttccggcatcggaggcgacggattcgacccggaatcaaacggaagtcctaccatggaagggattcggggtggcgaaattctagttctgggaggaggagatggggaaagcggctagggttgcttggctacggtgggtggtggagaggcgaaacagaggaagcaaggtatttatggtctggtcagacgcagcggacggtccggatgaggcggttgtgctcggacggccaggatgcgaggcacgtggcgcggcgccattggctgagacagctggatcgcacaaggacaccgcaacttgcggggtatttgacgtcactgcgtgcgtcatctgcttaaccggatcgtttgcgggagcgaacacgaggatgcggtttgtggccgacggtattggggatcctgattggctgcgacgcgtattctagatctgagctatttaggccatgtagcccaattttaggccttttagcccaaatgataatcacgaggtgttctataggccttttagcccaattttcactacagttggtcattgtatttgttggtggaataagtttatgttttctccctcctgtctagccattggtcgaatcgcatccctcactagcaaaacggggtataatgcctcccatttccgaaaaccgatacaaatcaactccttaagtggttttgtaaacgtttttgtcctatatgcgcttaggtggcattgtagatagaaaaaaataatggcagtgggtcccatatgttagtgaagcattcatcctcctccctctttttccacatcccaagccagcaattctggcgagctcacaccaccatgatcatgccgcagccaccacgaatcaagcatcaccctcgccgccacccaatttcttcagcgccaccattgctaatggcggcttgtagcgcccgttccgtcgtggtgcctagcgggaaaactatctcttaaaaactctatttgcgaaatatgtttctttgcttgctgtctagtgtccgtgccatctcagatctcaaatccccgatctatcgccgagttcaatcccgaatctccaatccttcccaaatcaatccctccgcaaaagtctatttggcctccctcgg

SEQ ID NO: 66247 - DNA, 3993 bp, Oryza sativa
cccctttttctcccgccggcgtcatcctccctccgccctgtcgccgatttggccgctagccggagcgccagctcgctggctgaccgtccaaagtcggttcccctctcccaaaccgacattgccatcctataaagcccaggcgccctccctctcttctcctctcgttgtcccatcgcctccactccattgtcgccgcctcccgtgctctgtacgccgtcgccgtttgtcgtcgcgcgtgtcggaggagccggcacgagcgaggacgcggaaggggactccgggcgcgccctcttcttcctcttcctcggcccgaggccgaaacgatcacgtttcgcgccgtcggctctcgtcactgcgcccgcccgcacggtagcgcatctccccgttctccctcttcgctccatctcctccccttagactcgggtagtagcatgagtagcctccccgtagctagccggcgccgccccgacggttgccgtcgctcgccgtgtgctcgccaccgtcgtcgcccgagctcggaagcgccgctcgtcgccggcctcgctcggcgccgctccgcccaatccaacgctagcatcggattcccgtagccgcgtagatgctctcgccgccgggaatcggcccctcgtgacctcgtcaccgtttcccccttcttccgccgccggttgccaccgccgcaatccgccgccgtcgagcatcccccggcaaatccgagccgttggctcgactcccctcgtcccgtgcaacttcccggtgtgctcgctttcgcctagatcaccgtgtttcgctccgccgctcgccaccgccgtccgccgtccgttccggccggcgtcttcttcaacctcccgccggcccgcgtggctgccacgtaggcgccacgtcggcgccagctcggccaagaccgggtcgagccgaccccggtcagccgctccctccggccccgctcgcgggcgcggtccaccgcgaaccacgcgcatgcaccgcgccccgctccacaccctagcgccgcgccgtgtgctccctccgcacggtgagccaagccgctgacaagctggtcccaccccggaccacccgagatggactcggtcccaccggcgccctctctcacccctccccgcgccctattgggccgtgtcctcttgggccggccggcccatttagctcggccgagccgccccttttctctcgggccgcgccctagccgcccgagggaagtctacttcccctccctctaccttttctttttccaaaagggtttaattaaatcatttttcctttagaccaaaaatccaataatcttataaattcaatatcttcccaaccgtaagtccgtttgactccgttcaacttccaaaattcctcaaatctcgagatctatctaatggcacgcttagaggtcattaataggactttattttcgccgtttgttgagtcgtcccgttttgcgtgtagtttcggagcccgaagacccgcagtgcgaggatttcgatgatcaagctcaagatctcgagcaaggcaagccacctttgaacatcttgagcctatatttgaacttaattatgttgcttgaaaaatattatgcattgataggatcgcacttaatctgtttgtcccgtctgcaaggcagattggcggacctacctagtttgttgcatttgatccttcctttgtcaattgttataccatattcacttgtaaccacccagttgcgcctcggaaatcgtgcactctgcacgagtatcgacggtcgccttcaaacttaaaatctgaaaaacaacttgggtaaaacttgggttttacaaaagacttggaaaacccgacacctgggtcggtgcttgcgaactaaatgaatttccaaaaccgcggaccggggatcgtaccgggtgtacggtttctcgctcttgcacttaaggaccgtttccttggaatttcatccgaacataagacaagtacgaccacatgggtggaatgggacacccctggctgagtaactagcttatcaggggagccttgatgccgagagacatgtggattcgccggggtggtgtcggggaggacccctgggcttcctggcacagtatggtctgggacctaacctgttgttggtctgggacccctctcgtcggcatatggtaaacctgtgtcggctttggaaatgccttgtcatgaaagcttggaggtctcccgacgtggctgatccccacgggctgggtgatccgggttagtaatgtcgtgtgggtaaagtgtaccccctctgcagaggttaacaaactgttcgaacagccgtgcccacggtcatgggcggatgtgaggtgattcctagcgtagttttgtttgactactgccttgtgaaattgctgttgtggaaaggggttcaatgtttggaaaatctgcagctgatgggatcagctaggcccgggtggccgtttgaaagttgttggcccgggtggccgtttgaaagttgttggccgggtgccaatcttgaacaattttaaagactgatacattgcacatactccgaccggacgagacgcactgtctcatccgtgtcgtttgagaagcactcacttagttgttttcagaaaagagttcaaataaaatcaattgcaaaaacaacagcctttcgttgaagcctgcattaaacacttatttcccatggcttgctgagtactcccgtactcacccttgctctatataaataatcccccccagttgctgaagaagatgaagcggatcccgctgacgaggagttcttccaggagcaagccggctacgatgagttttagggtttcggcctagttcccaagtcgcgcctgtgttgcttggtccaagtcttggcttccgcttccctttgtaatgcagttgtgagctcgggatctgtccgcagcccagcatgactgtacctctactctataataaagaactttgttgctgtgatattctgtcttcctgtgataccagcactgtttcctgggactggtatcgattaacaggttaatttagagtgtcacgggctagttccggtcgggactagtttggggcgtgacacggctgctttcgaccacaacgctccccttgccacacgcgttgttgtcacaaccttgaggagctcccaccgtcgcctgagggaccaccttcctcagctccaactcaccaccattgccgcccccccccccccacttgcacaagtggatgttttcgtggaggggggcaacggcggcgatgcgtcgaaggatatagatgagagagggccggcttggggatagcaagtgcctcctcgagctcccgtgccatcgtggcctatgatgtccttgctttatcgacctcccgcagcgcaatagcctccttcggcagcaacgttttcgtggtcctgtcacgtccatctgcagcagcttgtccctgctagtcccgccacatccatgcgtcacatatggatggacggcctttgcccctctccctcctcctcacacgtacgtcactcgacgaagatgatcacgacaccaaagagctagagaggaggcatggctgacgcatgactactaaagtccatcctctctttgggggcatgggtaggtggatctgtcatggataggaggtggagaccaaggtgtgggggcgcggcaaggcggatccatctccgccaacctgtccctctcctcctcttcgcaggcgttgatgcccgtcagtctgtccccggaccatggagaagaagcgataccaaagagagagaaaatggtaaagggaaagaagtgagactgacatgtgaggcccactgtcattttttttctatctagaataacacctaagtgccacgtatgacgaaaaccgctttagaaaactacttgagaagtcaatttgcaccggtttccggagataaggacgctacccggttttgtggttgagggatgatattcgaccaaaggcaagagataagggacgcagagacttattcttttcatggccgtgtcatttgggcctttagcccatcttgat

SEQ ID NO: 66248 - DNA, 13495 bp, Oryza sativa
ccatctttcgtaaacatacaggttaatatgggtttagatttttttcttttactatacatctaagtcacctacgtatattcatgggtaatattcgaaggaataattcatattgtcaaaattatttgtgctaattttgtcaacactatttagatgagaatgacatacttatataaggatataataggtttccatgcgacattttttattgtacgtatgtattttttttgtattttttttgtgaatagtactgcgcatattcgtaggatggttgtgcacatatttatatgagtgtctatgatttcgttttagatcattagttaaaaaaatattttaaaaaagttttgtgggatggcatgaagcgatgccacggtggcatgactttttcgataacatcgtaaagagtttcactatatatatgcataatttgaggaaaactttagtgctgcaaagaaagaaacaaaaaaacaaccagacggagcagatcatatatacattcttcttttttttttcctttttgacatctcttgtataggtacgtacatagggagagattagttggtttttagctcgaatatatccaatataatggttgaaaataatggatctaccagttgaagtgtaaattgatgaccagatattttcttttttatatttttccttatactttttttctaatttatgagatctattacgtgatatattaagggttcttgtagaagtgtagaattctattgcttatactgacaatatacttgtaatcgattattatttgctgtggcttggtggcatgctttactttacctatcatttgttgatagttctccacttagcatagtccgttatatatggtgcttcatgacataagtgctcgttggatggtagctaattattaggtgcactatgaatgaatacctcgtaagcaatatgacttgacgattagttgatagaatttatatacttatggataagtggtggcatatgattatatattaggatatttttttattcataaagtatattatatactacacattaaacattttagtaaataagcaataagttctagagtacttatcagattggttgctccttgttttcccagttatctacccattgatataggaattattacaaaagacatatcttttgataataatatctaaatccatctgaaccattttatgcactataattaaattgacaaccataacctacatcgtatatatttaaaagcaacttgtgtataattaaaatatattttatataaaagtttaaaaattaaataaatctattttggctttattatattcaatatttaattaatcttgcactaatgatatgtgtcgtttcatgtatcctgaataagctcagccatccagctacagccatccagctagatcaaatgaagcataagtagaagataaagtagatcagtatggtgtgaaaagaatatatacaatctttgatatttaaatattatacgaatagagaaaacacattcatgataaatttagtgatatcagtttgacatatcattattttttataaggagtaggtaacttttgagaattgctagtcacaattagaattgtttttattttaaaaaatgcaagtctaatttaactattacataatatatactttaattaattttttcttctcattggtgtttcgatgacatgtgcctatatttttacaacgtaagtagagcatagttaatatgggcagtttggttttctatccgagtgaaaaaaaagaaaataaaaagatgtcgttagcccggcctgcttatgacaatatgtacgtactttattaccttgaaatatatgtacgacctattaaaatttggaatacctactaaacgtccgtacttatgtgcacatgcacataaagattggcaatattgggttttggagataattttaattggtatgttttacaatagatctaatggttgaaaatcatgggtaatatacgatggaataatatgtaatgttaataattagcatattattatatagatgggaatgatataattaagaagatataatatggttacatgcgacattttatgaatgtgggaaatactaaaatgacttacattgtaaaacaaaggaagtattatttgttgtggcttggtggtatcaattcttacctatcatttgttgatggtttctcacttagaattgtccattatcagtacttgataacacactgcatattagatgtcatctaattattaggtgcattaagcacggatgcctcataagtaattaatatgacttgataattggtggatagtggtttgtatatgaaacttatacacataggaattagtagggatatatgattgatatatttagctctattcctaattgacaaaatatattatatactatatattttatagtaaatttaaggttgagttctaaaatcttatcggattggctactccctttatggtgagatgtttcctgaaatgattcatgttttcagatactttctatgcaaagtttttttaaaatatcaaataaaaccatattcaagtttgtaatatttaatagttaattaatcttacgctgacgacatgcttttttttcgcgtgtcctagataagctcatctaatgaggtagaccgaatgaagcctaagagataaaaaaaatacatccacatggtgtaaaaaatatataatcgttaattttccaaaaatatatgaataaaggaacatataatatatgaaaatatattcatgataatttaataatgtcatttgggcatatcaatattatacagtagggagtgagtaaatttttagaacgctgctcataatttaaattctttttattttttgaaaatataagtccaataatttaactatgttattaagagatatacaatcatataatctacaattttaatttattaatatttttaatggatgttttgatgcgatgcactatttagaataaaacttgaaatagcatatatttttacaactttaatttaacatagtttttcatctaatctaccatatattaaatgaaaatcgatggctaatattttcttagaatttctataatttattagatcgccacatggcggcgtaggagcgtttctaggggtcctatgtggcggcttaggagggtttctaggaagtttaatggacttttagtatataatagatagatagataatagataatagatatattactactatcttactatatcctttcctgatcacatctacacatagcacaaactgccaccaaaaaaaaggaaaacgaaaacgaaaacgtgtacatgcatcctgtactttcctagatatttccttttgattttatatatccaacaattaggtcaaaaggctcttcttttttttctttccttttttttactcctgctcatcatcctgtgcaattctatgaaccctaatgggaaggcccttggggaagtcgacgaaggggaagacgaaggcttggtccggctcggcgagctcccacctgaagttgagcaccaggtggtgcaagaacacggccatctccagcttcgcgagctccgacccggcgcacagccgcgtcccgccgccgtacggcatgaagctgctgctctgagccaagccgccggatgatccgctactctgcaatcgaacaaaagaagaacacttgtgtgtcaacaattcgaagcgaagttatcgtatcagcagtagtaattattgttttttttttcgcgtcatggaatgatcgattggctgcagtttttgcgcagcagattatcttgctcaatctcctgcaggataatccggacacatgtctttttcgcggctgcatgcagacgagcagataatctcgtcggcgttggcaactacaccacacacagatccattgttcgatcgatcgatcgagcatacatacacacatgcgtcgttcacccctcaacaactaatgtccgtgagtcgcagcggataagaatggagatgtgatggatggactgcagggctccaatcgtccactgattggttcggtttgatccgcttgcgatttggaccaacgctcctggatttttctcgcacgaatgcataatccatcacggcgtcgccgcctaatcccccgttccattaccgcacatgcacctcggttttcaccactgactttgtgtgatgagaagagaaaacaattcgtgggaacaccattgactagctagcacgcaacacggcgaaatgagaaagcacatgcgcgcgcgagcgagcgagctgagctgagcattcactttcatatcaggttcagtgattcaccatgcatgttcctatcgcggagcttgcctctctgcatgattgctgctcgaggcaagcacgcgtttagcctgtgctgcttttgcagattctgacatgatccccttcgcttatgattgacagacactgcccaacagcgacatccgcgcttgtcccagtattttcttttccttgaatcccagcaattaaaccgagattaatagattagattcactgataatcctactgcgactgaccttccatctccagggattgaagcgctgggggtcctcgtacagggacgagtccagatgcaccgcggctaacaccggcaggatcttccatccgcttggaatgtcataaccttcagttcagttcagttcagttcagttcagttagcttctgctgtcagatagaggagaggtcgattcagggaagaagagtgaaatcgagctactcacccttgtagtgcacgtccttgatgaccttccggtgcaggaacctgaccacgtttcctagccgcaacgtctcgtttatgacctgcaataaggacccaaacaaaagaaatatcagtgccaagtactgtatatttcttttttcatgttttgtttcctgaatgcaagttctgttttgggtctgctttgaacgcaagtactacaatctacagtactgcagcgactaaactatcctgctgactaagacccataattacatcacatacatgcatgcaacttattctcgatcggtaggcgacaattgtcgagcaactcatctgaatttctaaggcctcaaattactctgctcctttatctgataccaccacacacatatactgcaactgactggaatggtatttcggcatgttctgctctgccgtctgaacagcaatgcagaagattcagataccttcttgggggcaggccgtgctactggaagcctacaacaacaggtacttgtcatggcatttggatcgttgcaagacgatgggcctcaccctgtagaaacttccaaggcgaaagaacctcagctggctagcttacaaggcagaacagatcgactctatcgatcaatgcacacatgcgtgcgccttcttagctcgatcgatccaaactgaagagagggagcgtaagtactgtagtacgtggcccggcaattatttcgcagagctttcagtctccattcgtacatgacatttcgggaagttgctatctctctacgcaagtgaccaaacaaaacagcaagagctacgctagcacaaagcctttgcaccgatttatattagtagcgtttagggaggagggatcggaaggaacaaagtagggggggccttacacattgcgtgaaaaccatctctttgtagtcttcccagctcaatttgcactcccctcttagcctttgtctccttgcaatcccaagatgctcctcctgcatgtcacgcgtcagtgtgagtgtaactaatcgattcccatgtcatttctgatgccttcgctttctgcaattgttgctctacagttaaacgtagcactgagctagtgacagtagatgttaatttcgaatctgtaattctctgtaccctcagttcttggacagccttggggcagccttcaaggaagaagatggcgagggcgagcgccatggacgacgtctcgtgcccggcgaagagcaagctcagcaagaggtccaggatttgctcttttgaaaggttagattgtttcagagcccatccgagaagatcgtcttgctctacgcttgcatcctccttgctcagcttctcaacccgctcttccattttcctctctattactccgagaatggcagcacgcgactgcaggggaacagtaaaaatacacagtaaacatcatggaactaatgtcgacatagaacagaaaaaaataagctcacggtgaaaagttccttcttatcaggaaaagaaaaaaaatatgtgggacacctatcaaattcagatatggtgttgcctaaccgcctactagtctaggattatgtctcttgtcatagctttctgttttgaagagaaaaaatgtcgtttcctttcgatatagaaaagacacatattgtgtcgaccttcaaatgagagagaggtgttcttcagctgggtagctaccccttttcttttccaagtgcgctgtatgtataattcattcttaaacatccatgttggcagtgtttagttataggcctgcagggtacttgaaacttaacacacggataacaacattctcgacaaagtataatttccgggtctacactaattaactaagagtgcacacaaccatatttacggagactaggattaatttgaccgtactgggtgagataatgcactcagaactccacaactataccaatgatgtttccttgtatattcctcggcactgaacataagatagataattaatccaactcatctggcatttcatgagacatgcaaattaatgtgttatagtgttagcagctgtgatcagtgatcacagtttatttttgttagccaattagtggaagaatctcctatggtgtattgccatttgacttggatcactgatgtgtgggcctgataagtgtgagacctagctacatgttattcacttaaagttaaaggatagtactgcagagatctatttcccaattaaggagaacgctcagtaggagtactgcagtgtctcttcagctaataaaactacaagcaccctttcattaactaattaaaaccaaactgtgaaggttgctggctaatcatccgcttaacgaaattaatgtggttcgggtgtgtggcaaagagtttggtcagcggttgaatcatgataaatgatagattccccagcatataatcatgccaaattatgaaggttggtcatttactttccaacagattaaaaattccacctgccaggttgcatgctgttgagcacagcacagggtgtgtgtatcggagagagatcgtgaaagctagcagcatgcatgctgaggcaatcaataaagatcatttgagtgtgacctcacatgcagtaaaaagtaggcaacattttatgctcacatgagtgatgatcagtacgtccccagggaaaaagaaagaaaagaatctgcatgatcgatcagtccccaggatgcatactcagaagaagtaccaatgcatggttttttgagttaactatatataggttttggctcatgtttggaagataataaatatattcatatgacctctgctagaatttcaccttaagcaactgcctttgagaaaaaaaaaaaaactggacctggcctaaaagacatactgctagcatgcatgcacgcacctttcaatcaacattttttagctttctatattgccaaatagctatggtctattgctagtatgcagtttcaatcctatgttgattatctcaaaggcaagataatttgtccgaacaaatcgtactaaaagacccgctgtgcgagctgaccgattggacctgatctcgatatggatcactaattcactatgctagtatagaactagctgcaacaattcctggaccatccacaattctaaacacatacaccttgtatatgcccctacatatatataataagtgcactgccgtcatgtatatatatctaatgatgggccatgcatatatatgatatatcatgcatgcggactagctacacacaaaaccaccaaacaaaaattaaagaaactaaacctggccctctctagccaattcctttctctaaactcttttccccccgtgtgcataccaaacaaaacattgacagggaagtcatcgtcactcctacacaaatatatagtatatatattcacttatcactcacaagtcgcaaatcatctctctctcctctccaatataaatatgatccccttgcgtacatctcgatcgtcgtagtaacttgttttctctttagataatgaaaacaacaaaaatggtttacatctctaacctctgtcaacagggacctgcacatgatcgtcgttgcaagttgtttgctttagctaagctgggtatagtagtatatgcctatatgcagctgcttatagtatgcatacggaataggggaagaaaggaacctggccggccggtcataactcatatgtaaagtactctctcctcctaaaaaaggcaacatagacaaagatatgatgtaatctaggacaatgaatttggatatactcctgtatagattcgttgttctaggttacatcatattacttgtctaggtcgttttttttttgaaacggaaggagtaaaactcatgcgcgcacgactttgcgcgcgtacggccggggcgcagggtgtgtgtaggcagagagggacatcgatcgatcgatcaatccgcacgggtggggtggtagctagctacttcctccgtttcgaaatatttgacaccgttgactttttagcaaatgtttgaccgttcgtcttatttaaaaacttttgtgagatatgtaaaattatatgcctacataaaaatatatttaacaatgaatcaaatgataggaaaataattaataattacttaatttttttaaataaaacgaacggtcaaatatgtgataaaaagtcaacggcgtcaaacatttcgaaacggagggagtagctagtagctacgagtacgtaccttgagagccttccagtagggcgtcccgggcaggttgagcggcgcggagaccacgcccttcatgaaggtgatgtactcccgccgcagccgctccgtctcttcctcccccgggtccatgctcattatgttcttcgccatcaggttgaacgtgaactgcacgcacgcacgcaaacgcgcgtttcattgatattgatcgctagagcgagctgattgatatatgcatgctcaacttaatggaggacgatgtgtgttgtaccttcttggcttggtgctgagcggagaaggtggaggaagggggccaggcgcggaggacgaggagggtgtggcgctcgacctcggggaggaggacggcgcggaggcggacggaggagaggaagttgagggagatggcgcgcatctcgcggtgcgggtccccgacgaggaccagcatggaccacttgcccaggatgccgccgatgctgcgcgggtagctgcactcgaacagcctcccctcgttctgcaggatgtaccggttgagccccgcgtccgccgacaccaccgtccgctccccgaacaggctcgaccggtatatcttcccgtacctgcatgcacgcacgcacgcaaccgcacgccaccccccagctcgccgtcagcctattattaccgatcgatcgatatcctagctactagctaagcttgcttcacggcgaggcgagcagtgcgcgtgcttatatagctgtgtgcgtgtaccgagtaatgaaaccaccgaccgtgcgatgtgctgctccatgaagcggccgacggaggtggcggggtgggcgcggaggtagccgaacgtctcgccgacgagcggccacccggcggcgccgggcggcaggttcatccgcttcctcttcgccggcgtcgtcccacctcgccaccagtgcccgccgtggcatttggccacggtggtggtgtagaacgtgagcagggcaaggaggatgaaggggagaaagaagagcagctcgctggttatggacgccatcatggcggccatcagcctgcaagcaagctagctatacaccgatcgagatgcccgccgactgccggccagttgctctctcttcttctactacaaaatttatttatttttccctcttgctcgccaaattacaagagtatcctccacgcctctgagtctgcaaaaacctttctgctggctgctttgcgcaaagaagagaatttggtagctaggagaggaaggtgtgcccacttcacctcgctctctgctgtggacatggggtactcttatataagtttttgaggcgtgagacaggaagaagaaggatgtggttgttgcgaggattcttttgctataattcaatttttggtgtggcgcaagcatgcaggggaggaggagtggggctcctgctagtagtaatagctactggagtagtggtattttttttcccgctctacttgccatacaatggaatactataatgcatatattcatgccaagatatataatacatacaactatagtactagagattagtgaataattaacaaactattctaccgttctgatcctgactaatgacagggtctgcacaggaggcgcctcttgttcagttaaaattggcaggatgtggatgtgagaagctggttatgtttttatttgtcacatgcatctttttttgagatcaggataatataaaaggtaaactttctttcaaaaattatatatatatatatatatatataagttagactagcaaagtcttttattacagtttagtatagagatcacctggatatagaagaaataaagcaatgctccactggttaaacaacttgtaatctgtctcataggaatcaatgggcaagttaggtctcctgcggatactatagtgctaggttttcatacttgcacgcttcttaaaattccacctttgtatcaaatttcaattggcgctaatttcatgggctggttagcggacatgcatgttgcaaattactccatactgttgtagtgtgttgtacatactctgcagtctgcacccttaaaaatagaatatctagtagtatagtgtactaatataatgcaacaacaggtcagatgctaattgtgttttattcttatacagttgaggatgtgaacatacataattagtcaagccaagacagtacaaacctatgttgcatataacatctaattaatgaagacatagcacttcccctgctgtgcagacggctgcaaaatcggaatcatccaacagataatgacagctctactggatcagagtctaattgattgctagtttgccgctactccgtggctctgtgtgtattgctggaaatccaaagatggttgctgcggctacagcagcgccgtcatgccagctctgctccatgtccatcgcctctacgaggcagagcttgacctttgctgctgttatatgacacctgaagatccaaacttacccctacaagtatttgatatttagaacaagatttaatcaaaaatttcaactttgaccaccagtagtttctcaaatgctagatttaaaaacataaatggaacactgaaaattaccatcataatattataactcattagccgccgtagtattttttttccttcctagctacttttttgttttgctttttcttccttcccctagcataaaccggtctggctgattatgttgtgtataaaaaaaatttcgctctaatatattgacgtgcaattcttttgcgcgttcgtgaaaaagattttacaatcattttcaaatataaaactgattgtcgaagttcaaatgtttaatcaaaccttgtcctaaacattaattttttgcaagacttttggctcttgaatataatgtgaattgttatatatgaaagagtctacaaacaaataacataaaatgtagtgatatagaccacttcacaaagaaaatgttcactgcctaacttgaatttaaaaactacaaattcaactatgagtagtgcaggtactgtccattacattttttttcccttgatgcgtggatcaagttcaattaggacttgaaatttttgggatgatggatgtaaattgttctagtgttttcaattactagtatgttgggaagaactattcattatgtggtagtatttgagaagtgggggacatccttaatgattagaggactttctctaagatgaccagcttcttaatttacaaaagagttgcacctgaattatgtatttctaaatagaagaaaaacaccactagttaatgtattggtgaaacatgcatattcatatcatgatgctctgtcaaggtcttgaactttttattagtatactgatttatcatttgagttgaaagctagccagcatcgatctgatttgttttagaaaacagagcatgaacagtattcttagtgcttccagcttgttaacggaatctaatggctctcatcaaaactgattggtcccgttcatccacgaacggcatgagattccgtagcactgacaatcaattcttggtagcctgatcaatggcactggcagagagatggcccctgcgccatgaggaagcatggaacagaaatgatcaaaaggaagggtctggatccagatttccagataggccagcatcattgttaatttggtgccatggaaagatgattagggtgatgtttacagataacttttttatatgtatgctgcataattcgtggctgttgctgcggtcccatgtaattatggtgtgatgcacctttaatttatggacagaggcctggaggttgcgaaatagtatctgttgcacgccctgcccctcatttagtcgatgttcactcaattgttatgcgtatggatcgtatgcgtccttgtggtagtactcctacctcttaagaaaaaaaaatgtaatcatacggccatctgttgtctatgcataatttagctgggcagtgattactaaatcgctaaataaaacgacaaaaaaaaatagacgatggctcatagataaaatccaaagagtaaattgcatccacggtgcatcaacttgacaggtgggtgtaatttggtgcaataacatgagaaatgaacattccaatgtaacaacttggtaagtaggtgtaatttaatataaaaaatttataagtgatcgtataaatgcaacaacttacaagttaggtatgattttgatataacaaattaaaaggttatgtgacaacttaattatttgcaacattatatatatataaattcatttttaagaacttattttgacaatatactagcgcggatttgtataagtatatttatatttttatcctaataactaatagctgaaaatcaattaaactggatgtagaaattattatatttcgattgataattgagaaggtgaagaaaaaaaaatcttaaaggtaattggatgtaaattgtactactatgtgcagtataattcataaatattaaattcaatataaggtaatatccgtatgattactatgtaatggcatgttgacatcgtaaaaaaactcacctaagatatacttagccaagttaatacaacaaaatactaaattgttaagttattgtactagaacgcacctgacggagcgtggggtta

SEQ ID NO: 66249 - DNA, 3606 bp, Oryza sativa
agtcaaaaaaatactaatttaaaattttttgaataagacgagtggtcaaacgttgcaaagacaaactcaaaatcccttatattatgggacggaggaagtagatttgtagctagaaattcgttgttttatggagtagtcgtacgtcctctctttgctctgctagaacttctctttcgatcgaataacgtcgtggcacgtaacactgcacgttctggtctacaggacgttcaacgtacttatgtatcgtagactgtcgtacttatgtatcgtagattgttacgtccaccgattcgccactgctttaatgattttccatgtactactgctcgtctgctcctagattaattagattgtgttgtggccatggattaatggagtggcagtgctattgttatccaccccaatagtcggagcggaagaaccatcatcagatcgaccgaaagagacgtcgcacgcattatcatgtccaaacgcttcgattttgagatggatactgtttctttttctcttcctttggccgaaaaacagtagcgcatacctggctcaacccctgcttcagaatctatagtatgtacgcagggatggggctacccttgtagcgttgtctcgctccgatgggcatatgtatgaggtatatatcgatcgactattcaattcgaggggcttaattactttacgtgggcaggtggagcaccatcgagttctaaaactgtgagctcagccatgttagggtacatattaagggtgatgttacgaaaaacaccactaatactcctacatttttggcgtgcacacggttgaccgatcgagctaggattgccctgaagcgtacgcagtgttggagctttttgttgtttgttaactgttcctatggtgcgtgtcggtgtcgagcctagtagtgagtttccaaccgttgacgtaatatgtatctgagtttttctcctaaactattttgagtcatatgtctcggaaatggatataatatagggaaaaaaataaattacccccctaacggtacgaattaccccttcaatttaaaacggatattcttcactctcaactttttataccagattaattaccctccaaacagactgcagagcgattttgatgctacgtggcgtacacgtgacagttcagtcaacataaaaattgatgaaatggatggttactcaaaataaaaaaaaaactaatgaaacagacgtgtagggaattaatgtagaaactcatacgtataaaaagatagagtgaaacgttaggatatagaagaaattggatgaaatttcaaggatgcacgagaaatttccttgaaagagcggcaaacgcattcttggtgaggtgggcgctaagaaaattttttggccatattaaatgagtgatattttgttgaatgagactgataattgtgttattaattatgcttcactataattatgtgacaggctactctagtctcttctagtgattattttgccattaaagccagagaaaagtaatgcgagacaatgagagacctggagctagggctcagggcggtaagagtattaagcttccatctagctggcaaattgtaacagcttggaatttgattttaaaaagcacatcatgcgataaaatatgccaataaaaaaacagtcaaccaataacgaccatacacggagtatggagatgggaaaacgtcttgtatagtcagtaatgacttaaggcttcttttggaactctcagaaatttaattattctgatttgttttgaaataggggcgatgccccgcaaaaaaaaaaagggcgatgaaatttaatagctcaattgtttgctcttcagtttataagtcgcaagcaaaatttaaaatttaaacttaattttagagttgattttgatgttttttcattgtagtttattttccaatattgtcttttaagttacaaagaacacatgtatgaaagtttaaacaatttagttgttaataagcgttacgacatataattagctgtaaatgaaatgatggaacttctcgaaaagtatgtgccaaatagtatcttaattagatttgtgcggtgctatagttttcctcgaccctggtcatcctacgaccatgcgccctaaccctagaaattaatatttgcctccaacaatgctgtgaaatggatgaagttataatttatatgaggtcttaaaaaattgagcgaattattagccaggattttcttccagccacgtgcgagactgaaaaaagagttaatttggtggcttggatacctggtcacctggaagtaaacccacccaccaacccacagtacgattttctactcttattaaagtagggggtaatccaacttttttttccaatagactcagaattaatataaagaaattaaaccgtgacatgttaatggtctcaccaacagttgagttgttgctagcctttgtatcctcctgttttgctctctcatggcgaacagtacgtagtaacatgctcagatcagtggtcaacggttggccggggaactagctaggcctgatcataggacggcaaatggtgcgaatcggatttccccatgcgccgggcacatgcacacatattgacatcaagagattgcaaagtactattcgcgaatctcgcagcaggttgcccgtagctgactacgtacagtacaccccctgccagctgatgacgcctagctagtcgtagtcggccgggtcaccaactcaccatggactggcggcaactcttgtacaggatcgcgtttcacctgccatttcggtgatgaacttcacgggagttctcacgtgcttaaagaaaaggtgtagtaacagtgcacgcattttgtgtgaacagctcagtgcgtgcaggtgtagggtaggagtcgtcgggagatcggtacgatatcaaggaactaggacagcattgtacagtccccgtacccttttttcttccgggaagtacccaactcacgtcaacattgtggttggcttggctcagtcctagcatgggaggagggaaaaaaaagaaatcaatcggtttctagtgtcaacactcaacacgagtacacaactcgcatctacgaaaaattaagtcccaattataagctacccattccgtttcataatataaatcatttaacttttttaatcaaatttatttaaatttaatagagtttatttttcaataaaaaaataaatgtattatcaaaatatattgaattttaaatttaataaaactattttgtataactattttctataaatttagttaaacctaaatagttttgaaaaaagccaagcaagttataatatgaaataggatcatgcatgcatcctccgatccgatgggctcgctacaggtagcccaagtacgttgcgggtgcatggtgggcaagggggaaacagtagtttatgttgccgctatgcgtcggtcgcgtagtatggctcatcaccaaatgcacgtcgccctcgccgcgcgcacgtgtggtggcgagtcccgccccgcgaccgcgtagtaggactaggagatggatagactttactagtagcattccggtgggccgtcggtccgacgcgcgcgcgcgcgcgagggcgtgcggtgcgagcgccgagagaaagattccc

SEQ ID NO: 66250 - DNA, 4991 bp, Oryza sativa
cggccgtattagctggctgcatgcccgggcgcagcggtggctttcaaggcgctactggtcctgacctgcacacatacacacacttatcattggcattggggccctcgcatcgaagctgagagtagagtgggtgtgcgtgtgcccatctcgatcgatcggtgtccaaagccttagctatatcgacaattaagactgcacagctagctgcaccccactgttccaaaggctcgcgatccatcgatgtgtacgtgtgccgatcgatcgattggattatttgggtgcatgcacacaagcccgtctgcacagtgccactgtgtttggagcagtgcgcgtgcgtttgcatgcgtggccgatcgctcctctcacacgctcctcgccgcgtcgacccggcggacgtacgtgtggctttttcgttcattctgctggggacgctgccagttcgactgttggataatagaaccgccgctcggtttcagatgctagtggctctgggctactggtactgatttttgttccttggcactgttcactgttacatcggcaggcgagatagatcagccggtggccttggactatttgccggcacggcttcgacgactactcccgtattttattaatttgctacccaattttctatcggtactccgttttgcaagtgcaaatgtgtgtgcaactcatttatatatgacggctgcggtagtagtactgtgtagatacatatacacgtggtatgcacatacacaaattttggactacaagcacaggacgacccatgtatgactactgcagcatatgattatgcttggactgtgtacatgcacgcatggatatcgagaaagtttgcacagtgccatgcgcagggatggccaaggaaagagtttgaccgaaaaggaggcatgcattgcatgggctacacacctttgcatcatttctgacgaccaccaaaccccatcctgctcctctgaatcgatcaagtggtacttcgtccttgcagcaataaactatatgtgatacttttagcatatagaacaatcaggaagctagacaagaacagagatcttgcttccaaattaaacatcgtgtaatcgagcaaaagctacttaaagaaagagtaatacctaaaaagtaattcaataatcactgttcaagtaattaagaactttgtagcctgaacaggttttctgggattctgtctgatcaaagctatttaaaaagagatatatatgctcgaaaagaattcagtgatcactgtgcaagtgatttatagctctgtataggctgaccagcttttctggagctttgtctgatatattggagtatatatatagtaacaagtaacgggatataggctctgctagatgcgtacctaattgtgcgattgaaccgtgatttgacctgattttactagaagacatgtcggcaatcctgcgccaactatcaacaggttaaaaaggaggaagagaaaatagaatagcaagtgtcggggaaagatgttgtgatgtcgctcgaggacatgatgaatgtgcatgaacaaagatgatgctgatcagaaaagaaaaaaagaagggctccatagattaggctatacttttttacccaaaaatgctaatgcaagtgcacaaggatgtgtcgattgctcaacagacaaataggttcttttgatcaaagggcaactcgatgagcttaccatccgattagtttatagttaatgtgcacaacaagtgaccaggttagaagaaaagcagcttagccgagtttactttagtgcaagctgaagtgtgcagatcgagttgcgtctgcggctagcgacctcaggcctcaaaaggccatgccatcagtcagtgcgggcacttgtcatgaccccctctggtcctaattctgcaacttagcatctccattgggcactcactcgtgcggcacaatatgctccagcttttggctaattcggctcctgcttttggctaattttcgcggcataggagaaggtagctttcaactcgtgaggaagagaacacgcgaatgcaggggctcttcggacagcgaaaggcacaattggtcactggttgggtggtggtcaatgacacactgatattgtttgttgttgttgttgttgtgcgaggaaattacgagcccgggaggatatggtaacctaggaggaggcgcccgtgcaacgccctgaagcgtacgtggctctgcgtggtgcaggcctttctgataaaagatgaaagggtcctgccgcttttcggcccaccttggggatggaagcgtgggtggtgggtaggcacatcgcccaactagacgacgcccaagtccaaactatatttgcactacaaccagttgcttactatatagatctttatagcctattttcagctcacttatatagcggttaatatttcactataaatatatggtccacaagtctgtctaacggattttcttagttcctgtgactaaaccagctataaacttacccgcttcttatctttctcctctcctctctcatcaactcagcatttagtcttcttatagccctctattatacttctattatacttgctctaccagtaatctactagcggccgaggtggtttcattcatcaaacgatgaaaagcgtggcagaatgggggcgtgcaaagcaatggagtacacatatacttgctgctgcttgggtgccagattggcatggttacttacttaccggaagactagcgcacacgaaaagcagcaggtcaaatacggaagcactgggcactggctcgagagaaaattttgcaaaagcatgtgctgaaaattttgagtgctcgcttcgggcttgagacagatattttgctcctgtccatttctgacggagctgcggctggatggatggacaggctccccgtgcttccccccctcggtggatggcaaacctacctatccacttgtggtaagatcttacggccattggcttgccctcgacatggtccataataaggtttagtataactcgccaccgaagataatgattccgggaaaacgacggcggtttcccaactcgggcgacgtggcgacgcgcgcggcgcaaaccaatcgcgccgcgggcgagaccgagacgagatcacgatatcgccggaggggttgcgcttgcgccgctgggtagaggttggtgggagagcggcatcggcgagatggcaaccgctgctcccgccgcggataaacgcatccggcaaccggcatcgaacgttccgatcatggcacagagctttgctccgacaagagctaagctcggagctagtaacacagtgtcagtggccctgtgccgaaccatggacaatgatgatggccttatcccctctggtaaccagacagtgcgcttggactgaactgtttctggcctgatagctaatgtaagttatcctggtgcagtggtgcctctgccttttttacaaggcactcaagctctcgaagaacgatgccagcaatcagtactgcagaagcagtgcatctgggaagtatattaaggatttaagaacatagcaggaagtgcaaaaaagtggctgctgggccgacaacagatgcataaatgggctcacattagttgaacttgaaccacaggttgcaacacacttgggaagcaggatcttcagacgaaaagaaaacagaaccgaagcatacggtgtccgtattcatactactccctccgtcccataatataagagattttgagtttttacttgcactgtttgaccactcatcttattcaaaaaatttgtgcaaatataaaaaataaaaagttgtgcttaaagtactttagataataaagtaagtcaaaaaaaaataataattctaattttttttttgaataagacgattggtcaaacagtgcaagcaaaaagtcaaaatcctttatattatgggacggagggagtacatgatatgctaagaacagggaaagcagatcacttgacacagaacaaaacataattccaagtgaccgacaattgaccagttatttcacatatgcattagtgagcataatcacaacaaacaggcttagatatccaaagattcactatcagaaattttctaacggtagcattacctttcaaaggcaaagctcgaaaaagatgggcaaaaactgagacaagggtgttggtgcatatgtatgtgcatgcaccaaaacagaataggtaatacattcagacatttgggtgtaagttgaactgtctgtaaattaagtaaagcaggcaatttcctatttgcagttgcgcggttttactacaatgttacaagatatcaaaaatatattcacatggacaaaggtaacaacaatctcctttctcttttcctcttcagccttctatgcctagatattttgagacctactggaaggagaattccgaaaactacaaagatggctgaaagtctgaaccatctcaagtaaagggcaacatagcaggacaccatgacaaaacaaaacaagatagcatagaagagagcaaccttgagatcccgcctgcaacataaaggatcatggatttaagagcaataacaaaggcctcagaagtcaaaacagaagcagaagcaggatagcaacaaccaacagattatatattgtgctaccggcctaccgaaatgaaaatcacctaggaattccagttgcgaatacctacctaaagctcattttcacaagctatagtatttcctctatcagtttcattatagacaagcaagatactttctatatagtagtttagactttaaaaaatcaacaaggatttccagattgcaaatactaagagctcatttgcattaaccatgctacattcagtttgctagttcttaactctgagaaagggtatgaacaatttcaggactatcgcattcaattggaaaaatgagcacattgtgttcactataaactcgatgtttcctttattcactccagcacaagctaagtatgtcacaaaattgcctaatataatactccctccgtcccataatataa

SEQ ID NO: 66251 - DNA, 10881 bp, Oryza sativa
tgtagagcccgttcagattgtagccaaaataaaccttacaaagttctggcaatgccaaaattttggtaagatgacaatattaccaaaatttggcaggatttcttatgtattgaccaaatttggtaacaaactaaacgtagatattttttttggtaactttgccaaaaaaaatatggttgaaaatgatatcaaagtgaacatacccgtagtcacaactcacaagctcgggccatgaataggagatatacgatcttggtctatttgattactactacattattttggcggattatctatttgattagacgtgactacacagctagtggtagctggtttgtctaccactccatctataagagacaccatccacctatatttcaaatacaattttctcttaaactactcatccgatctacgatccgattacaccgttgtgttcgtaacaattaaatctttacaacaagatctcacatgattatattttgatgaaaaatcacaaattacttttatgatatgtctaaattacttttagatttcgctaagttacttcttagacatacaaaagtaaattcagtaaagcttaaaagtaatttacatatattataaaagtaacttataacaaaaagaaagtaactttaattaatacattttttcattgaacaaattatcatatatttaattatcatatatataagttacttttaaatttgattaaaatacttcctatacattcataatgctctgaggtgattacttttattattgtttctttattattgtttttagttaattccataatttgtgctgattaatttaatttctagatagagtcatgtttttatctctacaacggatttacttgaaatgacatgccaaagttacattcgttttgttctaagttacttctataatatatgtaaattacttctaggctttactgaatttacttttgtatgtctaagaagtaacttagtgaaatctaaaagtaatttagacatatcataaaagtaatttgtgatttttcatcaaaatataatcatgtgagatcttgttgtaaagatttaattgttatgaacacaacggtgtaatcggattatagatcgaataagtaatttaagagaaaatttcataagaaaaaaaatatggacaacctaatagcaaaaactacttgcatgcatgtctgtaacgctactagtacttctcacgcaattgtccgcgtcgctcgttaagtataaatcgagatgcctctcgaaatagattttgcgtatttgattataggaagaaatcaaatgtcttgagaaaaaagacctaaaaataggttaaaataaatgatctaaacaatgcaatagaagaaggtttctaaggaaacatatctttagagttatggagcaaatgatccatgttaataatccgtacgttgaagtagctgaaaaatactcctttgatttcgtattataaggtgttttgattttatttttagtcaaagttctttaactttgaacaagttaatagaaaaataattaatatctataataccaaataaaatataccatcaagatatactttatattatggtgaattttgatgaaactaatttgagattgtagatgtcgttgtagttttttctataaatgtgatctaatttcgagaggtctgacgatctttgtattagcatgagaatgagtcctttactcctttacttcacctacacctgaaaacactatgctatgcatgattgcttgcacgagagcacgtactacgcagtttcagaggatacactaatgccttccgatagcacgttgtgacttgtgagtacacatttttgactgaattcacatgaacattgggtgcaagacttgatgaacgacctgtcgaccttatagcatctccaacagactactaaaatccggctctccaaacacccatatagccaactctttatctgatttagcaagtcaaactagttcctcgctccaatagactctccatttgtacttttcatcctgagtctatgacaatggaacccacatgtcagcctccaccgcccttcttcctcttttcttccttgcttcctcttttcccgctagggcaaccccatcggcccatcctcgagctccttactggccctctctgaagcgaggacgccagcgcacgtgaggcggggggcgacggcgacggggatccgcccgcatgaggcaggaggcaacaacgacgaggatccgggcgggcgagaggcgatgacgacgagatatccgggcacgcgcgaggtgtatggtaacgacgacgagatccaggcgcggcgaggtggaaggtggcgccgacgagatccaggtgcgcgagaggtggaaggcggcgacgacgagatataggcacgcgcgacatgatgacgacggcgagtgcggaggtcggcggtcgcgacgagcgggggccggcggctgccgtgctcgagctcctccccatgcctcctcctcatgctcctcttgtgcctcctcattggttgccgtgtggggatagagaagactggatgtgtggggcccaccattggtcagccaaatagagtggctaaatttggctagtggaggaagggttttggtcagtcggatggcttagccatccggttggagaggttgttggagcatgtttttttattagaattattaaaatttaacttgaagagtgagatgtagagactgttggagatgctcttattagcccgatacaaacagttctcagctccctattttatttaggaaacaaaaccctcagccatcatgaaccacatgtgtctatttacaacttgtacattgcccctgacagtttctgtctgaagtcgcctaccctgagtatatatatacatacctacacatgggatgtcagcgcgtaatgcttaaattacttacgtataaacgtgaatcacatatccacacacttgctatttgcgcgtgtgatcactccatagtacacactttgcctagtttgccttcactgctggaacccatctttaacgcttcactgctggaacccatctttaacgtcggttggaaactgacggcgaatccggaactaaagatgtccatctttactcccggttaaaataactgggacaaaacaccaaccgggactaaagatggcgcagccacgtgtcgtccaacaccatctttgccatctttagtcccggttgatagatcaaatcttcccattgaacttataaaccggactaaaaattatttttagtccctgttttttatgaaccgggacaattgtggtttttcctcgacctggtaaagatcatttctccagtagtgcttgaagtgctctatattttcggatgctgccgcgagacacgccgactctggcctgaccatggttcccattttgccatctcgataatccgagcaaacagatcgcctaaactacagctacagccacgcaacacgtcaacgcaggctcggagaacggacagagacctactcggtccggcttcagtcatccagccagccatttggccaattgcccatgtccccgaaaatttcacagaagaggttttttactgttattgaggttatggagtaccaaatcttgatcattgatctggcatcatccaacggtcagaaatcgtccgtacctcatggtaccgtaccttctcattgaagtggtactatgggtgggagggaatttatgtcattttctgtttcacgagagaaaaaaacgtcgggagagcagcggcgtggcggctagctcgagggggacggcggcgggctggatgcacggcggcgacggatgggcagggacgacgaagagaggacatctgtttttattagactgatcatatccctgctaaatcaatggttagattagattggtacctcatgttactttttcaaggatgaaaaagatgctcttcacagacactgccacttaactcagccgaattcgaggacgcccaagtccaccatggccaggcagccgatcccccgtggccgtgggccgtgggtaccgcgggcgtccgtgacaaaggggacccagccgcgcgtggacacggtggcctggtagccttgctctgccttgtggacgatggtgtgtttaatttgtgagttgtgaacttgtgatagagcaacgggccagtaaccaccgacgaggaggagagcattcgcactcatacgaggttgtcagcagcacaggtcaaagcttcttgtgcatactactgcaattaaccggggcaatgatgaacaagaggtgaaacgctgttttcttcccatatttgccatcatccccatcacgatccgggtggcattatggcatatggaatcgctttacctcactcagcgagcgccagcggcttaataattggagatgagcaccggtgattagtatacccattaattacgacgataaccacccgtgtggctgtttccgcgccacaacacgactcgcccatattcgccactcgctcgctcatgcaatcctgcttaacgtccatgacagattgttgacagacagcaaaatcccatcacctcccgaaaccaaaattccaggtacgacgctgatctgctctcgcgagtcaggctcacggcacaaccgcacagccacatactcgtcacgggccatcctcgcgacgatatattgacatgcacattttttacgcgttcacgaaaaagatagaagcaagtacacccgagaaccgagaacgatgtatcgcctccgttcccttccctgatcaaagccactattcgctgtgccgatccacactgcggttttattcttaaagcttatgattaaactaactggtgagaaaaaaatgggttctctagcttctatcttctattttatttttttctacaactataaattctaaaagtctaagtgaaaatttagacggtctagagaaaattatgttatgcgatgatttaaaaaaaaattgtagctatcagaatctcctctaaacaagtcttacggctcacctgcttatcaccattatctttatgcttgtgcttatcagctaaaatttaaattttcaactttaaatttagagtttattttgggattttttttattgttgcttattttttagcctttgcttttagatcgttaagaacacgtatataaaagtttatttacaaattatttttcatttgtaaatactaccgtttcgctttttcctcttatatgccggggctgtatttctcggcgagttgacgcaccaaaggagaggggaaaaaacgcattggcgggccgcgccgcgcgtgtagacgtgcggtcagaggcaggcaccgcgagaaaggaggcgaggcgacggtgaccgcggcttctcccgcacacaacccttgtcgtcgtcgtcgtccctgtcctgtgctgccgaccccacggtgtcacctcgcgccccgccgctttctctcctcttattttacgcagcaagcaagggggccaaagactgcatcgacgactcgcctcctcctcctccttcctggcctctttcctccttgtcttcttctttgcctctcccattgccagtttgccactcgagctcctttgagtcttcgaccatttcactgatcccaagtagtagccataattggactcgaacatctgagaagctgcggcgagattgcatcaagcagtaggattcttgttgctagtagcttggctggcagtggtggcatgggggcgaggaggtggctggatgctgctgtcacctctgggctgctgcaagcgctcctcttccacttggcaagtaagttctttccgcgctagagcgcttctttctcactcaagctgtctcctgcgaattgtgccagtgattcgttgcttcttgtacatcattgacatgctaccttgttgtttcttatcgcggtgaaagttttgatttcgtttttgcattttgttggtagatagatagatgaaatggtatcaccgaatcatcttcagatcatgtttcgctcgctggatgcttattaactggttagcttagttcggttttggaatagtggaacaatggcttcactttcgttgtgattctttgttcctcgaattagcgtactgcactagaatactttagtcagttcagcgaagtggtaggacgaaattctgcgtcgtttttacggatgcaggttactcattcgtgccgagttaccgaaccttttctagcttccggaatggtgagcaaagaagatggcgattgatggcacatttttttttctaataaataggtggggaggatttgatgagatcttacttttttgctccgagaaattgagatttcgccaacacgaggggcaaagtggggagagaaatggagtttctctgccacgactcctgatcatattcccaacgcctagataaagagaggaattattttgggattgcattcaaaagcgacggttaattatacagaacaccatatattgtttgttagagaaaactctttatttaatacctaaagcacttatcagtctacataacgtatgaaatcggttattgtgcccctaaagtacgaaaagcgttccacataaagtattctatagtttctgggaggtacttttaagctagttaaagagatatgatattaggtgtgtgtgtatgtgtgtgtgtgtgtgtgtgtatatatatatatatatatatatatatatatatatgtttatagagataagtgcacgcatgtgtatgaatatttacgtttataccgtgttccaaaaaaacaacatatcaaagttgtttggaagttttttttattttctaaagaaacatgtgaggatggtttgtaagtgttcttttaggcggtgatgcgaccgagtggtattgtttgcatgacagacacgttaaccaatttcagccgaatagttcaatcactaactttctccgatcacgttacttctttcctaagccgctatagttaggagtaaaaatgcatttaatcaattacatcctcatgtcactgtgtgttcgtcgtggtcccggtggccaaaaccactctacaggttatttgaaccaatttcatacttttgggagataatttacccggttgttccatactttataggattaatcagactttttcaacgctttattctcaaacggtagaaatggtaagaagccgttgtgctatggctgttgactttgtagctaaacattgcagagacccgaagttgactcttccttttttttgaaaaagaaaaaaagaacagagcaacttggcatgtaactgtaatctgcgctagctgcatatgaaccatgctcaatttacattggcctggtgtaggtgacttttaccaacgattcgcattgagtacaccaaaagggttggtcaaggaatctagcaaataccaaatcaaatatccaaagcataggagccaacactcgtgggcgcaagatccatcacctaacggccgctagaatagttggaggctttattttgggggagaataattcgaacttgaccaacaggcaacagctctcgccattggccaaacaaagaggaacaatgatcacgcttcacgcccggcagcatttgacagataatggctgccccaaagaggccaaagctgtacaacgcagctcgtcctgttgctatccaactactgctctggaggtagtacgtttgcgtgtgctctcaccactgccatatgcttaacgtgacaattaagtaattattagcagatgctgcgcgtacgaagtttgcgacagcgttggccatgtgaatttgtatgtgaaatgaattttgctgaaattttgtaaacttggatttctcatgcgagtttgattgatatttgcagcgtcgcagtcgttcatcggagtgaactatgggacgatagccgacaacctcccgccgccggcgtcgacggccaacctgctgaagtcgacgtccatcggcaaggtccgcctctacgagccccagccggacctcgtcgccgcgctcgcgggctccaacatctccatcctcctcggcgtcccgaacggcgacgtccccaacctcgcgtcctccccggcggcagcgtcggcctgggctgccgcgaacatcccgaccacggtgcccgtctccgccatctccgtcggcaacgagctgctcaactccggcgatcccaccctcgcgccgcagctcctccccgccatgcagaacctcctcgccgcgctccccgccggctcaaccaccaaggcacgtatctcatcacagcatctctacgtacgcatcgcggtggtttcttgaacgagtttgcggttgactagcagatctcgaccgtgcattccatggcggtgctctcgtcgtcggacccgccgtcgtcgggcgcgttccacgccgacctcgccgggagcctggacccggtgctggacttcctgaagcagaacggcgcgccgttcatgatcaacccgtacccgtacttcgcctacgcctccgacacgcggccggagacgctggcgttctgcctgttccagccgaacccggggcgcgtcgacgccgggtcagggctcacctacaccaacatgttcgacgcgcagctggacgccatccgcgcggcgctggacgccaaggggtacagcggcgtggacatcgtcatcgccgagaccgggtggccgtacaagggcgacgccgacgagggcggcgccacggtggacaacgccagggcgtacaacggcaacctcgtcgcgcacctcaagtcgcaggtcggcacgccgcggacgccaggcaaatcggtggacacgtacctcttcgcgctctacgacgaggacctcaagggtgggccggagtccgagcggtcgttcggcctctaccggactgacctcacggcgaactacgacatcgggctcgccgccgctcccggcacggcggctccggccaccgttactccagttacggtgcaggtttcatcgatgctcgttgcctaccgattctgcctgcagtctttggatcgaatggaatggacgtccctgatctgatctccatgtctttttttggtttttgcagaacacgccgcagccgagcagagggatgacgccgacggggtactgtgtgacggcggccggcgtgccggggacgacgcaggggcagcaggtgccgcagaccagctcgtgctacatccccgcaggcgcggtttcgcggcgagctgacgccgccgtgcgtcggcttgtttggcttggagtgttgctttgcctggtgactttagtccgcaagtagatggctgcgtaggtacactccctccgtccaaaaaaaaagacaaacccgggttgccgtgtctaacgtttgaccgtccgtcttatttgaaaaaattatgaaaaaaattaaaaagacaagtcacgcataaaatattaatcatgttttatcatctaacaacaatgaaaatacgaattataaaaaaatttcatatgagacggacagtcaaagttggacacgaaaattcagggtttgcctttttttctgagacgaagggagtatacgtactaggtacccgtcacctgctaagaggaaaagacacgtactccacatacttttgtgaccaacttggtatcattgtgcatatgaatagtgacatgtcactagataatatttctacgaagttgcacataatcgaatgattaagctttcaggtacctacatgccattcttccaccttccagccagcagccaccattcattagagtgtaaaaaatatcatgttctgtagattgcatgagccatgacgtgcttttatctacaaaactaactaattatcagtttcatggtatgcacagcctgtctaaacatgcaccgtccaccttttgtgccagaaagcacagcgagccgctcgcaccaaatttgacagaaacatagcaccaaggcacctatcttctcaggtggaacttttgtgcttgaaaagttcgtatgttgtcactgctggaaacatcagcatagtcatgagttaagtttgttccaaagataggcggctcttcttatgattaggtctgctgacgagccttctgcatatgcttccaaagctcgcaagagttttatgaatttggctccatcatcctgaagaagcattgcgggcaagaataacagtgtaagcaggaatcagagggacaaactttagtaatggtttagttgttttcataaatatatgatgctacaattgctacctttggcttctgaaacacaagatccgatgtcttaaaaggaaccatataggatggaaggtcagaacgtaatgtggcctacaagaagtgtaaattcaatgagaagagtctggttgagatagaatctcacaatataatatggaagatgattgcatttcatgattcatcaagacaatagaaaggacttttgagcaacataaaaaaaagattaccaggcttttgcaaagcattgcttgttcagattgagatatcaaagcctgtaaaggaccacaccaaatatgatttgctcaaccatttgagaagtcataagataaaaaatgatatatttgacaagagagtatgtgcaatcaacattcaagaagataatcatattatactaaagggtaaaatatcaatgccatttaatggggtcattgtattgcgctgttctagtgaaacaaaagcgtcatgcaacccagtttctgtatcttggcatttctgtgcataagtgcatgctgataaatgcgaagaggggatatctcatctaatgtataatattaagaatgatacctgtttaattcgttcttcctcaacttcatccacagatttcaacagattctccaaggaacctatgtgagtaccaataaaatgacaaagttataacttttggagaattgcaggattatcaggacagctaatatgcccactatttccaaactcaaaacatagaatacttggattccaaatataagttattctagatttatgtacagggataataaagtacatcaaacgaccttg

SEQ ID NO: 66252 - DNA, 970 bp, Oryza sativa
atcacattatcaacttaaaaatactttgacacatcaaaatcgtgtgcaactgtggtccatttttctgttttagagctgaaatgaaagatattggacaagaaaaacaaaggtagccaagcacaagaatttattgcgagaaataaataaataaatacaacccaatgcagaccaaagtttagtatcctttctctcatagttttcatagctaccaacaaaaattagtctgaaagaagaatggatgtcagaacagatgtgtagcataaggcacaatagaaataaagggtacctggtatattgtcggctttatctccagaaagcgcaacaacgtcaacaaactgtgatggtttcagtgctccatatctcttgacaaagtcttcaactccaaatgaaaccatcctccatgtccaaataaaaacgattagctattagagtattccagtaagcatgcaagaaaggcaaaaaaaaccaagtacacttacccagaaccacgaggagcaatcctcagcaaacgtaaagaaggtgaaagaatttggaagaagtctttatcaggggagacaatccgtaccttcaaataaggaccagagtacacaataagatatcatatccaacacactgcaacggcatcacattttagttacactgtatttcttgcatttttgttacaaaattcaacatacctatgacttaattccagacattcagttttgtcatgtgcaattggaaaagttagttatgaatcaacttttacaaaatatcaatcatttcaaaacaaataaaaacagtttcagtgaatctataacacctcagcagtttataagtactaacttttgtaaatgatgtgaaagattaaagacggcactggagaacgattcatgaagagagatacttatgaaatatccattgagaatattgaagaacaattcatgaataaaatgttcacaaataatcacagtagaaagttttattacct

SEQ ID NO: 66253 - DNA, 1185 bp, Oryza sativa
  unsure (1)..(1185): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaatctgtgagttctgaaccctggtaaggaatatctgaaactgacctttcaacagcaatgggcttttgacctgtggatcccaggatttcctcccagcaactgccagtacaattgtgcagagagacgagctagcacacacgcaattaaatcgtggcagtacgattcaacgagcggttaagtgttcaatttacgcagctgttcctgtcctacgggtgagcatatataggtgtccgaggccaaggggattggagatgcccaataactttaggaatttttttcattgctcactgtccagatccatcaaagcctgaaggctgggaagcttgagacgtcaagctcaacattgattcggttcaagcccctcataatttgcagatatattggtggggtgggtatcgtgtcatctctcaaggaggttactcgttttgggagttcgttgggggtgtgtgcattcttgttggatatgcacagcatcccaaagacacggacaccaaccgatcgatgctgtgatggtttgaagctatggattattgaaaatttatagatttgccggcgtgtgcgtatttttaatcgcttcttcattcttctgtttttattcttgttcgggcaagattggtttgccgatgctgacggctgaccgccaaattaaacatgcatgataatgccaaaatctgatcgttttggatgcatcctgatccatgtctgcctgctcccagaacaaggccactgcaaaactgaagatgcccacaacgaatcaaagggtaaagaactaaagatgccaagaatctcttgcaggttgcagctgctgcctttaccctgaagctactacacagccaaggcagcaacaaagccaaaaccaaagcaagagacccgttcggtgcttatctactgactactgtgttgctgtgcaaaccttagctgaccaaacaggaagaaagaaatccggacgatcaaacaatctgacttgacaacagaacatccctgtgcgatgacaatgcacgtacaactacaacggtataattgtccttacttttctgcacatgatccgagctagtacgtacagtatgtactagctgggtacattg

SEQ ID NO: 66254 - DNA, 870 bp, Oryza sativa
atagtattaaactatcattcccaaatataaaatgaaatatcatcgtattattctactaggggaaaagaaaaggatgatttgaaataggatcagaaataagcagtatctccctaaaagtcataaaagaaatgaaaggcaggcatttggaaggtcatgttaaatcactcctactgctttgatacttggctaagtaatggactaacataaagtgcgacataaatccaggacatccatcacataaagatgtggttatgcctaaaatcttagatgaatccaacggttacattctcccatgaatcccatgatcctatcaagttacttcagtatatcactcttaccttttgccatgtgacattctttggatggcatggcagtataatgaccataagggactcctgaaaagaaaagtttggccacttatttgttactctaagaattttaaggaaatgtatcatttcaaatttcgtagtaaagatgccgggatttttcttatgatctaataaatcaggggatgtagatccaaacaagtagaatccctccacagaaacatttatatggatttaaacttaagccatgcatcttgaattgaactatattagataaaatcacatgggaggccaataacatttatttgttgtcatatcaaaatctacaaatactatcctttgtgcagaaaaaaaaagggaaatcatagtacacttcaacaaggattagtaagaaaagaaagtgaggaaaaagccagttgttccaatcagcaattaaaggaacaaatcagagaatgggatatatgagcaggaaagaggaaggttttgtcttaatatattgcatttcttaaaaagacagatggagaatttttgtttctttcctgat

SEQ ID NO: 66255 - DNA, 4184 bp, Oryza sativa
ttaacaagttgcagacaggacaagatctcatgctacgtatgctcaaagcttacagagaaaaatttaccaagtgtttgctgcagagagcaatcaacaaacaatcacagcaaaatactaaaataataaagtgaaagtttactcagtgaatatgagaattatccaattgaaaaagctcaccatcatggtcaaacaccacctgcatatgtgttcaaagtaccataaggaaaaggaatgctaagaggcataaaacataaaaccacatacagaaacaaactgtggtttctacaaatgatgcttacactgcacctggttattggtttcctagcagtaagccagtaacctctaaatattctggaaatattaagtattatgttccagtataatggtaaaataaatactcctttggcgcattggcccttgaatccttaattatgggctaaacatacaatttaagttgcttatatgcacttctcattaccatggtttagcaccatgtgttaatgctccccagttcctaaggatagacatgaaactttcacattttgttagcaagaaatatgattggaattgcaaggggtgtctgtgatcttagttatatataagggttttaaaaattctctatgattcatccaacaatgttctaaaacactttattttaacaaaagttccatgagaaaaatgacagatatgaacaagaccatataattttaggctacaaaaaagatgagcgtaccgctgcatgagatggaatgaactccagcatatctagaacctggagatataaaaagcaatgtagttataatagggatcacacatgttataaacaaaatcaagtggaatcacaacaaaggaacgcatgtcataaaatattacaacgagaaaagaagattctgtgtagaggcagaaggttaacatgttgaattgtaacaccgccacatgataaaaatctataacgatccacaaaggacagatgtcaaccggggataaacttatgaggctaacatatactcctttttttttcaaacaggcgatgtttttagtaaatcatcagtttccaacaactccaaataccaacagttcatctcaagcatactaaagaaaaaagtgtatcttctgtcatcacacttattcatcgcaagtaagtcttatctcatgctggttcattaaacaatgccacttaaagacagcatgtgtgtcaaaatttcactacccaatccacgttttgcaacatagcagtttgaaaaccttgcttatctacaaaagacgttgcttaatatttctccacttcaacaatgttgcacttcctacttgtacgatgatagatttgtaatgagaacaaaatacaaacacatgtaccatagtcaaccttaactagaaacacagatgaagaccattgtgctagaagcctagaagatgcgtttcagacgaacattaggtgaagcaaccaaaaaaaaggactatcattaaagggacccggaaaacgaactatgaataaatttaagcttattaacaagtatgccacaaaaaaatctataaaaaaatatacttaccagtgacagagctttaaatatagttaaaacccagtctccatttccatcagcatgctccaattgaccatgctgcagctgtgctgcatacatgaggaaaaaaaataaagctgttgaatccaacaattaatgcaattgggcacctaactccaaattaaccctggattttagtgctctttaatgtgagcagctgaaccagttttgtgcagaaaaatactatggtagttttgcaaaacatgattttgtttgagtgcctttgacatgattatcctaaaggaattagaaaggaacatactaccggaaaccaataatgaaactttctgctgcttataagatgctatgacagcatagcacagttcaacaagacagatatatactgagataatggatgggtgttctcagggtaggaaagcagcagagaagttaaaccacaaaaaaccatgcccatattttttttatcaaaagatcatgcccaaattatgagaataaattgagaaaatgttttcatgtcatgaaataaaacatcaagtgtgggcacatgtacaacttcttttgccctttgtgcatgtgtctgtgtgtatctaggacatattgcaacattctgttgtgccttcacattataggaagaataaaaatgttcagttcccatgtattaatcatgccagtggaatttagtttaaatataaatatcaaaacacttattttctaaacatgcatttaccttgataaggaggagaagccaaacataatataccaatacagatgtaacaaagagaatcaggaaacatttacccaatatcttgtagtaggatctgtacattactgaggttccatcaacaagcattattctactctttgaagggtcagcatgagctacactatcactaggattcggagaagttgtcaacaagcttgagggcaagctatcatcatataatggaattcgtggaatgttctccatggatggtccttgaaaattctcgatcatgtctgtgattggcaatacggactgttccgagaaaccctgatattacatagaaaatttcagtaacattaattatcttacattcaaatcattggattgaatgacagtgtgaccgtatataacccttgaataactatcatctataataagagaaaaaaatgtttggatagtctaatttgcagcataacattacaacagtggcccgatgaacaacaaacattggcaatgtcattgaagcattggtggaatggctgtgcgctgccccaaacctcattgcgtctagctaatatgctgattgttttcgattcgtgcactccccaaggaaaagggatcagaaggaagagaagggggcgctatagcatgtaccttcctggaaaccgcgaccggcaatggggctcgccgcgcggcggcgcggaagaggaggaagcggggcgccgtgctggcacggaggcagcaacacgccatcgccagatgccaacctctcccccgtcgcccccacgagggttagggttctggagcacgtggattgattggtgggaggggatggaggcgaaggcgttcgacgaaatgcgcgagtggcggctggcggggggaaccagacgactggagcagagactgctagatgaggaggagccactcttcaccgcactccccacggcgagcaagccgcacttcaccgtggaccaccgcgagcgcgccccctcccgcgcctcacggcgagcgccgccgcccctccctgtgaggtcgcgacttgtgatgctcaggattttctccgccctccaggacttccgcctgagttcgattctatagtgaaatgcgattagaagggttttggaggaaaaaaaattacaaaatcaattcaaaaaaaataactaagtcatttgtttgtctgtagtatatattgttttaaagagatttttatagaatagaaaagaaaactcttcatattttgaagaaatctggcattaggtataacctaatattttatgaaaaaaaacttttgatacgtataatcttcctctctcgtcgtaacatcatttaaccatgtttatcaaccacaactaagttttaatgttaaacttgattttaaagttaattttgtgtggacgaggagaggaaagggagtttctcgtagtctattttcaacattggtttcaatcacaaataatacatatataaaaattgtacctataaattattgttgtctcttcttttatttatctataggttatcagccatacattaatcaattggaatgttgtgtttttgtatttttgtgtgagacatccatattattgttttgagcaattataaggttttatctgctttatactatctctgtcccaaaatataaaaacctaggtagtaggattcaataggtcatggcagtgacagagctagtggcaccgtcaagtctacacaaccaataatgttttatggtgctccatccatttatcctatattcctttaaagttgatccccgctaactataattaataccatttttctactttgtggtgcatccacgtcaccagaattgtttacccccgttagattttattttcaaggctgtgattagtctagatgtagcttcggtctgcagaccacaacctatcaagtgagtctagcccagcgaggaggccggccccaaa

SEQ ID NO: 66256 - DNA, 4773 bp, Oryza sativa
aactagcaaatttgatcgccctacacctcgatcaattctaaattaaagcgctagttttaccgttttctttccctttgctttgcgccgtcaattttaatccatcgataatcatccatgcgcacatatgacgtggacctaacttaaaatgtatagctcaaagacaatggttagtccacaattagcgcttgtcattaattaccaaaattaacaccgggggcctagatgcttcaatctccccatttttggtaattgatgataaacaccacaaatatatataatcaaacatagagcacatggacatatattgcattgacaagcaaaagctccccctaaacatgtgcataacaatcacaaatagcaaatatggagccaatgcacaattcaatttcacaaatcaacatagcacaacacatagacaaattataatgtgaacttcacatatgaatcaaccgaatgcataagatggtcacaagtatatcaatgtcacaccaaccatccatcatagcacaagttcacattaagaccacataaagggctcacaaataaatataggctattacaagaccacgaagggtccaaatgacatagagatcaacaaaacgaaaaggaacacacaatatagagtaatagcccatacccatacataatatagcccaaacctccttaacctattagatatgaggtgactaacctcactactactagtcccaacccacgagacataggaacacactttttccccccttttggcatcaagtaccaaaaaggtcttcattcttgtggtggagaaggaggacgcgccgaagtggaaggatgatgagcatcacgacgacgatgatacacaaatgcttgggtactcttcaaagtttggactcgagaatccaagacacccaccctagtatgcaatcttcccaccgaagtattcaagttgccaacatcggtgcgcaagccacgaacatcctcatgcaaagcttcatgcccggtagacaagcgttgaatgctttcactcagggtattaatagccccaagtaccgggttgaagtactcgttgggttgcattccaaaataagcatattgtggatggaaaaaatcacttggatcatacccatgaggaggaggaggggctgcacttgagcttgcaccttgatcaaaagttggttggcgcacacaaggagctctaggagtggagagttggagacgaggcttgtactccttatgttcttttaaattgtgaccaatttgtcccaacttgctttgaatcaacctcattatgtagggagcataatagattccttgttcaatagtcccctttgagatggcaatctccttcattataaggttgataacatcaaaccgacgaccatccaaaatggcatcaatgacatgccaagcaactccgcgtatgtcatcattgttgccgcatcttgggaggatggtggcccttactatacggttgatcacacttgggagagccctcaaacccgccacctttccatatgtgtgccttcccccttcttcataaaactgagaaaagtgatcaatggagaaggggttgtgggtgtgctcatcatgaaggtcatccccgttgttgaagcggatgtgcaagagctccttgaattcacggcggttgatagagcatcgaagggtccccgacatccacttcattgcatcacaatcgccggacactcatacggtggcatagaattgccggatgagatcttcatcaaaaggttgcttcatggtgacaattctatcaatcccaacggtccggaacatctcttgcaaatcttcaaactccggtgtctcaccaatgtgcctccaagaaatccacttgtgttcggcgaaggctttgttggcatacacttgttcatacacggacttttggaaccgtgtatgaaatcttggatcattacaatcgttaggcctctagaattgatgatgatgacggaggatagtgtatttttgagcattcctcaaattaagcacaaattggatggtggaatcgagaggactcccatcatcacttgcctcatcatcttcaccattgccactcccattgtcatcaccatcatcacttccttccatctcatcaccctgaacattttccatattttcatcttcactttgaacatactcatctccgctttattcctcattctcactgatgggattgggcgtgggctcacgatgaccatggcgagtgcggggaggcatagctgaaaaacaaggagcaaaggatggataagcaacaattttagaagccacatagtgaagagtaaggaatgggggtgctgcctgtcaggggcggtcagaccgagagccaaagccggtcagaccgacggccatgggccggtcagaccggcgtctcacggccggtcagaccgccgctgacagtagcacaaccgaatcattccacaatccacacaaatgattctaaaaattgctaggacaaagttgcacaagattggaacatgaacatcaaggtgtaggtctatttcatagagattgaagcaatgggggaaactacccttaaccctagagattaaaatagaccgatttgagagcaatgcacaagagagagagagtgatttaccggttgaaggagttgaatcacaccaagaaactaccctctattggtgcaaattgaagaacacctcttccttcacctagggttccatgccatggatcacaaactcaataaaaactcaaatcaatccatggaatagagagaggaagcggaggagaatcacttacggtgtaatcggagtgattttgacggttgaaccggatggatttggtggagggaggtgactagggtttgggagaggagatatgagaagaaatttcgagttggagaagaaggatgaatgggaggagatggagtcgggtaggggaagaagagagaagaaaagggaagattcccgggcccaccatccccggccggtcagaccggctatacacggccggtcagactgccggggtgcggccggtctgaccgggccaccgtcgccaccagaccggtcagaccgcgcatatagcgccggtcagaccgcctggcccccagccaactgtgcacagcccttgcacagttcggctacccccacacaataaaattcaacaaaaatttaatttttggagcaattttgaaatgtgtgagttgaaatattgccaaccattcataatatttgaaatttatgaagatttgcaacaaaactcacttgagtgctaggaggtgaccatttatggtctataggggtttttgggcgaatttgattttcaaacaacttttgaaatatttggtttttgaatatgatttgaataccaaaaacatttcaaatcttcttcactaccaactttgttttgaaacttttctcaaattccttctcaatctcattttggggtttaatctcattttgaccaaaaacaagattctagattcttcaaaagaaggccaaaatggcattttcattcaaaaatcatttttcttacaaagtgagagttggaaaacatatagggaaccttgtgaaacattttccaagagatagttttcaaattacattgattttgcaaaagttttgacttatgttgacttgggcattttgaaaatactactagcaccactagttgatttgcttacatataaaaggaagtagagcacatgcaagagtgcaaaactcccccttaatgtgatatgctccattttcgcaatgaagaaccaaatggcaataaatccaaagcataagagcaaataggagcaaatatacaatatgcaaaggaagcaaccatggtgcaccatctcaagccacattagagaaatatatgacatttaactcattcctcaacttgcaaaagcgggtttcatcaagaggcttggtaaagatgtcggctagttggtcctcggttcttatgtggctaatgactatgtcacacttggcaacatggtctcttaggaagtgatggcgaatgtcaatatgcttggttctagaatgttggaccgggttgttggctatctttatggcactatcattttcacataggagtggggttttagtgaaggatatgccatagtccaacaagatttgtttcatccaaagcaattgggcacaacaactacccgccgaaacatattccgcctcggcgataaagagggctacgaagttttgtttcttggatgaccatgacacaagggatctaccaagcatttggcaactaccggatgtgctctttctatccactttgcaaccggcataatccgaatcggaatagccaacaagcttaaatttagcaccttttgggtaccacaagccaatagttgaggaatgctttaaatatcttagaatccttttcacggccactaagtgacactccttaggagcggcttgaaaccgtgcacacatgcaaacactaaacatgatatccggcctagatgcagtaaggtaaagcaagctaccaatcatggaacgataaagttttaaatctaccggtttacctccctcatcaaggtcgagatgcccgttggttgccataggtgtcttgatgggcttcgcatcctccaagccaaacgtcccatccttgagttgcttgatttgaagtccatggaagaagctcaactctccaatcatggacatctcaaattccctagacatcatatcaccaaattccttgcaaaatacctcattagtacaaccgaatatgatgtcatcaacataaatttgacacacaaagaaatcatcaccaatgatttttgtgaaaagggtggtgtcaacttttcca

SEQ ID NO: 66257 - DNA, 1184 bp, Oryza sativa
agagtttataaacatggttaggatatttaggatcttcaaaaccgggaggttgttcaacaaagacaagttcggcaatttcaccatttagaaaagcacttttcacatccatttgaaatagttttatattaaagcatgatgcaaatgcaagaaggatgcaaatagcctcaagtcttgtcacgggggcaaaagtttcaccaaagtccaaaccttcaacttgtgtgaaaccttgcgccacaaatcttgccttgtttctcaccaccaacccgttctcatcttgtttgtttctaaagacccactttgtccctatgacattgtggtctctaagtctttcaaccaaagtccacaccttatttcttgcaaagttgttgagctctttatgcatagcatttatccaatccggatcacaaagagcttcatctacatgttttggctcaagacaagaaacaaacgagtaatgttcacagatcgaagcgacacgagatcgagtttgaacacccttactaatgtcacccaacacttggtcaattgggtgatccttggaaagagcggtgtgtatccttggtggcataggtagatcttgtgccttctcctcctccacttcaacttgagcttgacttggcgtagcggaagtagatggctcatcttgagtggaggtggatggcttgtcttccacttcaataggcttgacatctccaattgacatgttcttcatagctctcatcaagccttcatcacctacatcatccaaattctcatgcccctcttgggagccattagtctcatcaaattgaacatcggcggtttcttccacaatacctttgttcttgttgtagacccggtatgccttgctatttgaggcataacctagaagaaacccttcatcacaccgactttcaaatttggttagtctaacaccctttcggtaaatataacacttgcaaccaaaaactcgaaaataggcaacattaggcttcctcccaacaattagctcataggaagtctttctcaagagacgatgcaaataaagcctatgggttgcatggcaagcggtgtttatggcttccgcccaaaaggagtcggaaacaccatattcatcaagcatagtccttgccatctcaatcaatgtacgatttttcatctccactacaccattttgttgaggtgagtaggtagcggaaagttcg

SEQ ID NO: 66258 - DNA, 705 bp, Oryza sativa
cctttaaggcatgtgctttaacgcacagctctgtgtaggtcccatcaagcttccaagctctcaaagttatgaaatagtcttcaaactgatcaagattaataccatctctgtggacttgtacattcatcccaacatcttcaaagccgaaaacatcagattgcccttcatctgtcccaatggcccattcaaaatgatgataagatccatctgcctctgataaagtttggcgccaatcaattatgacagcatcctcaaacacctagaaaatagagaagccacatgtaacttgaatataactcagaagctattgaattgaagttagaatagtgaagtgggcatcgaggaggcaccctgacctcacactggaaatcagtgtctgcaacacagaaccaactggtgcagcgaggttcccttcgcatgcgtttcagttccttcagttccttgaattcacggataacattccttcggcaatctcgacagaatctcttgctctcaaacctattgacatttgtattaagaaaaaataaaatcaatcctacactgatcaattgtcagttgctggataaatacaaacaaatagatgcattattggcaaaaaaaaaaatccctacatatctaggtagatcatagatagctatcagtatatgaaaaagaaaatagcaggcccttattgcatttgcatcagatagctatgatcgttaatta

SEQ ID NO: 66259 - DNA, 807 bp, Oryza sativa
agggatcccttttagggtgatagtggctcaattatatctctaggaaagtaaatcacactcctatgtcaaagttttgcaatcctagggtgaaatgatctcaagtatgtctctagaaatgtaaattgcacaaatgtaaatgcgacaatcaaatgagacaaggagacaagagatttttcaccgaggtttggaaactcgccggtttcctactccccgttgaggcgagcccaactccaccgctcaaccacgaagccaccgcacgccccctttgtcaaggggtgggcaaggcgggagccggcccacggagaggactacccaagcctcgatcactagggtagttcttccttcactccgaaggtggtgaactccaaaccactcacaaaccggcgccgggccttctccacaatcttctcggagagatcaccgggcaactcctccacaagccgtctaggaggcggcaacctccaagagtaacaagcaatgacccggcatggagatgatcaagtgccacactagctctacaatggaagcaaatgcacttgactcttggctaaacaaccctctaacacactagatggatgaacacaaagctcaagtgagtgtgagagaggtgcaaggggtgtatgcaattgaattgggtgccaagagagcccccttgctactggtgggggagtatttatactcccacccaccaaaactagccgttgggggcgaaatcccccaactctgtgctctgccggtctgacctgaggtatgtggccggtcagaccgtgctactctgcaacgactagaaaactagccgttgtagcc

SEQ ID NO: 66260 - DNA, 12588 bp, Oryza sativa
tttgagcaaccgaaagcaaattgaaatttagagatttaacaagagagacattatcaattgacaaatcattggagatagcaattttacctaacccaattacctttcctttgctattgtctccaaatgtcactttctcttgttcattccctcctacttcaaatgtggtgaacatagccctatcaccggtcatgtgttgagtgcatccactatcaagcacccaatggctcccaccggtgcggtagttcacctacaaaagaagatcaagctcttttaggtacccaaacttgtttgggtccttggaggttagagaccaaagctttgggcacccaaatggcattctttttaccaccgagtataggggaacccacatatctagcaacaatgctaccatcataagccttcctaagcatataatgagaatcagacatgcatgtcttaggaggcttaccaccggggcaatcactcaccaaatgcccaacctcacgacacttggagcaatacttaccattgctcttgacaaaacgagtggcacggtgagaaggtttcttacccttctttagaatgaatccaagtccctctttgttaaggatgcactgttgctcactcaaaatcttgtcaagagtgttcttacccttgaagcatctctccaaactcttgttgagcttagccacttgctccttaagctcattgttctcaacaacaagtgaggcatcacaaatagaaacgcaagagctagagctagagttaggcatatccataagatcatcacaagaggtagaaatgctagatgatgcaacatgagcaatatggcaagtagcactatcatcaagcaaatcacaagatatgccaacatcaatgagagctccatgttgagtagtggaaaggaggttgtcatgagcttccttaagcttctcatgagaaatggtaagtctctcatgagaagtctttagctcctcatacaaaacctccaaagaagcatgatccttctttagggtcttgaacttgataatctccttctcactataagcatggagctcctcaaacatactcacaagctcatcataggaaacatcatcacaatcatcatcactctcactatcactaagagatgttaccttagaggggctctttgccatgagacaaagtggagcgaagagtgatggtgcctccttgatggcaacaacggccatcttcttcttcttggagcttgcatcatcaccaccttcttcctcggacccggatgaggcagagctctcctcatttgagtctcattccccgatgaaggcctcaatcttcttctttttcttcttgagcttcttcatgagcttgtagcctccactcttcttcttggatgacttgtctccatcatcatccttggaagggcacttggaagcaaagtgtcccttctcaccacactcaaagcacctcaagttggagagagtcttgttgggtcttctatttcttctcctattggagttggagccccttcctctctcctttctccttcccaagagatcattgaaccttctagcaagaaggacaatctcttcctccaagtccttattgacttcattcaccttgctcttgctcttgtcttcaacttcggcttggagagcaatgcacttcttggaaggtgaggcttcctccatctccttcttcttcaacttgtacatgtcattggtgttgatcttccccaagaggcttgcgggtgtcattcttgacatgtcggagttgatgagcatggtgacaagggtctcatacttctccggtagagccctaagcatcttttgggcaacctcaagattggtgtagtttgccccaagccccttgagatcattcacaatgacattgagcctcccatacatgtcattcacactctcatgaggcaacatggagaatgtctcatattggatcttgaggaaatgaagcttggcatccttgtactcacttgtactctcatggatctccgccaacttgttccaaatctcatatgcggtctcaaggttgctcactctatcgaactcctcttggctcaaagagttgaacaagacattcatggcttgggcattgagtttgaggttgcggtgatcaatctccgtcaagggtgtgccggtgatagcaaagcctacatccacaatactccaaatatggaagctcatagctttgaggtgagtagacattttaattttccaagtggaatagtttgtgccattaaacatgggagccttccctacatggttcacctcgttcgacatcttctctctaggcggtgaagcccaatcaagagagaccaagctttgataccacttgtaggattgagatgtcgactagaggggagggtgaataggcgatttaaaactaaataacacctaatcaaaactaacctaagttgctaggcttggtgagggtgaactctaactaagcaactaagttatgttttgcaaacctagggtgatagtggctcaattatatctctaggaaagtaaatcacactcctatgtcaaagttttgcaatcctagggtgaaatgatctcaagtatgtctctagaaatgtaaattgcacaaatgtaaatgcgacaatcaaatgagacaaggagacaagagatttttcaccgaggtttggaaactcgccggtttcctactccccgttgaggcgagcccaactccaccgctcaaccacgaagccaccgcacgccccctttgtcaaggggtgggcaaggcgggagccggcccacggagaggactacccaagcctcgatcactagggtagttcttccttcactccgaaggtggtgaactccaaaccactcacaaaccggcgccgggccttctccacaatcttctcggagagatcaccgggcaactcctccacaagccgtctaggaggcggcaacctccaagagtaacaagcaatgacccggcatggagatgatcaaatgccacactagctctacaatggaagcaaatgcacttgactcttggctaaacaaccctctaacacactagatggatgaacacaaagctcaagtgagtgtgagagagatgcaaggggtgtatgcaattgaattgggtgccaagagagcccccttgctgctggtgggggagtatttatactcccacccaccaaaactagccgttgggagcgaaatcccccaactctgtgctctgccggtctgaccggaggtatgtggccggtcagaccgtgctactctgcaacggctagaaaactagccgttgtagccctgtcagagggccccatcagcctggtcggtcagaccgacatggggtggccggtcaaaccgccatcggctcggtctgaccgaatacggctccgtcggctctgtatcggccatcccgagcagcaccatcccggcctccagggggccggtctgaccgcgcatgtgccgccggtcagactgtccttatgcgccggtcagaccaccttcttgcggccggtcggaccggccagggcacgccggtcagaccgccactatgtggccggtctgaccgcccctggtcaggccgaacctagtgaagtgtgtgtgtgtgtgtgtgaaatgtgagcacaagtctaaatgcataatgacctaatgtggcaattaaaatcatctctttgctaggtcattacccctcttaatagtacggcgaaactaaaaataaactagcaaatttgatcgccctacacctcgatcaattctaaattaaagcgctagttttatcgtcttctttccctttgctttgcgccgtcaattttaatccatcgataatcatccatgcgcacatatgacgtggacctaacttaaaatgtatagctcaaagacaacggttagtccacaattagcacttgtcattaattatcaaaattaacaccgggggcctagatgcttcaccaccaataaactaaacagttacatgcatatatttatcgattgcatttcttgactcctttcctttcacctaccctttcacctcactatttatatgcctctccacaatggcatgtcttagccatcgtataggatcataacagattctttgtgaaaccagtggatgcaatggctgtgatctcttcaaattactgatggttttcttgatgtcttatgctgtcaatgctatgctacagtcattccttcaaggtttgtggtgtgttcctttcctcggcctacaatttaaattattatttttgttttacttataaatattcacgttagtattttctttctttctcatgtgttctttgtttatctgttttcgctcaccgtgatgatctgaagttcttccctttttctactgcttatatggacattgatcctgttgatgttgctttatggcaatgagcaactaagctccctatacgaccactatttttctatgatattcattcatacagcaatgattcttgaagtttattctcgggtactaactaaaatttacttgctatttcatagcaggcctatatctttgtatgcatcggaatgatgcatgtcagcacaattaagtcaatcttcctttccaacgacctgactcagttgaagcaagcatcagaaaatgcgtaactccaatctttctatttattattgaatttttgtaatttttttaatagttacaaggtgtatttaaatcacaacaatcaagtgtacccgacgcttgaagtaatggataaatttacaatagtgctaatgtaggtatacaactggctagatatatgttgcgtctaaagttttcttttatcatataaaagtgtcgcggtaacgcgcgggttactcactagtttcatacatttgagtgttcggctttgtaattgtaatggagatgccattgatagaacccgaacaactgtctaattagctcaagaggtggctccacacacatagcatggtatttcaatcggcggagttatagatagatagtatgtttttttttcatcaatttcaaaatatggtataatctgtggtaaacttccaaaaccagtttcatcggttagagtgcattttaccaagtgtgttgtgtgtcagctgaactaacacattataacggttgctggtggtgtttgagacggatgaagatgtaaagtaagggcatgcaaaacgagtaaaccattagggcatgattaattggttttaattattgcaaatttgagaaatatatttatttgatattttaaagtaaattttatatagaaatactggaaaatttagaccaatccattgtcgtatagtgcagaacaaataaattgcactgtacacatatgtcacttgtccattgtcgtctagtccggttaggatacctggctttcacccaggcgacccgggttcaaatcccggcaatggaattttttttctattttttctatttgtctatttttctatgtttcttttaggggatctacatgtctttatgataagttagcagacttaactcaaaactatacgggacctgcagaacttcttgacaaatcgcacataactcccaagttagcaaattagctcaaactaatcaacactttatttagtggttttccgtgagcatacgagaactaacttgttactgttagtgtgacaactcacaggtcacaggattcgcagcatgttcacggttcaccaatgaattatatccacattaagtaaacaaactgtccaaagaaaagaaacaaaaaatcaaaccgagcggtgaacacaactacacaaggggacatgatctgatacactaatacactacctgagcaataatacgcacgaggcaggagtgttgtctgtaaaaagtgaggcatcaataggtgtagtataactattttatcacgaaaggtgaaaaagactatctaccggctctacatcattttatatcaggggcagggcgccccgctttagccgctggcaacaatctcgtggatcttgtcactgacttcgggatcatctgacctgacggcaagcttcatcgccacttccttgggcccgctcagtccaaacgatagcctgacaagaaccttggcgtcgccgatgaacacaccagacagcaggcaagtgtgcgatcttgcattctttggtacaacctcagtgccctgccaaacatgcgcaaggatttagcgacatttaaatttctcaaaaaccaaatgaatttaaatttctcaaaaaccaaatgatgtagggccaattacgatgaataggaacagaagtggaaactgacctcacaaggctgcataccaaggatactaatgacagcactcacagcctcagccaagctctctctaacaccaagtccatactcatcgacacgctcactttctgggtccatattttcccaggcattcctgaagttgggagacctgcagaccctcaagcatgctaactcagtccgtaaacaactttccaggatcttccgatgctggctattcatctctctcacagccattccttcatgcaacttaccctctgtagatgtgtcaacctgagaattggcaggattagtcattgttctaagaaaaagaaatagccatggaacaacttaaatagagaatgattaccccagtacaaggtacgtgttgatgcctcaatttaattagaacaaaatggcttataacaatttaaaccatagaacatatttttattactatattcttaatttgatttagaatgccatagttctatgaacaagggagcaagactcttatgaaggatccgaaactcactaaaggtgaaaacatagttttatatgagatcaaaagactttaacaaagatgaaattcactttcagtaccaacaaccataacacgtacgggcatagacagacaatacaaagtatatccaaagcatatgatatagaacagtcatacttgaattagtataacaaaggatattactgtcggtcatatcaggatccaacagcagaaggaaacatttacctctttaacaataaacttcagcacatttgaaaatttcccagtagcaggaacatgttctggcttttcaaaagcaacaaaaatttgcccaggtgaatcataaggcaaacttctaagtggctttgaacaaacttctgaaaattcctcagcatcagtggcatcaacataaacagtcacctacaagaatcaacatacatatatgaaaaaaaatcttcagtgtgagttgacagctgtgcctccaagaacatatttaattgtacttaattgtttgctgcttacattttctagcagttgttcgggtatagtgtttgtacagttgtactgcaacacaacatggctactgtatatgtgcttaaccacattaatcgcatattcagtctccgcctctgtcagctccacaggttctgaggactggggaaaaagagaggggtttagcatgtgtactcaatcaaaatcattaatggtatagaagctacagaccttgaagagccttccaaacccggagaactcaggaatggacgagagaatcttctgataagcatcaacagctggaacaggtgcaggagcaggagcaccagcaggtggcttctttcctggggcctttttctcttgaagtggttgtgatttgacttctctcgacaccaaagaaatatcaaaaggctcctcagagggttccttaagtttgaagatgttagtataccatagggcatggcagttgcttaaaacataaaatgttcattgtaaaacatacataggttttaagacttgcttccaagttggcaagtggcacatcaaatgatccaaataggaactccttaacatccttctcagtgctaccaacagcaacttcaccatcaagagtttggagataaagtgtagcacggtcacgaacctatgacaaagaccaataagacttgttattgcccagagaggagagacaccatacaccaatgttgtttctaaatgccaagttggcatcttacaataggtggccttaaaaataagaattgtaactgataaaaacatacttcaagatatgcatgtcacaaaaaggaaatgataataatcatgtcggtttgctatttacctcatcatcggtgtcaaacaggcaacgacgcaaaagaacaaagatcctaggctgaaaaagaaaaagaaaagcaagatctcaaatgagctaagaatacacaaaagtggtctatataaattagagcacatgatatatgatttatcctaccttcaaggcatcaactaaggcaccaaactttgccaatgtactgacagcactagcacggacagtggcattttccagtatcacacggttgtagatgtagcgtatatatctgcttggatctgatgtccttggtccttcatttcccaaaagatgcaatatctaacaaatagagaggattgattctctgttcaaatgttgaaaaacaagagctaggcaaggaactaccaattggaaaagattgattatgaacattctcaacagttcatatattatactatagaaaggtcgtcagtttgttatgtccccgttctttttttaccattgcatcagcatttttcactatatcaagtaatactacctgataattcataggcagctggaaggatggaagttaaccagttgttacttaatcaacagcaaatagctaatgtaattacctgactggaaagataggtgaactcacagtcttcaatgaactcacagagatacaaaagaccaatttctttagcatctggtatctcactgataagagttactatggaatcaacgatggcctttttgtactcaaagcccccttcttctctcaaactgttactcaagaagttcatcctatagaagaaaaaaaaatgaagagcattggacaccaaatgcaactgatagtcaaaacatacggcactaaaagaatgtaaatgtcatcaacaccgaattaagatttacatacattgaacgatacttcaggggaaacttaaggcatagagatcgtatagcttcaacaacaactatcttgaattcatctgctatgtctgacatgaaattggtaatttgtttcatgaggcggtctacgctagattcattgcctgttttaagaagtgtagtgattgccagggttgctatactcctattctggtccgacatcagactttccaagtccacattgcagtttgtcactgccaaagggcgtgtcatagcaacctgcgagataacaggcaaatcaagatatagacataagctgagaaaatttaaatgtcaaagattaaacatcatgcagggataaccttgttgagtgtccggacagcagcaaatcgaaggacaggtttggatgaactcaaaaataactgtaacacagtaatcgctggtgctaattcacgacttgtcacatccatctctgctattttccgtgcagcctctagaatcaccatttctgatttatgtctcaaacatgattccagataatcaaaaaatgggcgatcactggtttgtgtgttcatgcttgactcgcgtattacctggtaaatcacccttccaatgttcagcaatttacttttgctaggttttaagcttcagtagaggtatatgtagcttacctggctcgtgtaacgaatcagaagacattgtgcaagaggtgagcggacagaccccctagtcaagccagaaaccatcttgctaatagctaaacgatcattctgtctgatctgaaagttgggagacaaaattaacagagcatcaactcatcatgtgtctcaggctaggacaccttataccatactattccttttgcataccaaatgcacaaaaataaatcaatttctacataattacagttattttaagattaagtaaagtggaggtcagtgatatttgaagatgttaacccagcatagcatatgactaaaactagtgcaaaatggactgaagcaactgaaaattggttagtcataccttagttcagaaaagctttactttggtaaaagtgtttgacctaaatagtttcattctgagatatcaagacattgacatctggtgtataagttcatcgtcggcactgataaactaaccatggactattccaaaacagtaaactgcaaagcatatgacctgtggcctgacaatggcctcctgaactgaatccataagctatcaagtgaaacagggcacacaaaatgattcaggtagatattctaactttcaataaagaaagatgtcctcctagaaaatttaaagagtaaactatgaaaagctacaatatattaagtaaaagattgatattccacagttccatcatttagtcaaatgatgaaaaatacttttaacacagatgctcccctgtaccaccaccgatcatccgaatgtctttgagatccatgcacaaaaaatatatagctacgaaaaatccatgcacagatctcaaaatgtgccatgacacaacccaagggcattaagaagtaggatggaatcccattaagtggttaaaatctatctccctcaaatgagatcatgcagccaaagtgttcttcaaagggccaggattaatcagagtttgtcatgcttttcattttttcgtcaaaagctagtaaaacacaacgtgcaacctatattattaggcacagaactgctgccggcttctttggtaatgcccaggtacaactcagaagttctattcaccggatcaacaagatataccataacataggcattataatctatctcaccttcatgttcaatacctgtctttgctttgctattagtctaagtttagttgggcattgatcgatgaaacaaaatacaaacctggtgaagaagagctaggccatgaaattgcacaagtgcaaatcttgattgaacagcttcctgcacttcgttgctccatcttttcacgatttctggatttgcctgcatataataagtacagtttttgacttccgaaaagaattatgttttttttcgtatagaactatagaagtgtacctgaagcagatggatgccactaacaagagcagcactagcaaccacaggattcttatcaactatagcttgtttcaaatatctctcaatttgagtaaggagggtgccatcaattattctacacagaactctgatagcattggcacggtacatatccgtcttgctgttcatatctttcattaatgagcttgtgactatgataacctgttgtgtaaaattcaaacaatttagaatgacaatacaagaaacaagttataattcatggatctaaaaacagtttcctttgacctcatctgatgatggtgaaagctctttgatcattaaatacaccagccgcctaagaccagcatccttggactggaacagctttgttactgcaaagaaaacttctgtggcctcaacctacatcagaagcaaatccatcagggcattgagagcataaggcaagtttggttgcacgagatgtagtatcctacctttgtgaatgtctccccttggttgagtaaatacaatagcttagtgatgacctgagaaattccaagacacatcaaacaaagagcaaagccataataatgaataacaagagggtgaaacatacatctgaacacaatactcagaactgatatgaaaatgagagaggtcatgcaagaaacacttacttgcgagcacttcctggcatcaagctgcggatcatggaaagcccttgcctcctgcagaacggctcccttctcaatcccataaaatggcgagtactcaactgtaaaagcatccatgggttaataaacaggtaataacttgaaagcattttactacactgactgaattcaatctaaaaacaagagataggacactctctataaaagatcaaactgcaatatcaaaatgaaatgctctgacgttaaggtaaacaccgcatgtaaccagcttgcattgagcaccaaaaaccttaccatatttggatcatacaaattggccgaacacccatatagactaagggggtgtttagatccaccggcaaatttttttgccccgtcacatcgaacgtttgaacacatgtacggagtattaaatattgataaaaaaaaaactaattacacagtttgcgtgtaaattgcgagacgaatttttcaagcctaattgcgccatgatctgacaatgtggtgctacagtaaacatttgctaatgatggactaattaggcttaataaattcgtctcgcagtttacatgcggattatgtaatttggtttgttattggtctacgtttaatacttcaaatgtgtgtccatatatccgatgtgacccggcaaatttttttgccagtggaactaaacacagcctaaggaacggatctactcctatatgcaaattagacgtgcgaatctccaatggaaagtgaaacgaaatggttccagcacacgggcgcaactgaatctcatctcactattggatcaccaatgggcctagccgactgataattagaggatgaacataaaaaaaaaacgaagtgcgtcggaaccgaacgcctgtgatgcctcagaggagtgatcgagcgcactccagatccaggtaaacccaagctctcccactccaaattctcagggccaaagcacgccaagtcgcaaaacagaaggccactctgaccagcggagagaatcaaacattcaaacaggaagctcgcacaaccaccaccacaaactctcgggggcggacatgcacacg

SEQ ID NO: 66261 - DNA, 1312 bp, Oryza sativa
tttgggaattttgaaggtaggaaaaaggccactttgactcccttaaaagtatgctgaatctaattcataccccttaactagaaaaccaggtaaaatgactcctctaactattaaaaccggtataatttaactccctcgacggttttggatgccagttttgcttatgtggcgctttgacttggtccaattggctgactcagcgtgtgggacccacatgtcaatgtcacattttccttctctctttctttctctttttcccctctttttctcctgcctccgaatgacgccacaaattgtcgtcattcatggatacttgcaaggacatcgtcgctgcccgtctccccgccgcgggaactcggccggtgacagatgctcatgtgcctgtgcgcgacagtccttctcctcacttcttatcacctgctccatccttctctctctttctcttccctttcctctcccccaaggcgaagcgacaccgtggcctcgaggcggagtggtggctggaggtcctgatgcgcggcatcggcctggcctcaagcggagcgactttctatgggagccgtttttgctttatttgctggattttactattgggtgggtaaaatctttggcagacatatcctgaaactttaggataaatccatttttcgattactttattcagggttaatctgacattttttcccatgcatttcttaggacgtcggcccggcgtagagggggatggcggcgggccggcttggagacggggtggtggcgtggcgcgcccagacgccctgcggccgcctagggaggtcatggaacaggtcccctccaccgtcggcagcggctcggctagctcggaccctggccgacacaggagtagcctcgctgcaccgcctcgctccaacacgaaggtggtcctccccgccatcgctgacgaactgcggcgtgtcgaagttcacggacacgccgtcccgagtggtggcactctgtcacaccccgaagtttttctccctagccaaaatttaatttataaacgaccccaagaaaatgcaggtgcaaatcaagagaaaaccctaagaaagtaatgcaaataataatcggatttgatatgtggaatttttcttgagttctacatgtcgaaattcattaacaggatttttagtggaattttcagagctctagaaataattttaaccaattaaaattgagcaagcaatattttaattccagggaaaatcctttttcctttttctttttttctttttctttttcctcccttttcctcccttttttgaatgggccgccggcccattctcttcttcctccc

SEQ ID NO: 66262 - DNA, 9352 bp, Oryza sativa
gaccacgcccgcgcgtgcgccgcgttccctgcgcccactcccctctctcttccgttcgcgcccgcgcccgagatggccgggattcgattttcgaatcccgcctctctctcttcccccactcccccacgtcggccggcgattcccgcctctcccggccacgtccggtcctctctctctccctatttaagcttccccgtcgctccctctcgctttttccccatttcgccgacctctcccgagctccccattgctcccgcgccgtgcaaccacccgccgctgccgtttccgcaactccggccgccgctagccgccgctaggctcgccgccgcaccgcgccgtcgccgccgttgggttcgtgcggccaaggtccacctcgtccacccctcctccgtcgaggttcgccgccggagccccattcccgtcgtgcgtcggtgagtgacgccatggccgccgccttcggccggcgccctcgtcctctcgcactctcctctctccctctaacccctctccttttgttcgttaggaggttccggagctcgtcccgccgtcgccatcgtcctccgtcgcccgccgtcgtcgaccgttgtcggtgaggcctctcctcctcttttttctctctctcccgcaccgtttcgccgtcgcgcgccatggtcgccgggtcggtttgcgccgtgcccgcgcgcaccggccgcgagctcccgccgccgtccgatctacccttgggtagatcggggccgtcggttcggctgtcgcgtggccgccgcgtggcgcgccgctcctccccggtccgtggacccgatccgccgtggaccgccctccccgagccgctgactggtggggcccgcttgccggcgcccttcctccctctcccgagccgctgaccggtggggcccgcttgccggcgccgcccccctccgcgctgacgtcagccctggaatatattgcgcaataaatgatttaaggtttttcttttatagtaataaacacagtgaatcttctaaaattcataactaattcatccgagctccgtttaagcccattcaagtctcagtaaatcaagaaaaatgtgtagaatccattaaaaatggttgtgttccctgtttcagtagtcttatagcctgtttgcaatgtttgctttgtatgtcgctagattccgacccctccgacgctccggtgtacttcgaaatagtcgccgaggttcctccagcagcagagcaaggcaagtcatgcttgtcacttgaacatgttgatcctatattgcaaatgctccattgttttctttcaaatattgcattgttttataatattactatgggatggttacctattgttacagccatgctttttggataccatgctcctttgttagcttggggttataacatgattagagtttggactaggaattgcttagccatgcttagttcaactagttcacaatggggaaaatcatattaatgcttagactgttggttctaatggttttgttggattagtgccaccgctttggtgttggttaattaaaataaatcacatggtgggctgtgggtgcatggttttgctggtcgcacccatggcagttaaggaccggttcgcgggatgccctggaagaacttatcgtacttaccacaagccagcgtgggcaacggctgggcttgtagtgtagctttcctctagtcgacgcattcaggcaagggtgggcgtgatagagcggggcgggccctgcgacggcctctgtcgcttccggattcacctaggcacgagaggggactgcccgttgcccgctggggacgggggtgaaacctgaggtgtggtgtgcttggctagagggggttatgcgaagggtcctgtcacggcctctttccgatatgtcgtggtggcatgtcggcgcacgaaaacgtgtcgcggggctgtgtcttgtgggtacagttgtacacctctgatcagagtaaaactattcgaatagccgtgcccgcggttatgggcggtcaaccagattcaccgtgattagtatcaccctagtgtaatcttttgaatttggttagtttaggtggatggttgggcctgtcgcaacgtgggatagcgttggatagtggatgtttaattaattattacaacggtttaatctttcaacttctgtttataaatgctcgctttatgcaaatgaaccgctctagctcttctttgataattccgtgcatcatacccctattccggtatgacttgctgagtacagtgggtagtactcagtcttgctctacttttcccaaccccagagttcgagttcgggtcagatgaaggtttctccgaggagtaggctttgtccgtgccgtcgaggatgcctgtggagtggtgttcccgctgcagttttagtcaaggcttagctcttgttgtctttcttttcttccgctgcatttatgtaagacttttatgatgtttgtaagacgtggatctgaatgtcaacattgtcgtttgtgtaccccggctggtcctggacggggaatttaatgcacattctgcttgaaattctattcgggaatttctgggcgtgacacgctcggcgtactccaccaatggcagtggcacgggcgcagccgcacagagaagacgcccacgtgctcctctcgccgtcagtcaccgcccactcccagcgccctgaagaaaaagaggtagaaaaagagggggaaaagataaaagaaagagagttgaggaaaatgtgacattggcatgtgggtcccacatgctgagttagccaattggaccaagtcaaagcgccacatcagcaaaaccggcatccaaaaccgccgagggagttaaattatactggttttaatagttaggggagtcgttttacctggttttctggataaggggtataaattagattcgagatacttttaagggggtcaaagtagactttttccttgtgttaacagtgaaatttggtaagcccggagtaatcatcggcttagagtcagcatcgacttcgaagtcctgagattagccgatgagacttatcacgtcgtcagttgccggattcttgctatattcggttaaggaaattgatctactaaaggaagcttatccagaagagaccgagttcaaagagaatgcgacatagcaagttatctattaattaggaataatttgttagtttccttttatctttaggaaagtgtgtttaatgtcctataaggactttatcttttccttttatttgtagtttcattcttgtccgacaaggactagtatctccctatgggtataaatatgtacacccgaggtcattgtaatctatcaatctctcgatcaatactactctcggcgcatcgccaccctctttaccgaggtttttacttatcatccgacggaacttggcacctagttgcattgtgtttagagacgcatcaatttagttggaatgtctcggttaggtccgatcttctgtcttagccaatatatctctacaatcacaaaggtgttctaaatagatttgttatatccatcacattagacagatctatcggctcatcgagtattagattatcatatacaatctcgtgctgcatcggttaggttcgacctattagattgttgttgataatataagtcttgttaagccgataggttcatgctggtgtttatcggggtgctagccgataagttatctggacgttgcatcggcttacaaggattgcatatacatataagtttgacttagccgatcgcaacaaaggtttcactgtttaatctaatcttgtggattttatgacatcggacctacagccgatgtatgttttaaccgtcggatcagtgcttattctatcatatcattgctagctaattagtttctaatggattatgttattgttatactacattatcatcagccgactgcctttatatcattatttaagtcaagtgtcagactctacattggacataaagccgatagctcagaaacctatcgctatcggctggcatcggttatcggctggtatcggcatcggctggaattatttcatcggcttgtcaaccgatcggctatttgatctactctttacatatcttgtcagttgcagaatcaaactgactagcacgcccgcatctcaccaacctttggatctgcattggagctaagcagatctcaggccagtgtgtgtttttcgcatcaacaccttgaaggtattctggaggaggaggaagttcactttaggtcccttagttcgtcgcccaatctatttttcgtccttgatccaaaaaccggatataatacatccctcaacttatataaccatacaaacgaagtccctcggtagtattgactccagttttaactgacatgatgcctttgactaagtcttcgtcccacgtgacattgacatggcgcttacgtggcagtttgacaaaaaaaataaatggaacaaaattaaagactaaaaaaataaaacaaaatatacgggacccacatgtcagccaaacaaaaaaaataggacccacatgtcagtggttcccacttcttccacctcaccctcttcccctcttttccaatcttcttttgggtgtccatcctccatccttccccgctcctatggcagcggcaagagcaagagggagaggagcgcagcaaggacgccgagcgcgacgggcggcgagagaggagcagtgtgcaacaagcggtgagagtggagcggccgctctccgtggggggggggatggccatcggggagaagggcaatgaccggcgggaaggagctaggcgatgggcgcggtgtcaccgagctcgaccgctgtggggaggtctagggacctccgctcccgcctcgccatcaggcctcctaagctcccgccgcggcgaggctaagcaccaaacccacgacaaccacggggatttgggtcccctcccgtcgatgatggatccaagagccagtcaaagttggatcccctctcgtcgcgtctcctaatgccgccatcggatcccctcctgtcgtcgttgagttccccttttgaaggccgacatcaccattccctctctctgcacagctgcttccccacttctcctgcagacaatggtctccattacaacggaagaggagcaagccggcagtgacctcgtctcccatcaagcggtgccagtgaagataccccccttctccctctctatgcatgctcgctagggatgcaagtgggtagtcctactacccgcataaaaacccgcttgctagtctatttttcgcatgatagtacaaaatttagaagaaaaaatgaactagaagtaggataagcaggaaaaaaaagcctgtttgcctgcccggcttgcatccctaatgctcgccagccgacgaggggagcttgaggagagaggaaggatggccgggacacggcacaaagaaacacgtgcagtacgttcgacgcttttcaaccgttccattagggcagtcccaacccatattgtccataagcagtgtctatggtgccatgtcaataagacatcacaatagaaactacactctacaacctatggtttcttaaagtgggccattaataaatataaactacactctacaacctatggtttcttaaagtgggccattaataaatacatcatctctcttctctaccaatcatatttattcttcatctattataaagagactattctctccaaatgcaaaacttgatagtgtctagtgcatgggttctcgtgttgaaactgtgtcttgcatgagacccggtttcttcctctattcactctctctctcttaattaatacagtgtcacataagctaaaagtcctacatgacagtagttaatgccatatataccatcttagatggagagttgggaatgcccttagaaacaagctgactaaacttatgtaagttccttcgaatgtatccttaacttcaaacgaaacctctcttcttccttttctcgattcagtgcaaacctcaccagtagatatatgcaagataagcgcaatatcgcattactcatcgatcggatacatcattaaatcacacgataatacagccaacaaagcagtcacgtcaaacgatcggcctgcaatatgcacgacagtatcccaattcccacatacacggtacgccccggttcccatcgatgattcgccatctcgcaacaccacacagtttccactttccacactcacgcaccgaagaaatagtcaagtctagctcgacgcctccgatcatacggctagcgatgctgttgccgccggggtggctcccccgagtcggcgctggagtgggtcccgtactcgctgctgtcctcgatgctgctctcgaaggccaccttcctcaacctgttgatgtcggaagcgtagttgccggagtcgtactccgaccccgtgctgaacatcatgctctgcccgggcttcaccccttcgttcaggtcgtccagcgacgcgtcgccctccagcgcacggacaatctgcaatacacgcaaagaagaaaaaatatcatatattgccaggcaaccaggtgatcgatgatcagtttgatcactgtgagctgtgcggtttcaattacctgcttcatctttgggcggcgcttggcggagtggcggacggcggcggcagcgcatgcggccatgcgctccatctccagccggtcgaacttgttctccaggcgctggtcgatcagctcgtcgaaactgccgtcctccgacaaggcgcgcgccaggaggggcctcgcctgtcacgaccaagcgatcgagtggccggcgtgtcagaaccacgtatgtaagcttaggatgtagtagtggtagtttgcgatggaggcgagggtgacgctcacccagtcaaccaagctgtcctccatgtagttcgttgggtcgaccggtcgccggccggtgatcagctcgagcagcatgacgccgaaggagaagacgtccgatttgtccgtcagcttgccgctcgacgcgtactcgggagccagatacctacacacatgtaactgggactcgtcatccgtgcccgctcgtccgtcatgcatgtcaacgagcgagccacggtctcatgttgcactaacccgaaagtccccatgacgcgcgttgagacatgcgtgttggtgtccgtggttagctttgcaagcccgaaatccgcaacctaatgcaaatgaattcaaacaagtcaggactagctagttcaatcttaaacgcagcttaaacaagctggtgtgttcaccttagcatcgaaattctcgtccaagaggatgttggccgccttgatgtcacggtggatgatcctaggatggccttcgtacgtgacaaccacaatgcaacaaatcagatcgttagaaggacgtacagacaggatttgtccctgcagactgcaaattaaacgaaaagtttattagggaccttacaatcttcgtgaaggtacgcgaggcccttggctgagccgagcgcgatggcgagcctcgtcgtccaggccatcaccggcacgcccttccctgcacgcatccggcacacgcgcgtgtcagaatcgaacaaaaatctcacgtacgaatggcgcgttacgatggctgggaaaagagcaggaaagatatggagaccgtggaggtggtgctcaagggtgtcgttggggacgaactcgtagacgaggaggcgctgggatgagccggcgatgcagtagccgacgagggagacgaggtggcggtggtggacacggctgatgatctccacctcggcctggaactcgcgctcgccctgcccgctcccggccttgagctgcttcaccgccacctccttgccgctgcccgcgaggacgcccctgtacacgtacccgaacccgccctgccccagcaggttcgccgacgagaacccgcccgtcgccagcgccagctcgtcgtacgagaaggagctcttcgagaaccccagcgccatgcccggtgacggcggcggcagcggccccgccccgtgcgacccgctcatctcgctgctcggcggcgcctggcctggcgagtactgcgcgtgccagccgcccccttggtccacgctgttctgccacctgggcatgctgttcgcgtagtacactttccctgcatgcacgcggacgcgggagcgcaccccatgtcaactgcacaagatctctctgcggcatgcgtggcgagcgcaccatgccgtcgcgtcgcgtgtagatgtgtgcttaccgttctcgtcggtgtagtacggcatgtgcatgtggggaggtctcttcttcttcttggagcagcacacgcaggcgacgatggccagcagcagggcgaaggtgaagaacccgatgaccatgccggcgatgatggcagcctctggccccggcctgttgccgttgctttcgctcttgccacggtcactcgagctgcctccctccttggagctcccactgtccgaggaggagccaccgtcgccgctacgcttcggagcgggttgagactggacggcctttggcgctggcggcgagccatgcgatggtggtggggacccgccgccgccggtattcgccggtggcgccgactgcgacggggaaggtggcgacggtgctgagcccgaggaattggtcggtggggccgacggtgtggacggtggcgggctggcaggaggcggcgatgaccccggaggaggtgactgcgacgacggaggggacgacgacgtggagctcggcggtgatcccgtggagctagagctgtccgcgcctgccgatgaatccaatccatttccatcaaacagattatctagcggggaatcgtccatttcccgccggacgtcgagacggatctcgccccggcgatgatcaagacgattccacccctcccacgagaggatgttctggaatggaacggcgcggcgcgcctccccctcctcggctcctcgtcgcgataaacccctgcaaaaatatgggaggaaaaaaatggtgatattatctaaaaggaaaaaaaaaagaaaggatgcataaccatgggagaggatagtgagggatttgaggattttatctgcatttgagggacttgtctcatgtttcatcagacctttggtttagttaacatgtccattcatacagaactacacgctgaaaagcagtccttttttttttgtttatcttacattttagaatcctggaacatcaaggaagatagttcaaaagctactttaccttacatcttagaatctaggatcaagggaataaccacattcactttaagaaaagcaaacatcatgcaaaagaaattggggtttatgaaactggaggtgagatcgaatacaacattcagagtaccaaacaaatagaggaattgaaatgccatgaaattgaagaatcaataatgtaccttcctttttccctgttctttct

SEQ ID NO: 66263 - DNA, 1813 bp, Oryza sativa
taaaacatgagctaccctatttgcttctctctttatcttgtgcacttgcacttgttggaaacactacatcactcctttaatctcttcaattgtcgtcgcctatttatcttgtgcacttgcacttgttggaaacactacatcactcctttaatctcttcaattgtcgtcgcccaggccgatttcaatggcccctgttgttttatgccatcgacaatttcagcattgtccatctccatcacaattggcatgtggatcaattcaaccgccgatcacagtccttctagacatgctagcgcctccgcctgggccgaagaaccgcattgatgcaaggttttgtggccagcaagaagcaccaaccccttcagtctctgaatataaatccgacgcttgcatccccagactcttctctgtaaccagcgtcaacattcagtttagcgaaatattccggcggcgcacaccatctgtcagcctgtctgttcatacttgtagttggaacttttttattatgttccatatacatagggcccttccctttgtgatcatcttcccgttgtcggatcggctacaattgattttcatagcttaccaggaagctagccgagtcagctattgatgcatttcctttaccatggatcacgtcatttcgcagatgccaggctctccaaagtaaatacatctgccttcgctgaagtactgagactgtccagcagtactaacagccaatcagggcccgtccatgaaaaactccaaaaaaaaaaggagtttatgtatattaccatgcaaatgctttgtgccatgtagatttcttttctttcttttaataaagagccagtaatagaaattaaatgaattttgtatcagtaaaaaaaaacagtgactgaatcttcggtcattaacagtcagcagttgtcaaataacaaataacttatgcccatataagaaaacagcatcgaaactggtgtactgaacactatcgttccatgcatctttgtgtaacgtcagacaggacagggaaatttcatacaagtaaaaacaagagcataaggatagattttgctcaaaagtagccagtatcccattaaataaagagcccgataatacaatgtagcagcagctcaattagaatcgaagcaaataaagtatttcactcacatatctaaaccagaaagaaatggacatccaatgaagaaacgtatgcaaattactcagttccagggttaaccagtgaatgtttggagcattggacaatgcatgcactgtccgtgttcgaaactcatacagaaacaattatagcacatcacccaactatacaagtgactcagataacatactattcaaacaactgttccgaatcagctatttcacttccaggagttcctgccgaagatttaacaaccgtctcttgatcagcataaataaaactctctggcaatttgagtactgctcgatctccatcagattcaccccggtaggccagcccaagagcataccccaaagctcgagcaactggaattgcaaccgcattgccaacctggatatatctacattgaacaagaatacatagcataagaatggaactacacaacactcatctgtcatatactattatatctgtgagtaattcaatccaaaatatggacactaaagtccatattactgattcctgaatccactacaatcgatacaaacatcctataagcacttacttctcctttagtgggccgatcaatctgtaatagtcaggaaaaccttgcaaccttgcattctcgcgaatagtcagaactcggtcttggctaggatgcaaaataatctg

SEQ ID NO: 66264 - DNA, 1270 bp, Oryza sativa
ccagatgacagtcgttcacgggaaatgtttggatccagccgcacagtattatctgggccaactatgacgccctttagatcacgaaagttcgctccctgaaacagaaaaaaaggtaagcaaccaaggtattgaaagtaactggcatgacaatcttaagccttgctaaccttttttacaggtatccgctgcacacgctcataatcatctttgtttagctttagaggttgatgatcaaacaatttaccttcttcagaaggatcatctccacgaaaagagtaatcctgaatgtctgaaaatgaataacaaaacaaagtaacttggcctagaaattcaatcaagaaactacaagtagcaacacttagaattgcataaaccaacgggcaaggcaattgtcaaacccacacactaatgaaaatttaaatagttagaattccacaaatgcagagggaaagagcataacaaacgaacatagccctccatcccataaaaaaataaacctagtaagggatatggatcatcttaatactacgaatctgaacagactgtttcacatcccatattaggtgtgtttttttatgggacggagggagtagatttcatgaacagtatttatcgatatttgttaattcaattagtaacaaatcatggactacctttacggttgttccggatataccgttgaaattcagttttgggggcaacactatactctattacatctttaggttgatcatttccaacctgtaaatttgtaatatagcacatacaaaaaaagaacaacacaattgtccaatcagcattcaaaagataaagatccatggatatatgaaaataacacaaaccttgggtaaatcagatatggcatctgcaaggagaagagcctttcgtaggcaacgggtgtctacctcattgtatgcagcaacactatgctgcaaatggagcagccaaatattaaggcgatacataatacaataatgaaatcttggcaattatttactcaattctcttaccgaaaatgtagttggtactattccacgcacaacagcatcatgggtaggaagtgggaattttggtaatacctattggtgaatgtaacatcttaatatgcaaaagtgtcacaaaggaataagattaagaaagcatagagagaaaccattgatggaagggctccccagagaaatgcccgcattctgaactgcggtagcccataatatcctgccgccatcatcccaagcctagcttgataattcatagccacaaggcaactcat

SEQ ID NO: 66265 - DNA, 985 bp, Oryza sativa
tggaagaggctcatttacatcgtcagcatcatttaagggcatatctatactaggttctagtgtatcgtttttgtggacaacatattttctacaaagtgcatcccactgctgaataagggcaagaaaatcctcagttttctcgttccgcacctacaaagtagaggcaaaagcaaacacatgaatttgtctatgtggtggatgtgcaaggtgatactatctagtggcagtacacaagtggaaacaggaatgtactacctgcgagtatgggtgattatgtttgagacaagcacaagcatatttgtttatgtcaacagcccacctctgcacaataaagcaagtattaacattgtcaatagacaaaagagcttagtaggcagttaggagtcacaccaagtacaaaacgtacagtctctaaatttatgccagaaaatgcaaaacccaaacaaagcccagttgacatagcgccacatcctgagtaaagatcaagcagagaagctgtctctgtttgttcactatatggtgccacaatatcagccgacaattttcccttagaagaattgtcagcatcatcgcaggaaatatttgatgttgcctcactccccaatgcaccatcattatctacaagaaaatagctccctcagaagataagacaataaacattgagattgacaatattgaagcaacaagtgtatttttgcatctgtcaaatattcaaaatagtaatataatataaaatatttttctcatacagtttatcataaaaggtctcttatgtaagttaacaacaaagtgaatgatgcacatacacacctatgataattgcaatgggaaaagaatcatgtaaacaattacctgctggaagatttgcaaacgtggaatatgcaacagagtaagacatgtcatagtacaggtcacaatcagatatagcatgagctcttgcttgaggcgtcatctgaatttgtttaagtattagcacaacaaaaaa

SEQ ID NO: 66266 - DNA, 6054 bp, Oryza sativa
aacaaaaatggcagaaagtaaaaggtacattaatcatcccttgttagtcagtcatataaaaatgctatcgtaaaagcaatacataaaactaggaaacaacattggttaataaagttctaagaagtgtgaacaagatattcatgactgaccttgacatagacatcatcatcaagatgatagatttcatcatccacattagcagccaggtagtgacatcgagccttcatttcttcatcttcgtcaggcctgcataaatgaaaattctgatcaccattataaaagcagcataagaagagattaagagtactttcagaacaatgttagcgtaaaaacacacatactcctgcttaagaagcgaatcagacccctgcaacaaaaacaaaagagcatgtcagttttatttttcaaaatcatctcaaaatcgaagtgataacaaactttagtattccaggagataactctagaatagagttagaggtttactagaaattcttacctttctactgtacctcacgggccatcgttgtcgcgcttcatcatccggtactggatcgcccacaaagtggtcatctgagtcctccacccttctcgcagtgcttggccgcgccaccctcttcctcgtcgcagccttctcggctgatccttctccgacacacttacccatcctctcctctgcttccagcacgtcggctgcctcctcctcctcctccatggccatctgttcggcgtccggctcatccgcgcacacgtcttcggccagcgcgccacccgcatcgttcaccttcatcttctcgggcgcctgagccgccgacttctcggtcgtctccttcgtcttctccttggccgtcttcttacgggtacgacgcttgaccttctccaccccgcgctgccgcttgccgcgtgactctgcgggcgacaacccactgtcgagctcggtcccctcgggctcctgcgccgccgccttctccacgtcctccggcttccattcggtcgctccctcatgggcactaggcttctccttcgccgtcctgcgctggcgcttgcgcaactcggggcgcggcatctcgcggtcgatctcgtcgagctcggccaccccctccgccgccgccgccttctccacgtcctccggcttccattcggtcgctcccttacgggcaccaggcttctccttcgccgtcctgcgctggcgcttgcgcgactcggcgcgcgacatctcgcggtcgatctcgtcgaggtcggccaccgcctccgcctcggcctccatcgcggcggccgtcattaggcgcctgcgcgtggagcgcctcggctccgtcgccgccgcgggagccggctccgggaccatggagccgcaccggcgcagccgcagcccgcaaccgaggccgcggagatcggagacggagacggagacgacagcgagagggggggagagagaaggattagctagggttttacggctcagcgagctctcgatcgcagagtgtggttcgccttggataggagcggaagcaggaggcgctttgatggcttgcggcgtcgcgacgggaggaggtctcgagcaggccggattcgcgggaatgcgtgacgtcgtggtctcgtgccgacgcggaagattggaatggaaatcggagagagcaggggcggtgggcggtgggcccgtgctcgccgcagctcatgcaaaagagggggtcgtggcttccgagtgggccccacttgcagtgacggacactttccttcctcaaatcctcagttctgttggtcttctttttctctccggtggggatagcctagagactagtcaatggcttgtccttcccgcgatgtcagcagcatctgtgatctctcagtgggacccacgtgtcattgggcgaagactgatcagcgccgggagggccaagagcgggacgattcaaactttgggctttgagattcgtgtagacccattgtctggcagcggcgatcgtccgatcggctggtcgtgtgggtccgccaggagcagggtgatcacctcgttttctggtcacagtttccttttgtgtgaaaaactgaaaatttccgaaactttctggttaccgtttgaattccatcgtactcgtacgattcccttggcatacgttttgtatgggaaaaaaaggaagcattttcatgcatatctctatgctcaatctgtgattgattatacttactgtttgaattttgaatcaccgtgcagaaaaaaaattttgctcggcatgaactattcatcttcgccatggatggtgattggtcatggactcgcggttcgggggctcgcggcaagagtaccaaacatagttaccgctatttcagaagcccgtaactatttcagaagcccgtaacaaacaggccgtgagatacagtacactatttcagaagcccgtaactctctaaccagcaactagctaattgggccgaattattaatggctatggtttcctggcccggcccatagttaccgctactactcactctgccgagactgcattgtctacctttccaccttcccatcctcctcccgttccggccaacaccaccctctcctcccatggcctccgcctccgcctccctctcgctggcgttctcccctctcctcctccctaccccgcgaccccgaccctactcgcgacccatcaacccggggtttcctacccccctacggctcagccttgcgtgctcgccgccctcccgtcgcgccggcccggttgccgcggtcccggacggcgtcgccgtcgcggacgtagtggagaaggactggtccttcctcgatgctgcggcggcggcggcggccgcgggcggcagcctcccccgcgcgctcgcggcgggggccctctcccccgcgtcgcgggtgctggccgtgaccccccggccgtccttcgtggacgccctcctctcggggcacccctgcgagctcctggtggccgcgcacgagtccctgtacgtgctggcggggatcaaggaggggcacgacgaggcgaggtgcttccacttggagggaggcggaggcggcaggggaggcggagtggtggagggcgtgccggagaggttcgacgcgttcgacgccgtgttcgtctgctacttccccgggatgggtgtctcggccgccgcgctgctcaagtcgctggccaagagatgctccaaaggtgagaagctatcttatctctgttttgctctgttagcttcgcaatcatttgagggttaaaactctgcattcctcgcttaattggagggcctagttgtgggtttgtacataatcagcggaattgctgtgttcactgctcttgaggtggtttgtgatggttaagaaactaggagtacattttgttgtgacaaaatttggtttgtatgactaacagtgacttgagatatcaatgttagtactaggtaacctgttgccttgccatattcatgaaataaattggatacattagtttacaattacatgtggttttgatacagtgtcctacatggtttgaatcgttaatccttgtgtgtgctgatttagtttgcttgaaacaattttgatgcgatttatggaacagacaaacagccgtaggcatgcatatacttgttttgttctgattattttcagttcctgtggttaggctagttttaaatcctaattctacattgtagatggtgtttgtttcatggagtgcattagctcaattcaggcactacttgtatagttgtatgtgcctaaccttgccctctaaagttttaatggggtgatttgcggccttgttgctttatatatgctttatagttcatcttttgcatctgagaattgaatcaagctatcaaaatgtccttgttcttagttcaatagtattcagctgtccttttctcttatatacatttgctccactcctcagctccgacaacccagcttctcacaaagctcttagattagctatcttaacccgttgcttcttattattaacaagacatcatcaaggatcagtcatcaacctttgctacatcccctagtttagccaaatttcatgaacatcgacttgtcagggtgcttcatgtgttgaggtcattctgatatgttgtgattataccacctggatatttcttgtatgcattttgtcttgaattgaaacgctgtatgccgtttgccataggtggaagagttgtcatctttttggatcaaggacggcaaagtttggagcaacatcgcagggaacatcctgaagttgtaactgccgatttgcctaccaggccttctctagagaaggctactgccggtagcaagtttgaaatattagagtttgttgacgagcctactttgtatcttgctgttttgcagtttcaatgatgaacttgttgaaaacaacaaattatatagacagcttgcccatccatgccggcgagaatcaactcggctttgtagtttgtagatatgcaagaaattattgcaaagttaatgatccttatggcagccaagttactttgtagtatccctgttgacatatgggaattaccagaagcactggcagttaagggcatttacgattagatgaagccctgcgctttactgtgggatatatggatgaatttatgttaaatgtcgtaggactaatcgatagatttgaccggtttgggttaaatattgtgaaaataatgtgagatgataatttagtatgcttctatattgaggtttagaatataatgaattgtagaagtaattgctatgcatgcatggtgagttttaggtgtttagtgagttgatgtggcatgtttgcatgttattcttttgaatatactaacaactactactatgcttacatatgttgagttttagatgtttagtgggttgtaactttataaaagatataggccttgtttagttggggaaaatttttgggttcggttgtcacatcggatatatggacacatatttgaaatattaaacgtggtctaataacaaaacaaaatacaaattccgtcaggaaaccgcgagacgaatttattaagcctaattaatctgtcattagcaaatgtttactggagcaccacattatcaaatcatggcgtaattagacttaaaattcgtctcgcaatttaatatttcatgcatgtattcaaacattcaatgtgatggatgaaaagtttttgttttggtaactaaacaaggccatagatactgtgacgtagggactagcgagtggcctctccttcacgttggaaccggaaccagggctaggtgaccgttctatttccagtgccctgcaaggcagttcgcacttcacatgaactagaactttaccgcatttctgaaatctatgcctttactaagttttcatacacacgaggaacgtacaaggaggaggctaaaataaagaagacagaggcagccaatacaaggaaaaaactcaagcatcttttatttcgttcggacaatacaaatcactcaccaagtatagtgccaaccacaacagcaacaacagtacagatctcccgcgtgtgttgcttttatctcgatataaatgaaaacatgctgccatttttcgagcaaaacagattgtattctttgacatcagtctgctccctcgagcaaggctgaacttgaacctgagccaacggcgttcttgtagctgactctccactcgtgtcatctttggatgatggtggggcagggggagctattggcaggttgaattggaacaacgagaaggatgcattcccctcaggcgagcttttgttctctcctggagcatccttcaggtccaacggcttaggctgagaaggatgcctttatagagtcgggtctccatgaggatggccaacagtttgactctgatgcaatccatttcggtaaggcggcgatgtatgcatgactctgaagcttggcgtggtcttccgaatcggctccggaggagcataactaaaagcaggagctgggaagtgatgaacattgctgtactgcactggaaaatcaggagactgctttccaggtactccaaatccaagtggattggaatagaagtggctaggctgggcatactgcatgtatccacttgctggagcagccca

SEQ ID NO: 66267 - DNA, 895 bp, Oryza sativa
tgcaaaagtggtagggcattgactattgcacaattaactcatggaagtttcttgaacaatcttggaccttttaccattcttttgctgatacttatccaggatctaacagtggatattatatcaaccgttgcattcaatggtacatatcttcagatgatgtagctcaatgatgttgcattttaagttttacctttcacttagagagatttggcaaccaattgataattgatcattggattatcagttccagttatcataatttggtttatgaaaccatgacgatgatgataatggaacagtactccaataatgttctattcctctccaataatgttctattcctctccaattaatgtgcaggttttgctaatctcttcggtgatgtgcagtctcaactctacagtgacaacagtgttgggatatctgagctatggtgaggatgtgcaggtgaaggtgacactgaacttacccacggggaagctgtacaccaagatcgccatcttgacgacactgatcaccccgctggcgaagtacgcgctcgtgatccagcccatcacaatggcgatagaggacaagctgtcggcaatgatggcggcggtggctgacaataggaacaacgggctaaccagggtgctcaccagcagccgtcgttgtcaacatgacggtgctggcgtgcactttgcccttcttcggctacctcatgttgttcatcgggttctcactgaacgtcgtcgttgccatgttgttcccgtgcctgagctacctcaagatctacatgccccgaggaagagttgtccgcttcgaggtggcggcgattgttgggatactggtcattggagtgtgcgtcaccatcgttggcacctacacttcccttcaccagattatcggcacattt

SEQ ID NO: 66268 - DNA, 1123 bp, Oryza sativa
attcctgcagccctcataggacaaatcaaagtacttctgtatatatgagggggtaaaaattttgaagtagaaatgcactaattctgaaatgacagctaaaatagaatggaggagccgagcaagtatcatgttcaacagaatcaccaaaaatagcttttgtggtacaaaatgaagaatggacctctgtacaccaatataatgaagacatgcccggatgctccataaaatctgaaagtatttgatattgtagggaagaactagttaattgtatttagcaaatcctagaaagcatagccagtacttgcatgatcatatcgaatactcgatgctaattgtgttcttgcatagttgtctcttcttatgatgaagctattaattatgttggtcaagtgcaatatcttatctgtggtaacccccatcagctacctcactgtcatgcaggaaagtgtctcaatcaagcaattgaaggatttaaggtctttatgtattagaattgtttccttggcacttaaccagtatgggagtaatgactttggagaaaaattctggaatatcttttttacttctgtgaaacctctgattgactgcttcagacaagaggcgtccagtagtgagaagccaagttcattattttcatgcttcatggctatgagtcagagcccaaaactagcatcattactgggggcacacaaccttgtaccagccattttttctatcttaactgtgaagaaagcatcaggatccatcacatcctatgcacttgagttcattgagaatctgatcaagctggatactgatttagagcagcatggagatcattcactgaagaaaattcttgtcccacatatggatgttcttctccatagtctcaatgattttgttagttatcgcagagaacttcacaggtatatttcgctttatttaattttggagtttgttgtttatctatccattattagtgaaacccctcatgtgtgaggctaaggcctttgaaactattttttattttgtacaaatgtgctgcatttgcaattctttataaactcttcactggttctatctgatcctctatcttcatggtctgactatcagctagtattatgggccataacccagtatgggg

SEQ ID NO: 66269 - DNA, 1265 bp, Oryza sativa
cctagatgattgcctatttgttttcgtagttgagttaaaaattcggtgcttcatacatagtagctttatgttgctattcattaccataggtgttttgtgctgcatttcaccccatcagttggtgtactaacaccttacacttgagttatcttttgttgcttgctggtagttcagggttatgcatcttgtggttactggtacatcaggggcatccgttagatcttttgtttttcttcaacaaacttaactgttgtttatttgttcattttaatcttatttttttcattctaggatgtgacgatgaaagtctttgttccactctttttcaacatgttttttgatgtcaaagctgggaagggtgaacaagtaagagatgtatgcttggatacactttcttctattgctgccaaggtgcagtgggagcactatcgaacaatattgatgagatgcttccgtgagttgagcctcaagcctgataagcagaagatcatattgaggcttatatgtgctgtgctagactcgttccatttcatgaaacctgcgcatgatgtctcaaggaattctgatgctatgaatgaggattctgattcttccttgactttctcctcaacgatagtctcttctgagaagcaacactacctgcaaaagatagtcttcccacaggttcaaaaactgttaggagcagatccagagaaagtcaacgtaagcataaacctggtagcacttaaaatacttaagttactaccggtagattatttcgagtcacaactttcaagcatcatacatcggatttgtaactttctcaagaaccgtcttgaaagcatacgagatgaagcaaggtcagctttggctgcatctctaaaggagcttgggattgggtacttgcagttcgtggtcaagatattgagggcaatactgaaaaggggttatgaattacatgttttgggctacacacttcattatttgttatcaaaaaccataacttctgatatgaatggtaggcttaactattgtttagaagatttgcttgctgttgttgagagtgatatacttggggatgttgcggagcaaaaggaagttgagaagattgcatccaaaatgaaagagacgaagaagagaatgtcattagagacactcaagctgatttctcaatgtgttacattcaagacacattctttgaaattaatctcaccgatttcttcccatcttcagaagcaccttactccgaaattaaagtcaaaacttgagatgatgttacataatat

SEQ ID NO: 66270 - DNA, 12085 bp, Oryza sativa
  unsure (1)..(12085): unsure at all n locations
ttcttttagatgtcttgccttgttgattaaacttcctttgccatctctcaaggacaatgcaaatctgatcaagaatgtacttatggacattgcacagagagctgggaattccaatggtcatttggtcacatcttgtttgaaactgcttgctgatctacttaggggtttcaggatttcactttcagatgatcagctccagattattgttcatttccctatttttgttgatctccagacaaacccttcacccgttgccttgtcgcttttgaaggcaatagtcaaaagaaaattggtttcccctgagatttatgatattgtagttaggataggagaattgatggtaacaactcaaactgaatctatacgccagcaatgcatccagattctgctgcaattttttctaaattatccactctctgagaagcgtttacagcaacatattgattttttcctgacaaatctaaggtaagaatatccgtagctacttacctttggtattgcctttgtgcgttgtaagctaaccttatgcaaatttgcagttatgagcatccatcaggaagagaagctgtgcttgagatgctccacaatattcttaccagatttccccagaggatagttgatgaccagggtcaaacatttttcctccatcttgtagttgccttatcaaatgaacagcaccagaatgtgtcttctatgatccttagggcaatccaaaagttgttggggcgcatcggtgatcagggaaagaattctatatttgaatatactctttcatggtacacaggtgaaaaacagaatctgtggagtgcttcagcgcaggttaatatcagaactactttattttcccaagcactacattgcacgatttagtgcgggcagttgcaaattgtgccctggatttgctttcacattttgggagagcattgaagcatttccctcatattattttattgcatttatacaatcttcgtttcatgaactgagaaataatccttgtaaaaaaattttcaggtcattggtttacttgtaggggatcgttcgttgggaattggcaaacaccttaacaacattttggctaacgctaagcaaataatggaatgttctgtcattgcttctggaggacaagtagatttagctgatgaaacttgcctgccattttggaaggaatcgtaccactccattgccatgatggagaggttacttgcacgatttccagagttgtacttcaagcaaaatatggaggtatgattacttgtgagctgtatttttaaactgttttacaagaataaattctggcatgattttctctgatagtttgatgcaatgctattctccattaattgcatgctgagaaccatcatagtacatagatgactcttgatatgcatctgttagccttctattcaagtgcacttggatatggtcattgcttcactagtgttccctttgaactagctctgtataacattcagattatgttatttaaatctagatgatgactagcctttgtgtttgtgccttattattactgtatttccgtagttacgtcttttttgtcccatttaatgatacttagtattttttattttgatacttctgatttgcgagaagtggttgttaacagtatgtgtttgagacctgcaacttccttttggttgtgcaatcaagtttgtgacccaattctacctgcaggaaatttggatgatagtttgcaagttgctgatccatccccattcaatgttgcgtaatatatccagctctcttgtggcctcatatttctcttttgtagagaagagtaagcgtgaaaagaaatttgatggcaagtcctcactgcttatccaaccaagcatgctattcctaatagctgtttcgttgatgaaacaattgagagcagaactaagtgatactacagcgaacaatctaattgtacaaaatctttcgtattctgtctgtaacttgcatacattggttaagcaaacaacctcgccacaccagttttggtctagccttagttcttctgatcacagtgcattccttgagggttttgaattgtttggttcaacaaaagcaaagaacgcatttctcatctgcacttctgcatctactgatgtaaatggatctaaccttgatggaggtgaagagcttacatctttgttagtttcttcgctcctgaagaggatgggaaagattgcaatgcagatgcaggatacgcaggtaagcagcatctctcaacatgaatattattctcagattgaacttatactttgcatacaatacttagagttgtactttcactatgcatgtgcagatgaagattgtattcaattgcttcagcatgatttcatcagcgcttggtgctgaagtatcactatcctatgctaacctcttcttgggccccttatataaagtttgtgaaggatttgctgggaaagtcatcagtggtatgatctctgtcttcattattccaaactgggaaagcttcaaaattgttgggattctttgttaagtccttgtagttgtatttatgtcattaaacttatccgaagctatttttattatcagatgatgtcaagcaattagcagacagtgtccgcgacaagttgtgtgacctgattggcaccgagaaatttgtagaggtttacaacagtgtcaggaagggcctcaaacagaagagggagagcagaaagcagtcagagaagcttatcgcggccgtggacccggcgcgccatgccaagaggaagctgcgcatcgctgccaagcaccgggagcacaagagacggaagataatgaccatgaaaatggggaggtggttgaggtaattttggtatcatgtgctatgtagaatcaatttgtacagcgctcatttccgcactgcaagttcttcgcgtagaaggcctgcacgaaattttggcatctctgcagaattttcccatagtccaatgtgttggtagatctgcttaatgtaaacttcgctctcacagcagagtgaactactagtagacagacatacaccaccatatgacaaaggaaagagttgcttattagacgtgtatactgttaggtacagacgtgctcgtgttttttgaccttagtctatagtacaagcgcattgagatacggagatcatatctcgtctcttctttattgttttttggggtgtaactctatttatgcggagaacaaagctgacgctaacgcgaaccagatttatgtttttatttacggatccggatcagctgcagtcatattattgactaagcaattgttttacagtgatgatgatgacctgtcagtacttctaatggaaagtgcagccagattaatgccatccaatatatttcttttgaaatgattctcctcttgaacagtcttctcattcaaaatgctacctgcaagaacacatagcaccaatctcatgtggtgtttgaatctcctaaagataaagataaagtttaagtgtttcacgtaaaataaggtgataataacgtgtgattaattgagttttaattattacaaatttgagaaatggattaatctgatattttagaacaactttcatatagaaagtttttgcacaaaacacaccgtttagcagtttgaaaagcgtgcatcaaaaagtttatccaacttttgttggagaaaagaacagagccgtatggtaataatactacgtgcacctgtttagtgggaaagccagtctaatcggtttattggcaatgagccgatgatagcacatgtacctatcaactgaagaaagccattccaaaaacacctacggattaaattatgaaaaagaaaacgacttttctccatcgaactatttcgctagagcaacccattaaactatttttgacttatttttgcaccctaaactcctaaaaaaaattccaacttcttaacggttttttctcaatataagttgtattttgcactaaaacttgatatgtgatatgtgcactataactatggacttttttttaaaaaaaaagaactatttatgtaagttagaagcacctgcgactgatttaagcatccatattttaaagtttcatgcaaatagtcacgaaaaaaataaaatatttttaaactttgatagcgttgtcatctgtgtctaaaaatttccagcttacagtacaactcgtataaaagaaacaaaaactaataaatgctattaagaagaaaagtgaattgtttttaacattcgctttgatcgtttagggctgaatgtagcagttgcactgctgcagccagcaatactgatcagcgccattcttgaagctaaaatgaaaaggcaaaaacagtttcacggtttaaaattgttcaaaggagtaaaatagactctttccactaagaattgcctccaaattaactcaatggtgcgaagtgagcttaactcgtctatgatgacttcatcaatctcaagatatgctaggttcaaattctagatttaatacggtgtttgtatttatgactaattattttttcagtggtggacgacgtaaccgtcgacggtgggacgtccgtattaacttcatcaatttcaagatgtgttggcgtagtccggaggtactcatagtgataagatgtgtgcgcgtatattcatagagggaagagtgtgtccatgttgtaaacgcctacatttatactatgttgttttttataaaagaaaaagattaactcactgctaagtttggggggagcacatcgatcaacatctccggtcgtggccggtctccagccgagacgacccttccatacgtacgtacgttgattagttgaagccagccagccagccaagattattgtcgctgtctgcccactgctctgccttaccacccccggccccgcgccgtgccaccgggctcacgtcgctgtgctagctacacctaccagctggccggccccgccgttgccacgcgacacactgtcgttccctgcccgtccggccggcaaacgccctcgcagaattctgatagtaatacaagtataaaacagagcattggaaaatacagaaaaaacacaggaataactgtttgattggaccacagaaaaaacacagaaatcggatgagagagatagactcaaaggaatttttccaagaggttgtacctcttgctaacttttctctaaaatctctatagtattagccattccatgggaattttaaaagatagtataggattcaatccttagtttcaaaggctttaatggaatttcttccatagaattaaaatcctttaaattttctacacttttccaacaaatcaaagggtgcctaagccacccccgtctctacgtccgccgtcaaagtcgccccgccggtccacgccgacgaccgccaacttctacacacaccgcagctgcgcagcatgagggtatagctagcttgtcagatcttgtttggtccgtcgtccatatacgcttgtgtgctctaatgtacttgcccgactcctactttttcgttctacgtacgcacgttttctaaatagtttacgcattacgttttatgtaaaaatatttttatataaaagatctgattttgaaaaccatattaatccagtttttaagttttttaatactttattaaccatacgtcaatccgtcacactgttatatatgtgtgcttgagagctaaggtccgaaccatcacgatacacaggaccggcccttagctagggaaaactattttaaactctcgaggagatatttacttgttgtttctatgtcattaaaatagttataaaagaactgaaaaaaattgaaagatgaattaatatgtgatatatcattccacaagtatgcaacttaaattcaacttaaaatttgttttttcctgtgacatatagaagttgaattttcagttgcataattatgcagtgatatatcatatactatatcttaatacatttttctctcttttttttaattttttcataactatttgtgtgacgtactccctccgtccaaaaaaagacaaaccctgagttttcgtgtccaacgtttgattgttcgttttatatgaaattttttataattagtattttcattgttgttagataataaaacatgattaatactttatgcgtgacttgtctttttaattttttttcatagtttttataaaagagtttgtcttttttttttgggacggagggagtataagcaactagggaaacgttccgttgagtttaaaatccattctcctaagctagcatggatcgatgaggaccccacagcttttttaaaaaatatctctatggaccttatttttatgtataaataaaaataaataaatgacaccacttaaatacatagtagtaattgatttaaatttctggctccgtctggacaggagccgggccacttgtactgcacagttctggacttctggtttagcagagactcgccgcgcgcgcgcgggtggccgtcgcgttgccggccgtagctgtcgcatatccgggatcgagacgtgcgtgtatgtgctactgctgcatgcggcgatgtttcctgccgcgattttccaggcaaagtccccccgcgcacacccacactggcacatgtactacgtcgccgtcggtttgaacgcggccgtggtcaccgcacgcgcgcgtgcagcatgtcgccatgcattcacagctactagctactatacagtatacacacacaattccggttgataaagcgctctgcgtgagctgagctgagctaggcgtcgcgcgcgatgtcgtcgctgtacccgtctctcctctcgctgagcgagagccccgccgagtaccggcaggtcggcggtggccgctacgcgggggaggacgtcgtcgacgacgacgacgacatggctgccgtcgccgacgctgtgtccagctacctctccttcgacatggacgacgtcgagtattacacgccggaggtgggcttccactcaaagcagcacaacccgccgccagttgctgcggcgccactggaagccggaggaggcagggagcaaagccggcgggaagccgccgtcaatcttggcaagatggacaggtcagtcctatgaattctctgacaaaacaagtctcccttggttagctcgatcgtgatgcagttttagacgagtccagcttttgacacggctgccttctttgcaggggaccggcgccggtgagcggcggcgcggcgactggcggcgtgccgaggagcaagaacggcagcaagatcgcgttcaagacgaggtcggaggtggacgtgctggacgacggctaccggtggaggaagtacggcaagaagatggtcaagaacagccccaacccaaggtaattagttaacccatccatccatccttccatcgctcgccggagagcacatctcgccgccgccacgccatggttggttgatcggcgtccgtacgtgcaggaactactaccggtgctcgagcgaggggtgccgcgtgaagaagcgggtggagcgcgcccgggacgacgcgcgcttcgtcgtcaccacctacgacggcgtccacaaccacccggcgccgctgcacctcaggccgcagctgccgccgcccggcggctactcgatcgccggggcaccggccgtggtggcgccgcacggccgcctcgggctggaggaggccgaggtgatcgctctcttcaggggcaccaccgccacctcgctgctgcttccttgaccggccagtccgacgcggcggcgccggcggcgacaactgactagctagtgtgagtcctgggccgtacaggaatggacaattagtttgtctccgatcgaggaccaaggcgacctgaatcaaaattacggcccatcgatatatagtaggtcgtttaattcatcgaaattagacgaatttcatgtacaattattgcattacagtattatttgaaacagtattgtatatatttgctatacaatttgatggatcgtatgtctttagcagttgtaagtatattaatctatagatctagtagttcagccatgataaacctttaattatttgtctagaaacaacagccatgatagacgctatgggtcataccattttttaattagtgagataggagatttaattacctcattcgttgcatggagtaaaagagaactttccttagctcttatgattgagtcaacagcatgcacatatttgatccttagaacaaaatttcgacaatcataaacacggatgatagaacggtcggttgatcttttatgctagatgaaaccttatgtgttgctgtacaaatattatatgataacggtaacaataaagtataagatatatttgagttccgctatacgtacgacgtaactttatatactttgtacaatttgcatctttaatcgatattcgtaaaatgctatgaataattaaaacagtgtggtttatgataacttagattatatatattgcttatcgaaaggaaaaaactaacatgatgtggctttacatagaagaaaaataaaataaacatttttttgcggggataaaataaacatttttgaccatagaataatcatccaaggcctaaaaacaattaatgtggtgtggcttaacgagagaaataacattaattatacttagcccctattttttctgattaagatatagattcaccttggtttatgctggcacgcgttttaaactattaaacagtgtaattgttcaaaactttctatatagaaattgttttaaaatataaaataaatccttttttaagttttaaataattaaactcaattaatcatgcacagatggctttcttgttttgtgtgtctatacttaatattcatcttgggtggatgcgaaagagaccttagtatgaatgaactatatagctacatagaatgtggaataacacatagccatccaatcgagactcaatggcttaggtcatgtgctacaacaaatttagagtaattaacttcacaaaatctcacatattttgcttcaagttgtacaaaactatatgagttttgacgcgttgcattggaccatggtattatagttctatagtttcacaaaacaacacattatttattttatctgatatacatatgaattcaaaattgagtaaagtgcacgagtaacccttaaacttgtaatagtgtgtcattaggtccatcgcccgcagaatttctaggtcagcctaggctgccattgtcaaggcccctcctcttcctttgccaacaggcgacccaaggtcactctggcgagcgccccgtgcgatagcgcccgcagttataccgagaagaaggataaaaaattggtaaaaagataaaaagaaggagaagaaaagaaaggaaaaggataattttaagtgggtcatagccttggggaaaaaagtacgaattacccccccccccaaaaaaaaactatcgtggtcggccaaattacccccataaacttgaaaaccagacattgctcaccctaaactttcaatatcggacgaattaccccctagacctaaaccagaacggttttatatacattttgagagtttggggacctaatatggttttgtagaactctaactataatatccggggttacgttctatgaaatttacttataaatttatagcacgaacatcgtttgcggtacactagattacactattgttacataaaattatcttagtcgactcaggttgtgttcggtagagctggtttccatcttttaccccttgttttccgtagcatattttttcaaacttctaaatgatgtatatatatatatgtatatatatgtatatgtatatatatgtatatatatatatatgaaagtttcttttaaaaagcatattaatctattttttattttttatgttttaagataatacttaattaatcatacgctaataagtaccccgttttacgtgtgggatgagcatatcccaagaacaagtacaatagtcgatggattggcgataggtaggccacgtagactgcggtgcaataggttttagctttacgtgattatataagttaattaacgtaactaagctatgtgttgcaagtctctgaaattaaaaaggatgaatagagatgagatgccgtgtcattcatatattgagtaaagttgtgctatttagtgacctagttttaaaattgcttttcatgtttttctttttagttatattaacgtacattcggacatacaccctccgtcctaaaataaattcaattttatacatgaatctggaagaatgcgttgaaatacatccaaaatcgtaacaatcattttatgtatatattagtgcaaacgacaaataaacacaaaattcaaaatataattatacgaggagcgactatgcgtgtcaaattaatccacaatcatgcatattagagtgaacaagaggcgactgtgatgacgctctctctcgtggcccgatcttctggtgaggggataactctcgctttgatcgagtgcaacgtttgcgacgtggctaccaaccagaacaagtccaggatgccatgcaatcgctacaccacaaacgatgttgtaccaaccgtgacacgcggttgatgatccctgcaatgcaaacgagagaacactgcaataacaagataagatgcaatctaaatattgcgaataggtaattaagcacaaaggaatagttgcgattgaagtggtagatctaatcgacctggcaaatcaacacaccaactattgggggctctaaatctatagtcgctggctaatcgagcgaggactagagacaatgtgaatggcacttggcaaaattcaactaaacaaaacccaattgttctagagggtgtcatggacatttatagagaaaaatagatttagtgtttagtgctaactagtagaggtagagggagacacttctgagataggtctagtctattacaaggcctaaggcccaagttcggtttcagcaatagcactgccttgttttgacgattcccgttgactcggaatgaatttggatatgagactggatgcgtttgaaaggtgatgagagaagttttccatgaagtccaagatcacccaaatcggagttggcataaaggtgctaggtccgtttgaagtcagtgctatctccggaggacgaactggattgcaaaactcattggactttaatatcttgtagactgccattcattcgatgtattctttgaaaatgttttatacttctcatgcttggttttatgcatatagttgatggtcacatcagattgggtgaggccaatctaccacgccgcagtatttgagtcaccaagttccacaccattatccaaaaaggcaccgttgagttcttacgtctcatgaccagcaccctctatctctaaatcctggcttcgccactagagagagaggaggaagaagaggagggagtgagaacgacatgcatggccccatcattntttttaattatttttggtgtaactgacatgtgggtccacggtttttattattttccaaattaaattgccacgtaagtatcacgccaataccatgtgggagaacttagttaaattagccacgtaggtgccatgtcagccaaaaccggggataatactgtcaaaaaaccttatttatgctggttttgtaagttgggggacccgttgtatctagttttttgttcaaggatgaaaatagtatttggtgtcatgttaagggaccttaagtgaacttattccaaagtagtaagacacatttgggcctttggcccaacctaacgattgggttgatcaggactcatgcaggccaaagttgaagggtaatctctttttataaaactcatgcattttattgatagataactaggtggaaaaagtacgaattacccctcccccgaactatcgcggtcgtccgaattaccccccgaaccataaaaccggacattcttcacccccaactatgcaaaccggacgaattacccccctcaaaccaattcagagcggttttgtccaacgtggcgcatacgtggcaatccagtcagcgtttttttaaataaaaaaattgtgggacccacctgccatactcttctcttcttcctctctctctattctctctctatcgctttctctctctcgcggctcgcggggacggcaaggacggcgacagcgg

SEQ ID NO: 66271 - DNA, 10910 bp, Oryza sativa
gccaccgttgcgtccgcagtcgctgaccgcccgtccccgcgccgtactcgccgtgcacgcagcgcgagccgcgagagagaaaaagcgagagagagagagagagaatagagagagaggaagaagagaagagtatggtaggcgggtcccacaattttttaattaaaaaacgctgactggattgccacgtgtgcgccacgttagacaaaaccgctcttaattggttcgaggggggtaattcgtccggtttgcatagttgggggtgaagaatgtccgattttgtggttcagggggtaattcggatgatagttcgggggggggggtaattcataatttttcctaactaggtaactgagttatcctcgtagggaatttatctctaagtacaagcagtttttgccaaaaaaacttgaagatgatcaaattaagataagctcctaaaaatttgctaggaaggatttataagaaactagaaaaggcaatcaagtccttcttttctctactagatagcaagctagatccatagctgcaacgatgatgaagaaactaagagtagctaaaaatgaaggtgcaaggaagcatacctacaaggagcctccacttggaggttaaggcttccatgataaaatcatgaaaatactgcttctctttgaagatgcaccgtcagtgatgaagaaggattgcaaccttgtggttgccttgttataaatgaaccaaatgaccgatgcaaccctttgtgaagcaaattttccttggaagcgtctatgccaaacccggagaccacttcatgaatggatttggttggaatctatagatgactaccgggacaagagaaatgtgacgctgccgaattcttacactacacaaatgtatcaaaaagaaaaagaaaacaaagaggaaaacattacttcgggaagaacctgactacctggactctcccctctcgccggtgaactgagtcactgaatcgatggaggaaaagggccagatgaagaggaaggaagacgatacttttttttttcgtctgaaggagtcaccaatagtgggagttgaagtgtaatcttaaacacgtataaacttatcctctactcctgaatattaggtgcacatattacgacaattttcagctcgctggtcatgctactaatcatttcattgagaacaaagtaaaataccatcctgtcttccaagttccaagacaggcaacttgagctcctaaaaggctgaaataccatcctgacatagatttgaggagccaaaaaggggtacgatatcttccggcaatgcagacaaacgccaaccggcaaaacgccaaggaacgccaaggaaagaagagaagacggcagcgccaggctgggggcgccgtagatctgtgagcaaaaccggcagccagctgcgctgcagccaaaaagagtctattggctgtcttcttttctcacgggaaggtttcctgcacatgagcgcaacaatttattatcgtgtgattaattaaatattagttaaaataaattttaaatatatattaatatggttctttaaaattatttcaggttgtggaaacataagagtaaaaagaggaaatataaattgggaagaggcgataaagaacacatccttataaatggcgtgggttttaaggaaagaaatagaactttttttcattggctttttcaaaaataccttttgaatcaatttttaacgtattggaataaaattaaaatttattttacgatccatcgtctatcctcgtttcagaatgaagctgccaatggcatggtcgtctcttatagttgttgggatcctctgcagtaggtgaatagtaaaatacaatctatccggccataaatatttagcgccattgactttttaaacatgtttaaccgttcgttttattcaaaaagtttaagtaattattaattattttcctatcattttatttattgttaaatatacttttatgtatacatatagttttacatatttaacaaaatatatttaaaaaagttaacggcgtcaaatatttaaagacggagggagtatatattagctaagtactattttttcaccgttggatctagaatgaatggatgatataaatcgctacagtaacatgacaaatttaaacagtaataaacagtgcgtgaactgtagaattggtacagtgctcagattagctgcgtagcagacccagatggacacaggtcgttcgttgcagtactgcaggggatctcaattggactcggattgctggaggtacaattctttctctgctgtaatgtagaggatctagatccgtatcagataggggtacatggagccctcgaacccatgtccatgtgttttctgcttgtctttagttaattattggttcgtaatcacatttgtaaatagcttcctataaaacaatgtagttctatttaaaagacaaattaccaacgaagaaaatgaccaagataaagttgtcatcttaacctttaaccaaaccccatttaataaaagacactaaagtatttctcttccaccttaacatttgtggatgaagttctactataaaagtgcacttattttggataaattttaaataaagggtgtaaatacatatgctcctctacgcaattgcacttttaaattgcgatgccccaaaatatccttaataatgtgtgaagtaaaaattgtaagttaaatgtaggaaaatgcattaggatattttgtgaaacatgaagcatccaatatgcaaaaaattaatctgaagtagcagtagtagtaccaccgacgataataataataataataataataataataataataataataataataataataataataataataataataataataataatatgatgatgatgaaaatgatgatatgtcggatttaggcctctagccatttagttatagccaaaggcttatgcccaaagaaaccacactggtatcatccaattaaaacaaattatctatcgaattgtcgagttgaattaaatatttctaaaaataaacatagaaaatagcttaaaaatatgtggtactaagtaatctaagtagaacaattttttttagaaaatatattttctaaagagatgtggagcaaataattcactgtaataatttaatttgatgaagtagctgaaaacaatttgatctaagactactattgttgacacaaattagggtgtgttcttttctctaattttccaactcttactctctcctttttcgtacgcacgtttactctctcgtgttccgtacgcacgtttcatgaattgttaaaaggtgcatcttttaaaaaatatataaaaaactcctttaaaaatatattgatgtattttcaagtttttagttaatacttaattaattatgtgctaatgactcaaccttctcccgcgaacacaaccttagaataatcaatagatgtcttgcccctgctcctttctatacttaatgtcatatacacacacgagcaaatccaatgctaccatttcgtttaggcttatgtttatacgttaatatcaattttagagtttttttattgtatattattttaccgtatttatttttaatcgttaaagacatgtatatacaaattttacttctactactactattattacttaaaaaaaagtacagataagtattagcataagcaacacaacgagcccaaatagagtaggcctctacctctgtttatgttacaaaagggtcaggatatcattgttgattgcttctcgcgggcagtgatgatggatagttgcgggcgtacgtggcacatgacgtggatctgactgtaaaatcgatccaagcttgcacgctcggcttgcaattgacgcgtgtgccgcacacacggtgtcgtgactcgtgaccggcgtcgaggtgcacactaaaaagaaaaaaaaacaaaaccaaacttgccggccacccaaaccagcaccaacacgtaaagcctttctccgagcaaaacatccaaacggcaaaatataccccacaaaaactaaaaagtgaaaaagagcagagaaaattaggcaagctccacgtgtcgggcttcctccgcgccgccggtcacatccaacccaacccaaactgccagccacacctcggttgggaactggaatagtatgcacggaaaacagagcgatccattagcacataactaattaagtattagctaatattttttaaaaaattaattaatttgattttttaaataacttttatataaaaactttttttaaaaaaatatatttaatagtttaaaaagcgtgcgcgtggaaaacgatggagagttgtcggaaaactgggtgccgaacacaccccaacccggcaacggcaacccgacccaacctgcgcgcgcctccccgtagccgcagaacgaacctgatgccgcggagtcgaagcgacgcgagagcgcgcacacgtgttcttcagccaagccgacgtcccgcctcgctgcagatcggccgagatgccacgcgaaaactcgcgaagaaaacgcaagggcgaaaaagaagaacagagcagatcaggccgcgcaccgaccggtccacgtggaacggacggcgaggatgaagcgacgattatagtttgttattatagtgttaaagtatgaacaaacaaacccacgggatggagcagatgtgaaaagaaaaggaaggaggcggaaaaaaataaacaaaacaaaaattaaacagaaaaaaaaaaggaaggaaaggtggtgtagattgagccattagaagccttcggctttacggcttcggcgagaggaaggggaggggaagaggagaggaggaagggactggaaggttcgatggcgtcggaggtggaggacgatgcggcggcggtgctcaccaacggcggtgccggcgccgcggaagtccggcggagggtgggttctcttctctttccctgaccatatctcccgtcccattttttgttgtttccgttttgcccctaatttcctccgtttttttgctaatcttttttgttccttcttcctcgggatggttcgttgtttgatgcgcagagggaccaagcgaaggagattctgtccaagcaggccgtcaagatcgccaccaaggccgaggagcacgagcgcttcatcttcaaggtccgttcctccgatcctttttgctcatctcgcgtcgcttcttgcttaaaaatctttttttttttttgggggggggggggggtgtccatgttctctttattcaaattgtatgcgtaacctgttcattttggcgggcattgatgcaaatgctttaaacgagcgtcagagggggtgtatatttactgtttgggggcatttgggcacaatgtaatgctgtagcttccaatttgtgcatctatttttttaaggagcaatttcggcatttattgacccgtacttgaagtattgcctctgtcctaaaatataacaacttttggctatgaatctggacgcacagttatctagattcatagctaaaaatgcttatattttgggacggagggagtatttactaccaggagaccaagattgcgaacaataattggatggctctggatggatgttcttacatggtgctggctttttaatgtgcaggtcacacacttgctgggtgttcttggatttgggacattttgctacctcctgggtgccagtaagctactgcagcattgatctgttctgttggcgtgttactgcatctcaatgttttggtttgtcactaagaatgctctggttttgtttgcaggaccacaggatgtgccgtatgtgtactgcctgttctatgtcatctttgttccgctccggtggatctactaccgctataagaaatggcattactatctcctggtgagtccaattatttttcagtttttcagagtttactatcctgcaaatgtgggaagtaccggtaaacttgtttccgccaaaatttgtttattttatcttgactgctggctggacaacatgtctaacagtttagctatggttattacaacagggaaggtaattcccgctaggcatttgtagtattgaagataggatattaggaattgccctttacctgatgaatgctatgcttgtgatttttgtgcaattcaacatcatgtttcctggtttactctgcaatgcgagtgttccatttggttagtgaaaattgactctgtttttatgctcttatgatagaagcattacagtttcaagccattgattgtttggtaagtcattaataataatcccctgttttataagcatcgtcatttctctgcaggacttctgttactatgccaacacttttctccttgttatgattctcttctatccaaaggatgaaaagcttttcatggtttgcttctcatttgcagaggtatgggaagttagaagtattcatgttgatttctggtctgcacccatctcgtagcatgtgtgattttttggtttgccatgaattcttgcaggggccgcttgcttgggcattaattgtgtggcgctgcagcttggtttttagctcatttgataaacttgttagtgtcctgattcaccttttgcctggtaagcggtctcacaattcaaagtcccagtttactctctaggaaatgttagttacgtaagtgtggtatcattttagggtagtgaaccacatgatttacttgtttatggaatctcttttactatcatttgcaagtaagatacagaggatttacagcaaaaccttgtagcatattattccaatatggtagctcatgattttttaaactagcacattcatttttagttactaaacttctggtatttttcttattgctgacaatttcatgctctgttctaaataaagggtgttgtggccttgtaaaatgttgtttacaagggaaaggcagtctatccatcgtattaaatttagaggcaattaagcgtgcaaataacctagaaatttagaccgtttggcagttgagcattttctagttgttgtacggtagaaatcctcattttggattacaaaatatagcatggaacatttaattgaagcattctagcaagctgaatttagtcaaacctttcttttttgcttctgccatggacattactggcagctccattctgtatagagtaataatgactagatccttattttgtatcaaatagacatggatacatctcttatttggaattgtaaaacgatatatagttgtggaaaactggaaggccattttgcagtcaaacactataaggtcagatggttgtttgttaattattaaatgttatttacaaggttgctttcatgacaattacaagtggaatccgaaaatttttttagcaacacaaacagtaaaataatcaacatttgttctgaggaatttgacaagcgcgtgaggaacctcctgaaattgttggtaccatggtcactggttgggtaaggtctgcagagtgaagacttgggtgcgggtgtgggtgtgtgccttggggggggggggggtctcagttctcagttaactctgaccgggcttgtccctgttgaactatcaagctctgtggcttgttggactaacttaagatttgttgtttgattggcaatgtggtacatggggcccctttatatgtatggatgactgacttgacccttaagaaagtaatcctaatatcatggaaaccagcagcctgattgttatctctaattttttgataaatcttatcacttccttacctaatcttccaaatgggtgccacaaggattgcaagaagtgttggtctacgaccataacagttgacaacctcaagttccagatatgaaacagacctgtctgtactaaatgtattagggttatatgtacttatattctccatccggcgcattttaaaatattttgagtttacatgactgacatactggcaaataatttttacaggcatagttatattcactatccggtggtggaatccacaaacttttgctgcgatgcatccagaaggaagagcagccagagtcacatggccttatgtggaggacaaatcatacctgtggacatggctgtttgctgttcctctagctgcttacaccctgtggcaacttatgtattttctcatagttaatgtgctgcgtcggcaaaggctgttaaaggatcctgaagtcatgacatcatacaggtacatctttgttgttcttggcagtgtacctatgtagtgtggattacattgcttgatatacagtacggtattaatgttgacttaaaagatataaactcatagagctaaaatagctggaattatgaattagagtcgtcgaaaagacgaattgcaatggcaggttgcatggatagttttgcacctggaaccctgtgattggcacactcaatacactaagacccgtaggtaatagttggcccatttccgttcaactaagtgaactaagtttcagttttgaacccctgaaaatgatatttagacccactcccattcaaataatatgggtaaattcacgggcccgtggttgtatccttaaacatttttttagacaatccttgaacaacattgtagtgacatgtgtgcactaccgttttgatctagtttacatttgttctcttagcacaccttttcctaaaagtttctgcccttgatcatttttagctgtgtcttttactgcacaatagtttccaattgttctagcttaacaggttagtttagtaactgttcacagttttaaacagtgtttggtcatgaaagaacatgaagtagcccaataatgtgtgtttcttcatgaatttcttgtagggagctctcaaagaaagcacagaaagcaaacaacatctggtggagactcagcgggcttcttggcgacaggaaccggccactcatgtacatactactccaagcgctgttcacggtggcgacaatggcgcttaccgttcccatattcctgtccttccagatgcatgtggtcttccagatactcaaggtgtgcgcgtcgacatggaacggtggaagcttcatcctggaggtgatgcctaggcaagtcgtccagaaggagaagaagaagctagagatgaagcccatggaagaggctaattcgagccagaatgctgaagaatcacaaggggacctgtcagcaaacggccagcactcatccgagcatagctaagtcactgaaaaaccaaaccatcgcaaacggtagcatttttcagtttttcaccagttaatacactgtggatagcttctctgtgtgttgtgtgctcgaaacaaattatccatgttctgttgggttgagaattttgatgcgtgtgtgaggtttgatctattcagactccaggcagggagcatttctcaggtagaaaattatttttcttttcccagtcaacccatgatattcactgaaacttctgatattgaccatgacaaatttccgtgcgtgacccgtcatctgctagtacttgctggacaagttattacatgactagtacgtaatttcgctgaagtacactgcgtttacgtgtttggcttgggtcttgggtcttgggtccttggggctctatatatacctcgtttctccaggccggtaaaaagttcttttctttagcttctggccttctgctgctccgatctactactacttattacgtactcgcatctcaccatgaagccgctatcgcttctgtcagcgctcgccctggcgttccacgcggtcaacacgggcgtcgccgtgtaccgcagccgcgccgacgccgcggccgtggcgctcgtgctcgcgtcctcgctcgcgctcgcgctgctcttcctctgcctgcgcctctacgagggcgcgccccccgccgaggccgcgaggcgccggtggctgcgccgcgccgtctggctgctctccgcggcgctcacggcggcgttcacgcgccgcgtcgcgggcgcaatgccgccagcgggggccgtcctcgtgtgggcgatgagcgcggcgaccgctggcggagggttctacgccctcgtcgtcgtcgacgacggccgcgatctcggcgcaaaatagctaattaataataataataataataataataaatgcatatgatgcgtatatatatgtgacgtgagttacttgctagtcaggcgatccatagaaacaaaataatactactattaaaagggatcaaagtacacaaaatgtgtacgtatgagcacttcacgctcgtgtcgatgttcagctagcccagtggatgcagtacgaaccaataccagcatgctctgctggctatggtgttatacagtgcttgttattgtgattattcgttgagctctatatgtagtgtggttgttgttgattagggatctcaatttgatatcaacaaaggattatatatttatccattgagtgatcgattgatttttctatcaatcattcttctttttttgtttcaatatatagcagtccatacaattttaatttttaaagggatgacatttgttatctcttcctaaaaatagggaaatatttttgtcatctcgcctcaagattgtcctttttgatgaggaactagaattttaaaaaaagtaagatttgcttaatactagccctggggctctgcagaaccaatttttccttgaggactgcaaaaccacagttaattaacaatgaaacccctgtgaaacctttggaaccctgccaattccattatattcgaaaaccaactattataaaaattacaagttgaatgaccgcgaattacaaaattacttaactaatagttgtttctgctcaacagcttaattcttgtcattctcaagctatgtgtagctatggatctaaactctagaatctatagatgacttcattactaaacctgtagtttgtgatattatgccttaagttttagttttaagataattttggtgctaaaatctgtagttttataatatatatagttgcatacgtattttgtgaaattta

SEQ ID NO: 66272 - DNA, 17880 bp, Oryza sativa
caaattaacaaatgatccgataataaaccgtgggtacacttatatactaggtgaaacctgcgtgttgctatgagaatttactataataacaataaataaaaataatatgtaaaatagcttaaaaaacttaaggttatctaagttgatgtgatttaaatttaaatggtatataaaatgatgattcgaatggctttctgagagttcactgtgactccgctttgtttgtgtacacggctctgtcgagcatcgttgtccatcaactaattatatatgttggcatactattgaagagttcagttaaattgcgtttccgcttgtcatctaagggtgagtttgaggagagggggattgagaagattggtaagatacgtaaaacgaggtgagtcattagcgcatgattaattgagtattaactattttaaattttaaaaatggattaatatgattttttaaagcaactttcatatagaaaatttttgaaaaaaatacactgtttagtagtttgggaagcgtgcgcgcggaatacgatgtccttttctcacccaatcccccagaactcatcacaacgaaagcagcctaatttttgtttcatcttggaccggacaccatcactataagtacctgcacaatatacatacataagagttattactttagaagacgagtttctaaatcaaaaataatatacatacgacgctgtcgtccaactctagtgtatgaccaatgcaatgatgaaatgcctcacacatgatagatgattcaggtcgtgatgaatctttggttgcgcctgttagttgtgccacgttgtaacacggtcggacatcaatcagacaacagctttggacatcaatcttcaaatgcggcgtctctggcctccgctactagtcgagtcattccttccgatccttccccatccaattcccaatcctaacccttcaaaaactataggtgccgtagctcgtggctctacgacaatagacaccgtaagtcttattcaaaaacttttatgagatatataaaactatatgtatacctaaaaatacattttaacaataaatcaaatgataggaaaagaattaataattacttatttttttaataagacgaacaatcaaacatgtttaaaaaaatcaaacgtgtttaaaaaagtcaatggcgttacatatttagggacagagagagtatctgtgtcaatgtgtgtggtttggggggggggagggggggtttacttgtagagaccgactgagtaaacattgatttttaggcagtcaattttataaattcaagcaacagcaaacaatctcagccgttggggacaagtgataagaaacttacgaggggaaaagattatcatttcgaatgaaaaggagagatgccagtcaattcttcttagataatgctgggaacaagtcaatagcacacggtaaactaagtctggttaattaattaaggtgacttgtgaactttggttttgtttgcttgctgagcgaaacaatgcagcattaaccctcctctccgggccaactgacgtgatatactgattaaaaagatgtaatctctactgattttacgctcttgcatcggagagattcactaatttactactggccaacagaaataacgcgagacagacacaaaagtgagatgaaatcctactgacaaatattgcttacgttgttacggcgtacgacaaggattttctacacctaggtgccatgacacctatcatttatatatgactcaaatagttatagagaaaattgaaaaaaattagtaacatcgtttgtgatgatacaagtttatgcacaaacatgcatgactcaatttgatctatgaccagagaaacaaaaataataaaatcagaccgtgaatagtacccgcacagtgcagataaaatttattatttttgtttcttcatatatcgatcgaatttagacttgcatgtttgcatagtgtcttatattatcatggactatcttatcaaattttataaaatttttatataactgtttacattacatgcatacacctaggtgccatggcacctagtggtagaaaatactttctgtacgggagctgcaccctgcaccattatcaatgacaacctaagcacaagcgaaattgtccagccatccgaggaagcatttatgcgagaaaaatgctactccttccgtcccaatatataagtatttttagaatagtgccaagtcaaacttttaaattttaactattaatagcaaaaaaatttaaaaagattaatcatgtaaatttgatgtttactatatttatcattaaacgaactattgtagtatacaacttgtcagggttatggataccacatacctaacagtagttgactaaatttcggcaggacccacgtcttatacggaaacaaccttcagatatagaaggagtttcgcataaggaaggatgaatagagttctacatggaaacgacaagggctactcagattgtatccatattggtttccctagttctacttggacaatgggatacctatgggtataaatacaaggcccctaggaggagaggggacacggaacaatagatcaagacacaagatcaacatacaagccaacatgcgccaagacaagccgccggatatcgacatcagagatatgcctggactgaccctatctggtaccttcagtggcctgctgtagggatctagcgctgtctctgatctcgtcgggcacgaattcgaggagaaagactaccttgttgtcgactacgagtcagcacttcagaccgccaagtcaacaacagatagataggctacccgaaatattgtaccggtgtgattacggtgaataagagcaacgactggcttcagccaacaagagtagggttattacctaacaattcaggggcccaaacctatataaaaatcctcgttcccattcttttattacaatctcgcatatatcctagtaccaacgatctctatactatgcaaataccagaatcgcgacatcaaacgtcgacacaactcttttattaagatattttacttttattagatattgttggtcaaagtagcatctcggaaaccgtgtccagatccaaaaatgcttatattttaggatggagggagtacacaacttgttttttcatgccatcaaacacgtttaaaacacctaatgctttgtgatgatatcaaatcgccaaccaccttaatctaaaaaactctaaatccagatagcttttgaagattaaaccggctagtggagccaatttagatgaaagataaacatacgtctcgtggatagaacggaaggttttcaggacaaacctacacagagaggattcgcactctcgtggtgaagacgggtagttttcgatgcaaaccagcgaagatggatgaaaactaggctagaactagataaaaagtagatgagatgctgaaaaagtaatttaattggctactgtgttggagtagattgtgtcttaattgaaccaaccatagccattataaaggggttggttttacgttctagaggatcttttttacgtcttactcgggatagaaactaattagaataaaaaaattgtctttccaagaaaaaaaaccaaagaatcaatgtaattcaacttggagtcgaggttagctcgtcttaccgaccatatgccatcggtcagaccagccccaagtcaatggtcaagagccaaatagacgactgcacaggacctacgatttttcggggcccatatgaagatgacgacccaaagtccatttcccacaactataacatgcaaggcaaatcgtcaagcccaggtggccacgcgtacaatactgcaacatcgtcgcattgatcctaattccgtgattgcgtgcgccgtggctgctacgagaatgagacgagattgtcgatcctaattccgcaccgtgttgaccggcgaggcaacaatacagcctgtgactccgagcggcaacggcgatggccctggactctaatcttcgagcagctctacagtatgcagctgcttgctgagctcctggctcctgccctccccctccccctccccctccccctcctcactcttttagtagaacatgactacatgaggtcagcattaccttcttcactcttttattattattatcatatgatatatttcaaaatatggtacattatagcacatattgcatctatataatttaattgaacaaaaacatgttttatttatattagacatgcttttataaaaaaaaattataggccctcaatgtgtatttcaccctagggccccaaattcatggagacgtccctgtcgttggtcggacaggccttacgtgttgaaaaccgagtccttccaaatatcatcatgcttttctatttcatgtctaagtgtcaaatttaaatattaataacaagtacaattgaaaatttcaccactctttaacttgatgctcttttttttttttgccctggctgataataggattataataccaagcaacatattttaaatttagaatatgattttagggatttctatgttactaattttgcaaccaagctctttttaaaaatctaattgccaataagacaagtcggtagccctaaagcactagtagatttgaactagatttgcattataatccaaagcggaaataaggcggcaacttttggtgaaatgcattcaactcattataatcattttttccgccatcgctgattcgcgcgcgcctcctcccagcctttttttttctttttttctaccgtttttttttgttttctttcccacttttttctgatttatttttttaatctttagcatgttttgagtttgaaagtttttaaattttaagttgaaaattttcaaatctgaacttaaaagtttttaaatctcgacttgaaagttttcaaaattttcaaatctagacttgaaagtttttgaatctcgagttgaaagttttcaaatctcaaattgaaagttttcaaattttttcaaatttggacttaaaagttttcgaatctgagttgaaagttttcaaaatttgactttaaaatttaaaacttaaatcgaaagtttttaaatctaacttaaaaaaattttcaatctgttagaaaaaaatctccaaaaaaaagtctccataatctttcctaattactatcattagtgttaagtgtattggctaacagagataattaagacttaagaggggagtgcggagtgcacgcgcttgctaggagcctaggagccccctttttttcccgttcctaattacacaatcatccattgcagcctgaaactccttgaaatttacaacaaattttcatctcgagaaccagtcgatactagtaacacactaagcactgtataaatacggtgattaatacgtacatgtcctagtgatcatcaaaccctgcggcgacgatcagtcggactcctgcaggccggcgaggacgacggagccgacgaagaggccggcggcggcggcgaggaggacggcggcgaggacggcctggagcgcgacgagggcggcggagtcgtcggggacgaggacgacggcggcgatggcggcgacgaggagcgggagcgagacggaggcgagggcgtcgggggaggcggcggcggcggcctcgacgaggctgaggaggccgaggtcctcggccttggagaggaggccgagctcctcgagcgaggagagcgtgacgccgagctcctccgccctggacagcagcccggccttctccaccgtgctcagcaccttccgcctctccagcttcttgaacacgtccacctccacctcctcgctcccctccgcgaatatccccgccccgaaccactgcttcgaccacttctcgtcgtacctgttcacctgcacccccaatatccaaccaattaatccgccatggatggatcatggatgaacacatctccaatttcagtcgagacggggcatggctagcttggttaccttcttctggggagccatggccgtgaccttgaagcgccgcctcctcgcgaacggcggtggcggccgggacaggcaagacgaagagcagcaggtggagattgctgcttggacggcagccatttcttcctcctccccttctctcttctcttcttcctctggcgaagcaagaattcgacgcttctttttgtttcttttttttttaggaaggaagagaggaatcggagtgtggccaatggagagcagcttatctctgggctgggcccatcgtgtgggtgatcaaagcttgagccacagaaaatgccacggtggattggatttcctagtgtaagctgtggagacatctcagccattattcgggcacctttttggaagaagtttaataatttaacacttttttcaattactttaattattttttataaggatgataaatgagaacatctgagtgaatgaaagtggaccaaaatatcaaataatcgaaacccatttacggaggattaaattatattatcaaatctctccttttttttggccgttggttgggtaattgaacggctgagatcagagagtgaaacgaacttgctcgaactctctttctcacgtgtgttcatgggcccaaatcaacagcccaggtgtgtttctggtccggagagtggaggcggcctcgaaagcaagtagatagcccaaagcccaatctaagagggcccataggcccagatcgacgaccacaagacaacccgccgtgcggcccgcctggcagtttgcttttgctccacccaccaccaccgctgcttccaagttccaaccgctccctctctcgtcgctgagctctcctccggtgggcggcgcggcgatggcgggggacccggcggcggcggcagcggcggttggggcgatgaggccgtggaactacgtggtgacggcgcacaagctgacggtcgtcgcccgctcctgcgtcggcaacttcaccgcgcccgatcacctcgacctctcgtaagcgctcgcctcgcttgttcgctcgatcgatcacgcattcaccgcacatgcctgctcctcctcctccgcgggatcgcggcgggcgctagggctttgcggctgcgtgttggtttttttttttttacccgcttaaaccctatttcccccgtcgatgtttgctgtgatgatcgattcgatgctttcgtgctaggttgatcgtactacaccgaggtggaggtgctccccttttttttttgttttttggaatggggcgtgcttgcgatttgcgtcccaatttggacacagtgggttttgtgggaaatttaagagctcccccgtgtatttgttctatttttccttctccatgtattgttgtttggaattctcagttcgtgtagcacactagtcattcacactagtcattcatcagaaatgggcttgtggattcagttgtagtggatgttagcctactcatttattttaaaaaaaattcgtggtactgtgatgatggtgaagcagtaaaacatctgtgagttaataaaacttagattgattgtgttttttctaatatgttttttttgtgtgtatttgacttctatttttctccaaaattttatgtacatccttcatttgtttgggctaaagcttgaccgtacaacaactttcaggaaatttacccgtattgagattggagtatctgcttactcatcagggtcttcaggtcagacagatttgcctcgaccagaatatgttccttctgtttgaacctatctattattatggacagcaaataactgtgccttgttgttagcatcaattgttgaaaaggtgttttttaaggttattcataatggctactgttgttcagataaatgctgatatacttttagttgacaagttagaatttgtcctggcagatcaactggttacatgatattcttacaactataactctgtaagaccttttctttccttaccagcctatgcttgatgcacctgtgtatggtagaattgcaacaattgagctcttccgtccatgtgtaagtttgtactctgtttctacagctaaaaaattgaaagattctccctgccttcagacagtattgttgtaggactgatcttaagatcttatgttttccggtcccatcgttatggcatatttgcaaacgaaaaataatttgtgaataaaacttttatatacgtgtttttagcaatttaaaagcaaaagctgaaaaataaatttcaatgaaaaaaccccaaaatcaactccaaatttgaagttaaaaattcaaattttagttgaaaagcataagcataagcgaaaagataacgctcttcattccttgaatgaacctcaagaattaagattctcttttcatttgtacggaaagatacagatattgtattcttcactgggatgggagtaagtcaaagcttcttacaaggtttgatctctccatcatcacattatttttatatagattgcaattattaaactccatttttatcttaagttccttcctcagtagatattgttaggctgtgtttggaactccaagttaccaacccctctccctcgttttccgcgcgcacgcttttcaaactgctaaacggtgcgttttttaaaaaagtttctatacgaaagttgtttaaaaaattcaaattaatctatttttttaaaaaatattagctgatacttaattaatcacgtgttaatggaccgttccgttttccgtgcggggagattgggttctcaaccctactatccgaacacaacctaaaatatgtatccgtggcaacggtatttttcctgcaatcaaacattcagatggttttaaagtatgcatgtgatagtgacctgactgccagactgacattaaagtccaatctagcccctttagcctctcaaagaattcattggaaccaatcatagacatgcattcattcacttaatctatcaatatatccttgaacgagctataaatttaacatttttcaggaatacgtaaaaagattgcgcacaccttagcaagttattaggagtgagtagccatgaaaaggttttgcttaatttaagtatctattgatctagtgggcagggaaaatgtttcactatgttagttgtagatgaatgtatgatttcaaggttctgcatctttatattaggtattggcatctatcaagttctcaccagacagcagagcaaagtcatcttgcaaatttgtgaacgcttttgtctatttgaatcaggaaaatcggtatgtaatatgcaggtcagggagagatgcttctgaccacattggacgccctacaaacaagggacaggtactgtgttcatgattagaagcatttatttttccacttcgtgttctgtacagttatcagctatgtgtttcttgttaacagacagatgaactcagcagggactataacataacctggatgactgcggttgagatgctcgacgactacgtttatattggcgcggacaattgctataacctgtttaccgtgctcaagcgccgtgttgggaggcttttagtcattgggcagtaccatctgggggacctggtgaacagattccatcaaggcccccttgtgatgcaagatccaggctcagaagtagaccagattcctgccttcatcttcggtgaaagcagaatagactcaacgcaatagattggattgatatcggtgcggagtacatataggcacgaaatctcccttatccactcagccggttcatagaaactgaaccgagagagataaggggaatcggcaaaatagggaaacagagatatacacgagatacaattctaacattcggcacggccagtggcgccatcggtgtcattgcctctcttccacattactccctccgtcccaaaaaagacaaaccttgggtttgaatctggacatgcatcatgttcctcgagaagctgcagcttgtcctcgctgattacatcaagagcgttggcaaccttacccacgcgcagtggcgggcattctgtactgacggcaggagcgtaggtgcggcccagggatttgtggacagtgatctgatcgagtctttccttagcctggagccaagcaagatgggaggaggttgcgcggatggtgtggcttcatgcggacgagctgtgtaagagcatctccaacagcctctccataccactctccaagctaaattttagctgatttgatacaaaaacacactcaaacagaatggctatcccaattgccaaaagttagcaatggccaaacatgggctcgagctagccaaacttggccagcctttggccaccctcagccactgtccatccgtgggcccaccaactttttcctctctctccccaccagccgcaccatccctgcccgtgccctccctccttttgccgcaccgcccttcctcccgatccgctcgtgcctgccgccaccacggggaaggaagctcgccatcgccgtcgcttcgttgccgccggcgagatgggagaccagcagcgggatgatcacctccggctccgggtcggcgccacgggtcaggttgcagaggttgagcgggagcatcgccgaggcggggtggttccgcccgccgccggcaagcttggggagctcgcgggcgaccttgcctgtcctgttgcggcggcagcgcctgtgctagctgagcaccagtaggaggtgaagcagctgcttggggagcaacagcagatcggaaccccatgccgggctgacgcgaaggcgaggaggagaagggagggctcatcgggtcgccggccggtggtggtggtggtgatgcgcggatgaggaggagaggccggccgatgcagcgagcggagcggagggggcggtgcctcgccacgcgcctcctctagatcccgctacgtcatggctgctgaggtcaccctcctctcctcctccggcgactatcgaggaggacgaggccgacgaggagtggatctgtcgttgccatcgccctcttgtccacaggagaggataaagaggggtgtggggaaaatggagaagtacgaggaagaagaagagctgtagaggctgacacgtgtgtcctactgttatagagtcagaatagagagggtgaatggagaagctgttggagtaaacaacgtgtttgacttgctaaattagatggagagttggccaaatagatatttggagagttggatttagaaagactgttggagatgctataaggtagtgaaggcgctgaggaaactgcactgtcatgatcgccgaatagatggcactcatggcagctagattctgatctccatgtgctgctgctgatgtacatacaagactggatggaaaatctgtgcatagctccatcgtcaatcagcactaccaggtgagatgttgaaggtgctatttggtgttttaggcttaactaaacggccacacaagaacacagattttgtaacctcctggttctactggttcaatttttccatgtttagttggatactactccctccgtcctataatataagggattttgggtggatgtgacatattctatccagatttattgtattaagatgtgtcatttctaccaaaaattccttatattatgggacggagggagtactcggtaggaggaaatagagtaattgtcagtagttgcaaatcatacgtcctttgtctgaaaccttttagacaaaggttcagttaggctgcagcatagtgcatcaagatactccgagcatatatgccattgttctggagtgagctagtttggcatcaaagagaaaatgagtgtaattacgcatgcaattcatgtaacgcaactgatcggttattctcagctgtgtgatcatgggaaaaagaaagtgtatcattgtatttcgtcgctgtgtatgctttaccaggacatcggacaaaagtaatgttctcttgcaaacgagactttcgatgaattaaggcattgtctagccgacatgggctccactgctccagatgcccactaaagcctcccgacggaacagaggacaaatgaaagaaacagacgaatggcatctaagaattactaatagatcagtaagatcacaggtgattcttacgcttctttattagcagattaagaaaaaaaacaattatacatcgatactgctttttttcccctaaactttaatgccggaggcacaattattaacagcctcttctaagaggtaccgtataattgtccatagtgacgggcatgagtcactccaagaaagtagtattaataaaataaactaaatacgtagtatttattaaaaattttattttagttgatttttctcaattagaataagacattgctcttttcgcttattcaccagattatttgctctacccttcaaaaaaatatatttttcaaagaaatttcttacagtttattgtttaaatcacttgttttaagatactatttgttaagattatttcttaaattatttaattagctctataataaaatagatgatatgtgacaaataatttacttaatgactaaacgagtaaatttcagaaaaaaaaaccctgtattttatagtcaaaactttatttaaaaaactaggcattaaattggtggcacattaccataatactcttaaagttttataaaaccaaccattctactgttgagtgcaattttttgtaaattttaaaacatagagtatgattattattatttaattgagttcttcacttaaggttctgatcgagcaagactaccttctgaaatttactatcgtttaaatgaaaccagcgtgagttagcgagtagaaatacccacatagtgacccaccccaaattcctaattgctgtcatttctctctcatataattctccttgagcttgtctctggcatccaaggtctagggccccttcttttaagaagagaaaagaggcaagcctgagctggctcttcttaatgagttgctcgcagtcacatgctccatgggtggcgccgtgcaggcaggcagcagggagaagaaggtgattgtgtcctcaggcggcccaagaaggatccaccaccgaatacaccgccatcattctcggccgaacatgccatcatttctggatccaaccgctacgagttggccgccagatttacgctccctgccacgtactccgttgtcccgaaaaatatgttcacgttgattgacttagatgtatcacatcttattttagattgagttattttgaaacgaatagagtaaaactacctaatacgatgtacacggtacatgcatacacggctcattatctgtgaagccacacgggaatcagtcgctccagtgcctttgtccaagatggagctattagatcaaagaaagaaaaaagaaggatggagctagagtagatttttcctttttcttttacgtaagacagaacaaatgcacctatgaagcttacacgcacacaaacactcttaaccgcatacacctcattgtcaacttctcaacagggacgttatctttcaccaaaaaaaaacagttagatgcttaaccacgaacatcttactagtaatgaatacatcgtctatcactaaaaaaataattaactcatatataagtacatcgtctgctattaaaaatataactagtaataaatatgagtatttatgtcaatcgtaggacttaaacatgagtgaacaagttccattaaaaaaaacttaactagctgagctattcttaattcaaattaaactaattaataatgtgttataaaaaatatttaaattggaattgaaaatttagagaaaattttattgtttgaaagtaatttttgtgataaatgcactggtgccatttgcaacaattctttacaaagtttctctctctctctctctctctttttcatagcaactacttccttcgtttcatattataagactttctccacattcatatagatgttaatgaatcaaggcacacatatatgtctagtttcattaacatatgtctagatttatatatatatatatattaatgaatctagactagggatgaaaacggagcggatacggacggataatgctcataccgtattcattttcatattttttaccggatacggaaacaaatacggatagctcgaatacggaaacaaatacggattatctcgaatacgaataagaatcgaatatgaccggacacgaatacggaaacaaatttttctcggaacacgaaaaccaacttaacttctaatagaaacaaatatcaacatatataattagctcactttatattaaatgtagtataatttataaatatttttaaaaatttaaataatatgagtgtggactagtgttaacagataaaccactattaaaatctaaaaatgtatattgaaggtcatatagttataaaaaatggggtatgtctcatagcttctgcggatatccgaattattatccgtatccgacggaaactccgataccatattcgtattcgtatccggaagaaaatatccgtattcgtatccgtatccgaattatccgatccgaaagttatctgtattcgttttttgccggagcagatggaaactatccgctccgttttcatccctaatctagacatatatgtgtgtctagattcattaacatttatatgaatgtgagcaatgctagaaagttttataacctgaaacggagctagtagttgaaaacagatataataattgtctagaacatcgaacataagtatgttccattaataatgctttaaaatctcaccgtcatgaaatttgaccatttattcctactactatttgtttaggtgggcacattttgcaattatttagcattaattagacatctttttattgacataataccaactcagaatgagacagtcagatctgagtgatgtcacatcgaaggatagtgttaatctgttaattagttatgagatttttaaaatcttagagaaaagctcatgacgaacaatcttaatatccgatgggttttggaacattaacggcagtttttgaagaacgaatttttagcgaagagttttgtagggtttgaaatggagaacgttctatttttaatagatgattgtgatactgtgaaattcttttgaattattcaatacataaggattttagatgaaatttaacatggacctaacctctttttttttccgtgaacacgcaaaagcattgtacgtcaatatattaaaagaaaaaattttgttacacgacacaatcagctagattagcttatgccaagaaaagagaaaaaaaacacaacaaaaaaaaagaagagactactacgatgactaaacacaactccaatcagctggggttaggggggggggcacagagccacactaaccttgtagaaattttcttttggtttatttttctccttaaattatcgtcctatttggtggtctattcaaatcatttatgtgttttgtttcgtttcgtttcataaccctatgctttgcaaatgtcatatgtataagaatcaccttttttccgtttatgtgttttaccatacctactactcacgttaaaagaagccatttaatagcttcggccagcactgtgtcaataccctaaagaactagtcaataccctaaagaactagcgagtcaacgggcttatttggattgttaccctatcaattttttggtagtgccaagttttggcactaccaaatatttggtaagttaagattatttttatcatatttagtttgctaccaacatagagtcaaaatgtgaaattgtagtaaagaatgttctagataatgccaaatctagattaggtattaccaatgaatgggcttcaatccaaatcaaacgcaagtactattcaattaccaaaatattggtagggcatgtttttggtagcaatccaaattggcccaacacttatctttttttacttcgtatcatgtttaggtgtatctgtcgtcagtgtgtttgggaaacggttagtgccacccacaagtaggggtgggcattcggtctaaccgaaaatttctgtctcggtctttggtctttcggtcttttcggtctttgaaaagcgaagaccgaattttagtaaaaaaatgtcaggaccgacaaattcggtctcgatcttttcggtctcggtcctgaccgaaattcaacaatattttcatatatgcaaagaaacaatggaaattttcaacataaaaatcacaaaaaaaattcataagcacttatgagtaaagactcttaataggttgcatgcctagaagaagtaggatgtgaaaattagagtttaatctattaaacatagtggattgtatgttgcatttagacatttttttggtaattcggtcttttcggtctattcggttacccgaggagactaaccgaattgaccgaacaaaattcggtctttcactacctaggaccgaattgatgaccgaatttctcggtctcggtctcggtcttttcggttcggtctttcggttcggtctttttctgcccacccctacccacaagctaacccaaacttgtgctacaaccttttctagaagttactagtacactttgttgttaagtcgttgcaaattaaccaattagtattgactagctagttaagaggatggatggttctactaggtgcacgctactctgtcgtatgcaacactctttgattttttttacatacgtataagtacgctaattattaaaaatatcatcacatccataaacaaagaaagcttaccaacccaattataaaaagtaggttgaacagaaaaatagatttggcatgttgagaaagaatccaatgaactttgttggaacatgccaatatgtgcaagccacagaagataagtacaacgtgtcgtacaattgtgagatcctatttatgttttttaattaagaatgtactttatattctaagtgcattattgtttttaaactacatattttctatccacacaaatcaataatacataagagcatataacaaatgaataaatgaggtggctctaacatccattttgctgacgcggagatatgaaagggaggagaggggctgcaatacctctttttaaagaagagatttggccattgttctctaacaaaattgtgaagcttatattagttttctttgctcgtataaaagaccattattataggtaagtgttattttgactgttattttaaatatgatgcgagatttccaataacgagaatacatggaccaataatatccctcctctcaaagttcttatgaatcaacaacaccatcatttgctttttagcttatcagcatatttaaaatttgaatattaaatttagagctgattttaaagttttttttgttgtagttaatcttccaacattagttctcaaatcaacaagataccatatatttttttaattttttatggtttatcaatttatgccaagtgcccctaaaacccagtattcgaaggtgcctatagttgtaagccgtacatgtgtttataaacatgagtgtctgcgcgtatgtgagtgattttgtttgtgctgtgtttttttctaaaaaaaaaatagcaaaacacctatgctttggtataggtaaaataaattatattataatgtcatagaaaaaatatattttttaccaaatatgttagtatacttgtttgcttatttaaatataggaaaaagtacaaattacctcccccgaattatcgcggtcgaccgaattaccccctaaaccataaaaccggacattcttcacccccaactatgcaaaccggacgaattacccccctcgacccaattcgcggtggttttggtctacgtggcgtacgcgtggcagtccagtcagcattttattttttttaaatagtgggacccacatgtcatacccctctatctctcttcctaatgtctctctttctctctctctcatgggcggaggcacgcacggcggcgcgcggcgtgagacgaggaggggaaccagacgacagcgtgaggccgcgg

SEQ ID NO: 66273 - DNA, 11408 bp, Oryza sativa
cgtgcgtgcctccgcccatgagagagagaaagagagacattaggaagagagatagaggggtattacatgtgggtcccaccatttaaaaaaataaaatgctgtcaggactgccacacgtacgccacgtagaccaaaatcgccgtggattgggtcaagggcgtaattcgtccggtttgcatagttgggggtaaagaatatccggttttatggttcagggggtaattcggtcgaccgcgatagttcgaggggggtaattcgtactttttctttaaatatatggtaatcacttgtttgaaataaatgccttactgttccatagtacaaaaaatatcataggctgatttgtaaaaactaaaataatgtgtgtcactgtgcttgtgtttttttgaaggagtacagaaaaagaaaagcacttgggggtgggggggggggacaaccagcgtgcacgtaacaaaaaccaagcacaagctggcgagggaagggaaggaagggggagggcgaaagtaggaagggaagaggacaagtggagaggagtttcggtggcagtggaaagtggcagttctgaccacattccctacaccaccaccatcctcaacctcaatccccatccattccattccatcctgcacgagttctccactggagtggagatccgtactatacttttttttattattaccacctgcccgcaaaaccaaatccccgcaccttcctctttccccttctttctcctcccaaaaccgctctctttcttctcccaattgcccacctaccggaagagaggaagagagagagagagagatgggttcttgcggattgaggagggtcagatgatgccattaccaatttaacatcttctgcatcttttttttgcctttcttggcatattcttctcttctggatgtgtagatccttctttccccagtcctgcttagctttcaagcagaccaacaggtccgagattggtgacctgggagcggtttcttgaggtgtggtgccgttctgggtaaggtaaggcaacgaggcgccccacctcgcgcttctcttgaagaatctgtggctcttttctttttttgggttcatgtccgcttcttgtttgttgtattgcctcgctcgctgtagctgatatcttgatacctctcgtttttttagatcgactctgttgccctgcaagaattcgatgcaggagtaagggcggcggcagtatgtaatttggtgggcggttgttggagaagaggagcaattttgcccatcggtttcttgggtgcaaattgagggcaaatttcggtgaatttcgtcggaaattgaggaagcccgtttggcaatcggtcctgtccatgtcccatgcctagaagctggggcattttgggtgtgaattgtgacgaattccagccaatttgggttgggccaggaaagtaccctttgggggtttcagtttgtggtgtgatctgcaatctttccaagattggtggggagttctttgtgtgtgctggtggcaaatgggttgcacacactccaaggtggaggatgaggaggccgtcaggaggtgcaaggataggaggaagctgatgaagcagctaatgcggcgccgagttgagcttgcggctgcacaaaccgcctacctgcagtcactccgaaacacaggagccacacttcgacaattcgccgaggtggagtctgcattgtcacagcagccccctgcaggtattgcagtgcatccatcaccaccaccacctccacctccacctccaccgccaccaccggtgccagtacctcctgcatactcagtgacatcctcagtgccaccgtactcgatgacatcctcattgccaccctcaccacgccctccaccaccgctaccgtttagtccaatagtgataaggaggaaaaagagagacggtgaacttgatgaggatgattctacagacgacgacgacgacactgacagctgctcgactcctctaccacctcccccgccaccaggggttgagtgggagtacttggaaccttttgcaatgcgtcccttaaattttccatcttcattggctgataggattgataaagaagcggcctcacaggtgaccatggatgatgataactgggtggagactaacacagaatttgatggatatgacgatgaaagtgtgtctggtaatgttgaaggcattgtgagcagtgtccagttgaatcaagccaagagtagggctctaggtgatgacaattcatcaatggttagctgggtgacaaaggactcagacacttcagcgatggcctggaggagtaagaagtcgctggcaggaattgccaaggagattgatgaatacttcttgaaagcagcggcgagtgggagtgacatcgtcatacttttggactcttctggtgggcagccagatccctcagagttagaggcaaacagaggtattatatacagtatcttgtctctgtttagtgtttgccatcattttaatatttcttaatgctactattttataattccaactcctggaaacacatatatagatataaagctacatccatgggaaatgaaatgattggttgtactaaacttttcaagatcatgaacattctattctttactctattacagtaaagttaagtacgaaaggacaagaaaagtgtttattcgcaagcaatcacttccagagaataacatttgttgtcctaggtgcaggaaaaaattccaaatccgccaaggttttttccacaatttcttggagctggtcattcaaatctgcgcaagctaatagacaatcctcaatgcattcaagtgatgcctctggatatggttaccatggcaaaacactagagaaactttatgaagaggagcaaaaactctacaagttagtcaaggtgaattacagaagccctagtttttgcatttctttacaatacgttacacaatgcaatcatgtagccatgcaggagataatagcttatatggtagatttcaggtttcttaattatccgggagttgtttcttgagcagagaagtttgtaatccattaacaggataccttagtacctgatgaagaaatgcctacatattaccacattttactaaccaaaactcaaaaagtctatatgttgttgattattatcatcctatgttgcaggatgaagaatttgcaaggctccagtacagaaagaacacctcgttgctacaaagactagaatcaggtgaccatgataaattgcatgcagagaaagtgcgagataatatagaggaattgcaagctcggataatctctttggaggaagctgttggtttgacatgtttgtccatatcaaagctcagagatgaggagttatatcctcagattattgaattatctgcagggtgagcttcaaactttagttacctaagttctaggctgttatattacatttatgtgcatggtatctgatttcagttcataatatgaattagcgttatagagtaatgcatttcaaatttcattccccgatgtagctgatagtttcattcagagctcccaattataatttttaagctaattggtgttgtcttacattctgaagcccatgacaattggcctatggaaataattagtactactaagtgccctagttatgatgtgcaacatcattgtggtagcacgtatctcttcaattatttttgtggcttagttattttcagattgttcactgggttattaaaacagattatctgttccacgcttctaaaatacattttctcaaaaaactttcttctactgcattgctatttgtgaagtttatctatcaaaacatttagtttatccctataatcaagtagataatccgctcaataatatgtttcaaactgagccagtgctatggctacaatgatatcttgctaatactgaaaatattccttgttatgatgctattttgttctatgatatatcttttcacgttctaggcttgtgcatatgtggagaaacatgtatgagtgccatcaggttcagaaccacattgcccagcaagccaatcttctaggcaatttaccagggaatgaaccaacaactgacactcattgtcaggcaacatctcagctggaagttgaagtttctgcatggcatagttcattctgcaatctcatcaccttacagcgtgactacgtaaccatccttaaccagtggattaaactcactgattgcctgcctgataacgatggctttatgaaaagttcgtcaggaattcgtagtctctgtgcagaactccagcgagctcttacaggattacctgagaaggtagagtaaaaccaacttgttttattagtttaacattgtgtgttatccagtgaaatcaagcttgtaggaacttttgcttaagaatatgccacttttctaaataaagatgttcccagtatattgtactcatgtgccagaatttgagctctatcataatcattcacttcgattgccttcttcgtggttttttttcttataaatgttctgtttataaacaggtagctgcagaagcaataaagacttttctgtcagttatacacactatagttgtacagcagactgaggagcgtcaactgaagaaaaagtccgaccaaatcgagagcaagttccatacccagttagagaaacacagcaacaatgcaacccaaaattcgggccagcctacacttgcaaagctggacacgttcaaaaagcaggttgaagaggagaaggctaggtatctgaactccgtgaggactagtcgagccatgacactgaacaatcttcagacgagccttccaaatgtgttccatgctctgatggggttttccggagtatgcgtgcaggcgttcgaaggtatcagtagatgcagtgagattgtcgccagccactcgggagcagtttcacctgccatttcttcgtgactgcatccggcatggttcgttgtgattgttcattgtaagtaggcaaagaaactggttctacgtgaatacacttctcttccaaaacttaaaaagggaaagaatttagcgacgattttaagtcagtacaggcatagtagtcttttgaatagatcaacatagtctcgatttgggaagaggtggatgtctatgaggttactgggaaatgattcatgtgtaactagatacttgaacagttgaacagtagtctgttgctgcatgttctcaacttctcaattctcattatatgatgctattttctatttctcaacaatacagttccaatatcagagtactgaatgtcaagtctcacatgacagatgcttttattcattgcttggttgttatttttttgacgtatgggaataatgctctgtaatctaatctgtgcgtattcctctgcattttgttacagcttctgatttgttggacaagacgtttgaaacgtctgaattgttatatactgttactccctctgattaaagatgccataattttaatttttaccgtcatcgttgagtctgaattgccagagttttaattttgaccatacatatactccctccgtacttgtaaaggaagtcattttggacagcaacacggtctccaaaacataactttaacttcttatttttataaaaatatttattgaaaaatgatatatgtatacttttatgaaagtatttttcaagacaaatctattcatataacttttacattttcagacttaacaacttgagagttattcatgatttatattcccaaggtttgatttaaacattgtcctaaacgacttcctttacgagtacggagggagtataagagaaaaaaatgtctacgtacatgctagatagactcgtgacaatatgacatggatgatgatggatattgctaaaaaaactcaaaagacaaatgttttaagaaataacgatgactttttctttttggaacaaaagagcttttggaatacgagcatgttggctataggggtccgatcatttctcatgaaatatacttatgttgagagatacgaaagtgttcaaatcgagttgcagcataggcaccaccgcccggcttctatgcagttgtcttgaaaacaaattaaagtttacatgagcattttttcggatgggggatacagagtactatgttttgtaacatgttttaagtaatcatactttttaggtctaaatattttctaggaccctagatttatatgtacgtcatctatttgactaaggcatttgaaatacttgtacaaaatagcatgtggtacttttaaaagtaaatatacatactagtcttctgttttctgtttatgtagtcttggttaccttgaaacaaattgcaaagatcgcaaaccaaacataccatttgttgtttattttgactgtgcaaatatgacatttcaacaatcccttatatttcgtgaattgttataatcgtgttttcgccataaaagtataagtaatgttttcctctatgactaagtatttaacgaaaagttttatacctatattttcttccattcttcctataccttaagagttaatttctttcttccacgtctacttaacccaaataagagtgcattcagtttggaggaatttcacagaattttcaaggaagtgaactatttctggtaaaaggcatataatttttttccctacgtttctaagatgccctagcttggcgaggagggattttgtagcttataccgtgtgcaaatatcaaagcaggcacgatggcatttgaaaaaccaaggcactttctttttaaaactaagactaagagattcactattcattatatagagagaagaatgaatcatccttaaaggaaaaaccaaccgtagaagatgagcatggacaccatggagtagacaagaactccattaaagcaccctatgcaaacatagagcatgcgtcttacgagttaagacaacaaccaaataactttataatacattactcatcctccaataattaagtatagtcatagccaaacacaacgcggtattcacattcccaggactactactatgttatgacttcggacacatttttttagtttgttatacgcctccgacaaggacgacaagggtgtcatgagacggctcacgctggactacgacggtagccttcgcctctacagcctcgacggtggcggaatatccccaggaacgcggcttgtcggaggcggcgaggcgatctcatgttaaggcacgtcgaaggcagcggaggaggatttccggccgacgccaacacgagccgagataagttgagaagacgaggcggtgacgagaggagaagcatgtcacgttggatgcatggggcctatagccacagctagctccccgatcacctttttggtatattaagaccttaccgaggcgagcatagccgatggcaaaattgtcttttataaaaatttctctctttgttttcatcgaaaataataaaataatacagcggttgtccaccagctaattatcatatttttacagtgtccacgagaagataaacattctttggatgtctcttagacaaggccacaaactttgagtgtctgtaggaaaatttttatcttttttggtttgtttcgatgagattgaaacgaatgaaagtggttccaacttttttttttatagaagccctcgcaaatcattgacctatcaccatccactccccctcttcgccaaaaagtaaaattaactctccatccatccaaaaccaaatcaaacccaccccccctctcaaaattaaaaaaaaagcgtgctgttcttttctcctcctctcgtgcgcctcctccccctcccccaccctcgccctcgcgatcccaattcgatccgctccggcctccccctcgatccgccgccccccgccaccgcccctcgccggccgcggaatccgcacgcccacgcccggattcgcgcggcgccggccgcggattcgtggccccacccccgcccgccgtcgccgtcgccggaaaccctagatccgcctccgcctccgccgccatgttttggcgcatgaccggcctgtccgcggcctcgcccgtgagttcttcccctctctctagctgctgcctggttatctcatatcttcgtaggattggtgcgcgcgcgcgcggcgtagcggtgagctgcgtgtttttttttttccttctgtctgtttatttattttccgttgggtgttttttttgttgggttggctgtggatgaattgatggggcggttggttgggctgttgtgccagccgctcgtgttgagcttgtgattattgcggtggggggggggggggagcacgtagctctgctgctcccggcggatttggatggtgctgttgggtgtgctgtggccacgatttggttaggttttactgatttttgggggaggattggatcagccccgcgtatggcatgaaagggactggcgtattgttacaaatgaatcctgtgtgattctgtctggtgatacaagtcttagtttgcatttgcattgtgaggtgaagattccgattcgttgggcactgacagcgttgctcaaagaatctttattgtgagggtgtagcattgttgtagtacaataggctcttaccctttttgggcattgccattggacatcaatcttttgaatcactgaacttatgataaagtttttgttccattttatgattgctgcagagttcatatttgaacataatgccatgattaacctcgtttcaatgttatgtgttgatgagttctggaacttatttgtattgcctgatcctaattgagcgataatttcttttcccttttttgtattgttttcctgttgtcaaaatagccttatatctagttgatgcctcaagttattgatacatatgcaagtaaaggttctggttatattgcctaactcaacattttattgcttcaggtggatacaatcctagacaaggaaaattttacactggaagaacttcttgacgaggatgaaattattcaagagtgcaaagctctgaatacacgactcataaatttgtaatttccttaaatatttctgttattagtttgaggagacttgagtggcatgacatgattagtgtactattggctgttgcaacttaccattcattccttatgttgtacgtgtgtagcaaataagaaacatttacggtgttcttatgatttcacttattcattgtgattgatgcaaaggcaattcagttgcttcttagataagctagcagcttattgggtagttgctattttttcctggcacttattgttcgttggacctgcacaattctaattccatcatatggaagaaaaagtagctctttcatttgttgggcaatataggtggaatactatttttgggagtattgtatgtcatagtgcctttttatcccttattatatggttcaaaaatttcctctattatgtttacataactatttccatttcctcccttttctggggcacaattgttctttctcacttctacttcatgtctttttatttgcattcatatacccagagtctactggttgaatgcattacagtataatagtgtttcattgtttcttcaaatagatattagttgttacatttatttagtccgcctataataactaaaaattttgtttgtagcttgcgtgacagagcccaggtggagcaattgcttcgttatgttgtggaagaagtaccagatgatgctgaaaaaaagcgctctttcaagtatgacatttttgttaacatatgccatcatttatgtaaagagaagaattttccacctcaattttctgtccatctgttgtaggtttccattcattgcttgtgagatatttacatgtgaaattgatgtcattttgaggaccctagtcgaggatgaacaggttggcatttcttcatatccttttgaagtgtttgttcagaacattagtggttgtagctaatcacaattgtctagctaatgttatttatccttctgtatgttgcagttaatggaattgcttttctcatttgtgaaatccgatcatccacatagcacattgttatctggttacttcagcaaggtacttcatttgatcaggcattatatgtaactttaccatgggtaaactcatagtatgaaggcactgtagaagttaattttttaggtgattattgtggttacgatgttaaactccaacctgcttttttttttttgctgggttgaaatcagcttgattaattgtttgttctaggtggtaatatgtttgatgctgcggaagactgctcctcttatggcttatgttcaggtattccttgtctttctcatataattgaactaatttattgattctatttaagctgactaggtctgacattcaaatattcgatgcatctgtcctgtcttctgttcactttagttgtgttgttcttccaattatatgctgtttggttaactggaacaagctaatcatccacactgaaccattttctttgagatatctgcttaagataaactgttatgcacttacacttgtatgttgtttgccctgtgagattttatattttttgggttgatcattcagtggattcatgacacctaatctgtacttttatagggacatccagaaatagttgtccaactcgttgacctgattggcatcacatcaataatggaggtaagcaggctatcaataattactatttgctctgcgcttgcatttggctaatgctgcccttgggatccttcaggtgttaatacgattgattggtgctgatgagaccatatactcaaactatggcgatacattgcagtggttagaaaatacagatgtccttgaaatgattgctgataagtttagctcatcggtgagttcctaaagcttgtttgctaagaaatgtatgtaataaacatggaaatgtttttaatcatccatctggcacagtaggtcagcacttatatctgcttgtaatttctataaaattagcagtattttgatgctaatcccctaaatattattatcccatattcctattttttatatggtatgttatttttatgcaggactcccctgaagtgcatgccaatgctgccgaaattctttgtgccgtgactcgatgtgctcctccatctcttgctgcaaagatatgcagcccaaggtttccattttataaccttgttacaaagtcacagtttaatccttatcttgtgatttcgggaaacctttttaaaatgaactttgtgcatggatattttttttgcaatggacagaaaaaaagatgtttatgctgttctcccaactcttcgatgaactttataaccctaaagaggttttgaataatttagaacaaccaatcaaacaaatatgctgttcattgttgaattctgtttgtgtcaccttctatcatatgttctatgaaatttcagttttgttgggaggctatttcgtcatgcacttgaagaatcaaggcccaaatccgttctagttcgggctgcaggaat

SEQ ID NO: 66274 - DNA, 10974 bp, Oryza sativa
aaagaactgaacttgttgagcatgttcttaatgactgtgacattgttggtaaaattcttgccgcggaaaaactttcttctttgtcaacagagtctactggggtaagttgttaacagtctgtggtaattttggatgtaataatccccttacatcatttttgtcttgtgtgtagcctactataccttcagatggtaaatcgattcccaaaattgggaatattggtcacatgacaagaataaccaacaagcttattcagttgggaagcagtaacggcacaatccagattcacttgcaggtgatatttcctttctttccattgactcaacagtctttaattttttgaactatgaagtacctgagttctctgctcactgtctcgaattattttttaacaataggaaaatagtgagtgggttgactggcaaacagatgttctagtcaagcgtaatgaggtggagaatgtttatcattgggcttgtgggtatgtgactgtttctttttttgattgcatgctaaacttgcatgtcttgcttctgttttttcactgaatagtttatctatatgtcttgttgctgcaggcgcccaacatcacttcatgaccgtggtagggatagtgatgatgatgacttccgagacagggattatgatgtggcagctcttgctaataacttgagccaggcattccgatatgggatatatagcaatgatgatatggaagaggtgtgtgttttgaatgattttgtttctcttgctttgatggtttgcgtcagtcaacatgtttctctgccagcacattttgttaggtttaatttgagaggattctatggtggataaaatatcattctgttactcgtgctatatattatctacttgagtgactcaccagctctaaccatgttccagttttgcagttccttaaagccttactataccagatactaatgatacttgtttgtttcttgaatgcagaatcaagggacacttgaacgggatgatgaggtatatttaaggatgctagtttacccccatttattgcttttttgttcttttcacctggtattaagttcaatttgattaaaattcagtatagttcctaaatgcttgcttcaatcaaccatgtaaaaagaacagaatgttgcatgcggataatatagtgtctagaaccatatttgttgaagctgtacttttgagtgagtggatttccattgttttctcctttcaggatgtctattttgatgatgaatcagcagaggtcgtaatatcttcactgcgactgggagatgatcaggatgggtaatttgtgatcttaaaacatactttggtatctttggtttttttgtccttgggctaattatgtgtttatgtatttaaaagcagttccctctttacaaattcgaattggtttacatttgatggagagagaggtattactgaccgtttggctgcggttccttcgtcttcacctaattcagaggagatttccccagacactgaggaaactgatgatggtgaagtcgtcattggtactgaggatcatatggatactgtcaatcttgggaatggtcctatcgaggaggcagaagatgcagcggaatttactaaacacccggctactagcacggaggatgagcaactacaaaacgctgaagggattgagcgacacctggatgtttcaaatggtgatgctgaagctagtacagaagctgcagaggcagcaccagtatcttcagccccatcttctgatgaggtgcagacagagagaactgcagatgaacccactggctcatctgattcgggtaattctgtctcagaagttttgccagatcctgaagatagtagcattgatccagccaacacagcagtatcgtctgaacaaactgtggataacgaagacgtggagttaccaactaaggaagttccgtctgtggatgttgaaactaaaaccgatgaaatcaaagcaaatgagtgaaggggcaggaaatctcatgggctaaaatggcatagttgaccagaacagttgttagtcagatcggtcagaaagacaagcaagcctcacctgctcatcaggcatggacatgtccgaagcaaactgctgtacaataaaaagagtgtactatttttgccatccattgtggtctatccctgtacaaaaatgatcaccatcatctaaccgcacgctcgtcatcgcaacatctgaaactggtcaaaatttgtttcaagttcgcctccagttcatgggaaaaataggttggtgccaaacgtcatttgtcagttagtctctgtgtcgtgtcttgatatatggaaaagaacattctttggatggcagctagttttgtcaacgtggtcttttgtttccttttaggtttaacactttgaactgtaatatgggatgtgctatttatttatagcctagctattatttgtaattttttccaacatgacgtgggtcagttcaaatggaacacgtcctttttgataaaaacaaaatttctctgcactcttacccatttggttttcgaaacgatttccacatcagccttttgttatgttactacatcactatactagctttcatcaaaatttggacaattttatatgttcttgtacagcccttttaaagagggccaattgatcttcacttgagcttacgctgctttctactactcgactccccgggctgcacattgcacctgtgctgtgtagttcctctccatgaggcgctcttcctgctcgcgtggatcgtagttgagggcgccgacgtcgatgctccggtggcggcgctcctcgaactgcttgctcgccgccggctccggcttcaggttggagaggttctccatggcagccatccttatgccgtctttggaattcgccgtgttgcggttgcggtgcttcgtttccaacgtgtaatggagcttgtactcctggctcttgtagagcacgtccaaccgccaatttccttgtagttctcttgtagaacgtgtaatggtgcttcggtatgtcgttgggaatttccttgccgatggccaccgccatcttcatccatccacggaatttcacaaactggatcagcattgccatcaagtttggatcaatttcgcaagaaacatgaaaacatatctaatctctcgagagaacattcttctgtaatctctttctcgataatctctcactcgttatttttttaacattcttctatgtatcggtttgatacctctctcgctaagcgctcggaattacccgcatgtgtgccggtgcatgcgcatgtgcgcccggccataaccccggctggcaagaggtgaaaaattagctacgttcctataatttcctctctttttatccttgttgttattaggccggtttcttgcatgttctgctacatccttatagacttgtttttttagtaatttccttgctcctctaatttggatgggattattattttgtttgcgctctcagtctagcagtatgctacccgcatgttaaaagaattattaatcggttttgctataattgtggtaacacattttttatggaatcagagtcaaattttagacagttagatttatgtaagatttgtgcatgcgtacgagggccactgacttggttttttggcgtcattaaacaatgcagtcagtagaagaagcagaagaagcagttgtattctatcaaacaaaataacgataatctgtctggataattaattaaggtttgatttaatatttttttcatctcgatttgtcctcacacttttgcatgaagagaagcaaatccaaacctgagtcattaaatatgtgctttgctttctccttacccgagctaatgttgctcatcttccggcacattacctagtagtagcaaacattgtccaaggctacacatcagtggaagaatgaaaatagagaacaaaagagaatgaaaagtagagaagttacgatgtgcatataatgttcaacactataattatataattatattgtacttacaacacacttatatgatataattacactatacttacactacatttacattgtacactacatttacattgtacttacactacacttacacacttaaatagtacttacgttggacttacataataattatgttgtacttacattttaattattatgtaattcctatattaagcatactgtaatagtgtcaatcggttaattaattagcttgctagcttcaggggtgcaaatattatttgttttttcacggtttccacaaattcccgatgctgttcttgttcctttttctttggctaaaatttaagttccaaaaaaagctgtgtttatgctaattttgatcggaagtcaaaaaaggtcatcttttttaccaagggactactagatggatatcccaataacttccacaggctctacggtttgagataattaaatatgcaacttcttcccaagggctgctctactatttggaaataatttaacatgaacttcccaaggacgctacggttttaagataattcattaaattgataactgcattgcattctatagtttgatatgcgtacatgtaatgcgtacatgtaatcctcaagatatctctacgtataactaatctcgcatatcatgcccattcacaattagatctcatctcaactcacaataataatcgactatgctaaaattccatcgacaatttttttcattaagatttgtcgaattttcagccgttaatctaaccatgagattcgtgccctctttgtgtcggcactcccatgaaacgtaactcgtgagcacttgaccacctggtggtactgtacatccatgcacacggctgattatctttgtcgctcactaattaaatagtttaaagttgttgttaatcatctagtgtacggtttcctgtcaaattcatgttacccaaaagcgtagagaggattaaagcatggtaatgatatgagagagagagagaggaggtaagttgaggaaaaaaattacagtgtaaatatagtacttttagagtgtaatttgttgtaattacattgtgactcgttgtaaattacaatgtaattctattagacttgtatgtaatttattttttttctatttttcactaagtgtaagttacactttatttttaactataaggttatatttaataatgaattctgtgttatgatacgtatgattatataagtattaaaaatctgagtgattttatgtcgggtgatctagatactacattaatataacatgtgcacaaacaaatacgaagattatggtggcggataagagccctatcgacaaggctgtcctccatggcaaacacgagcaagatgatctacgggacgataaggtggtttacgacgtggagtagaagcaactcctccttcccacatgtcggcggtgccgtacgcgctatcgcagggcgggtggctcagcctggtgctcttcaccatggtcggtgccaactgcttctacaccggcaaactcatcgaccactgcatgcgcgccaatcgctgaatatggagctacctagacattggccaccgccttcggcggctatggccggatggctatcagcctcgtcatgtacgtcgagctctactttgtcgccatcagcttcctcattctcgagggcgacaacttgacaagcttctccccagcacggtggtggagattctatggtacagctgcacgggaagcagctgttcgtgctcacggtggccattgtcatcctctcgacgacgtggctcaagaacctcgctggtttgggccggcgtggccgacaagtgcttccacatggcgggaagcaacctctagaatctgagcaggttgcccaccacctgcccaccaccctcagcctctacttcttcatctatttcatcggccatggcgtcttcccgaccgtgcactccttgatgaagtctaagaaggattttcctaaggtacactttttaaaatgtatttatatgttttacttgatagtaagtttgctaaattttgtgataacaatcaacaatgtaaatttagaattatggttaatgaaaattgaaaagtcaatggtggaattaaattagcaacaggtttagtaagaatacaaacaaattgttttttattacatgtatgcatggaagacacgcacactcataaatatttttgagaactcgtacatcactaatcatgcacacctcttaatcatcatcgctgctacgttctcatcatactcaccattgcaggtctatatatacatcatgtagataaaatttaagctaataagtttatttgatcgtccaataagaattaggatcagacgaaatgaacactaaaatcatttattaaaataagttgtactatcctaaaaaaagatgtaatgttaatttacagtgatacggaatggcgagtgcattactggcaagtgcaatattcacaatttagcattaatatatatttttgcataatgatgtaaatttagcgtaatgtcagattggcctttagactaatttgacgtgtgcggtgacatggaggcgtactgtgctatattatagcctatcaccccagtggaataaactggtgaatggaggcaattagggtcgcctctcaactatatttggttacctctcatccacccatgtaaaagcaatgtagcttaaagataaagctaatcatgagccgtctaatatggtttaatttatttgctaaaacttgaacttagaatatgcgtctagcacttcaaatgaaataattgtattagccatttgaatacatagtttacgaaattttgtttttaagtaatttaatgcgtagtccaaaacaattttaggtaaattaaaaggtagcatatctaaagttggaagatgtgttgcatcataaacttttcaatgccaagttaaaatagatatctattatgtcgtatatattcttgtactaagtttagactcaaccaacagctatgagaattgttagggataagatgcaaaagttgtagggcactgactattgctcaattaactcatggaagtttcttaaacaatcttggaccttttaccattcttttactgatacttatccatgatctaacggcatatattgtatcaaccgttgcattcaatggtccatatcttcagatgatgtagctcaatgatgttgcattttaagttttacctttcacttggagagatttggcaaacaatgataattgatcattggattatcaattccaattatcgtaatttggtttatgaaaccacgatgatgatgataatggatcagtactccaataatgttctattcctctccaattaatatgcaggttttgctgatctcttcggtgctgtgcagtctcaattacgcagtgacaacattattgagatatctgatctatggtgaggatgtgcaggcgcaggtgacgctgaacttaccctcggggaagctatacaccaggatcaccatcctgacgacactgatctccctgctagagaagtacggactcgagatccagctcattgcaacggtgataaaggagaagctgtcgttgacgacggcagcggcgacggacgccgagaacaacaggcagaccagggtgctcaccagcacagccgtcgttgtcagcacggtggtgctggcgtgcacggtacccttcttcagctacctcatgtcgttcaacggatcttcgctgaacgtcaccattgccgtgttgttcccatgcctgagctacctcaagatctacatgccctgaggaggagttggccacttcgaggtggcggcgatcgtcgggatactggtcatcggagtgtgcgtcgtcgtcgttggcacctacacctcccttcaccagattataggcacatttttgtaacatcccggcctagggcttaataggattaatagaatactcatatcaacaagttgcaacttcttttccggaagccgatctccaaagaactccagggttaagcatgcttggcctggagcaatttgggatgggtgaccgatcgggaaattctttccgggtgcacacgagtgaggacaaagtgtgcagaaaagacatgtgttggtccgtgagggcagtctatgacttatgaaagctgccagatgtaagtgggctcgacctgggagaggcaggtcgttacaaaatggtatcagagccgactctcgcggtttcacgggcgcgtgtgtcgcagttgcgcaggcatggtgcgcatggctggtgtagacctggagtggtcacacagcatggcacatgcgctagcactggacacacggacgtggccaagagaggacgttcctggcctggggttgatcgacgggggcgtcgatctctcttaagggggtgagggtgtaacatcccggcctagggcttaataggattaatagaatactcatatcaacaagttgcaacttcttttccggaagccgttctctaaataacttcagggttaagcgtgcttggcctggagcaatttgggatgggtgactgaccgggaaattcggatttcccgggtgcacacaagtgaggacaaagtgtgcagaaaagacatgtgccccctctctatgacctatgaaagctgccagatgtaagtggccttggcctgggagagggtgcagaaaagacatgtgccccctctctatgacctatgaaagctgccagatgtaagtggccttggcctgggagaggcaggtcgttacaattttagtaattaaataagtttcaaattctttttttactttgtcctaaaaaaacaacagatatgttatacagagtgttaagaatcaactgagcggctatatattacatgtgtactctcctggaatgcctacgtgtattatcactaaggaagtttgtcacgcccagaaattcacaagtaatttccgaactaatttgtacattaagacccttgttcaggaatcagccgaggtacacaaactgacaatttaatatacagattcatcagaataactaaaacaataaatacttacataagaggcacttagtcctcaccatgaagaaaactgcagcgaaaaataaaatctagcgaagcttatgctccactcccacagtcagctcaactgggatctaagccaaaggtcttctccttctggatcctttttcttcaactgaggttcgatgattattgcaagaatgagcatatgacatactcaacaagccacacagtaaatatgcaagtgcacaaggataccaaaggatggcataatataggctcatttgcaaaagcagcatttagcaaagatactcaacaagccacacagtaaatatgcaagtgcacaaggataccaaaggatggcataatataggctcatttgcaaaagcagcatttagcaaagatactcaacaagccacacagtaaatatgcaagtgcacaaggataccaaaggatggcataatataggctcatttgcaaaagcagcatttagcaaagatttaagagtagtaaaacagtagagtaattaatcatcaatattaatcaacactgaacagcacaccaatgctgctcaggcccaatcaaacctgaacaaccaatcccggtcgtacagatcaaacctccaaaccaggaattaaccattccaaaccaggagtcaaattaattatcacattgttatcattaatcagtagtgtgggactaatcatgaaaaacattgctcaactcgcccataaccgcaggcatggctattcgaatagttttactctggccagaggtgtaccactgtacctacaagacacgattccacacatgttgccatgccccgaagtaccactacggcactgcaaagggggaaatcgtgacaatacccttcgcacaacacaactcaccacagtgcaccattcctggatcataatcaccccctctataaatataaccagaggcatggactccccagcgacccccacggacttcttgccgcttctcagtctggtgccccgtaatgaatcatgctatacaaaaggtaaagccgttgcccacgctagcttgtggttggcacggttaatgtctcacaacagtagctcgcgaaccggtccttaattgccatgagcacgaccttcaaaaccatgtgctcacaacccaccattaaccaggttttaattattaattaattaacataacatgattaaccatcgtgatctaccattaaatataaccataattaataataataatataatataatttatatttaatcctctttaattagctaatgtttctaagcatgactaagcaaacatacatatggcatttagctgaaccaatccaatatataaggttcatgctaatcaaattataacccataggaaaataaagtcatcttcagccgttaattaattgggaaagactcaccacccgatggcattcgaaaataattcataagttgaaataaaacattaactttaaacgggttcaacatgctcaaagtgttgtttgggatttgtgtgacttgccttgcaaacaagcgtcttcaattcatcttcaggaacttctccaacgaacgaatgatcctccgaaacaacggaaaactaaacctagaatgcaaaacgagaaaaacactaataaaaaccaaataaatagtacaattaaagttcataaatagatagagcttgaatttagatgaattatgagacttgaacgacctccttccgagttcgtatgaattagatatgaattttacaagatttaattccaattaaacctattaaagaaaagactattccaaattgattaaacaatttacaaatgatttatagctgagacaaaagattaaaacatcctccggaaaagattagatcatatttggtagatgacatttattaaaaaggaataatatgtcattgaaaagagatgacaaatttatattaattttggatggccaagatggcgcggttgtcagcgatgacatggctgccacgcaggatcgacactggcgagcccgggaacggcggttaccagcgaaccacggtacaatgacgcaaacggagggcaccggaaga

SEQ ID NO: 66275 - DNA, 7235 bp, Oryza sativa
gctatttataggattcgtgcgaagagattggatcaaaaacaacgggatttggcgagagaaaaacgagggtttatccgagttcgccggaaaaacggagctcgaaaccgcgtcgaattcacgcgatatacaacgatattcaaaggggtttcttagggataaggtagaggagatcgaggggaatccgtttttgcaaccaattttggaaacggagcacaggatgcgacggattttgcgaaggaagcggcggcgcacgcacacggctcggctctgtacggctcggctggaggaggaagaaggtactgtagcgagggtagataaagtagacttttcctgggcttccttttccttacttgcttggcccgattgctagagggaagaaaactggacttcggctaagagagagggagaggagtgggctgaattcggcccaaacaaagaagaggaattttaattaactttttaatttaaataatttctgaaatgatctttcatttattaaaaatacttccaatgctcaaataattctggtaaaaatacagaaaatacttgggaatacaaagtatttaataaaattttatctagctcaagtttatgttcaaatttttcatagattttattcacacacttgctttaattattaaataaattctaaaaattcctttttcacaacaatttataatttagcgattttcagggtgtgacaaagtttcataactttcattgtcttcttgttgactaactatcacagctaaaatttaaattttcgagttagttaagtttttagttgttatgaagttttttcatcatagtttatcttcttccacccttagttttaaatcactagtaacacatataaaagttgggatttgctatatatgtgtctacattttttttggttttatctataaattatttttggtttgtttcttttagggcttattagcctacaactgaatcttgtcgattatgaaagtatggtgaaatatggcgcaaatggccatgcattttatgagattatttttttatgagagatcggtagaatatattcccttcgtttttttaatagatgacgttgttgacttttaaatgagtgtttgaccattcgtcttatccaaaatttttatgcaaatgtataagatataaatcaatgcttaaagtcaagcataatgaggtggagaattcgtatcattgggcttgtgggcatgtgactctttgttttttttgattgtatgctaaacttggatgtctttacttctgttttttcactgaatagtttctctatatgtcttgctgctacaggcgcccaacatcacttcatgactgtggtagggatagtgatgatgacgacttccgagacatggattatgatgtggtagctcttactaataacttgagccaggcattgcgatatgggatatatagcaatgatgatatggaagaggtgtgtgtgtgaatgattttgtttctatcgctttgatggtttgcgtcggtcaacatgtttctctgccagcacattttgttaggtttaatttgagaggattctatggtggataaaatatcatcctgttactcgtgctattgcattatctacttgagtgactcagcagctctaccatattccagatttgcagttccttacagccttactatactagatactaatgatgcttgtttcttgaatgcagaatcaagggacacttgaacatgatgatgaggtatatttaaggattctagtttacccccatttattgcttttttgttcttttcacctggttttatgttcaatttgattaaattttcagtacaactccttaacgtttgcttcaatcagccatgtaaaaagaacggaatgttgcatgcggaaaatagtgtctataaccatatttgttgaagctgtacttctgacagagtggatttccattgttttctcctttcaggatgtctattttgatgatgaatcagcagaggtcgtaatatgttctctgcgactgggagatgaccaagatgggtaatttgtgatcttataatatactttggtatgcttgtttttttttttgcccttgggctaattatgcatgtatgtatttaatagcagataggctaacctttggaatcctattttcagaaagaaatacatataccaatatgaattcattctaggattaactagatacacacaattcgtgagagcacttttctaatgtatatatgctaacctttaccataggcttaagacatagttatactaatcttggtttatttaataattgaaaattacatatgtactcgtagtatgtgctatgaattactcatataaatttaaattcagtacttaattttaaaattgttttatctatttttaatacttataggcactttttaataacggataaagttaaatactactcaggatttcagcgcatgcctatattttaaacctattaagaggtcagcgtaatgtatagtgacgctgagttccttttacatggctaatttgtgccaagtcgggtagtgctgagacgttttagttcagcgtcatcagggttagcgctgaggtcacggtctatttttttaaattagtttgacatggtttatttttaaaatttttatagaaggattaatttgtcaaaattacagtgtaaacagaagtatccaaatcaatacgtatagtgatagaccaatcttttcctcttttctttcttcccacgtgggcctacttagtccattcaatcgtgcatggaaccttgcccatgatgctgcatgagccatgcacaactgtgtataggcgggttgcatagcatcgtacacgcgtcagaaaagcattatgccacctagaccaacaggcagctggcaaaacaaccatcatgagaataatagatagattattattttgtttgctctccgtccagcagtatgctacctgcgtattagagggattattaattgagtacctatatttatgtcgccatatttttcatgaaaaaatagtcaacatgtatttacattgtaagtctttaaattacatatgtaattttagtgtatttacaatgtaagtcccaaaattacatatcaagtctctaaattacatatgtaattttctaattttacaatgtaatttaactttgcaaccggttgtagacataatggaggaccgtgtacacaatataggagaagaaaaagcaaatttattatcaattgtacgagtccacgaaatgcaaatgcaaatgagcacataagagttggagcttgataaggtgtcccaagttagttacgctttcggatagctttgatctgacacaaaaaaatatctgactgtagtcaggccccaaatatgtcgccacacgtgaagcaaaaccttattaattttgttgacataaatgaacgaacaactaataagcatactgtaatagtgtcaatcggttaattaattagcttgctagcttcaggggtgcaaatattatttgttttttcacggtttccacaaattcccgatgttgttcttgttcctttttctttggctaaaatttaagttccaaaaaaagctgtgtctatgctaattttgatcagaagtcaaaaaaggtcatcttttttaccaagggactactagatggatatcccaataacttccaaaggctctacgatttgagataattcaatatgcaacttcttcccaagggctgctctactatttggaaataatttaacatgaacttcgcaagggcgctacggttttaagataattcattaaattgataactgcattatgtagtttgatatgcgtacatgtaatcctcaagatatctctacgtataactaatctcgcatatcctgcccattcaaaattagatctcattttaactctcaattaataatcgattaagctaaaaataccttgacaaatttttctgttaagatttgttgaattttcagccgttaatctaacctttagatccgtgacctctttgtgtcagcgctcccacaaaacgcttaacctgcgagtgctggacctggactacctggtactgtacatccatgcatacgactgattatctttgtcactcactaattaaatagtttaaagttgttgttaaacgtctggtgtactgtttcctgtcaacttcactttgcccaaaagcgtacaggggatgaaagcctggtaatgatgagagagagagagaggaggtaagttgaggaaaaaatacagtgtaaatatagtacttttagggtgtaatttgttgtaattacattgtgactcgttgtaaattacaatgtaatttcttttagatttgtatgtaatttatttttttccctatttttcactattacactttaataataaattatgtgttatgatacatatgataagttatacatgctatttccatatgtgtattaggtaattattaaaaatctgaggtgtttggtttaaaagtctgtcgggtgatctataaattcattattactaataacaggtacacacacaaacacaaatattatagcggtggataagagctctatcgatgaggctctcctccatggcaaacatgagcaagaagatctatgggatgatgaggtggtttatgacgtggagcagcagtagatcctcggctcgttctgcatgactggcgcttccttcaggagaagctgcctcaacctcagcaacgtgatctgcagcatcgggatgctctacgtgtcgtacgtgctatcgcagggcaggtggcccagcctagtgctcttcaccatggtcggcgccatctgtttccacaccggcaacctcaacgaccgctgcatgtgctgatcgcggcgtacggagatactccttcggcggctatggccggacggccatcggcctcgtcatgtacgttgagctctacctcgttgccatcagctttctcatcctcgaggccgacaacctcaacaagctccttccggcacggtggtggagatcctagtgtactaggtgcacgggaagcaattgttcgtactcgcgacggccactatcatcctcccgacgacgtggctcaagaacctcagcatgctcgcctatgtctagcggctgggctcgtctcgtcggtggcgctgacagtgtcgctgctctgggccggcgtggtcgacaagggcttccacgtggctcttgagtctgagcgggttgcccactgccctcagcctctacttcctctgcttcgcaggccatggtttcttcccaaccgtctaattctcgatgaagtccaagaaagattttcctaaggtatactttttaaaatgtatttatgtgttgtacttgataataagtttgctaaaatttatgataacaattagcaatctaaatttagaattatggttaatgaaaatttaaaagtcaatggtggaataaaattagcaataggtttaagaacatgaacattttgtttttttattacatgcatgcatggaagacatgcacactcataattgtttttgagaactcgtacatcactaatcatgcacacctcttaatcatcatcgttgctacattatcatcatactcaccattgcatggccctcatatattttgttggccctcatataagtttattttgatcatccaattaaaagtaagaattaggatatgacgaaatcaacattaaaatcatttattaaaataagttgtactatcccaaattaaaagatgttgtactacttataaattttgtaatgttaatttatagtgataaggaatggcgaatgcaatacggaattaatggcaagtgcaatattaacaatttagcatatatatatattgcataatgccataaatttagggtaatgttgggttggcctttcgaccagtttagcatgtgcagtgatgtggaggcatactgtgctacattacagcatatcaccccagcggaataaattggtgactagcgtggaggtgtattgttctatattacagcctatcaccccagcagaataaactggtgacttggaggcgattagagtcgtctctcaactatatttggttacctctcatccacccatgtaaaggcaatgtagcttaaagataaagctaatcatgagccgcctaatatggtttcatttatatgttaaaacctgaagttagaagatgcgtctagcacttaaaataaaagaattatattaaccatttgaattagagtttacgaaatttttttaaagtaattttatgcgtagtccaatacaattttagataaatcaaaaggtagcgtatctaaatttggaagatgtgttggatcataaacttttatatgccaagttaaaatagagatctattatgttgtatatcttcttgtactaagtttagactcaaccaacgtgtataagaattgttagggataagatgcaaaagtggtaggacattgactattgctcaattaactcatggaagtttcttgaacaatcttggaccattctccattcttttactgatacttatccatgatctaacggcatatattatatctactgttgcattcaattgtccatatatttagagatttgacaaccaatgataattgatcattggattatcagttcgaattatcataatttggtttatgaaaccatggcgataatgagaatggatcagtactccaataatgttctattcctctccaattaatgtgcaggttttggtgatctcttcagtgctgtgcagtctcaactacgcagtgacaacaatgttgggttatctgatctatggtgaagttgtgcaggcgccggtgacactgaacttacccacggggaagctgtacaccaggatcgccatcctgacgacgctgatcaccccgctagcgaagtacgtgctcgtgatctagcccatcacaacagtgaatgaggagaaattgtcgacgacaacggtggcggcagcggacgtcgagcacaacgggcttaccagggtgctcaccagcacagccgtcgttgtcagcacggtggtgctggcgtgcacggtacccttcttcagctacctcatgccgttcaacgtatcttcgctgaacttcaccattgtcgtgttgttcccatgcctgagctacctcaagatctacatgcctcgatttggagttggccgcttcgaggtggcggcgatcgtcggaatactagtcatcggagtatgcatcgccttcgttggcacctacacctcccttcaccagattatatgcacagtttgattgtgcatttgtgggtaaggttgtagttttggtagtgattaaatatgt

SEQ ID NO: 66276 - DNA, 8376 bp, Oryza sativa
ttgcgagttaagcgtttcgtgggagtgctgacaccaagaggtcacggatctcaaggttagagtaacggctgaaaatttgacaaatcttaacggaaaaatttgtcgagatatttttagcttaatcgattattaattgagagttgagatgagatctaattttgaatgggcaggatatgtgagatttgtacgtagagatatcttgaggattacgtgtacgcaaatcaaactatagaatgcagttatcaatttaatgaattatctaaaaaccatagtgccattgggaagttcgtgttgaattattttcaaatagtagagcggcccttgggaagaagttgcatattgaattatctcaaaccgtagagcctttggaagttactgggatatccatctagtaatctggtccgttggtaaaaatgatggcattttttgacttctgatcaaaattagcatagacagctttttctggaacttttaattttagccaaagaaaaaggaacaagaacaacatcggaaatttgtggaaaccgtgagaaaacaactaatatttgcaccactgaagctagcatgctaattaattaaccgattgacactattacagtatgcttattagctgttcattcatatgtgtcaacaaaattaatacagttttgctacatgtgtggcaacatatttgggggctgattacaattagattttttttgtcagatcaaagctatccgaaagcgtaactaactgggacacctgatcaagcttcaactcttatgtgctcatttgcacttcgtggactcgtacaattgataataaattcgctttttcttctcttatattgtgtccacggttcaccattatgtccacaatcggttgcaaagttaaattacatttaaaaaaacaaaaattacatatgtaattttgggacttacattgtaaatacactaaaattacatatttaatttacagacttacaatgtaaatacatgttgactattttttcataaaaaatatggtagcataaatataggtgctctgaattagtaatccctctaacatatgggtagcatactgctggactgagggagcaaacaaaataataatctatctattattctcatgctggttgttctgccaactgcctattggtccaggtggcacaatgcttttttgatgcgtgtatgacgctgcctatacaccccgcctatacacggttgcgcatgcctcatgcaatatcatgggccaggtgccatgcatgcacgattgaatggactaggtaggaagaaagaaaagaggaaaatattggtctatcattgtacgcattgatttggctacttctgtttacgccgtagttttgacacattaatccttctataaaaactttaaaaataaaccatgtcaaaaactacttaaaaaaatagaccgtgacctcagcgccaaccctgatgacactaaactaaaacatctcaacaccactcgacgtggcacaaattagctatgtaaaaggaactgaacgtcactatacattacactgacctcttaataggttttaaatatatggcatgcgctgaaatcctgagtagtatttaactttatctgttttatcaaaaaagtacctataagtaataaaaatagacaaaacaattttaaaattaagtagtgaatttaaatttatacgagtaattcttagcacatactacgagtatatatgtaattttcaattattaataaataaataaaccaatattagtattactatgtcttaagcatatgataaaggttagcatatatactttagaaaagtgctctcacgaattgtgtgcatctagttaaacctagaatgaattcatattggtatatgtatttcttgctgaaaataggataccaaaggttagcacatatctgcttttaaatacataaacgcataattagcccaagggcaaaaaaaaaaagaggataccaaagtaagttttaaggtcatctcccagtcgcagagaacatattacgacctctgctgattcatcatcaaaatagacatcctaaaaggagaaaacaatggaaatccactcagtgagaagtacaatttcaacaaatatggttctagacactattatccgcatgcaacattccattctttttacatggttgattgaaacaaacgtttaggaactgtactaaaaattttaattaaattgaactaaaaaacaggtgaaaagaacaaaaaaaaagcattaaataggggtaaactagcatccttaaatatacctcatcatcccgttcaagtgtcccttgattctgcactcaagaaacaatcatgtatcattagtatctagcacactaaggctgtaaggaactacaaatccggaacatggttagacctggtgagtcgttcaagtagataatgtaatagcatgggtaacaggatgatattttatccaccatagaatcctctcaaattaaacctaacaaaatgtgctggcagagaaacatgttgactgatgcaaaccatcaaagcaatagaaacaaaatcattcacacatacacctcttccatatcatcattgttatatatcacatatcggaatgcctggctcaagttattagcaagagctgccacatcataatccctgtctcggaaatcatcatcatcactatccctaccatggtcatgaagtgatgttgggtgcctgcagcaacaagacatatagagaaactattcagtgaaaaaacagaagcaaagacatccaaggttagcatgccatcaaaaaaaaaaaacaaagagtcacatacccacaagtccaatgataagaactctccacctcattacgcttgactttaagaatatcatttatatattatatatttgcataaaagttttggatgaagtgaatggtgaaacactcatttaaaagtcaatggcgtcatctattaaaaaactgagggaatatattctaccgatctctcataaaaaaataatctcataaaatgcatggccatttgcaccatatttcaccatactttcagaatcgacaagattcagttctaggctaataagccctgaacaaaacaaaccatagataaaaccaaaaaaaaaaaattgtagacacacatatagcaaatcccaacttttatgcgtgttactagtgatttaaaactaagggtagaagaagataaattatgatggaaaaacttcagaatatattaaaactgaactaatttcaaaacttaaattttagctgcgatagttagtcaacaagaaggcaatgaaagttatgaaacttccttagtgataatacacaaatgcattccaggagtactcatgcaatatatagccactcagttgattcttaacactctgtataacatatatgttgttttttcaggaaaaaaaagtaaaaaaagaatttgaaacatatttaatcactaccaaaacctacaaccttacccacaaatgcacaatcaaactgtgcatataatctggtgaagggaggtgtaggtgccaacgaaggcgatgcatactccgatgactagtattccgacgatcgccgccacctcgaagcggccaactccaaatcgaggcatgtagatcttgaggtagctcaggcatgggaacaacacgacaatggtgaagttcagcgaagatacgttgaacggcatgaggtagctgaagaagggtaccgtgcacgccagcaccaccgtgctgacaacgacggctgtgctggtgagcaccctggtaagcccgttgtgctcgacgtccgctgccgccaccgttgtcgtcgacaatttctcctcattcactgttgtgatgggctagatcacgagcacgtacttcgctagcggggtgatcagcgtcgtcaagatggcgatcttggtgtacagcttccccgtgggtaagttcagtgtcaccttcacctgcacatcctcaccatagctcagatatcccaacactgttgtcactgtagagttgagactgcacatcaccgaagagattagcaaaacctgcacattaattggagaggaatagaacattattggagaggaatagaacattattggagtactgttccattatcatcatcgtcatggtttcataaaccaaattatgataactggaactgataatccaatgatcaattatcaattggttgccaaatctctctaagtgaaaggtaaaacttaaaatgcaacatcattgagctacatcatctgaagatatgtaccattgaatgcaacggttgatataatatccactgttagatcctggataagtatcagcaaaagaatggtaaaaggtccaagattgttcaagaaacttccatgagttaattgtgcaatagtcaatgccctaccacttttgcatcttatacctaacaattctcatagctgttggctgagtcaaaacttagtacaagaatatatacaacacaacacaatagatctatcttttaactcggcattaaaaattttatgatgcaacagatcttccaaatttagatacgctaccttttaatttatctaaaattgtattggactacgcattaaattacttaaaatttttttcataaactatgtattcaaatggctaatataattatttcattttaagtgctagacgcatcttccaactttaggttttagcatataaattaaaccgtattaggcggctcttgattagctttatctttaagctacattgcttttacctgggtggatgagaggtaaccaaatcccaacttgagaggcagccctaatcgctaccattcaccagtttattccgctggggtaataggctttaatatagcatagtacgcctccacgctagttaccagtttattccactggtgtgataggttgtattgtagcacagtacgcctccacatcaccgcacacgtcaaactagtcgaaaggctaacgcgacattaccctaaatttacatcattatgcaaaaaaatatattaatgctaaattgtgaatattgcacttgccattccatatatctgaaattaacattacaaaatttataagtagtacaacatcattttttagcgatagtacaacttattttaataaatgattttaatgttgatttcgtatgatcctaattcttattagacgaccaaaataaacttattagctcgaattttatctacatgatgtatatgtagacctgctatatgatgggagcgccaacaaagtatatgagagccatgcaatgctgagtatgatgagaacatagcagcgatgatgattaagaggtgtgcatgattagtgatgtacgagttctaaaaataattatgagtgtgcgcgtcttccatgcatacatgtaataaaaaagtaatttgtttgtattcttactaaacctggtgctaatttaataccaccattgacttttaaattttcattaaccataattctaaatttacattgttaattgttatcacaaattgtagcaaacttactatcaagtacaacacataaatacattttaaaagtgtataggaattatgagtgtgcgcgtcttccatgcatacatgtaacaaagaaacaatttgtttgtattcttgctaaacctgttgctaatttaataccaccattgacttttaaattttcattaaccataattctaaatttacattcttaattgttatcacaaattttagcaaacttactatcaagtacaacacataaatacattttaaaagtgtataggaaaatccttcttagacttcattgagcagtaaacggtcgggaagacgccatagccggcgaagcagacgaagtagaggctgagggcagtgggcaacccgctcagcgcaaccgacaaggccagcccgaccgccgagataggcaagcacgctgaggttcttgagccacgtcgtcgggaggatgacagtggccgccgcgagcacgaatagctgcttcccatgcacctggtaccctaggatctccaccaccgtgccggggaggagcttgtcgaggttgtcgcccaagaggatgacgaagctgatggcgacaagctagagctcgacgtacatgatgaggccgatggccgtcaggccatagccgctgaaggtgaggtggccgatgtccagtagctcagcgatcgacgcgcatgcagcggtccatgaggttgatggtgtagaagcatatagcttggtgaagagcgccaggctaagccacctgccctgcgagggtagatcagcgatcgacgcgcatgcagcggtccatgaggttgccggtgtagaagcagatggcttggtgaagccacctgccctgcgataccagcatggagagccacatgccctgagatagcgcgtacagcacggagagcatccttacgcttgagggagcatgttccttacgctggagggagcacgtgcgctgtacgcgatcgtccctagatcttcttgctcatgtttaccatagaagggagcctcgtcgatagggctcttatccgccgccataatctcatgttccagacggttgacgtttgaccgcacggaaaaaattgtttctctactagtgtactaacggcttctataattagtttttttctactagtgtacgaacggcttctataattagtttttttattagtgcccaaacaactcatgcaataccctatataatatccgatgtgacgtgccaaagctttatacccatggatctaaacaccccctatgaactgtaaatatgggatggatgtgctatttatttatagcctagctattatttgtaattttttccgacatgacgtgggtcagttcgaatggaacacgtcctttttgataaaaaagaaatctctctgcactcctcatacactacacaattgattttcgaaacgatttccacatcagccttctgttatgttacattactactaggttccatcaaaatttgaacaattttatatgttcttgtacagctctttcaaagagggccaattgatcttcatgatcactttagcttacgctgctttctactactcgactcccctggctgcacgttgcacctgtgcttagtgtaggggctctcctgatctccggtgggctcgaagtagagcttccggtgcagcctcgccgtggggctctcctcttcctcttcctgctcgcgtgggtcgtagtagaggtcgccgacgttgatgctccggtggcggcgctcctcgaactgcacgctcgccgccgcctccagcttcagtttggagaggttctccatggccgccatcctgatgccgtctatggagttcgccgtgttgcggttgcggtgcaggtgcttcgtctccaacttgtagtggagcttgtactcctggttcttgtagaacacgtcgaaaccatgcttgggtatgtcgttggggatctccttgccgatggccaccgccgtctgcatccatccacagaaattcatcacaacgcgggatcagcattgccatcaaatttggataaatttcgtaagaaacataaaaaaataaaattctaatatctcgagtggataactcatcgtgtagcttttacttccaaattcaatacatatggttgtaagaaattctgaaagaaattgaccgtgttgagtataatagcatctatcactctaaaaatcaagttgaaattcgacttaagctttgattaacaaatgataaattcgggtgcgaatagtattcatacaataaattagtcccttttttttatatctcaatgtgtgatttgattttgtacctaagttttttccttttggagtgggatatgtatatatgttgtatatatgaatattgctacgtttttttaataaaaaatcataaactaaactatttgaaagggttttaaacaaatgagggacgaggtatcaaaatagttaatttctcgtacaaacagttgagagtgagtttggcagaaattaaattgagtgagttttgtaaaatttagttacctcattgcaccagcaggaggcgacgtggttgatggtgtagccgccgccgccgaggaggaggagcggcaggttgaagctgcggatgaagctgacgcactgggcgtggccgcgcgtggtcaggttcagctcgccgagccggtcgccggcgagggagtcggcgccgcactgcagcacgacggcctccggctggaacacctccatcaccctcgccatgatcggctcgaacagccggtggtactcctcgtcgccgatgcccacgctcaccggcacgttcagcgcgcagtagcggccggggcccttcttgccgacgtcggcgacggcgccggagcccgggaagaagccgccgccgtgctggtggaacgacaccgtcatcacccggttcgacgcctcgaaggcggcctggacgccgtcgccgtggtggacgtcgatgtccacgtagagcacgcggcggaagtgggcgagcagc

SEQ ID NO: 66277 - DNA, 19517 bp, Oryza sativa
tagtagtagcacacccgccgcttcttgtcgtcgccgcacgacggcgaaggcagcgaattgccgccgccgccggccatggccatgtttaacctagctacaccggcgagatgcagacgtcacggtggcgcatgcaccggacgtacacacgcacatatataggctaaacatatgtaaggctgatcgaagcccagttcgtgccggagttggattgttaattgacttttaaattattaattaatccgaaaacaacttccaaattaacttccaactacctgatcggaagtttggaacggaactcgtatatatatcctcttaactttcttcccgtgcaacggcgtctcctccccgcacgcgcgcttcctaaccctacctttcctttttttttcttttaaccttcttccatatatagatctaatcctctctcgctattttcttttaaccttcttccataaccccggccggtgagagctctcgtccacagctcgtcacatcatcgttgtcacgcgcgtctccaccggtatatctcctccgggcgtgcggcagcggtgtaggcggtgcgcacgccgcggccgacatcgatctacaaattggtgggagaggtgagaaattagctacgttcctataatttcttctcttttttcccaatttttgttattaggctagttaccctgcatgttctgctatatctttctatacatgcttccttcgtaatttccttgcttggatgggactagaaaatcgatgcgcccgttggcgcgctcaatatttatagcctattatattattatttaatgggttttaaaatttaggtttaaaactagaatagtgcccgtgcgttgcaacggataaaaaaatacaataataaatggatgacaacgatttaattatatcttcaggatattatctaaataacattatatatttttttatgaaaccttatatgtttgatattgtgcattagagtggccatgatggtaaataacattccaggaaaatatatttgttaaaccagccgtatcatttagagttttatagaattgaaagaaaaataagtactcccttcatcaaaaaaaaactcaacctagaagtggatgtgacccctcctagattgatgtatgttgttctaggaggtttttgttagacggaggaagtatttgttgaatcgtcatggccagttcattagttatactaggtaaaaccccgtgcgttgctgcgggagttcagtataataacaataagtaaaaataatgtgtaaaatagctaaacaatataaacttacataagttgatatggtttatgataatttaaatttaaatagatatatataataatgattcaaatgtaaaagtaagatgatgtggctttatgagagaagaaagggagtgagatactttggaccgtagattaatcgtgtaaggcaaaaaaaacaattgatatgatatgatttaatgggagaagagaaaaataatactaactaagtgaggatgaatcatataggtatatacgatattataaaaaatgatgaagatatatattgaaatattatgtgaattatgtgggatgatgatttaacatgcttacattttaaaactctaaaatgtaataaattataaaattatagataatataacatgtttgcatgatgtttaaatgcaataattgttagtggatgatgatgtggcatctttgcatgttgagctttgggatctagtgggttataactttataataagaaaagattatatataaccctatttttgctcatattacaaccctgataattgatagcaaaatttctgaaataattttgatgccaaattttgtgaatttaattttgaaataatttgattgatagcaaaataattatgtctgaatttaaatatgcatcaatgcaaaataatgttgtatgagcaaacaatacaaaatgatgtgtgagcaaatgtttgcccagagataagattgccttttcatacaacttaacggagaggagttaacaatagtttggctgtgatggaatttctgggagaaatatgcttgtacgatggcattttcaggaagttgtgtttgtcgatggcatttctgggattagggtgtttgttaatggtatttcatggattttctcttgattatatggatgagtatatgttaaatattataaaaataatgaatatatatgtgtgttaaaaatattgtgaataataatgtgaaggaagatgattggatgttgtttcgtagaattaaatgaattgtagatgatgttgcatgcttgcataagttttctatttaattattgctagtgaatgatgaggtggtatatttgcatgttgagttttagaattagtgggggttataattttatagtaagataggattagcttctccctaagacactctcgctgtcaattttgtcctcattcacctaatcgctcttcttcttcaggtagaagctaatttctgctattactacttgattattgatacaattaggccgtcacaaaatcacattggttagggtgggtttacttcgtgaaaagaaaaattttaggtatcagatcggacgtttgaccggacgtcggaaagggattttcggatacgaatgaaaaaactaatttcatcactcggctagaaattgcgaaacgagtttattaagcctaattaatctgtcattagcacatgtggttattgtagcactatggctaatcatagactaattaggctcaaaagattcatctcgcgatttccatacaaactgtacaattaatttttttaatctatatttaattttctatgtatgtgtctaaagattcgatgtgatgttttttaagaaaaagttttgagaactaaacaaggcctaacgaggccttgttacaaattatgtaatactctgatcaaattaattaggcgtacatcgacgtgtgccgcctgcggccggcatgcgcgcgggagttcacgttctacaagggcgccataaaccaaggctgcatgcatgccgtcaacgtgcatcgttggctaccacgagggcttcggctgcgacagtactgtgcatgcttaatcaatcgcgttggcccgtgtggaaagtaaaatagaaatggaaagcgtgagtggaacgcgggcgaatttttttgcgcgggcatatgcctgctgttcggacgacggaagaaaaaaaaaatccaaatcctattgccccgtggatcggcggattagataattacggagtaaaccgatgacgtccaacatttgttaacaaaaatatcttcaatttttataatagtagcgaaatacacgatgaacaaaataataacatatgtgttgctttataatacaagcatattatttatggtccttttcaagtaaaaatatacataagattttacatgaataaattcaattcttgttaggatgtgctacctgtctaccggctgaaaaatttcttgctttcagccgcttattttagcgctggataaatgtatcggacgatccaacgatttcctgcggcgctatcagcctatcacacattccgtcagaatttaaaagttgtcctttttgcaaaatagccatcaattttgtgagaattttagatacacccttcttaggcctaagctgttacaactttttcgcataactacctatagtttttttttataataaaaccaatgaaggaaaacttcctttctccttcgcatataatacttaagtagttttgtatacaagattttaaaaatactgttttgtatacaatctttgtgtgcaaagtactcggtatgctagttttttttgctaatttttgccatatgtgttcattcacttttctaacatgtatatagactggtcaggatcacgtctttactaccgattcaccattctctgtttgttttgttacgaccttcacgaaagtgaaacgagacgagaattgtaggcttctttcctaaactaaaagcggtggttcttgcctccctgtgcctaaagcgcggtgggcgactgcggtttgagtctttatcgatcgggtagatccatatgttcttgggggagacgaggtgtagcgcagtctggtcagcgcatctgttttgggatagtcatctcattgatatttttagtacaacatctaatctagcttaatcaacgtgcgtctagcttaatcaacgtgcgtctactttagttatctcattatttttttgtcaccttttgtattaatttactaataaatgtttcttgtttgtttgtaattttgttagcaaatttttaggtgtaatgagtagttgtctagtatctctcttatttctattttgtttcactaaatgtaagttgcactttatttttaactataaggttatcattaataatgaattctatgttatgatacgtatgataagttatacacgctattttcatatgtgtatcatgtaagtattaaaaatctatcaggtgattttggtttaacaggtgcacacacagacacggggattatggcggcggataagagtcctatcgatgaggctcttctccataggcaagaagatctacgagatgaggtggattacgacatggagcatctcctcctccctaccggcagcaacatggagcagcatctcctcctccctaccggcagcaacatggagcagcatctcctcctccctaccggcggcggctcattttgtatgaccggcgcttcctttgggaggagctgcctaaaccttagcaacatcatatccggcatcgggatgctctctgtgccgtacgcgctatcccagggcgggtggctcagcttgacactcttcaccatggtcggcgccatctgcttctacactggcaacctaattgaccggtgcatgcgcgtcgaccgctgtgtacggagctacccagacatcggctacctcgccttcggcagctacggccggatggccatcggcctcgtcatatacgtcgagctctacctcgtcgccatcagcttcctcatcctcgagggcgacaacctcgacaagctcctccctggcatagtggtggagatcctagggtaccaggttcacgggaagcaactgttcgtgctcgcggcggccgccgtcatccttccgacaacgtggctcaagaacctcagcatgcttgcgtacgtctcggcggttgggctcgtctcgtcggtggcgctgacggcatcgctggtctgggccggcgtggccggcaagggcttccacatggagggcagcagcctcttgaatctgagcgagctgcccaccgcccttagcctctatttcgtctgcttcgctggacatggcgttttcccgactgtgtactcctcaatgaactctaagaaggattttcctaaggtacactttttaaaatgtatttatgtgttttactttatagtgaatttgctaaaatttatgataacaattaacaatgtaaatttagaattatggttaatgaaaattgaatagtcaatggtggaattaaattagcaacaggttcagtaagaatataaacatattgttttttattacatgtatgcatagaagatgcgcacactcataattagtttttagaactcgtacatcactaatcatgcacactatactcgcacatctcttaatcatcatcgctgctacattctcatcatactcatcattgcatgcttctcatatattttgttggcgttggcgctccattcatacattaggtctatatacatcatgcaaataaaatttaagctaataagtttattttgaccatccaattaaaagtaagaattaggatcagacgaaatcaacattaaaatgatttattgaaataagttgtaccatccctaaaaaaatgttgtactagttatcaatttcgtaatgttaatttacactgataaggaatggcgagtgcaatataaaattaatggcaagtgcaatatacacaatttagtattgatatacttttttttgtataatgacataaattaagggtactgttgggatagcctttcgaccagtttaacgtgtgaagtgacgtggaggtgtactgtgctacaaaacagcctatcactccagtggaataaataggttcctggaggcgattagggtcgcctctcaactatatttggttacctctcatccacccatgtaaaagcaatgtagcttaaatataaagctaatcatgagccgcctaatatgatttaatttatatgttaaacctaaagatagaagatgtgtctagcacttaaaatgaaagaattatattagtcatttgaatacaaagtttacgaaatttgtttttaactaattttatgtgtagtccaatacaattttggataaattaaaatgcagcgtatctaaatttggaagatgtgttgcatcataaacttttctttgccaagttaaaatagagatatattgtattgtatatattcttgtactaagtttagaccaaccaataggtatgagaattgttagggataagatgcaaaagtggtaggacattgactattgctccattaactcatggaagtttcttgaacaatcttcgacctttcaccattcgtttactgatatttatccatgaatattgacaaatattgtatcaaccgttgcattcaatggtccttattttcatatgatatagctcaataatgttgcattttaagttttacctttcaattagagagatttggcaaccaatgataattgattacgaattatcagttccaattatcataatttggtttatgaaaccatgatggtgatgataatggatcagtactccaataatgttctattcctctccaattaatgtgcaggttttgctgatctctttggtgctgtgcagtctcaactacgcagtgacagcggtgttgggatatctgatctatggtgaggatgtgcaggcgcaagtgacactgagcttacccacggggaagctgtacactaggatcgccatcctgacgacactaatcaccccgctagcgaagtacgcgctcgtgatccagccagtcacaatagcgatagaggagaagctgtcagcgacgacggacgccgagatcaacaggctgactagggtgctcaccagcacagccgtcgttatcagcacggtggtgctggcatgcacggtgcccttcttcggctacctcatatcattcatcgggtcctcgctgaacgtcaccgttgctgtgttgttcccgtgcttgagctacctcaagatctacatgtcccgaggaggagttggctgcttcgagatggcggcgatcatcgggatactggtcatcggagtgtgtgtcgccattgttggcacctacacctcccttcagcagattataggcacattttgatcgtgcatttgtggttatggtggtaggttttggtagtaattatataggtttcaaattcttttttattttttttctgaaaaaaaacatacattatacacagtgttaagaatcaactgagcgccttgtttgtatcataatttggcttttagttagtccatttatgcaagccaaattatttagaaaagtgttgagtggtttgctcgagagtcagttaaataaatatatatgtgcagagaagagaagtatcggttatttgcaagttactagcaaagaactatagcatgcagttcggtatatttctgtatctgatcagattttgggctaagtgctgtaaaaggtgcagatggtacagctgatgagattatcgtgttctttgatggttttggatggacaacatcaaggaggcacagtgaatagcttgacaacatgaagacatgatatggattcttgtatttttcattgctgtcaaagccttatggtgttaatctagaaaaaagcataagcaggagccaggtctgtgctggtgttaagggaggtgaccgagatgaatttggattgtatctcgtctatacatactgattggtcacgtgaagtgagatttggtgttggtttgcatgtgctgaggacgattagcgcatgcagtggccagccagctgaggattgagatatatttttatcactttgtttccttctaagatcagagaatagcattatacgcatacatatccatggtactactttatgtgccatatcctgctatggatattaagcactattattagtacaatatatgggctgttgcacttgccctttggctctgtttgtgcatgtcttgttttttattcctctatgatacaagagattctctttttattgggtgttttattttttaagtggtttatttatacttcatgaagggttaaattgaaccatattatctaaaaaaatcctcactagagcattaatcattggaataatcaataaattacttgagccacaattgatggataaaatattcttaaccactacttcttgctattgcccaaaatttgatattggcaaagaacaaaacagatcctacatctgtgaactgagcaaccggggtggcatcactagcacgttgcgcacgtacttacacttgcacagttttatcttccacaacaagagtgaatagccaatgcggtctcttaattttttttatgttagtttaatccctgattttatattgtccaaactccaaataaacctcttaatttatcatgtgacttgatatagtctctaatccaccgaaaccgttatacagacatgccacgtcatcctagcatacatagttaaaatcaaaatattcattctaccttgtatataccatagaaaataagaaagaagaaaggaaacgacaaaacataatgattatcatatctttgtgtctttatttactacatttttatttgtcctttttctctcctttcctctttatttctctttttcttaaaaaaaatggcataggtgaggataaaatcaaagttggatggaagtaagtcaatggatctcaatccgaggaaggcacataatctcattttgttataacgtcacacaaatataactttggataaaagcatatctaacaccctaacctaaacgcttcaacttactacataatattgttcatataacttctaaggttgttttgaacatgctgatttccgtatacagatactaaataaggttttggttaacaaagatgacaaatttcaggactaatcctcgattattgtgattgtatcgatcctcagttattggtgtaaaaaagagtgcatgggagaatttgacatatatcttgaatatatctactcctcagtccgaagataacttcatttctaacatgaacagtttattctaaaataagttcatttctagcctattataaattgtatttcttttataccttttattctaaaacactcgtaatactatttctttatgaaaaataagttcacttttatcctgttataagttttattccttcaatacctttatctatctacctactcatcaatactattttaaggattattccttcaatgtcctttatctatctatccattcatcagaatggaatgctattttttttttcttttgataaggagactttggtcttttctctcaaccttagtttgaagtttgaacaccaaagactaaaaatagagttatttttgaatagcgggagtgtggcgtcactaaaatcatctattgtacatgtaaaattagataaaaccgaataaaataattagataaaaagcactttagcggttatacgaacagtattatgaagttgatagagttggttatccgacttcaaagtatgaggtgttagatggacttttactgagggtatattgacttctccctatatagtaatttagtaacaccaagcaaactacattaagagaccatggagcaacagcatcactcttgttctacacactttcactgcagcaacaccacaaattaaacctgaatacatcagagttgctactgctccctaattcagtctgttattttggtgttcgcgttacagaaaaaggctcaacttgtgtccacagaacctgcacctttctcctcaagcttatccatggctgatgccaaatagttgtcacagtaaccaggtggctcatagataaagcaagagatcacgtctcgcagtgtcacgacaccaacaacctcgaagtcaccgtccacgacgtatatccggtgggttattcttgatgcaatgctgtcaatcacgctgccaagagaagcgtcaggcgaacaggtgagaggtggcttcaccaggccgttccctgaatcagaaacggtggaacctatggtcttcatgaactccatgacagtaagttgcctgtatggaagatttatcattaggaacatggaaatgcaaaattttgaaaatgactcacgcggtaacaaatagccggatggtttgatacctgaaattcgaaaacaagtcaggcctaagtaacaaaaagcgaatatcccttatgctcacactgccaacaagttttttgttgggaccttctactacaggcacaccaccaattttgttgtccttcatgcacttaaaagcttccaagattagatcaccactgttaacagtgataacctgaagaaagcacaaaattgttcaactaccagtttattgcaaagtgaagagaaaaaaaattacattgtagcatgtttcagcttgagatataacttttatcttgataatgtaggcagacatgatttctcattagtaaagaattggattagggagacacaattacctcatcaagtgacataaatggaagtcccaagtccgagagagggagcgctgaaatataatcaaaccaatcccttcctttgcactgctgaagtcctttaacaacaccagtctgagtaatgaagttcttaataattggcttatcaggctcaatcactgggacattccttaacctgtacttggatagcaacagtaatacagtaagcattgaagtgtccagtgtaatggggacaaaaggagaccagcggtaggattctacaattgatcgaacctataataatgagaaaaaaatatgaaggttagcaggatttacatcagaagatcatcatgcaatattcaaatgaggcaaagaggacagatatccaaactattattagcaacaataagttgcagctaagaaatcacaggaagttttcaatcacgccaagctgcggcatatattgtaactaggatagccaaacttcggtgtagccacacagcagaacagtggttcaaggtaaaatatataccaaataatttgagactgactggactctataaatgatcgacatttaacaaaaaggaaaaaaaaatccaaatatgcataataattcatcatagagtaaaatgcatactgtagttgatttgaaaggttcttgctgaagcagaactttgtagaaatcttctcctaaatgatcagcagcagttagtccatcctttgccacacccttttctgctgttaacccaccagcaacagcagcccctactgcagcggcagtcaagccagcaacagctgcaggaccagttgcacccaatgctgccactcccactgcaccgacagcacccattccaactcctgctgcggttgctgacccagctgatagagcaacggcggcaatctcagcattttctagaacccagaggatgatagccgagtaatcaatgatgccaaggtacctccctttccaatcagccggagctccacattccggatttagcactggcgctgccctaatgttgtgtttggagagaattctcacagcgtcaagaacggaagtgtctcctggaatttcaatcactgcaatgcaatgtgagggatcaaaaaaatacatggcgcggacaactagttagttaattttgtcttgcagacgtgtgtacctcggccattaggaacatcaggaaaagacgagacaggaatctgagcaaaggcagcagtgagcgattcttgcaaagagaggggcagcttcttcttggactgtatagtgtcaaaatacgcatcacagcttgggaatttcacggtttcatcaggtcgatccatttctacacaaaaaacaaaaaaaacaaaactcactcaaacattaatcccagtagatggcagcaatctggacacgcatctaatctaatcatggcacagtagatactcataactaacccaatcacgacaagccactttggcatatattagcaaagttcatcacaagttcaacggaggtacactattaatctactcctgtcaactaatcaggggctaacactcccaatccaatcctaacaaactgctactcttactctggttaggtccaattcaagaaaattgcttgcggatctggaagagaagctaaggctaacgaaatccgagaagaaaaaagaaaagggggttaggcgtagtgggtagtaaagaccgcaaagagagatgaggaagaggatgagcgtgagtacggatgcttcaccgggcgaagtggcggaagcagctgggacttccgccggcgtcggttgctcgcgggaggggaaggggatcgatcggggcgctgctccgctcggcggcggcggcgcgaaccgcggcgattgctggaaaccgtgggcggcggcggcaatccaggaggaggaggaggagggagatggattcgattgctagctagtactagtactacggtgcctcgcggccatgggggcgcggtgccacgtatgcgcttgggtggggccacgtcgcgcgaggggtggcgttttcgttattatattatattatattactatctccgttttttaatagatgacgccgttaactttttattacacgtttgaccattcgtcttattcaaaaaatttacgtaattataatttattttgttgtgagttgttttatcactcaaagtattttaagcatgatttatatctatacatttacataaaattttttgaataagatgatgatcaaacgtacatttaaaaatcaaaggcgtcatctattaaaaaacagagagagtatataattttattcttttttactaggccgcctacataatatggcccacggttgaaatagtccgccacatataccaggacacatataaaagtggaatatatttattggagttcccttaactttacaccaaatctgattttcatccttaaaccaaaaactagatatcatcggtccctgaacggtcaaaactggtacaaacgaggtccctcggcggttttggctgacgtggctggtttgacttgatcttcgtctcatgtggcatttgacgtggcgcttacgtggcaattttatcccaaaaaataataaaagccaggccccacatgttagctacacacaaaaaataattaaaaatagtggggcccccacgggtcccacatgtcagcctcacctcccttcttccctctctcttctttctcatcctcactccttttcttctctctccctctcttctttcctctcccctctcttcatcttctcttcccgcgggcgagccaggcaggcagcgggcggcgacctcggcgagacggtgccctcggcgaccttggcgaggtgacgacctcgcgtgccactattgcactccacctccaagccaccgccttcctctcccctcctccccccgccctcgccgccaccgatcccgggggttcaagggtaaacgtgtgagaaatgaacgagtaaacgtgtttttatgcgggtagtgagataggccacttacatcactacataaaagtaggtcaaccgctttgcagtgtaaaatacatcagagcttcagaaaaaaaatgatgaaaggctaaagtttgcaaatttaacttaacaaatttaaccaattcaacataatttgtttaacctagttacaaataataaattgaatttacataagaagttgagccaatctgctcatctggattcgagtctaagacttaaaaaaacaaacaaacaaatggaatgtcgttattcttgtatgtcaatgtcagcaattggaatttggatcaaaactaaggactggtatgatttgtgacctaaattggtcttaccaatttttaaaatgccaaattttggtaagttttgacatgactaattttgggaaggtaaagttgtgtttggattaaaggtaaaatagtctaagttaactattgaaatgacatattttcttaggcatgccaaaatttggtttcaaaccaaatagacactaaacactattgaaattgtcaaatattggtaagccaaatttaacccacgaaccaaaccagccctaaaaatttttttgttgtttaccacctgtgcattagtggtagataatttgtatatttatggatgctagtacagggtgtttgtcactcgtcagcatggaggagccaagttgaagagctctccggcacccttcccaccggcaacgcgcgcgctctgctcacggtcacggacgtagctcgcgacggcggccgccaccgtcgcctggaacttggggtcccagatcgccttcgccacgacatctgcctgaatagggtagtttctctggctccatgacgactgcgccgccggcatcgcgcgctgaagctccgaccacgtcgaagacgacgaggaggaggcgagcatggctaccgccgccgatgaggaggacgacgacgacggagggagcgcggcggcgtagggcgtgatggggtggttgtggacgccatcgtaggtggtgacgaggacggaggtgtcgtggttgcagcgctgcacctgcttcttcacggggcaccccggcgcgccggtgcaccggtagtagccccgcggccacgggttgcccttcgccgtcttctgcccgtacttgcgccattgacaaccgtccttcacctgtgagataaaattcaaaaataaatcagctcatctataccattgtactccctccttctctaaatgtctgacgccgttgacttttttaaacatatttgaccgttcgtcttattcaaaaacttttatgaaatgtgtaaaactatatgtatacataaaaatatatttaagaataaatcaaatgataggaaaaaaataataattacttaaaatttttgaataagacgaacggtcaaacatttttaaaaaagtcaacggcgtcaaacattttgggatggagggagtatttgcataattttttttacataaggctgtatattatgtctcaagttaatggtgacgtatgtatttctttttttaaaaaaaagagggaatatacaataatgaagcgtgcatatatgtctcaacttatacaatacttctttcattttatattataagtcgtttgatttttttcttagtcaaagttctttaagtttgactaagtttatagaaaaatatattaacattttcaatacaaaataagaatatcatcaaaatatatgcaatgttaaatttaatgaaactaacttggtgttgtaaattttactaattttctctataaatttaatttgttcaaacagaaaaactttgactgagaaaacttataatatgaaatatattaattggtcactatctatatgcgtgtgctacgtgcgtaccgtgggtgcgctgcatcgtgttctgagtacgacccggccaggccgattcgccgtcgacgcagccgtgatcatgcaagaccggtcgtcgtcgtcgtggcccgccggcacggcggcggcggcggcgccgcccccgtattcgccgcagatgctgctgctactgctgctgttggtggtggccctctgcctcttgggatgcaccattggctcgccggcggcgggggcgcaacgcagcgcgagggcgaggtacccgtcgccgccgccgttgccggcgtccgcttcgtctttcttgctggcgtggcactggcacgcatcaggagacgatccgaggctaagcccaagtgacaggaataacccggcctcgtcgtcgttcgcgtgatgccgatgaacctacagcaaaatcagcaatcgattaacctccagagatgtttaaagctactaaacagcatgtaactgtaataggttgacataattatcatcatatcatgcatgcatatgggcgttctctcggtcttaaatccaccaaatcaatgtaagtatgtaactgatgcttttcagaatagtttgttcattagtttctggtatatattgattacagagatctttgtcaaggtaacattcaaacattcatgcatgctaccaattaaatgtaaaatacacatgtaagagcataaacaaaatttcacaaaaagatgttcttctaataattattggtcaaattaatctgaaactatagggggcatatcctgtgaaaatatggcgaacagtaatagctcattatcttttatccttcaaaactcgttgttggagtttgatcttcagacaatacatagacagtaaaagtgtacgatatatgcctttccggcaacatgttgaaaatggaatttgcacaagaagtgcagaggtgtgtcacagagtcactggacatgttaatctccctagtagcaaccgatttgcagtaaaacatgtagtcccaacaaaagaattatatcatcttaatttctgaagctctgaagcatagaaaaaatcatctctgaatcaatgaaataattactgcatatatataccttctctgaagctttctgcacctcatccctgaaaagtgtaaaagtgttcatctcgatcaatctctgaattcagacagaatccaaaaccctttctttctcccactccctagtttttgctcctttctgcaataagccaataactaagcatatccctgcagcgagttctatctgaatatatagagggagcagcacctgaaaatgtcaaaagctgaccaaaatatccaacgaactgccgaattcaatctctgacagagccgccaagatgccgagggcaagcaacacatgcgtcaaaaacgagaataaactcggttgaatttcgtttagaattcgagacgtgaccgctttggtcatttcaatttgacggtttctcgctttgccgcacatccactcccacgccggaaagatgtaaattcgatctaatcctcgtgaattccatgtgcacgtgcgtgtccggccgtggtctcgtcaaaattcggtcagaattctgaactaaattaaactggttggtcgggtgttttttcttagccacaagctgggaggattatccctcgtgatggctacttgttaacgataaatcccgtgtgattattttgtagttttatcttttatatgctggtttggttagaaaaggagacaaatttgagacatttcgaagaagagtattcgctgtaccgtgttcaaagggaggaagtaggtttgagaataattctcggattgttgtgacatcagtcagctgcacgcgtaattaagggcttttgtttagaggctttcacgttatcaactcatcatcgtctgacataaagacggcatagaaaactcttcggaaggcacgagacagacggaacagcatagaaagagttttctactagtatgaattaattcagattgactaggcccatatacaaatacaaaggattattagttcgacaagactattgagtcttgtttttttcgcaccatggttatctccattgagagaagacaggttgtttttttttctttttctatatatcctctatatcatgagaggcatgtcgtggtgctaataaagataatatatactctttacatataagtcgttttgattttttagtcaatattgtttaagtttgactaaatttataaaaaaaatagtaacatctaaaataccaaattagttttattgaatatattttgataatatgtttattttgtgttgaaaatattactatatttttttctataaacttgatcaaacttaaagcgttttttctttttgcggggaaacttaaaagaagtttgactagaaaaaagtcaaaacaatttataatataaaatggagggaatatctatctatctatctatctatctatctgtgtgtatatctatcaatttagcaatcttctatactaactgggtactttgatggacctcctatgttaaagaaaaatatagatgttgattagatcgagtgcacaattatgttgtaccgcagattgtatttagaatgtgtcaatttaaacataaaactattgtggactcttcaaatttacttaacatattagataaaaccagactttctatctattacaaaataataattattaattatgtaattattataacatataaaagactaattatatatcatataaagtctaaacgtagtacaactttatttaataagagcggattgtatttttgggctccattttataaattttactttggaccaccatttagctaatattttcaattgaataaattgtgctttgagttattttttattatcaaagtatcacttttagatcaccctttatcttatccttttactttggactaaataattgtctttgttgcaatttaaaccacccccaaaccttctttttttttcaagtataccactgcaggggaagtccctacagcatcaccccagaccattttcttcagtacataaaaaaccttgagcacattgactacaactcaccgataaactccctcatccatacgcaagatatatctttgttggaggagcggttagtcatagctggagaaaatacttggggttgatccaaagtgcaaaaaaaaaagagtaaagttaactagtcctaagtgaaaaagaaaaatatagtcaaaaggtagtctaaagtgaaaccttgataataaaaggttagcctaaagcacaattcactcttccacttaacttggttattttgcttatgttgcactttggaacatcccaactctctgctcgagcacatcaattacttcatgcacatcggtgcccacacattagggatcttccccacttgcgtgtatgccaccctttgttggaggagaggctaatgtggctaaaaaagagagttataatggtctacaacaaatgcaaatttgcgtagtccaaagtgaaaaaattaaataaaatatggtccaaagtgaaacttagataataaaacatgacgtagattgcaattcattcaaaaataaataaatttgctatgaacatgacctaagttatgaagcatactaaatttaaactttaacacaaatacaattaaacactaattaattcaaaaatatttaaataaaacataaaacaatagaagatacattaggttggatttcgaattcagtattttattcaattctaaaaatttaaaattaataattagcaagtaataattgatgtgaactattattttaatctaatcatctataatttgaaaattttaattattgtattcgacatatgattaaattttaatattgatattactaacactaatatataactcatgcagcacattagttgacaatcacttattgtataggcctattgtatataccctaagaaagacacataagagcatgtgtagtgcggaacaccaacccgtctccccagaacctgccgtcctatcgccgtgagtttttccttaggagggagagatataaagttcttttttctatttctatggccattatttggtccaacattatagtgttgaagcttgtttcattttgccaatctataatgttcaatttttcataaaagcaaccatccagttatttctcaagctaacat

SEQ ID NO: 66278 - DNA, 1373 bp, Oryza sativa
tacatttaactagcaagaagtcacagtattcaactacattctaaatgcatggtccacttacatcagtattggttcaagtgacaatctcgccttcatatttattctttttagaagtccggagaatattttttcacagtgcaacacgatttgaggcaatgtttgtaccaaatgtattgtctcttcataaaaggagatgaagtcatctgcagtattgagctcctgaaccagtggaaaagaacaatattagaagagctgatagactgaatgcacatcactgaagacttatacaatttaaatgaactaaacttggatccctttccaaacgttaaaaactaattttagaacactacaaatatcgcacagagagaccaaatggtgtgcagctaactatcatcttcagttcatcattcaaacttctacttatctctggtcaccatcatccaaataacatccatttttttctccaccgctaaatgctccccaaaagatcccaacaaacttataaaccaccaatcttaaaaggtagttgaaatagctcctcaacccccaccaaaagggatgtaaagcatttatttctgacacaaagtcagcatcaaatcaaaacagggaaaatgtaaaaaaattgtacgtccaaatatctagcttgctagctaagagatcaaaacattatcccatggaaaatggtgcctgaatattcatgattgaacaatatattagaacccttattctaatagctaaataaacctatttttgtttcagtggagtcaagtgtataattctaattctaacatataatagcagttggacgttttcaaacaccacaagatcacaaactgacaaacatcatgttcacagtttgccaatgccaaaaggacaaaactactcatgacacattataatcccatatacgctgcaaaatttgaatcacatataacaagaaaattccaatcattagaagaaaaataaggcactgaactccgacatgatcacaaccatccatttattctttcaatgttcacagttgttattgcagcaattccaattgctccatttcctaacagaagtcaaagccattaaccaacttatccaacgtgtttccttaatctcacaactgacaatgtaagagcttcaccagagcgaatgattaaagtgaaagtccctgaaaaatacatgtctatatctgcacctaatgaccaagttcaacccatagagttccagtaacttatgcacatacagaactcatggccactctgaggacttgttcggattaaagggtttacaccagattttgtaggactccatgattcttttggatttgctactattcacattcggattgtaggaatcacacaaaggaattttggagttctgta

SEQ ID NO: 66279 - DNA, 26227 bp, Oryza sativa
tttagcaagagcttcaacctcttgctaactttcctttgagtctatctctctcatccaattcttgtgtttttcctgtggttcaatcaaacggtcattcctgtgtttttcctgcgttttgttatcctctgttttacacttacattcctatcaaaatcctacgtttttcctattcctacgttttctcaatcctgcgattcaaaggggcctaaagctttaaatgatataatcccctagataactgaaaagttttaggcctatgagcaagcacataaatacaagcatcactaagaccaaaattgtctcctcatctagttcttcagatgcatgcaccaaatatgtacaagcatgcctaggacggaaacatcctaaattatcccctcatccgcaatttttcgtgtacacactaaatcaccacaagtataacttagatgtaaacattttagttcctatacatctgtagattaaggctatgctattggtacttcaggaacaatactgataacataatctcccaggctcttcctttgaacaattttaattttacagcaatatccttaatttccatatatgtcaacaaacagtatgtggcttatttcggtaacaaaagaaatggggaatggtttgttattgttcaatacaacaaaattctaaacaataccataatattcatgtgtatccatcatagttcatgacaccactcactacttaagacacctaattgagacagttttaagctttccttagtgatctaagcaccacatttagcatctccgctgctctgagtgtgcgagtgttaaccaggaacaattgaagaacggaagcaagagagggatgaagtggtgataccctccactccacgagggcgtcgaggaagaacgaggagccgctcgatggctccgccttcacctcgtgaaggctgcggtacacgtcgatgtcgatctcctccacccgctgcgagaaggacttgaactgcacgagcacacgcacgcaacggacgcacgaaaccacatcagcagccgccaaacgcgcccacgagctcgattccgtggggaggcgggggcgagagagagattgctggaagcgcggggaggggcggatgctcttaccacgaagcgcttgcggctggaggacgacgtgttgaggcacttgaccgccgcgtacgacggggtcgccatggccgcgtccgccgccggcgccgccgccgccggagaggtggggtggaagacggtgggctacgagggggatggggggaagaggggcggcgcggagcatgcggtgcggggacggcggggtttaagcgaggagtagtgggttgtctagttgtctagggttttgaggcggtggcagttggggggagttggggaggaggacgacgacgagatggcctttagcagttacgcgggctcgaagactgggcttcgtgaatgggctcctggcccactacgcttagcttcagtttcaagatatttccattttaggacaaaaaaatcaaaaaacttgtgctaattctgaaagggttcataaatatttaggtttggtatcaaaattgaaccaatgtgaggagaatatataggtattttcaattcttttttgggtagtgagaggttttaatatttggtttattatcttaccaaaaatttatgataccgaaatttggtggtgtagcaacccatgttagccctaaaattcaaggtaagagcatcaccaacagcatctaatatgcttcccttgagctcttctgctcttggtgtaatgctctaagaacaccacatgcattcgacttatatgtaattgacgttttggcatgtaattctcgtgtctcaactagctccgaagtcttaggctgcgttcgttcctccgttgttcccaactcactctccatcattttccacgtacgcttcccaaacttttaaacggtgtgtttttttgcaaaatttttctataggaaaaatgctttaaaaaatcatattaatctattttttcaaaaaaagctaatatttaattaattatgcgctaatgagttgctcccttttgcgtgcactgtagtagttcccaacatctagtatcgaacacagccttagtcctttaagtttcctttagtcggctcttcgctctagttttatttcttgtacccttgtaatggcttccggccattgctttgagtaattgaaattttgttttcttttaatatgttgacgtgcaatctttttcgcgttcgtgaaaaaaaaacgttttggcatgccttttttaagtgtaactaattgaccagatatcgcagtttgtaatgcaaatcaagtctatggcatgaccaaaaatcctactcatgaaactgaaaattggaagctctaggaaaaacttacatccctacctattcagcagctgctgactaacacaaactacaatatcgactagtataaatgtataatcgatgaacataagcacacagtgaactgattagaaacagggcattccgcattcagcctttcactcagttaggaataagatgcctaataataaaatggaaaaccgcttccaatcttccatggtaatattatcttaagaaaatcttccatggtaattaatctactctgtatttcatcatgaaaaaaaaaatgatctactatgtgcttgcactagccggttgtgctatgctcatcagaagaagccacaacacattttttagacaaagatatgcgctgaagcaatcagtgtaatctgaaaaccagcttttttttagcagccaccatcatataatcaacgatttcatagtttcatatgagaaatcaacatcattcaggtctgatttattgactaagactaattactaagcagataaaatgattgcttgatctggttctgacaaaatgccggagagcgaacttgtgggctagctgtggcagcaccgctgcatcagcaatcagcatgaattgctagaaaaataaattccactggcaattccagcaaaaacactaatgcgctggtttagggaatacgcaaaagatttgtgcattcttgtattaactattaagtaaaatccaatatttttagttctaggatctcatttgacaaggtaacaaaaagagtgagaaaaatccttcatggcttgtgctaaacattaacatgaacagaaaaccagagacttcatggaaaaaccgcagctgcagaatacctgcaaaaaacagatgtcttgatcgcaaggaaaatttcagctgcaaaatacctgcaagaacacatgtcttgcttgcaaaatgaaaggaagaagaggacaccttcggccactacggtacatcatcacattttcccttgacatatcatcatcgcattgaagctaaaccgacctgaaatcctgaacaaatgagaattgaaaaacggtgaaccaaacgacacagcagttatggggcaacaatcagtaaagcaaaatttccccgagatcctttgttgcaggcttgcagcctcgcaggacctgaactgaagcctcgaaaccatcaactgaggcacatacgcacgtatcattcattctcctgcaatcctactagtgttatcaaacaatttgatcatctcataacagcaattcaaccatactcatgatgaaaatgaagcgtatgcaagtatcatcataagctgaagagtaaccgggccggagagcgcatggtcaggtcaggggaaccaccaagtggggggagcgttgtccgacgtcgtcgggcggcgatccaccggaggccacgcctcgctggccatgtcgtccatctcgtacctgcccatgtcggtgaacgagtagcgcggcctctcctgcaccgccgccgacgccgtcgtgtcgtggacgaagccctcgtcgaggaagtagatgatggcgtcctcgaacccggggaaccgagcggcctcgaacgatctggagcagcctttccccacgaacagcatccgcccctccaggtagtcgacgggcaaccaggtggcgcgaggtcgcccgctgatggcggcggcgggcgtcagcggcatgacatggaacctgaacacgcggagcacctccgtgccgccctcgttgtagatgtacctcgcgaccatcagcagctggccccgggactccacgaggtagcgcgtgatggatccgttgcctccgatgaagcccatgtcctcgaggtaatcgtcgcgccgcagcatgttgtactccacgcggcgcatccgcatctggttgttggtcaggcggccgtaccccggccagtacacgacgacgccctcgtcggcggtgacgaagtagaagcccccgttgtagtagacgacgtcctgcggctggttcagcctcgggcccctgtgcgggaaccagcatttgctcccctggacccagaacgcgacgtcgagccgccgcgacacgaggacgacggcggcgagcatgtagggccgaggagacgacgacggcgtcggcggcgaggcggagagggtggcgaagcgcgcgaccaaggggaactgcttgcccgagggggacacgatccccggcgggagctcgacgcggtggccggagttgaggttgtagagcgcgtagcggtggctggagtcgagcgcgaggacgaaccagccgccgtcggaggagccgcagaagcgcgcgacgcggacgtcgggcgggagcgggagggggtggctcgtgcggccgatccagctgtagaaggagggcgtcgcggagctggggaagatgagccacggcagctggggcgggagcggcgggagctggggcgccggcggcggggggcgcggcccctcccgcacggcggcgcgccactgcctgttgacgcaggccatgcggacgcggtcggcgcggcaggggaggcaggcggtgaagccgaggaggacgttctcggggaggtccccccacttcgccctgtccatggcggccaccgtcggcaaccgccgggccgccgccaccgcgccacgcccgcggcggcggcgatagtagtatctcgtgggctctaacatttttggcgagcgcgggtgggtgactgggtggggtggctaccggttcgatcagataatgggggatttatagccgcgtcagggcgggtggtgccttcgcttgcacgaaatggaacgcgaaccgaagaggcccgaacccggccatcgatggattccgccgcttcgctcgccgctcggactcgcgcggccagcggcctccgcttcgacacggagcagctgcgcgttcggccgctcggggggctcgcggcggtgggtacctagtccggaatcgttgtgtgttgccaagcggcgtggtgtcgccgaatgcgctggcgctgcggcggactctccccgtggagcgcgggctcgccgggaaggcgctcggcgaaatggcggcaaggcgctccactttgttgcaggccggaggctgagactgagagctggttagtcttttgggcctattggttcagatggatatctgggctatgcattgggccggccggtgccgtgataatgtgacatgacatgccagtgaattatgccaagctgccgaccttgcactgaatattccccctttctcccctcgaattttttttatttttaattttttttattaaaagttttacaaaaataattttccattttgaaaattgacggaagtagtcgcctaccgccctctgggaaggcgatttttaaaaatcgccctcccagagggcggcgaaaatgacgtggcagacggccgttcgctctcgggcgacggccgtcaacgaaatttgcaggcggcccccttgccgccctccgcgatggcgattttgtactgtgcggggggccgcctgcaaatgggcggcgagggggggcatggaattttgcaggcggcccccttgccgccctccgcgagggcgattttgtactgtgcggagggccgcctgcaaatgggcggcgagggggcatggaattttgcaggcggcccccttgccgccctccgcaagggcgattttgtactgtgctctatatttttgtataaatatcaatagttatcaaatctttttatattgaaaactatacaagattaaaatctccaagactggtaaaatacaattttattattatttagggcatatttggattgttaccgtacaaatattttgttaccgtacaaatattttattaatttttagggcatatttggattgttagtgccaaatttttcttcacgaccaaatatttggtaaggtaaaattgcatttgatcatatttggtttgctgccaaaatgtaaaattgtagtgaagaatgttctacataatctcaaatctagattacgtattaccaatgaataggcttccattttcgtgtgttgtgtgctagtgggaaagaagatatgaagaggttgccttcagattgtcaattatatagcgtcgttttcactgcaatatatgtgaactcaatgagatacattattcattagatgtgacaagacgatcacgcgtgggcgtgattcactttatgtaaacaggcagcgccgaaagttgatagtgataactcgagctgccgcttttcatgtgtgctgttgtggactgtgcgcgctactggatctgacactaccgtgcagcgccgaaagtgtgttgtcgtgagcataagttgttctagcaccatatgaatgaaaagaactatgtagacgagacaaacacaagtagtactgcagtagtaatagcaaaagtagtactgctttacaagtttgtaagccaaaagaaacggtcacataaggactgaagaggtagaacactactgacgaggcctcttacccctgtccctcctaccctgcgccctaatgtgcccgtgggagtacgtgagtcggtccgggggtacggcacggccaacccgtcctgcctgtacaggtgtgacctctggctgctcctgagtgtgcgcctctggagctcctccaagctgagaggagcctagtacgtcgtggtggtctgcaccgtgcaagtcgtcgtcgtagaactggctagtaggaccagtcctaccggcgtgagacgaagaggccccagtaccgaagatcccggctgcaaatcctgctggacaaggaccatcagtttcatacaggtatttaacagtattaataaaaagtaaagtaccgtgtgggcgagggatcgacgctccgtgagaggaagagctggcgaacgcgcccgaagaggtggcgaacgcccctgcggagctcgtggaagcgccggtcgtgcctgcgaacgcgctcgaaggcagacgaggtcctgcgatgaggaaacgtgcagttaaaacatggtgacataatcgtgcaaaagctgaaacaaaaatgaactaatatctgggctgaactgtactgtgcgaaaccggtgctgtaggtcgcactgatccgaagctaggggcgctcgaaggcaaacgaggtcctgcgaggatggatcatcaagttacgacggggtgatgttttcgtacaaaaacagaaacaaaacttaagaaacctctgggctgagcagtaccgtgcgaaataggtgtcgtaggtcgaggtcctgctccgacggtaggcgcgcgaggccgtggttgtaccggaccagctggaggtacgacgtccacggcgctgcgacaggagaagacgcgcatgaccgcacgcatcttctcctgcatccggtcgaaggtcaccctctgctcaacgtcagtcaagtgcaaacctctgttcaacctcacttggactgcggtgatatcggcactgatatcccgtgcggcatcagcctatgcaagatggaaataacaaattcagtagttgtcctatattatgcaagataaatgaaataattgtaagaagtaatacaaattggatgtaccgccacgaagtagtctcggtcacggtgcgtgggatacgcgtccgtgacagcggcaacgtgcggctctagggcgtctggagtgaaggtcacacgcgcacgagtgcgaggaaggtaccaacgaaggtagtcacggtagttctcctccgtgtgtgggaagagctcgttgatcacctcctctgtagctaacacccagtcgtcaacgtactgctgtacacgtggagcccaaagtgcgcctgctagctgtccccgtcgagtcaacctgtgaagagaggtaaattatatggctcgatgaagtaattatcataaaaatttagaaatgaacaatccgaactcacgagtggtcggcagggaggacggtcggctgcacgttgcccggaaacacctgcctaagtccgaactgtctcatcacacgctgcgggcagtgaggctcaacgaaaatgtcgaacaccatcggcaggatggtgagccagtaagcctggtcgcgtgtgcacaaggacaaaagtcctagcggtgctctcgcagcgacggcatcttctgtgtacggctcccagatgacgtcgctcggctggagacggtcaaactcgaacacgaagtccgggtaaccacgtctcacctggacgtgagcgtaacgacgctgcaataaacatgatcggaattagacatgttatgtgaagaaaaaaaaaagacgactgataaacttataacgcagcgaagttgcactaaccccacgtcgacaccagtaagtccccatcgtgggaccgtcctctggccactgcgcgctgcgaccaaccccgtagggtgcgctgtccaccactggtcgacctatggcaaacctctcggctgcccaaagctgaagcaacatagggcagccagcgatgatcgctcccgcgtcagtcttcgtgcacgcctcacagagggcacggtacgtggctgctagcacggcagaaccccagctccactgcggcacgtcctgtggctgagcatccgcgatggaccgtgcgtagtggaccagccggaagtccacagcgtgcccgtgggtgctagtgaacatcacccacccgaacaaccacaacaggtacgcctcaagggagcgtcggaccgagtaatcatcagcgtcagggtgcagaaggtccgcctacaattaagaatgaaatgttagtacaaaacactcattcggtcgcaaataagcacgtatgataataacaacttatttacttacagtgaactggagcaaccaagccttgctaggcccgactgtagagtacggaggaagggtgatggtcggtcctaggtgtggaaggcgcatcacctgctcgaagcgcgcagtgatatcctccttccacccaaaaacaccgtccacgggaccaactgctgctcccgccagcggtagcccgagcaggtacgacacgtcctgcagtgtcggagccatctccccacagggaaggtggaacgtgtgcgtctcaggtctccagcggtctacaagagcggcaaggagtgaccgatctgcatcccaccgcttcgctgggtcacggtcgtccgctgccgcctcaacaagcctacaaagtggtagaaggcctgccgcacgcaacctgtatagagcaaacttcaaacataagtacaacacagagcaaagttgagttgaaatgtgaacatacgcgtaccaaggaacgtgacgggggtcgacacgcaaccactcgcgcgacgtgcgtggacggaaggtgccgagctgtgcaccctcgactgctgacaggaacgagcggtggttcctgtcaatcccacggttcaacagcgccggtgtgtcgtacgccatacctgcatcaaataggttgatcagaaacatataaataattagttcaacataagtaataaatgttgaactaagcgaattactaacacatattaaacaagagtacaaacaaacaaaagtgtttagtccgaacactcatcacgataacattatgatacaacaccgaataattcgcaatactactagtacaacaatagtcggaggtactcattacaacaacattgaattgaaattacacgatagaagtatttagtccgaacactcattacatcacaacagcattttatttcctaaatcgaaagcattgttacaccatggaatcgcctgctgcgcgacgacgccttggccttgcgcgcctgcttgttgttccttcaccaggtggtcgcctaccatcacttgcctgtccagatggactagcatctgcgccgcttggaacttctgcattcttcgggcatttcttgtaagtatggccgcgcagatcacacttgctgcagcgtaaagtcctcccacctgcttctgactcatccatatcatttctgatgcgtctagtttggcgtcgaccctttttcacccttaacttagatggatctggaatataaaaaacttgggcactcagcgttgtgtaagatcctgagatcccgaacccatatatctcctcactccatgtatgaaagattgcttctttcctgaaataatttgagacgtacacattgggagatatgccacaatcaccggcagcagcaagaacgtgtgagcaaggaaggtgatgaagcttcggcttcatacaactgcaggtacatccaccatccgccttcaagacacattcctgcacggcttgcttgcgatagataccacgcctgctcctatcaacacacattatttcataccgatgcacttgtgtgccttgagcaacaactcgatgtctccgtgcctttttgattttatcttccatgtactttgtcactacgttgccaaacactatgttgtcatcggccatggacggaccaattttcttgtatcgatccctaaagtacgcttgcgtgccgtgaaggatgaattcaacaatagcaaccaatggaagtacccgaactcctcgcattacccagttgtacacctctgccaaattggttgtcattatgccataccgagatccatcggtgtcgaacaatagagaccacttctccttaggctcattctcaatccactgagtgaaatttctgatggacgaccctgacctccttctcattgttggtgggtcatcatgtaatgcaccaagaggtatgggaggctcgtcaccttcaactagtggtctgcgagattgctcatctgtttgcttcgttgtcaactcatccaacttgtcccacaactcattaaatttcttctcttggttctgtgcacagagcctcttaaagagctccataagatgcttgttcttgaattgcttgtagaaatttgcacccatgtgacgcatgcaccaccgactccgaacatcaggccacttagctggaagtcccttctcatcccaaccgttctgcaagtagtcaatagcccgcaacatacccgcatgacgatcatgtataaggcaaacgttgggcctcatacgcaccactgcaatgtgcactctctctaggaaccagtaccagctttcagtgttctcactctctacaaatgcaaaagccataggtagaacctggttgttcccatcacacccaattgctgtcaatatctgacctcggtatttacctgtcataaaagttccatctatgcatagaacaggtcgacaatgcacaaaagcattgatgcaagcacccaatgagaaaaaggctctttgcagcacactctttgttcgatcatcaaccgatgtaaatgtatgtaggtcatagtacgtattattattcctctgggcaatggtggctaacaaacgaggcaaattatcataagaagcttcaaatgtgccatacctcatctcaatgatcttttgtttggctctccaggcctttgcatagcttatggtgtacttgaatttgttctcgatgtgcctaataattgattttggttcaaagccaatgttaccaacaacactgctgtacatctcacttgccacaaaagctgaagtgatgtttcggtgatacttctccaccccttgtaagtagcacttgtgctcggtcacaatgctaactttccaataatcattccatttacccttatatgcatggacacgccacggacaatcttccttcatgcacctcacttcatacacataatttgttgacttgaccaccctaaactctctctgcaaggaaactgcccaatgcttcaccgcctccttcatctcatccttatgagcatatcttgcaccctcaattacctcgttctccttatactcccagggtacatgatcaccctctgatataacaagtccagagaagtcctcatttgcccaatcagtggccattacatcaccttcctcatcggatgatgcgtcgtcgtccacttcctcattatccgaatcttccctctccatttcatcaacaattataccgactctctccccctcatccgccatgcccatagcctgctcctcccttggttgattttcctcattttgcatcgatggtccaacaacatcccctgcattgataggaccctctacatcttcagtttgcattgaaacatttatatctttctcttgtaccgacacaaatataacgaggggccatgaccgttcaaaagccatttccacataccgtctctaagcatcagtgctgtccatcggcattagttcccaaaaataaccttctgttgcacgactcactacaactgacactgacattgtgtagacttcttggtctattctaaatcctctcaacaaccaactataaattgactgaaatgttctctccgcaggcctatcgatgcccttagatgtcattacaaaatctgacagatcaacaccatctggaccaaatctaatatttccttcaccgtgaactatctgaaatgtgaccttacttgacattgtgcctgatgaaaacaataactgcgttaacctcgcatttctgtactacgccctaagttacattctctacaatattgttctctaaatttctaaaattacgttacattctccagatcaaactaaactacatcttacaattaacactactgtctatgtctcaattcatactattatattctatgatatggatctacacatatgtgctgtgtgctacagatgtgctaaaatatatggaactaaaactaaaacgcaacatatatactcaaacataacatattagtacaaatgcaaaagatgtatgggagcatacctgtgatgaattgagcgaaccagcagggcttcgccgctccccttctgctgccctcccctctctctcttttgttttttttggatttttagtgaatataatgaaattttacagaggagggactgggctttatagggggagaggcaaaaatcgccctcccccaggcggcaagggggccgcctgcaaaattccatgccccctcgccgcccatttgcaggcggcccccccacagtacaaaatcgccctagcggagggcggcaagggggccgcctgcaaaattccatgccccccctcgccgccaatttgcaggcggccccccgcacagtataaaatcgccctagcggagggcggcaagggggccgcctgcaaatttcgttgacggccgtcgcccgagagcgaacggccgtctgccatgtcattttcgctgccctctgagagggcgatttttaagggcggtaggcgactccttccgtcaattttcaaaatggaaaattatttttgtaaaacttttaataaaaaaaattataaataaaaaaaattcttctctcctctctctctctctttgttttttttttgtgtgtgtgtgtggggtggggggggatccaaattccaacacagggccaagcagagtggtgtttggccaaaggccttactaaatcttggctgagttttgagatatgaaattaacaaattttggtagaggatgtgttgttaatggtgtgcttggttgatactaccttatattttatattttaatgtatgacgctgttgactttttatccaacgtttgaccattcgttttatttaaaaaaattatataattattatttattttatggtgacttgatgcatcatcaaatgttctttaagtatgacataaatttttttatatttacataaaaattttgaataaaacgaatggtcaaacgttggtcaaaaagtcaacggcgtcatacattaaaatacggagggagtaccttgttagattctgataatgctaaactttggttgagttgagagtggcaaaaaaaaagcatttgaacggcgatcccctccattccatgagggcactgaggaagaacgactcaacgaggagccgctccaatgctccattgccctgaacttcactgtgtgaaagccgaggtacacatcaatgttgatttcgtccatccaccgcgagaaggacttaactacataaaagaacgcaggcctacgaatataagccacaccggccagtacacgatatatatagtgaagtcccgtagtactatacagtagtgaagtcccgaagttttgtacgctaattggaagagtatacgctaatgcaatatataaggagctaaatttcaatttaattatcattcttatgtacttctgtaattatcctatatatactaattatctattattgagtaatatactgtttcatctgtttcatattataagactttctagtattatccacatttatatagatgttaatgaatctaaacatggtataaaatagcatggtataaaattatcaaattttgataaaattataaaattatcttattatacaaagtcttataatatgaaacggagggagtaattaacatggtataaaatagctagcattgaataatttacccggggtcatgtgaccccggtaaatagtactctctccgtttcatattacaagactttgtagcattacccacattcatatgtttagattcattaatatatatatgaatttagacaatgctaaaaaaaattttataatatgaaactgatgaagtacgtaggttcgccagtggcagcagggagtggctgtttttagcccttaggtttggagagattcagggtccaccacaaattcaataaatcaaattcacaaaataccactatcaattttccagcatctatatccatgtaagatcttggatgggacattgtgcacatgtaaccaattaaatctctattttaattgataccaaaactgattattacacgcatgcagcatgcgtgttgctcaatatatagctcctcaaggtagctaattgcaaacactaatacttgtagtagaacctaatattaataaggcttaagtatatatcatgcatgtatgcatgcatggccttgttgatacatagctaagctaggtcatctgctgtagagatggctagcagaagcagtggcagaagtgacggtcgccgcggggtttgcactcgccgccgcggcactgcgactggcaccacgagttgcaggcgtcgttctgccccgggccgcacccagtgttcccgccccacgagtggaagtccacgcagcaacgcggctgatctgccgccgctcctgcaattaattagcacagtgaaattaaacaaacataaaattcttcagaaatctagacgattattcggcaaacaggaaatgttaattgtgaaatccaagtgcaaattaataagaactctctgaacaattactacgctaagagttcttacctgacgaggcaacaaaagcaactaggacaagaagggcgatcgctgcacaagtgccaatacgagccatggtcgtcgtctctttcgcgtcgtagtttctcgactagtttctgttgctcgatctctgcgttgatcttgcttgttcttgaggtttgcacacggtatggacgtgaatttatagtcatagtatttcctccaaaatatggaattcccaggtacgtatgctatggaaatttcagatatggaatatgtacagcacttagacattttgagatgatgtgttaccatgcatgtagtataatatggatatacattgtttggaaatgaaatatatatgtgctcatgactgttgccgtgcctagcttaccttttgttcgcaagaatcgaaaagatcgactattgccttcctttgctaattgctagtattaactgccatggattaacttgatacatatagaattaaatccacgaaagttggaagaatcggaaaaggttaattgctcccgtgacaacaatttttttctcttttgttttttactagcaaaatgccgcataatgacacttttgaactatttacatgaagaaaatgagtggaaatgagctgatgcaatatccgaatcacgacacgtaaaaattttattttcttataatatgtataatgtaattgttgaatatactcatgaagaaaatacgtgaagttgaaccgacgacacatccgaatagcgacatacagaaactatatttttaatgtaattgtggaaataatctcgtgcgttgctatgtgaaaaaaagtatggagttgaagtgatgacacgtctaaatcgtggcacgtaaaaatcatagaaaccaatgtaattgtttttttctaagggagtattgttttcgatttataaatcgcatgaggacaaatatatacctaataacaccactaaaaagacacatagatgacggcactataagtgtcgaaacagttaaaaccatcacatgtacaacttttcccacctatgcggggggtggaaaaattacagaattagcacatttcaggaattataggagccgattttaaacaaaaccgacacctatattataaatattggttttttttaaaaaaaatgacaccagaaaaactaagacgagccaaacgcgtcccgtccttgtccatactcgctccccaccctacacaaaatctctctcactctcgctctctctcactctcccccgcccctcctctccctccgccccctcatgcttcgctcgccatctcctcctctccctcttgcctccctcttgcagcggatacggcggcggtagcggcatcggcgacggattttttttcctacaacttgtgagtcaatgtcaaaatttaagttttaaaattcaattttgaagtggattgtatggtattttcaatgtagtttcttgctagaattgaacttaaggagacatatataaaagtttacccataaattattttttgagtaaaatacaccaccagtccttaaagttggtgcgtggtgtcacttaggtccacgatattgtaaaatcaacattaagatccatgaacttgtttaagtgaatcattacagtccaaaacacgtctgaccaggctgaccgtcctacatggcagtccagcgtgactacatatttgcaattaggctcctccacgcccgatccacggccttcacggtgtcggagacacggttcttgccgatgaccgacatgacggtctcctgcccctgacacgttagtgtaatgattataacatgagatgaacaaatggtgaatttctcaatcattttcacacaagaggcaatggatgaaaatttgtttgattaacaaaaaaaaagtatttaaagacaatttgttataggacattgaaagattgtggttttttattgtggttttttttgttgtgagacacccgaagaacgcgtctctattcatggatacataaaaacatggtaattagttgtttgatacccgacgcattattttattattttacaaaagacaagtttgtccttgagaacaaccacagccaccacctcctcatcattgccacggccaccgccacagccatgctactccttctgctcctgctgactatcgtgctccacctttggagccaccgctgccgtcccactctcccgttattgccgccaccggaccgctagctccgcagacactcccatcatgcggtccgccgcggcacgggcaggttccgcccatctagtcttggccgcggcgccacctcgcaagtcaacctcgccatctttctctgacatgtcgctcaccgctgtgagattccttaaccgggctaggcggctcgccgtcatatgcgacgtggcatgcacgacgccgcgccgtacggctgaggcgatcgctttgatcgacactaagaacctcactgcacatctcgtgcacatctcagtaataattatcctatcctatgcatgaaatgagtcagaggcccacgatagctccaccgctagtgtctctaatatgttgtctcatggaaaattttaattttttttacaatcgatattttttatctcaaacaaatattaatgggcaagtattttaattgtttgcattttatactatttaacggtttcttttacccgtaacgaagcacgtgtattttgctagtaataataaaataaaatattacttgtctgtaaagttggtatgtgtatgtcaaaaatagtttgttttcagcgaaattcaatcttgtggttaccacaatatagagcacaatggcacttgactgtaattatctaaagtctcaagcacgtacactatgtacgaccagtaaaaatatctagacagtcgctccctcttttttcctctctcttcccgtctttctccgcctctctccgtcctcactttctctgtttattcctctccctcaacgttgccggccgatccaccacatcgtcgacggcctatccacaacatcgtcgccggccttctttttccctcgagttgccggccagatccacgatgccatcaccacggaggtcctcctagagggcgaagacgtggaggcggcggtggtattcggaggcgagcagcttgaggcggagagagtggtcggagacggggaggccgagcgagccacggatggattcgcatcgctcgccatctccttctctccatctcgcctccctcccgcggtagatccggcatcgatggcggcgtcggcggcggccgcgggtggatctggcagcggtggcagcggatgaggacggatccggcggcggctccctctgccccctctcgcctccctcccaagcggatctgacgacggggacggcgaccgcgtgtggatctggcggcagcggcgccggctgagagtggatcgggtggcagcagctcctcccgcggcggattcgagggcagcggctcctctcacagttatccgatggctgctgctccccctacccggagtggcggccggcggctgcttccctccttgtgtgttggcagtaactccccgcccccctggctgcccctcacctccccgacgtggagccgacggtggttcgatttttgatttgtgaatattttgaggattttgtttttttgatttgtgaatattttgaggattttgtgatttggaatgttgatatagtaaccacagtacgacggcggtttgatttgggatgttgattttgtggagattttttattttgatttgggattgcaattgagtaattttgtgattcatgtattttgggaattgggggcaatgggattgggagcaatcgactcgattagccgattgatagagtcggcttcttttattttcactccaatgccgattgattaaatttgtttttttatttttttcggcttctttcgagtccgctcaggaattttttttttcaagacggtctcggattcaaacacggacgacagacgaaaaaaatcgatcggaagtattaggtgacgaccggaaaaatccaaatatttatattagttatagatatcgatatcatggacattttttaccttttatatataccacctcacaagtactagtatttccaatccccctttacaacttaatttctatatatatatatatatatatatatatatatatatatatatatatatatatatatatatatatatatatatatatatatatatagaaaaatacatatatagggtcctaatcgagctcatttcttataccatatactatgtttattttgttgcatagatgtttgctcataaagacaatggggcagcttgttcaaggaaagaagtgtgcattcacgctactagagagcgcatacagggtttggaggagaggctcctcctgccctctcggagggcacttttttaattaatataaaaaagctgtgcgccctcttataagagaagtggctgaaagcaaattttcccgcatagcttgtcacctctatattttcacaattttcaaatatatagggcatgcttggtacatctccaactcctaaatttagctccaggaattgggtttggagtggagttgtggagctgcctaaacccaactccacaactctagtacattttgtgagaggactccacccagctccactcccagttttggtggagctgaaactgtttggctgagctctagctccaaggggggtggagctagctggagctggagctgtgccaaacagacccataatatgaaatcggatgaaatcaaacttatatcaaaactatagagctcgacgagacatacaattttttttatttaagatcatttaggggtttcaaacattcgttacaaaatcttaaatctatttttacaaaatattatatctacatttcaaagtcctccgatggagataaactctattttaaagttgtagagttcaataagatcgataacttgtagtctatgactttttttatttaaaattatttagaatgccaaataagattataaattttcatagcaatacaaatcagcatgaagacattatttgaaatgacgtcaagggagaaggcggttttgtaggctggaggatgggatttgctttagcccgttgggctttttggattactaatcgctagagggataagaacaaatctagatcctgttggggcggcccatgaaaatgtggttgtacccgtcaattgtgtcaagctaccaaccggggccaaatattctctcgtctcgaaaaaaccaatcattttctatttttcctttcccctgcagaacactgttgccaccatcgttgcttcgagcttccgaccctatcaccccgaccacatcctcctcccctcccagccattgttgtgcttcactattcccgacctgcgccaatgccttcatgtgctttctaaacattggtgtaccaagttttgctaccagctctcttctcctttgacaccttcatgcgctttgtgtgtgtttcacaacagaggtgggaaagagaaggataccaatgatgccacatgtccatatcaatattgggcatgttcagctgctaggtataactagaacagtcccgtctgtagcctttgccggattcctaggatcaaaggtcggaggatagttattgacttgctatagatgaggtcagatggcattctgttaccgaatttttatttataataattaataaaaaataaattataggaataagtttgatttttttaacagggggagtataccacaggttcacagtaacaagtgctccagacggtggtgagacattaaaaaatcacacagtttgccagttagcagatgactacaaaacggacaaggatccgactctagtgaaactaaagttctatcaaacagctttatcacgtcacaaaattattctccataaatctatctagtagtagtatacagtctaattttatgtactatgcgatcgaaacaatccagtaactccactgaagcagtattaggacataccaattctataaagaaaagagtaaactttgttgatggcctataaacttggatctaggtgccacttagttacattattttgtaaattgttcatctagatcagtgatcttgtttgatttaccactcgaggtccaatggcgatcccaacagggggggggggggggaggtgggcttgagcccctcctactattggctagacccactatacatgctcttcaattcttcatatatacgtactctctccatttcatgttgtaagatgtttttgactttggtcaaagttaaactatctcaaatttgactaagtttatagacaaatatagtaatatttataatactaaattagtttcatcaaatcaataattaaatatattttcataataaatttatcttggattgaaaatgttagtatttttttcctgtaaactttatcaaaattaaagcagtttgactttgataaagtcaaaaccgtcttataacctgaaacagagataatataacttttaaacttgtcttatatttattctatgttatttcattagcacctcctaaaatttagtcttgcgttcgtcactgtcgagttccaaagcgtatgtgaaagattacgatctagatgagtcatttataagattataaacattagtgacaccgtgatccaaatttaaggatcgatgatgtattttactcaaaagaaaaatataaggaaatagcacgcttgcagcagttatttatgttacctttcccgcctccttttcgcttcttttatcctcaataattaccagtactagccctacacttccactggcgatctccctggcaatggccctactacctccctgttccctgaaactttacagaatgtatctatgcatgacagataagctaactattgttccttcacctgtcaaaactaaacatatttaattatctctgctgccaaactagtgctacaaattacaaatccaatttcggttggtgaacagaaaggagaaatgtaggggaaaaaaaagaagcaaaaaatgatttttattactgcgatgcactccagctgttggaagagatgtgcggcccaccaagtcgcctccattcccattggaagtttggaactggccgtgcagctctttgcattatattgcaacgtgcactgtgcacataatgaaatggccggtttagttgaaatgtatgatttgatctattaataaatcgatttaactaattaatttattggcaggcactggcctaccaaacctctgcaaattgccaattcctcctaccaattcttctgtttatatactgagaaagtgccaagtttttgtctgcttcatgtaacctatggatttcgctgtccaaaaccattgaaatttattcatggaattggccataagattatttttctctgtatcttttttctcccttgttaatgatcttttgaggtgacatgtcattgttacatggtaaagtgaagaacagaagagaagaggaaggcagtgcagctgtgcaggagaagggaaagtagctaagcaagtaaggctggcagatgccatgccagctgcaagctaggcgatcgatcaagagatcgcgtcatcatctctgatcaatctcacactgtggtaagctaagtttgatcgttgtcattcgaatcactcatgattcgtttcgtgtttgtttgaatttgttgcatcgattccatctccaagatcttcacatgcatcttgttgtagaacaagagtagaaagaaacctcatcaaggtcaaggtcaagctcggacgactcctctccatggatggagatcggagtaggaggagtgccgccgcgatcacgcggccgccgtcgcacggcggcccggcgtggcggcggatgatcgcctggattcaactactcagtgagtgatctctccaccttcttgctcgcgcggcgatccatccatggatcctagctgcagaaaatccgagctcactctgacttctctcgatcgatcgctggatgtgtcgcagaggtgttcgtccagaggtacggggaggtggcgaggtggcgcacggcgttcctcctcttcctggcgctcctggcggagcggggcctgcgccgcgcctacctgtcgtggaaggagtcgcggctgcggccgcgcgccgccgccgccgtcaccctgcaggccgcgttccgggggatggccgcccgccgcgagctctccctccggcgcagggccgcacgagccgcagccgccgcgctcatccaggcgcggtggcgcgcgcgcgcggcggcgcgggagcacgcggcggccgtgatctgccagtgcgcctggaggcgccgcgccgcgcggcggcggctcgcgaggctccggatcgagcaggagagggcggcggaggcgtgcaggctcagggagatggtggacgtgctccagcaggcggtggaggacgcggaggtgcgggtgatcgccgagcgggaggcggccaagaaggccatcgccgaggcgccgccggtgatcaaggagatcgtcgtgcaggtcgtggacaccgacaaggtggactcgctcgccgccgaagtcgcccgcctcaaggtgacaccatcgatgcctctaaatgtgcaatttattcatgtgatccatgaacaaaattcagatcaaagaaatcggtctgattcatatgatccatgaacaaattcagattaaagaaagtggtctgattcatgtgatccatgaacaaattcagctgaaagaaagatgcagtgaccaaccaaaccagatgctacattttgacatttcgagttgcaggatttgctgggagcagagatgaaggcgacgtttgacgcgaagaaggcggtcgccgaagccgagctgaggaacgagaagctggctaggttgctcggtgtcgaggaggtgaagaacaggcagctgcaagaatccctgaaaaggttcagtatttcagaattcagacttgttagctctgaatctctgatgtgcctgcacaattaatgtgtgatcccagtatgcgagttcatgggagaactcatagtgttttgcatggatttttatttatttttacttaggatggagatgaaggcatctgatcttgaggaagaaaaccagaagcttcgaggagctgtcgcgtcagtcccttatgtcaggttgccgtcaaacgtaaaccgtgatgatcctgatcttgaggtacctgaaatcacattgatgaatttcgacgcacaattttgatgctcagcgtgctcaatcatgtgcatcttaacagccaactccagagaatgaggatgagaatgagaatgagaaagcagtttattgtgaggtgaagccaatgatagtggatagaggggttgacatccatgtaagtataatcatcaaattatatttgatcagtatattcgtagaatgagttcctgatttaacaacatttaatttcaatctaggagaacaattctcaactgcctggcctgaatgatcctgaagctgagaagcagcagcaggtatgatgcttagtaattcggaacttctgtttgtgtttcaagcagtatcacaatttcgttcaggtgtcacgccttaaacatttttttctgaatatccaggagctgttgatcaagtgcatatctgaagatcttgggttctctattggaaggcctattgccgcatacctcatctaccgatgcctgatccactggaaatcatttgaagaggacaggacaacagtttttgatcgcattattcagaagataagtgctgcaattgaggtatgtggcagtggtatgcacatatctgcaactattattcataagaagatatatgcatcaattgtttgttttctcttgcaaggctcgagacaacaatgagacattagcatattggctatccaattcatgcacactgctgctgcttctccaaaaaacactgaaaatcaacggggcagctgctttggctcgtcagaggcgaagagcatcacccctgaagacgccacaggtaatgtaccgaaaaataaactctgtatgctcaacaacctaagtgattttgtaagtgagtttgggattctggactcaatattagttgcaaaaattccaggaaaatcaagcacctaatcatcctgaccgtagtccagttcctgatggacggttagtcggtggactaggtgaagtttgccaggttgaagccaagtatccagctcttgctttcaagcagcagctcactgcattgctggagaaggtctatggaattatcaggcacaatttgaagaaggaactgtccccactgcttggtctctgtattcaggtagcattgtgctttctgcatatctttctttcagtttcaaaagtatatttgctgaaagttaagaatgacggatataattttctctaggcaccaagaacatttgttgtaagccccagagggtcaggcgctcaaggaacagacttggcacagcaagcttctatggcacattggcagagcatcatcaaaattcttacaaattcgctgaatgtcctaaaatccaattatgtaagataaaaaaaattaaattggcagtagatacaattttaattcaagtatacacgccatctaaacctctttacattgcaggtgcctcccttcctaatctgcaagctgttcacccaactattttcattcatcaatgttcaactcttcaacaggtacacatgcatactaacgattcacttctccatatttctcaaactagcaccatgaactcatatgacaaatttttatcacttcaatggtagtcttctgctacggcgtgaatgctgttcattcagtaatggagagtatgttaaagctgggttggatgagctagagcactggtgcttttggctgactgaagaggttaaaaacttaaaaaagtctttacgttgtctgaacaagtctttcaggaagcagtctcta

SEQ ID NO: 66280 - DNA, 2693 bp, Oryza sativa
agagtggttgcttgagttgtgtgtgcctgcgtgtacagagctgagctgatatgtactaagccaagaaagaaaaacgatttttggtttggagctttcagagtgtgaagcttgcaagtcaagcaatgttgctgtatacattgccacgtgtgctctagtattgttgatatgatactacgtcccgtcctaaaatacttgtcgctttaagtttttatttgtaacttttatcattcgtcttatttaaaaaattacgaaattattatttattttgtttgtgacttgctttattatcaaaagcactttaaacatgacttatcttttttatatttgcactaatttttcaaataagacgaatggtcaaacgttgaaaaaacaatcaaagcaaccactaatttagaacggaggtagtatactactgtacttttatcaatcaaactcattttggacgcatacaccgtagataaaatcaatcaaactcattttctgaatgtgacatctgactgctgaacatctagtactagcactagaattgcatgccaatgagcctatcattatttgtccgcatcctgtcaacgtgatcctgaaccgaccaagaaatgggaaataattgttcgaagctcaagtaccaaacagagtttttgagcaagattagtaacagcgacgtaacagtaaatacaaatcaaaatcattgaacacttgcacatatctttatcaagaaccgctgcctggcttcctgagagaagagggtgaacaagatgtatttgtcacaatgcagctaaaatagcacgccacgttgttcatgcagacaccaaacaatgaaaatgtagaggactgattggttctgttttgctgaagtggtagcatcacaagggcactgtttagttaacaccaaacttcccccaaactttcaactttccatcacatcacatcacatccaaaacttttctactcatataaactctcaattttttttcaaactaccaactttctcaaaacttctcttgaatttcaggaactaaacacagccaaggattacaaacactgcctgtgtgcaagtgcaaattaattaatacagcaggcaatcaaacagtttgatccggtttgaaattacaaaccagtcaaacaatccatgcatgcgattttttagttaactaatactccctctgttttttaatatatgacaccattaactttttaagatagtttaaccattcatcttattaaaaaaagtaattatcatttattttatagtgacttgatttatcatcaaatgttttttaagcatgacttaaatatttttatatttgtataaatattttgaataagatgaaagatgaaacgttggtaaaaaagttaacgtcgtcgtatatttaaaaaacggaggtagcagaattgctgatgatcatccaaagatgtcacggccaacatgattgagaatggcatatataggccggaaatgctactgggcgaagggcgatcagattttgccccccctccctccctccacatctccacctggtttccttttttggcactacattactttcctattttagtaaatttatacacctaaagtttacacatctaaagtttagagaccaaaagtttataagtcaaaagtttatatttccgattcaaatttgaatttgaattcaaatatttttttatatatagtatttctatacatttaaagtttatagatctaaagtttataagtcaaaagtttatatacccgtttcaaatttgaatttgaattatatccgattcaaatttgaatttaaattcaaatattttctatatataatatttctatacatctaaagtttatacacctaaagtttatagatccaaagtttataagtcaaaagtttacatacccgattcaaatttgaatttgaattcaaattttttatatatatagtatttctatacataaatttttctaacttttttttaattttttatggtgtactgtagtaggaagagaagaagggaaggaggaatgggagaagtgggaggaggtattgcctatagggaaaggggggggggatccgatcgctgggcgatcgcccaggcgatcgatcgatcgtccattaggccccccatatataggcctcatgcgatttaacaagtaatctgactgtcggctttcattttgcagagtgaccaggcacgcagcgttggagtgatgctcattgacaagcatatgctatgatattaaaaacggaattgctaaaactctgtcgatagaaaatcctaccttaaatcttgcaaaatttggattactggatgtgcttcacgattcgtgctcttcttctccaactccggcgaccaccttttcttctccggcaccggcaaacctaaattccggtagagggccgacgaaatagggtctcggggtgggggtggggtgggggtgtggagggggggagttcaccggctttagagggatggccgtgggaggcggcagcccggcggtgggtggcggatcgggcgggcggcggtggcggcgccgaagccgcggggctggaggatggcggcgggggcaaagcggaaagagttgtaagaggaggcggacggtggtggcgcccgccgctagcgatggggatgacgacggacagctcacggccgccggcttgaggcaaaggagaggagagggagggggagggggaaggggagggggagggggccggctg

SEQ ID NO: 66281 - DNA, 5681 bp, Oryza sativa
  unsure (1)..(5681): unsure at all n locations
ggccggctgggggggcctcgccggcaccgttgacacctttcggctagccggcgaggccgggcggcggcgcgttggggtggcggcgcgtgaggaattgggagaggagagaggatttttagggtttggttgcctgcacgaattttaaagcaatcgggtggtccaaaatttgcaagatttatgagggggttttctgtcaaatgatctataaacagtccctattaaaaaaatagaggagcatttgtaagaattttgttgaaaaaaaaaacattgtatctatctttgcaacatatgagtacacaagtgtggaattaatggttctcatatagtcatgcatgtatgttaggatctgtccccacgggcatgatatgcttagggagcgttcttttcctcatagagattgtcacaacatattttttaaactgctaaacaatattatttgtattaaaaaaactttctgcaccaacattctcataactcttttaaaccgacttttcaaccttttaatatttaattgttttatttgtgcacatgaataatcgtcataaactaagaaacacatgaataaagcaatatgactgctaggagtagcatttacacaattacacaacacaactttcaattgttttttaaaaataaaacttagaggaaccatgaccttgagtccttccaactcgctagaaaaatgaaccccttaaaaaacttttcgcatatataattcaaactttgtatggaaaaaaattttctgcttaacactcgagaagtttatgattgacccatgaattatttccccgtgtttgaaatatatagctgaacaaaccagctagatgcactcatattcggaagaatagtcaagtgtggtgcagtgccccccaacagaaagattaggacatgaaagtggcttgcactccattatctcgatcaagctagcttggccccatctagagcatgattcaagtggaaaagaactaggaaaaaggtggaaggattagattaagggtgccatacaaaaaaccattactagcactaatcaaatttttaatttttgaaagctataccatattgcacatccaaccacatccaccaaaacagtggtggcagagtacacattgttttttaagggaagcatcgcaagtggattattgctactcattttgtaccccttttgagttaattattgctggtgatgagatgatgttttgtgaggttgttgatgatgacacaatataatgtgccatttccatcggtgtctttgatggctggtgcacaaccacacgaggcccagtttaaactaagcacaaccggccacatttaaaccaaactaaaattgaaccacactaccaaacaccgatcgaatcatcgaatcaaatcattatttgacagctaccctgcattgtacgtgtacgtacttgggtatcagcaagcaaatcagataagtatatatccatactaccgtacatagatgtgtactactccctccgtttcaaaatatttgacaccgttgactttttagtatatgtttgaccattcgtcttattcaaaaaatttaagtaattatttattcttttcatatcatttgattcattgttaaatatactttcatgtacacatatagttttacatatttcacaatttttgtttgaataagacgaacggtcaaacatgtactaaaaagccaacaatgtcaaacattttgaaacggagagagtactagtttgtactccctccgtcccaaaaaaactcaattcttaggtttccgtgcctaacgtttgaccgttcgtcttatttgaaaaagttatgaaaaaaattaaaaagataagttatgcataaagtattattaatgtttttatcatatgacaataatgaaaatactaatcataaaaaaaattcatataagacggacggttaaacgttgaacaccaaaacctagaaattgagtctttctgggacggagagagtacatacatgtacaacgaagatgattaaaaaaaagaaaaaaaaagtaaagctctattactttttgttggtatattacaaagtacaaacacaaaaatgtccaaacatatgtagtaattcacatcaagttaatcccctaatgcaatatcaagagagctttttggccattttaaaacaagcacaaaatgctccctctctctctctctctctctctctaccactctgttcaatggagtaattatatctctcccttttcacacactctagctgcattgatcctctccaatagcgatcaataactcaactgttgattctcctaattacccaagaatggagaataaatccgatgggtatataacccaaaaacaaaaacgaaattgaaatgtatttttttttgtttttccccatttttttcttttttttctctttttttttcagggtcagtgccacacctcacgtcgctaccttagtagttagaagccgacggcgacggcggttgcggtcgccggcgtctccggcaaggagatgatatcctcttcgtcgtcgtcgtcgaagagggagccgatgaccatgaactctccctcctcctcggccacggccatggccgacgatgagtcgtcttggatctgcctctgccacttctcgcggtacgagttgatcttctccagcgtaagccccgcgcggaatcgctcgatgaacttgtcggccttcgcgttcacgtcggggctcgcgcagtacgccggcgccggcgacgccgtgacggaaggaggcgcctcctcttccccctccgacattggcggcggcggaggaggaggcggcggtggcagcggcggcgacggcggcgggagcgggtaggtgtagtagacgacagcgcgcctgggataaaacggcggctgctgctgcggcggaggcggtggaggaggagcggggcgggacggtggctgtggcggtttcctggatcggcgcgtggtgggcggaggtggcggaggcggctgcggcggcgcgacggagtggatgcggcggctcttgctgccgcctttcttgaagaggttgtagaagatggatgatggaggcggcgggggagggggcggcggccgccgcggcggcgccggagcggggttggtggtgcggactgtggagtcagggctcgccgaggcgtcggacgacggcgacgagtagtggccatcggagaggtgatggtggtggtggtggttgtggtgatgcttcttcttgctcttgatgccaatgctcttgcgcttcttctggtagaacgtagcaatggcggaggcgaggtccttggcgccgcccacgctcccgctccgcttcttcttgctccgcggcgccgtcgccggaggcagaggaggaggcggcggcggcgttcccggcgggaacatggccggcgatgacgatgggagggggtacttgatctcctccacgactatctctgcctccaactcctctgtccttggcaggctctcgacgctgcggctgcgccgtcgtggccgagcaggtggtggcggcgtcgctgccggcgccacctcttccaccctcatctcctccagcaccgcgtccagcctctccgagttccacctcctgctcctcgtcagcgtcggcggcggcatcaacgtgtcctgctgctgctccagcgccgcgtccagcatctcgggattccatgtcctgctcctcgccagcgtctgcgtcggcatcaccgtctcctcctccacccgcgccacctgatccagcaccgcgtccaggtccagcctctcggagttccacctcctgcttctcgtcagcggcggcggcatcgccgtctcatccacccgcgccacctgatcgagcaccgcgtctagcctctcggagttccaccttctgctcctcgtcagcggcggcggcggcggcggcatcgtcgtctcctccacccgtgactcctgctccagcaccacctccaacatctcgggattccacctcctgctcctcgccagcggcggcggcgtcggcgtcaccgtctccaccggttgttgcggctgcgggtgtggtctctcctcctcggcgatctcggccatgctcgggagcctctcgatgctgccccgccgccgccgccgctcttccttgggcgggagcgatttccggcgcacctcgtaggtgtccacagggatcgtcttcacctccggcgtcgtcgttgttcgcttttgcggcgcgtccacgtcccagctccgctcaggccgccgcgtccggtaaagctcggcgtcgtcgtagaaccgccacgccgcctccggcgacgtgaggccccagacgccgtcgctgtcgagccgcagctccgggtacgagctgctgctcttcaaccgtcggatccccgtgctcccgtagtggttgttgccgccgtagctcgccgccgccgacgtgttcagactcgcccacacctcggcggtcgacggctcctcccccacagcctcggcagccggcgccgccgccaaggacggcgagacctgatgctctctcctgccaccctcggacgccgcccccgccgccgccgcggtagaagccgagccggaagaggactccccgtcgccggcgcggccaagcaggccgcacaggatggcgaacgccacgaggaagaggttgacgacgtcccagccgctcttgaggctaatcccccctcctcgtcctcgctggtaccctccccctcctcctcctcctcctcctccccctccccatggcccgcctcgccgcaccgccgacggcaagagcatgagcacgatcagcgagaagagcagcacgagcacccacaccttcgccccgccggcgccaccattctcctcgccgtcaatgctcatgtacgacgtcgtggcgccactagcaccagggcccgcccccgcgccatcgccgctcctcgccctcgcgtcgccgtccatcgccgccgccgccgccgcgcgccagccaccttcctccctccctagctcgactcgattcctcagcacacgcacgccgcgacgcgaatccgaaaccaaaagcggggagcagctagaggttagtggcgagctttttggatctctctctccttctctcgcttcgctttggctttttgattgatcttttcgtggaattcttgccctcttctgttctctctctttctgactcgttggtggagtggtggttatataccacgcgaggtgaggtgaggtttgcttcgagtgaaggcaggttgggggggtttgaatttaatttttttttgggagggttatattacgcgacacgaaatgatttggttggaagaaagacaggagggagcgtacgtttgtttatttatttatttatttatttatggttaaggaggggaatgattagtcgttgtaatgcgttggactaggcgagtgaaaatgtttgattattattaagttagtagtaggagtagattattggctaattacgcggttttctgtgtccaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 66282 - DNA, 1420 bp, Oryza sativa
ctaactaaaaggtttgtgattgaatattaatatattttttctatttctgcaggtgaagtattatgtgataatgtgttgataaattgataaatcattggcagggtcttagacgagagtgatcctgacatacaatcaaaagcattggattgccttttaaactggaaggatgaatttctgacaccatacagtaaaagtctcaagaatttaattgactcaaaaactctacgtgaagagctcactacatgggcagtttcatatgattccttgtctatccagaaagaccacagaagtagtgttgttcctttggttatccgtgtattgacacctaaattaaagaaatttaagttgcttggttctcgaaaggtccgtatttacttagctaattgtttatgtaccacaatggttaaaatggatatttgttttttaactggcacaaactaacacctgtatatcgtgctttgttgtgccagcacacaggggttagccatcgaaaggcaattctccgattccttatgcaatttgattcaaatgagcttcagctctttttctcgttacttctgaagtccttgatccctgggaaccttcgacttgaaatatttgggtctcagtctgacaacctgcttggaaatatttctgacattgtggaagcttcaacagagatctgtttagagaacctaacatggaaaaaagcaaatggttttcttcatttggttgaagaaatctttggtacttttggtatggcacttataagtccagttcttgatgttctattgctcattgttgttcgcttgcttgagagttgcatgcggaatctcagaagtatgaatgaagaggactatcctagcaagcaatcaaatgaccctgatgacgaatgttctatgactctggaagctggtaattctatgagcctgaaagaacactcaaaagatctgccctcagcagaccataacaaggtgtgtaaatacttgtgtgttgcaacggatttcaaataaacatcaaattttctaaacttagaacttgtatggccacagatatccttttagtatgatggatatcaagaaataactcatatgatttgcaaccaaacattaatctgcaaacaactctacagaggttgtggttgagcgatggccgatggcagactcaccattaatagaactactttttaagttagcccaactatagtgattatgtatcgtgattcatgcaactagtccaaactagttaagtctattgtagttcattttttcttgtgcttgatatcaacaaaacgtctcctatcgggtatgataatatatccacgtcgccaatcttaaacaacagtgacaggtatcggcttggatccgtaggcatgaaggtgcttgaaactgctgtcctatatgccttggaaaaagcatggtgctctgactgttcccacttc

SEQ ID NO: 66283 - DNA, 7893 bp, Oryza sativa
atccccgatgacaatctagtggttctcaccattcccttattacttatacttatcagtccctaatggttgaataataaattatagcaaatagaaaagtacaaaattatatgaattaagcctatagctcataaagatatactacaaaattacatgaaaaaaaagctcaaacttagatataaataaagtaaaaccatatactacctccatcccaaaatgtttgacgccgttgactttttaaaaatatttgaccgttcgtcttattcaaaaaatttaagtaattgttaattctttttctatcatttgatttattgttaaatatatttttatgtatacatatagttttacacatatcacaaaagtttttgaataaaacgacggtcaaacatgtttaaaaaagtcaacggtgtcaaacatttagggaaggagggagtatatagtagcaaactgcagttaaagtaaacaaaaaaaaatgcaaattgtgtagcattgcaatttcaggcttcgcaatgcaagtttaggtgactgaaacgtctaaaacctaacaaatctctattatattgttagaagagttgaagatcaaaagtacagaactgagatcattcacaatgtcaaaagagactacaggagttaatatataagagagagatatgttcatttatttaattgagcgtaaaacttgtacattgcgtataaaatcacgggcttcttagaggtaaacagagagcttctctaaaagctcatccaacaatattcgttttgacatctaccttctgtccaatctaccatgcacctatacgttttaacttgtgtcataactcataacatatatatactgatgggcttttagagaggccctcaggttaccttaagaagcccataattttatacacgatcgtagttttatgataaactgtatcaatatttatacgatattatatcaatatttatggttaacgtggaagctataaaatattcaattagtataggcatgaatatttcgtatcaactttttaagaatgatagctagatttatcttcaaattagtttttgaatattataattttactatataattgatgtgtgtcatacacgtattaatgatcaaattagtatcttagttagtgactgtgtcgttataaaatgctactcctacttgcgacaggagacagtactaggagacaattaagcctacagtcacactcctccaatcggagctcgatcgggactccggaggacgcggtacatttcgatttaaaggcagggagaagtcgatgtaaaactacagcgtttatgtaccctgcagcatcggcatagctcctgtgtatcttcctgccgtcctcgtagctgcttagtactgccaaagcacgcatgaattgaatagaactgccacggcgcagcgtcgtcatgcatcttgcacatgatgtcactggcaactgtgcacgacgtacgtgaggtcactggcaactataaaaaattgagtctcgctccggtactggcacgatcgcgtacggagtacactccagtgctcctcggcataacgcgcgatgtcagtcaatgcaatgcaagcacctcatgtcgatcagctccatggccggatcggccggatctccggggatcgaagaacgtacgcccgtcgatcgcacgacggacaactcgagaagcacacgcgacgcgaccgctagcgtctagcgagtgatatttgcatgcatgcaatgcatatatgaacggcgtggcacggcatgcagctagctgtagtagcgtggatgtggcatcttttctctttttcactccggttttgacgacgggagagccacgcctatcatggtgccatcattagcccgcgtccacgcaacgtcaaatcgacacgttgctgatcttgaccctacggaggttgaagcagctagcagagtggcgatatcagattgcgacgtacccgcctctggctcatggaggcatataagagcaagcaggctataagctgtctaaacggatgagagaaaaaaggagagagaggagaagcggactgtagacttacagctggcttggacataagaacctctgtgagagagataagtgggtcctatattaattgtaaagagctaactattatatgggtaggctgagagaatgataaaaagaatcttatagccaacaggtcggctgtattattagccttactctgagcagaaagatatccggagcgtatttcccgttgatctcaacgttgggcggtggctctctatatgatgccttgatcactttgatttgtcaatgcatgtttgcaaatcgcaaccgatcgatactaatgcggctagatcggaccctacactaatcggtcctttagtggcgaacgttaacggtcccaagctccctcagacaacccaaatgtaaactgtaagtgctgtgactgtgagtaaacaaaaaaaaaaaaaggtacacaggcgccctgcaccttgctgcgcgttccatccgttttgccaggctgtgcgtacgcagagagagcgagcagaggggatactacaggtcggtagatgcatacgaatggatggctcgcctttcccgtcacgcgttcctcggcgggaaacgctcgtctcgtcacgcgagcggggagagagagaggatgcgaatgcgatggaatatcccggtaattgtgtggagccgtcgatccatccatccgttctccgttctgcgctcgctcgcgccgcggcctcggcgctcgagagagtatgctgcctgcctgcctgccaactgccgtcgtcacgcgcgtgcatgccatgccatcccgcctgcgaggctgcgaccgacgtgcagcaatgcacggtgcaaaaacgcccccgcccgcccgcctgtcacgtgacctcaccgcggcgccccacgcgacgaagcgcagaacaccggccccaccgagcgcatgcagctagtactacggctttgtgtgcctcgcaatttgcgtgctcgcatgcggccggagtagctgctagccgtatgcccgtatgtagcgtggaccatcgcgcgcgccccgccggcggagatgacctgcggctgacgccacgccttcctcgtctctgcactccacgcacctcgtctctgcgtgtacgtcgtactcctacatctgtccgccccgtcacgtcccaacgaacggtgaatgattgagacgatgatgatatctttttcttctccatttctctatactccgtggagtagctcgcaacaggggagagcagggcacggagattgcgtgcgtaacagcgtaaggaagggtcgtcgctcctttgccgttcttggcaagtactagtactacacttgagtgtggagggtctctcgactcttgagtgaccaatagccttttcaccgaacgattccgcgaatccccccggtgcacggagcctgctggatgacgttatacatacgtgtgtgtacaacacggaatcggattttaactgtggcaacaaatgcgtcgtgagcagtcttatgttgggtgaagaagaaccaaacaaaacacaaacttgcatgcccagcttagagagagtacccctacgtgccattttctcccagcgcgagaggcgcttccataactacagtgccaaagatggactcaccctggacctacgtagagtacctcctttgttgcatgcatgcatgtggtagagactggctcaccccacgattgctcgatcgcaatcactcaatctcaattgccagaagattcgggatcctgtactgtgagcatgcatgcatgatctatcgcaggagcatcaactgcattgcattgtttagtccggtctcttcttgcatcgctcgttgctcaacaaatgcttcactgtggcgcacacagtcgcacactacggtccaagctactagttcaatagctaggctgatccatcttccaactaccccatggtccaagcctaaagcctacaaacaatatactcgatatagggatcaatattaatcgagcctcaaaaaaatttcatatttagggagtgaaagaataaggcgagagagagagagagagagagagagagagagagagagagagagagctagagctagctggtatttgcatgctttgtggcgatcgagagaccattggatatatatatatatatatatataaaatgcttctgaggtggtaccgttccattggatttttcttccatttgcggtaagctggcgtaacacctcttcgatggtctggaccagagtaactactcccacaatactacaccaccctacgtgccaggccagctagcctttatctgctactacgtttttacttatcgggcactgcatcacttgcttggaattttaattgcccctacctcgaaagagaatttttaggttctaaaatgagtactatcccaatcgatgtaaaagttcacatgcacgcagttaccctctttttgacttgtctgacttatttttcacctttttttttcgatttggggtctccaattcacccacttaattttggtactctttgcagtaggattattctaccacctcctggacaattcactaattggaagtaggaatatatgcaaactgttatgtgaaatgaaggtgggacagctaaaacatataaaaacaaaatggacggattgagtttttttgaatgaaaatggagagaaacccataactgtttcgaattgaaaaaccatcactttctaggacacaattagattgaccaaactttcacggaactccaagttagccatctctcttgtggctgttccaatcgtcgcggcaatcctcatttcattttgtataacggtcaacgactcgatcctagccccacccgttagtgctcaaatcgtacaaactgccatggtattgagacataccgttcgcctctcatttggcccttaccagtcagcacccctattgtatggtggccctgtctcccattgtgccacaacccacacggccatatatataccaccgtacgttgaacacgtaccatcgatcgatcagccatttgttgcaactcttatccgacggtttggaaatagaacttggcgatcgaacaacgtaacggagcgcacgagacatataacggcgcggtgttggtggcagacgtacgccgagaagaagcgccgagccgagcgtgatcgatcgatcgatggcagtggccgtggccgggtggtccacgtacgccactccgcgcgattaggacgtacacgccgggggggcccacggcgcagtgggcagagaatcatcaatgattgagagcaaatcgagagacggggcccacgcgcgtactggtgttggtacacatgcatgctgccctagacccagggaacttgttgccaaggcacggcgcatggagctcaactagcgagcgtagcatgcgtgcgtatgtacgtacgtacgtgaccagactcaccagactgtggtggtcacgtacccatctatccatgatcgatcgatcgatcgggcaggcatgcgtgcttcgagttgggagggagtgtgcatgctcacggtcacggctttgtctcttgcgctccggccacattcctacacttgtctgcttatggaagctatggttcctacgttatgtatgcatgcatcctgtaggcatacttttggttaaagggttgggatgagtcaggttagattaaacctatttttttagtgtgcttgtttgagaataggtgagataggatggtctctgacaggaaatattctcctaaaattcgggttagtatggtcccttaaaaatgagtaaatttcataaaactatatatactttgcacgatttatcataaaactacagatttaagaacttatttcacaaaacttcagattcaatgtctttgtttatcacaaaactacatgcactttgcataatatatcataaaactactgatttaagaatttgtttcacaaaactacaaatttaatatcttcatttatcataaaactacaggtttagtgtcttcattatcacaaaactacatgttttagcattgttaaacctgtgataatggagacactaaatatgtagttttgtgataattaaattaatacattaaatgcgtagttctgtgataaacgaatacactaaatctatagtgttgtgaaacaagttcttcaatctgtagttttgtgatagattgtataaaatacatgtagttttgtgataaacagacatactaaatctgtagttttgtaaaacaaactcttaaatctgtagttttgtaacaaattgtgcaaaatacatgtagttttgtgaaatttactcaaaaattggcgaaccaatccaacccactttttttctcactgacacatgagccattacttcaaaagtgggatcatcccatcccttatgccaaactaataatagggatgagtccaatccatcccaccttatccccaaaccaaacacatgctaggagtaattgctgccgcaaataaaaacataggaaaagcaaaggaaaattcaacgaaggaggatcataaggtatatcgtataaactatacctcaataaaaagtttatcgcttttaaactgtggctgataagctagccgtgaaaaataaaatgaatgtagcaactaaaaataatttacggatgcaatttttatatgatattaaccgatgttttctgaaatatatgttagaaaataaaccatgatgaaaacggctcaaaataaactctaaacttaaggggggttttttttctgcaactggtaaatcaacaagcatagaactattagagttataacttcaattcagtaacggcaagacatacacatctatatacttgcaagtgcatcacttatattccgtgtttactgcattgggacacccgatcttccgttaggtgaagaaactattgatttagcggaaacttgacaaacataatttggcttccgatcaaaatgatctaaaccctgcaatcgcagcatcatgtctcctctagttatcaaccgtgtcgaaacctgatggatctcgccgagaaggctaattcctatgcaaatctcgaagaacacaaattagaactagaaagataacaactttattacagatgaatgattaattaagaacacaaagttggggttccacaaatcgatctagcggcgaaactgctatgacagaaataatctaaacaaaacctgaccttaactcaacgacgactattgaatatatatatataggttttagagtcgaccttggacccctgagcgcatccctattggactacaacacgatacatgactcaatgggcccaaagacgatgatgcaatacccgaatagattctggacgtcttcttgttttgtgattcccattgacttgtaaggaactttacatgagactagatccattggaaatgtgatcttgttacctttccataccgttgatgcgaaacacggcggcatgggagatctgcttaactccagtgcaggtccaaggctagccttgtgtgtgtcaagagcgtgccagctgatttgatcctgcaatcagcaagaaagataaaagcagagttagtcagctgatagcgtatcgttagtggtctaagccgatgtagttagaccaaatcgcctatggaccggatagattaaagaataaaagaccctaaacatgtctcgtctgctatagtgttgttgttaacaacggaattttgcatcagattcggagaagaaggtagaagattgaagcgaatttggtgtgaaatcgagttggatttggagtcggactacacatcggctggataccgtatcagctagaaacagagtgcgagttgataaaggttgatgaggcagatggctgatacagccgatatggtatgatttgggctcggtctgggcctagattggaataaccatatttgccaactagagatggagcttgattaaggcaattgtatctattaattggatagttgagtcat

SEQ ID NO: 66284 - DNA, 3482 bp, Oryza sativa
ctccacactataaatacccctctcctctccctcattcacacacaccaaagcatgagctgaattacaagaggctctagtgtattttattgtatattagaacagggagagagtaaagtaatggaagtcggaggaattccggagttatcggtaaccctctcttatctcttgtactttgtttattattctgctttaatagaaatatcattctgagtaattaaggtttacttagtgagaattacttcttggttagttcctaattagcatactggatcattgttcactatagtctatttatttatagtgattgctttagtgtttgatcggcactagagtagttattaattgcgtagacgcggtgtctgggtaattaatttccagtggttgctgcgtatcccacagtacgtttgaggtgggtgtagaggtggtgacagccctcaagagtacttaagtcctcactgtccggatacgtagtagagcgacatctgggaacagcgggttggcagtgcctgaagtattgcgttaggattaaacttaagctttccctggacactgcttctcattaggaaatcctctctgccctctgcccaccttagctttgtgtccttagatgaacctgacgaggagataatcacacacgttccttggattcgatacccttggaatactccgtaggggaagtgctacatcggtatatccgtgcacttatggatcttatctgtgatcgtaagaaataccaacagtagttacacttacagtgcttgatccaacggcttgcgagctgccacacacatccatgcggccatgcgcggtaactactccctccgtttcatattataatataagtcgtttgactttttttctaataaaatttctttaagtttaaccaagtttattaaaaaaatataatagtgtttttaacagaaacaaatatatttaatgttaaatttaatgaaacaaatttaatatattttagatgttgctaatttttttttacaaacttgatcaaacttaataaagtttgactagaaaaagtcaaatgacgtactacctctgtcaaaaaaaactatagttttacaccgtttatgtctaacgtttgaccattcgttttatttgaaaattttttatggttagcatttttattgttattaggtaataaaacataaataatattttatgtgtaactatttttgtaaaaaaatatattttttaaataagatggacaatcaaatattggatatggaaacttatatcagtatttaaaatgagacgaagacactgtaatataaaatataaaacggagcgagtagctcgtacgtgcagtgcagtgaatcctcgtcctagctagccatagtaaagtacaagtacgtagcaagatggactcgctgtcacctgcacactcaccaggctgatcaccataaataatatttccagcgagaaccttgactgtggctttcaaggtgatgatcctcagacgtacagtacaggtcgatcacttggagttgagtcgtacccgtccatcgacgtcttcgcagttacaccattaattgctctgtcgcaattggacctctaatccacaccattgaagagtggatctgtgctacatcctgcgcctagagcgcgtcacggcaataaggtgcaagagtagagcaccagtgcacggctcgccgctcgccgctcgctgctgcctgtctctgtgcccatttaattcgatccccctaggctcctctaacctcttcgcgtctctgtgtacacgtcacatttcccctgctgcacagcacgactactcatcttttcaaaacagatacggtttaggaggagctgaaattgtacgatttggactactaaatataaattttggtgtgcaaaaaacaacctagtttcatatatttatatttatgtccctatataaaatcatttgccattcaaatagcaaacccgaatcccaacgaaatttgaaggaagaaggcaaaactcttgcatttttctttttttttacagtaacacaacaggggaggcctccctgttaaagagattttattaaaaaaaattaaaggtcaaaaaaagttacaacgaaagagtccaatctttagcaacatctctatttatttcatttagcctaaacaagagaagaatgaggtctcccttgaggagttgcctccacgaagataatgaaagaggtttatggaaaaaataaatcaattttttttgcttccaaatgttccatgcatctgtaagaaattgctccataaaacatcttcgattataaatggctttggcttccaatatcatgctctgaagagcaatggaggtattccatactatacccaatctgttccagcaatcaacaatcaatttttcgttttgttgcatttttcttcaaattgcaacgaaatgaacaatgaaaaaaaagaattatgtaaaaggaaatcgacacgtaagcactcaaaatttgattgtatatgtatcttccaatagagaagagaaatgtggtaatatggtatggatgcaataattattccaatacatattccacaccctagtgtgcctacacccactttgaaatttgaacttgtgctctttgggaaattataagaaacatggtatacatgtaaagaagcagatactgagtttttattaaagttaaataaaacaaagacaatttttttctagtacattttttatttttagatactttccatgtaaacattttatggcatgcattacatgtagtatatttatttagaatttttttagtgtgcattgcatgagcaaactgagaataagtatagctagctagctagaaccattgttcacaaaaccattcgtaaattaaaacgtgagttacaaatcgctcgttcaatcagtcaatttttttaaaaaaactaatactaaatttgaattttttaatatactttattttaattccagccgttctcactagttctccaatggtttcaacgaaaagaaaaaattaaagctaattaaggagatctggtaaaggcttttagaaatcagaacattggctaaaactttgctacacaatctctgtgttctaatatacaacgcattattgttttccataaagtctacatttgaaaaaatggactaacaattaaataaaaatatgtgtttagtgccatgcaagtagcatttttgtatttgtatttgaaaacattttttatgatgttgattttgtagtagatggtaatatattacgaaagagattaatgatcaaagtataatgttggaacaatatgaaaggtttaatataaaaggtttattataagcctagccacttattagcgactaaaataatttatggtaaaactattatataaatgtttttagcaactacctatgcttaaaaaataaactaaaattcaaaatttaactatgacagatgagaatacaaatcatgtgttgtttggtttgtgcaagcatatcaagggggagaaatcagttatatactacctctgtgacag

SEQ ID NO: 66285 - DNA, 2638 bp, Oryza sativa
tagataagatgaatagtcaaatgctaaacacgaaaacccacagctgtattttaaaatgagacggagatgtaatcgatcactcccaatccatatgtaagtgacacaggcatcccaatgcgcatactatatgtggcaaggcattcttggtgctgggctagtggccctctctggattatgttggattttcaatccgctcggcttgcgtgattaagagggcacaagtggtcttccaaatttgcatcccaaagacaaggacctagctcccacctacaaaagcgtatactagtgtggaccaaaaccccttaccacggggcacgggccctcaccaagtttcattcttcgtacgaaactactccatgaattcgcattgcagggctccaaaaaaaacaagcgaaatcctacagcagcagtattgctcgcgctgcacctctactctagtctgccaccggcgaagcgcgccgctcgagccttctctccaaaaacccctataaaaccaccgcttcgcacagtaaaacctccacctagttggcagtaaaaaaagcgccgctacctacacacacaaccgctctgcacaaggggccatggacaacaagccggcgcaagaacgccgcgagacgtgggtcccgggcgccgtcatcgtcggcgcgggcccgtcggggctcgccgcggcggcgtgcctcgcggcgcggggcgttccggcgacggtgcttgagcggtccgactcgctggcgtccacgtggcgccaccgcatgtacgaccgcctcgctctccacctgcccaagcgcttctgcgagctgccgctcctcccgttcccggaggagtacccgacgtacccgtccaaggaccagttcgtggcgtacatggaggcgtacgccgcggcggcgggcgtcgcgccgcgcttcggcgccaccgtcgaggaggccgcgttcgacgcggccgtcggcgcatggagggtgcgtctcgacggcggggaggtgctcatggcgcggtggctcgtcgtcgcgacgggggagaacgccgagccgcgggtgccggactttcccggcatgcagaagttcgccgggtgtgccatgcatacttccgagtacaagtccggcgagcagtttgccggtaagaaggtgttggtcgtgggatgcgggaattctggcatggaagtgagcttggatttgtgccggcatggcgcgaagccctccatggtggtgcgcaacacggtaagaaactagttaaactgagcttatgctttagaacctatctatcatgctctgtttttcccctgttttttttgtctgtatttgatttatctttctgtgtgtcacatcttattgtcattggacatattattgtcatcttaaatccgttttcattgtgcatggctgtattggatcatattcaggaaggagaaattagacctgttaacatcttccattccacacaactttatatgtcgggtgtcttgtcctatcaacagccgtttctttcttccattttgcctccccctgccctccgataattacgcgtgtcattttcattacattattatgatgacgggttacacaaatctaagcgccgtggtgatgtttcgtccaggtgcatgtcctaccaagggaaatgttcggtctatccacgttcggcatcgccatggcgctgctgcgatggctaccggttcagctcgtcgaccggttccttctcacggcggctcacctcatcctcggtaacacggggcagttcggcctaaggcggcccaaaacagggcccatcgagctcaagaacctcaccggcaggacacccgtactggacgttgggacgctagaccacatcaaatccggcaaaattaaggttagtgccaaccattcagctagcctagctcctttcaagaaccagtagtagaaactgagaccagtcaaactgtcgagctgtacatgtgagctgctgggcgtctacttcctaatgtggcacatcagctattcgcacatgcagcatgtacatttctcttgtggaaaatggttctcatatggagattcatttattttatccctgtgggttttctcctgtgctttgattgatgaggcgctgatgggaatcatgcatcactaggtagtgggagcagtgaaggagatgacgaggcaaggggtcaggttcacggatggcaaggaggagcaattcgacacaataatcctcgccacaggctacaggagcaacgtgccatcttggctcaaggtaaagcagagtgtgactcactcttgttcgttttatttttctttctgtccgcactgcactatactactactagtgatatatatctcgagatgatacggattatatggtcaactgtcaagcccaaggatgttaattatatgtctatatgtacgtgtgctttatgtgttgtaggatgccggtgacttgttcacgagggagggcatttccaaggtccccttccctaacagctggagagggcggaatggtctctacaccgtcggattcactcagcgggggctcctcggcacgtcatcggacgccctcaacgtcgccaaagacatacattgccaatggagagaaagggaccgatctgctattaatgtacttgaaataagcaactcttccttttgatttgactggaaatgtacagtgttttgattag

SEQ ID NO: 66286 - DNA, 6475 bp, Oryza sativa
tatatcaatactcctttaaatgggcgtaatggtagccaccaacttcctattttctttgaaaagaaaaaaaaatacagtgtgaaaaaggaaaaataatgattaagtgggttactaataattttcttgaattaaaaccctgtcgcaatacacggaaagacaacatgctagttagcatactgttgttaacgccgaatatacttttgtgcatatatggtcagcgggtgaaaagcatcacatatttgtgctgatctgataaaaacccatttagacaaatatggttctgatccaacccatcttgctcaccgaggttcggcgttgggccgcaagcccacaatccaggagatctacaactttataattaatatattttttcatttcagatcgtttaataatccaaatattccttacaaaatctctaatctacgttacaaacgacttccaatatagacaaacttatacaaatgttgtagatcttgacgagatctacaactttgttgtttaccagcttttatttaggctgtgttcggaatcggacgttcccagcgtgcacagtaagtaccgaaaacttagcggtctattagcgcatgattaattaagaattagctattttgtttaaaaaatggattaatataattttttaagcaactttcgtatagaaactttttgcaaaaagtatacattttaatagtttgaaaagcgtgcgcgcggaatacgatggagaggggctgggaaccttcagttccaaacacagccttaaaattgtttagagtatcaaataagcattattagtttttttagcaattaaaaccgacaagaagatctaaatgcaaaaaaaaaaaaaacatgtagaacccttctcactaggggtggcagcagggccgggttggacagaaacgctcccccctcctcacattcctccccaccccgcattgcaaaccgggtaacccaatgcacccgagcccctgtgaggacccagcgggagagcagccctcgcatttggcgacgttgacggcttgggggctacagcgaggagtcgaacgttagaggcaccgatgacagctgagggcggcgagccgacgatgaaagctctaggaggcgatgacggatagaagcaggtgaactttagcgcgtcgccatctagttggggatgcagcaactggcgagactaaggggacaaggcaaggttggcatggatgaagacaatggagtcgggacagagtcacgagatcggagaagactgcaattcgcacggtgacacggagcagagatgtgtgacgatgtgcggcggctgtggaatagggaacaaaactcagggttttttttttccaatatatccaaactctttctctattgggcctgttgtgccaatatgttataggtgggttgtgggcttaaattctcagaattggctacttttagaagagtaattcacagccttgagccctgtcaggtcttccgttggtaacttagcatccctgcctttttcttttctccgttcttttatttttcggggccccacccccctgcccccaccccataagagtggtcccatcgcgtcctcagccctaacgagaaaattaccatccctacttctcgcactctagaagggtcaatttttttttaaaaaaacacccttccgaagggcgcaaggggaatacatatgtaaatttataaaagagaaaattatttgttaaatattttagctaaagagtaaaaagaattcttcaagctcaaccgcattaaccagccgaaagaactgaccgctgaatggcgactaacacaaatcatgagcattgtcttgatcatgcaattttgtacgcaaaatattagttagtagaaaaaacaaaaaaaagaagttgtcgtgcggtcgtggccgctcacgcactggtatgtggcaacatgtattttggtgccacaactctggaacaatacataaagaaaaaaaacctgtaccaattaatggaacattggcgatgattctaactaagaaaacgtgagggctaaccacaatcgtatttagctttattttttaaaaatatgtaagtaggatggtgcaaattaattaccttttgcattcaaacaatgcgaatttgcactaagaccttaaagtttgatggactagtatactctcgcaaggttttccccagattagcggcgaaaacggggcgagtatttcccgatcacccgctcgaccagaaaattatgggaagaatatatgggagagaaaatgggatacccgatattttcaggtttaaacctgaatccgtaaaaaatatgggttaggatacgagaaaagtttgatccgcctgtatgttctatattataaaacatatgtgaaaatctattataaattcacctataaacatgataaaagattagttaatcactatttttatgatcttacgtgtaatattatatactttgttccttgatgtatctttttttaacactttaattgcattcttatagtaaatatctattgaattagatatacaaataaatatccgttcccgaatcagatttgaagaaaaaattaatatgggatataatacaggatgagtgatatattattcaacattacctgtacccggttccgaaattaaaggaagatatgggaatgctatgatctgctcgtaccaggcccgttttcacccctaccccagatgaaatgttctacttttttaagtttttttatccgtactccataaaagacaatgcatcatttgcaatggtgactatgtagatatatagacttgataatcttaaaaaaagtaaatttcataaaaccctacctacataatggattttggcggttataagacagcgctacttcggatagataatggatatatagacttgatatctatccattatctattcaggttgcacacaatcacatatatttttgctatgtggcacataacctcagatattagggtatgtttcacaaaaccaaactattgatctttttaacttttatctaccatatttttaagttttacaatcacatcttaaaatttatgggcattgtatccatcatataaatcctacacccactttttaaaaattttgatataagagtacgtcaaaagtgttaacggtttggtttttatgaaactttagtatcataatacccaaagttacgtgacacgtgattggatcataataggtggggttttattaaatttactcaaaaaattatttgcaatggtaacaataccagtaatagaattaatctaaatcatcataaacatatattgtcaatacatttttctatagagaagtatttgaattttgacatattgtaaactatacagagaaattaggagcagatctagcatggaggcggcggggtctcgagcccctactactatcacaagtatcatgggagtttccatggatccccactaaaactttttgttatatagatggaaagggggaggtagttttatttagttttatttggtttcctacagatagcacatacggtactgcctggcagtggtaaaaaaggtccggctaatggacaaagtctcgtaactcccgcgaggaaaaaacacaaaatcgtttgcatggattgccgaacttccccgaccttgcagcacacgagtggaagcacgcccgggagacatcctccggacgtgctggcttcatctcaaccgccaactccagttccccgacgtgcatgtcgacagccatggcttcacgcagccgctgaggcagggacacgccttctcgcgacatggcgacgttcaggtcgaccgctgacaacttgtccacgcagaaggccggcacctcaccccatcggccgaccacgacgcggttgtagtacagcgctacgtcggcggcctgcagaatcgccgtacgtccttgcggttgtccacgtggacggtgagttggaggccggcgaggagatggtcgtcgggccgcgcagcgggtcgagcccctcgacgccagtgagctgaacggtgaaacggggaggaaataagttcatctgaggtccctaaacttatccacgaattcgattttcatccttcaaaaaaaaaaacagatacaacgggtccctcaactatgaaaatcgatactaagtccctcggcggtttggacggcggttttcactgacgtggtgcctacgtggctaatttgactcaatcttcatctgacgtggcatttcgatccgaaaaaatattaaaccctgtgggacctacatgttagtttcacacaattaattaaaaaatagaggccccacataggccccgcatgtcattcttacccctacctcctctttctcctccatccccatctcccctctccggccacggtcacagcggtgcaggggacaacgacctcaagaaggcagacaaggccggtcttgactcttgacgcccttcccatgtcctccgccactcacctcggcggtacgctcggccggtggagagaagaagcgcagtggaggtggcccaagcggtgagagtggagatcggagggagttgggggcgccgccggcagattgctaccgctctgccccaccggcttcgcgcgccgccaccgccccactccaccccgtcgctctgccgggctccccgacggctgcgcccgctgcgcaccagaagacgacgatgacgaggctggcgccctccgcttggctccacagccccgctggctccggacgccgcccaaaacaatggcgttaatcatgttaggattccacattcagagagtgagctggagcacaacattgattcttgtgcagagatcgatggatcgattgattctgtcgccaacgactccaccaattctgtccagggtaagagcaggtacaatagcatattattaaccagctataaatatatttttaatgagatgatgagctgcagaccaatctgtttattgacaaccacaaaactaaaggagttgttttgcagataatgaacttgaaaaccatttggatcaccacccaaacaagcacaaagtgctaaagccaccgaatcaacattcaaacgaaacttgaggtgggaaaaacataccaccaacttaaaagaagacgatctagcgaaccttggaatgaaatgcacaggggaagagaatcgaggcctgatttcttttgcaaactccaaacctggagagaaatcccagccatcgacaaaagagagatccgccatgaagaatcatgcgaagctcagaatcgccctcccgatcgccagtccgaacattccggatcgcatacccgtaaattttagtttggatttcttccttatcctttccgctagttgaccgttaaattcttatgaaaaagccaattttaccatttcctataaagaaacataataaattaatggagtatattgtcggagcgtagaaatttgttagctgggctattatatttatgtgttagctatcaccgtattatttgcaataaatatgcttttagatataacataaaaattaatacttatttattaattagttattaaaggttgtttatgaagcatataaatatatttgtcttataaaaaaaatctgttgtattactatcaaaacacatggtgcataaaaaacttttattaaataataaataagtattaattttttatatcatatctaaaagtatatttgtcacaaataatatggtgcataacgaactcataaatataatagtcccacccaataaatttctacactctaacaatgtagtccattaatttattatgtttcttcatagcaaagggcaaaatagactttttcataagaatttaacggtcaactagcggaaagggtatgaaagagatccaaactaaaattcatgggtatgtgagggaatgagcaaagtttaagggtgtagacaactgttaagtaccaaattaacaccgtcaataccagcataaaaccataaaagtaaaacatccaatgtagtggtagggtttatttctaaccatttccacgagtgttggtgtatatttggatgcaggtgacgagccaccaaagttgagacaaaagatacatgatgaggtgaattaaactcccatattcaagcgtaatgaaacacattcaaatgggccaattgcaagtacatttgggctgaggggttctccaccagagcccacgagaaaattcggagcaaaataggccagcaagggtttggcgaacccgtagttgtgccattcgaccccatacttcacaggtcggcaattaccgacttgctatgacggtttctaccgactttacctgaacaaccgtcatcagctggacacatagcaagatgagagtgaagatgccatttagatgcttagcatctccacaatcccaaggcatctctccacctataaatacccatctctccctcattcacaacacacaccaagatgtagagctgaattacaagaggctctaagtatactttaggttctttatatgttctatagtatacttaaaatagggagagagtaaagtaaaagaagttggaggaatcccggag

SEQ ID NO: 66287 - DNA, 7594 bp, Oryza sativa
tctaacccaacacctgaaacattggtatgcttcaagaccataaaatttttatgtaaaatgatactatatatgatctgatagtctccaacacaacacaccgtgtatgtatcactagttatagtgacaagtgagtaactgacaactactccatgcgattgcaagaccaaatgaggtgcaaaccgtgtatgtatctactggaaggtcagagcatctatagtagtaatacctgaggaatgttaaaggggcagattgcaatcaaccacacatagggggaggaggtgatcgatcctctttgtagctctcggggacaaagcacgacactggcataacatcgaacgggtcgcgagtgaggaggtgatcgacccaccaggactccactgtcatgagaccacgctgtggctgtcccatgggcgacctgggaggggtagtcgatatcctgctcagcacacccccctcttcgacgagaaacagagtagcgtgccgcgtcgctgccgatgatggggttgaactcggggaccaggtatctgccgccgccgggggcgatggccaagctgaggttatctgtgtgggcgatggtcatctcggggggccaggaggcggagagcgctcgcagaaatggaaaggtggagcgtgggaaccatgtgaagtagcccttaagtagggattccacagaacgagcccgcgccccaacttgtcgatgatgagcgggcctgtgtggcggtgctgcgaggtgaagaagaggagacagggggatgtcggcggcgaggacggaggggaagttgtgtattgtggtcggggttggcgcattgtggggccacgacgaagatggcgacccatggcggcgtggagggtgtgagggagagctctgcactgccgagctcggcgtcggttttgtagcggcgagcatggcccacggcgctgccggcgaggatcccattggaggcgtgtggggttttggtggaagaaagtggagaggccagggtttgatgtctgtactattttgaaatcaagatgcgcaggcgtagcggagcaggcagagttaggcaaggcccccgcaaccgcaactccgcaagcctcaattttgcccatttcggccctttgcataaatttattttatgaattattccttcgaaaaacttttcttgttcggtttagaggggactgaaaagaattggagagtattgaggggaaataattccacatctaaaataaatctccttcaatccgtccctcacagggattaatcgaacatgtaaaccctcacagggattaatcgaacacgcccttacatgggaggaaatttgtgtagaactagtgggattcattacaaatgaaaaaactcatataaaagcccgttaagtgcagaaattggtttgaaggaattttgaatgatagaaaatattccttcatatctcggaggaattctaacatgtggtctcatctcatgtttacacatatctttgagaactctaaaataatatataaatcttactccctccatttcataatataagacacaactattttttttatattccataatactccctccatccacaagaattagatatatttcacatttgagtttttccaaataagttgtttctatttatagtctttatacatccaagacttagggtgtgttcgggagtgagggttaggaacccaagttgcctagcacgcaaaacgaagcagcatttagtgcatgattgattaagtattagctaaaataaatttgaaaaatcgattgatatgattttctaaagtaactttcatatagtttttttcgaaaaaaatgtaatgtttaacagattaaaaaacgtgcgcacggaaaacgatgaaggtgagttgggaaagtagagagaagaactcagccttaaattgagaggtaaattatatgtttgattaaaacccaacaagccatgtaaatattcattggttccatgtttgtattcattctttgatctttattacatgcaagatgagttaatttctcattgatcttggtgacaaaagtaataggtgtaactttttttgaaaggaatgagtataaggcatgcatgcatgcatgcatacaattaactaagacctcttctccattaaattattactcatttttttaaaatcatctaccctcgagatctctaattctatttaatgcatgcattacatttattaggatgatccaaactatgagatgataagaattgtttcttggtctctaggttagagcaatttgaatagtatagccaactacaggctccaaatcatctatagttattttaatagccatggagtaattcatacccggtatgttgacctacaagtagtgaaactactaggtaggtccgtcggtttggcacgcaaactaagaccaaagcaatttatgtgtacttaatgcaactttgcaagcaaaacaatcaagatttaaattataagagcaatatggtcaaggcctcaagggtgacttttcttgctcaaggtgttcacgacacttctcgaaatctgcactcgaacataattccgataaagtagtgaaaatattcaaaatcatacacaaagaccaataagaagaccttatttaggactaataatagtgccaatagatagatcacgattaggggtgaaaatggtcggaaacgatcggaatcagtagcatctcttcagaaatgatgctcgatcggccggtaattgatcatatttatcatttaaactactcattatcgatattaatacgatgaaaaaagaattgtgaaaaaaaaaaatttaaaaatagccaaaaaaggttacggtcggaaacggtactcatatacggaaacggcgctcggtcgataaggaatttccgccaccattttcacccctaatcacgattttagaggattactggaagtggaatgaagtcaatcggagctacgtatatgaatttctagagattaatttattttgaggaacaacagaaatgatttttggatttggaaaataaatattccaaaggaatattcatttcgggctgacaggtgggacctgatgtgagagggattgaggcttatgcctctagggttcctgtagacttttgacttacattgaccaaaggatgtaggaatcgataccgttaacttttgacatacattaaccattcgtcttcttaaaatatagaaaacaatataaaccatgctcaaagtatctttaataataaaataaatcatacaaaaataaattataattacataaatctattatatactaaaagtcatttaagcttcctacaaatactcttaggatgcgctctaaaaaattagagaaaatccaagcaattctgagaaaaaaaaagcaaaacatcttgcctttaattttaatttaatacagtggacccattttttaaaccattggattacatctattaaaaataaaccacctaatctctcgtctgtacatacaacagaaaaaatatgtaattattcaacagagagaaaaatctcttgtgttatgtacatacgaaaaaagaatcaccgaagaaaaactacgtacgtatgattgggaaaaaaaacacgattaatccttcacccctaatcctcacattaaatatattttgattaaaaacatgtcacatagaactaaagtctatccttttttcatttcattctcatcctaatagtgttacaatattagtgtccaaatgaattaaaaataatagattattccataatatattaacccatgcatgaaccatcaacaggtaaattagatctataatacagaggaaaaaatatcaacacccatattaacccatatgtttttgaaggattattggtcgaacaaatattgttttcacgtgattctcgccaccgaatctattagattttttaaggcagattgtaattaatgtggacaatgtgatcaaatgaagtgtcaaatttttcttaaaaaccatatcaactactatgttttgatttaaaaataatgacatgtaggatcacattctagccttttacatgttgtccaaataattataaaaagaacatagattataacatatattactaataagttataagtgctcaaagttggaaccttaatagtactctaagctgagattaaactttttaattttggctataaatgactttaaaatagagttaatttaatccatgatattgcaaacatgttatttcagataaatgctattacaatttgtctatttgtagttgtgccattgaaattttacaaaattagaaccgtgccactgtcgtcacgtttgtacgatcaaacacaagtaaccaagtctaccagagggggtgaatggtagataccgtagattacgtcagcggaagtcaaataatcgaatcttgacagatcaaaacacaccccaacctcaaaagccaatgaaacacatgtaatccagtctatccgacctactagagtcagtctgaccgagcctggctggtctgaccgcaggtcactcggcggtctgaccgtcagccctaaaaacagcacgacagcgtttctgtaaaaacacgatttctcttaaaccaaccgttggatcgagttgcaaacttgatagaataaactagacaaactaaggaaaaactccactggagggatttgaaaaataataaacggtttaagagaaaacaccctcgaaagtcagttgtctcagagtttcagcaaatctgaaccctaaaactgaagcaaattcaaatctaacaataagccaagtttgtgaaattagatagggtttcgtgagaaacttgtaaggggtgcattgttaaatatatgatccgaattttgggcccacaatatatttggataagttttctaatagaacttgactattatgattagtttcctagtttgactcataagtctttccccactaggactgttagatttatactatatatattccttgtaagccacacggggagggtgcgatagcccaatgtatcccatgcgtatgtatccaactcctcaatagtgatcattgccggtcaacgcccatggtttttcccgcaagggttttccatgtaaaatttgtgtttcggtttcgggttgttttattgtatatctgtggatagttcatgtttatggcttctagatggatactatgcgtatgtaatactgtagttttctaataatgagtcacgttggagatagtttggaatcggaatatggtttctttgtttgattcatgtgtaggtgtctaaatgcctcgggagagtattgccggtgatgaatcgggagtcaacttggagataaggtgacgtccggatggtcagatatcatgcgggattcttaggctaaagatcaatgcacgtgattggtgaatattccatatggcatatgatggagatattgtgtgcgtatgggatgtggagtcgaatttggaaggagtccaaatttggtataattggagtttgtaaagttggtttcttgtactggaaggtttcctaggtggattaggacttcttgtatgagtttggttcgtggctttaggcagcctacctcatgtataaatagagagggagggtgtggattcccggtatcactttagagagcattgagttgagagattaattagggtttcgagtttggtcgagatttttgtgaggtgtgctgctgttgcactttgtaaacatagagagaagtaataaagttgtcatctactttgagatatcttcaatttgtgtttgcacgggttcggcggtccaaccggcgggataccggcggtcaggccggcggcattgcagcggtcagaccagcggcgacaacaggcatcggcgacaagttttggcggttagaccgggagatcaataccggtcagaccggcggctatggttcggtcagactggttaatctactccggttagaccgcaattcatcgattcaagggtaacttttatttccgctaaaagttttggtttttgggtacaccaaccattcacccgtctctggttggcttagttcctgctgttcggtcatgcaacgttctccatccatttcctcatttgcacgggggcccacttatcagattcctcttcttccttccccatctcagcgtcatggcgaggagagagctcctagaagtagttctgtgcgttgttgtggtggaacccctggtcctgttgccccaagagggaaagcgagagctagagcgaggtgagcgggtcatcgtcgacgtccccggcactaatggcatagaagccgcgagggcgtggaacacctgcgcacttccgcaccccatggataaaaggcagtctcggttctggttggtttttttaataggtgacgattttttaaaagaatcggcactatatctatattataggtgtcaattctttttacaaaccggcatctacagtattggtatcggttttttatctagaaccgacacctataatgtaagcaagcataggtgccgattattttaaaaaaccgacgtctatagtattagtaccggtttttttaaaaaccgacacctatattgtttaaaagtgtcggttctgtattttttcattgaggcagaagtgggagaaggtttaaaaccagcacatgtgagccgacaccaatgaaggtttttgttagctgaacggaaggcccatgcacaaatatccaatacggcatgagttgtggatatacacgttgcctagcaccatgccaatcggacggcataaaaatttgattgaatcagccataaaatctgtcgactgatttttagcaacaccatacttttatactcttcttgcgtgtttatatattttcttaaataaatgagcggtgaaaagtttaggatataatacgagattatttgaagacagagtgagtactaattacagcaacccgtgcagtggtacatcatgtgaaaaaaatagaaatgctagatgttgtatacagatcgctcggtctcggtgactcaagagaatttagaaccaagagaccagcctttgtcaccctatggatctggcatgcggaatggacaccagagccatctgtaggtggttttgtaaggaagaacgtcgtcattcataaacaagtcggcgacgagtcgcatgtcgatctgcacctctagctctgccaaggattcgccacttgccatatgttcgtgcacgtcctgtgccagcccaaccagctcgcttgacgtggctcctgttactgtgtcacgagtcatcttcttcaagcagaagctgccggggatggaaccccggccaagcggggtccctgcatgccagacggagaactgccactctgaggtatacgcgtaagtttatatacgcatatgcaaactttgtatacgtgtattttttggattttatatatatgtaatactaattttttattcacgtatacaaagtttgtataaagttgtttatatacgtgcattttttggatttttatacgtacatataccaattattttttatacgcgtatacaaagtttgtatacacgtatttttttagatgtttatacatacacacaaactttatatacatgtgtatatatttttttacattaaaatagggtaagacttattctatacccccagtccactcctccccgtccctccctctcgctccccctccctcttctctcgctccc

SEQ ID NO: 66288 - DNA, 1719 bp, Oryza sativa
aaagtagaagtgttagtacataataggtacatgttaccactttcaagtagctgtgttactgcacataattgtagttttactatgtcattttacaagatgaagatcgaataggtgggctataggtaaagtctgtaggtggctttgagcgaggtatgattgatgtaagagtgttttgaacaattttatacatttggtaaaactatgttactgcatgtatatacacatgttactacaaattacatactatgttactgcatatggagtgttaaagttcaaaatgccaatatttgaaaagcaatatctcacaagttatgtattattttttaaaaccgttttcacaatgatgctatagtgttactgcatgtggaggtttaaacttcaaaatgcatctacgtactcccctcctcaagaaaccgttcttcctccctcttttcaagaaaaccgatctcctccctccaatatagtgttactgcatgtatatgacgttactgcacttttgacaataatattatggtgaattacagtaaatcaggattgaaacaaaaatatataggttaaaagtctttgatgctaaccatatacttattaatgtacaaaagtaaaagtgttactgcacggaaggtacacgttaccacgtgtttatgcagtaacactacccaaaaatacagtaaaacgcattgtattaacatcgtgatatgattgtagtacatacaacagacaagtagtaacataatagtatacatacaacagacaagtagtaacataatagtatagtattaccgcttatggagagacaaattgcaaaaaagtcaagctttgaagaacaatatctcccaagtgatgtaaggttttttaaaaccgtttgcactatgatgctagaataaaagagcttatcaaaagtagatccgtcatgactatatttcaactatactttaacgctgttactacacgtaagacacaatattactacacagtggtcgtcgtattactgcactgtcttgggacgagagctgagaagaggtgggtggtggggggagttagtaggcgggtttgaccggtgggaggggcctttgaccaaggtgggaggtgggttttgggccttggtaaggagggggaagtgggtgtgacccttgggagggaggggggtatagaataggttatatatatatatatatatatatatatagacacacactagcaatgatgcccgtgcgttgcaacgggtaaaggtaattttaatcatgtatactggttgaaaaaaatataaaggaatcataatcataataataatactaatgaaataaaattgcagtgacctttggtcaaaaagataaaaatatataattaattttccattaattccattggctaaaaataatataatacgaagtagaaaaagttattctcaaattttagcaattttcaaaaagcttaaatagagcaaactaattatataaatgaaaacaaatttaatcacctaaataaaacaattagacctgtaaatgaaaatctgttgccagttcagttaaacatgagcctgcgggtgtgtgtggggtatatatctctcactcgtatgtcgtggtcttttttttgacatagaaaaaatgcccgtgcattgcgacgggtaattaaaattataacaaatataaaaatattatatgattaaggtttagttttacatgatatgagcactttaagaaaatatatttataatgaaat

SEQ ID NO: 66289 - DNA, 3421 bp, Oryza sativa
ttatgtgggtgcacttcagaacatattcagcaagagtgcaaagtatagtttatttgatccatgcaaagaaatggcctacattcctttggatgaagatatgaaggtttgcttctataccagattgcatatttattcatgtgattcgacgatgaacatttaaaaatatttttgcgcattattctgctttgtatactctcgtgattcatttaagcagtttgttgcttcatatatgcatatcccatgtgcatcatttagaaattatctagcaattcttgatgaactagtatctgttaagtaatttaaagcttctgtcttgatcctgtagttgtaagataacattgcctgtgtttacctgcttccattcattgcatcatatttgctttagttacaccaataagtgcaatccattggcatgagcaattgagcagtttgaactgaatgtcagttctctatccataaagtttgatgttgtgggctttgtacaaagcactagggcgagtttgcaccaccaattatgctgcagaagccaactctgcttcctctgtttgcaggtgaagggaaaggcagccattgatgttgtctgcaacccattggggaagtctggtggagctcttattcaacagttcatgatccttacatttggctctttagctaactccaccccctaccttggtggcatactgttggtgattgttctagcatggctaggcgcggcaagttcactagacaagcaattctctagcttggctaaggaagatctcaaaagggatatgtctgcaaaagagaaggtagatccttccctgctcaaggctcctgaggctgatgtattggtggagcacacaaacggcactatagagagcgaagctactgcaactgagagttcaccatcaaactcatctccaagtaattagattcatctttctttgacaaagtcaatcgataggtaggagaatgattgcagtgggtagaaataatggtgatgaaacaattcacggtttctcaagtttgtaacagtgcgcagaatcaagctgcctgtttattttgtttgtaacgtatgcaaattttgacaagtgcactgaacgccattgtggaaattcaaccgttctggcagggagaatgaatgaataggtttcccacgccttgcaaaattttccttgtgaatggattttgcttgcctattgaagtgggccatgtcaattggtaagctcttgttatcccattgctctaattaactgaaatgatgtcataacaggctatggcaggatcaaacaagcaatggctgagagctcaaagggaataagatcactattccagcaaatatcacttatattgattccagggcttatactaatattttttatggtaattctccaatcttattgctaaccacgcaccaagtgatctagggcggattctgtgtctgccatttcaagtaccggatcacatcaaacttatcatccatccattctcacttcctttcctatttgactatgacatgagaagaattctgaagtccgaagcccagtgatgactaatgactggccagccgagaggccaaaataccagatgcatgtgagtccgtcttttttgtgccggttcagcagatgcatgatactgatgtacatgagcaatccatccatcggttgctcggctgcaagtctgcaacacttgccggacgtattggttgattttgtcgccaaattcctagagatactccgtactagttagatttagattctcatcgttgcctgctgtttagtacgatccatgccttatgtgagcccgcttgctcgttcactccgttggaattttgcaattctgatgctgagccttgtttttaacgagtgtttggtccatccgtttgtgcataaatccgtgcggatgaagcctagccgcctaatgtatcttagaaactttgtgagccattcttctttagggcaaaagctagtaaaaggtaaatgcagtaactcgacgtggacagatcacctaaattcaggtccaaaactctcctattctacctacgctttctcgtttgccagtacagaagcatgtgatcaattttctcccattagtcgttctcagtactctgcaacaacagaagcatcatagacttgaccaaagcaattaagcggacacgtcaacaaaacaggcatcaaactgtccagaaaccaccttcctctgacataagaatgatgtgttgtgagagaacaagtattctacccgatctgcaactgcgtttaagataaggtaatccgtaatcttttacggctgcaaaactgtcacataaaagccacacctggatggagttctgcaactaatcgagaacagagtaccagcctgccctttttacttggtttacgagaagatgaacacaaagctacactcacacggcttatgaacaatgaacagtgatactaaaagagaactatagagaagagtgcttgcacgcacgccagtacacccctccttatctgaagcacactcactcgcactcgacgatttgtcgccatcggagaagccattgtgcaagatcatgtcgcattatgcgacggccccacgggcacgggggaggaggcccaccacttacacgggtgcggggcccattgccacgttgggcctaacaatccaattccccaccgctcgccgtaagccgcacggtgacgcagagacgccggcgagttcggttcactgggaggtggtggtggtgcaggacgaggcggcggccggcggccagaggcgggagaaggtggaggagacggcgattccggccacgttgagccccttggtgccccagtccggcacgggcacccaccaccactcgccgcgggcgcggtcgtacgacagccacacgatgtcccaggcgccacggcagttggagatgaggacgagccggaccacgccctcccgctccgacagcagcccggtcatcacggcgtacggcttccggaacccctccaccagctcgcccggcacggtggaggccagctgccagtcgccgccgacgaccgacccgaacccgtacaggtccacgccggccaccaccttcacccgcggcctgcccggctcgtcgatcaccgtcgaccggaccaccgcggcgctcccgtcgccgtacacgtggagcctgtcgccgccgccgttcgggttgtgcgggaaccgcggccggaagaagaccggccgctccacgcccggcccggagtacaccatcacgcagtccggcccggcgtgcgccgcgcacaggaacgtcccctccgtcccggccgccgtcgacgccccctccgcctggaccgcctccgatgactgccacgtgtccgtctcggactggtactcgaagaggagtggcgtgttgttcaccagctcagcgaacagaaaccttgtaagttaacagtaatcaaccaattaacaattgagtttgactgttctt

SEQ ID NO: 66290 - DNA, 5530 bp, Oryza sativa
  unsure (1)..(5530): unsure at all n locations
cgggggccgagcggggacgcgggaggcggcgggcggcgtgcgccgagaggtcgacgacgacgagctcgcggcggccgttggcggcgaaagganaggagctgccggacgcggccaggaagtagaggtcctcgccgggtggcaccgcgggcgcgaggatggcggagacggggatgcggaaccagcggccggacggcccatggaacccccggagcgcggcgtcgcgggggcggagcttcttgaagacgaggagccacgcggccgcggggcctggcccggaggcggcggaggagaggtggtacaggcggcggaagtccggggaggagatgacgtgggagagcgggcgcgcgacggagcggacgcggaggagctccgggagggcgaggcggatgaggatgtcgtggaggagctccgacgggaggaggagcaggggacctagagcggtggtggcggcgctcgccggggaggggtggtggtcgccggtgaggtggtggtggtcggacatgggtgggggcggggatgaggtttagtttcttggggatggggttgtttgggggacaagtttcgtgggggttttgtgggtggcttttatacagagcagaggagacggtttttggttgttgacctgctaaacgaaatttgcgtttcatgcggttttaagatttatttcccctctaaatttgtactacatcgtttgtggttgagatgaaaagaatgtgttcgtagggcctgctttcatatagtttgtgttttctgtttagtgggcggtggatgatcaattccgaatatgcatatctacctagaaaaaaaagggtctaaatttgttcagtagaggcctagagggggaaaaatatttataaataaattcaaaataacaaactaaaattgcttgtcttgggcttgtgcacgtcgatttcaaaatatttaaaatgatacatcgactttgtcaaattatttcatcaatttttaggatcatttgcaccatgtattcggaatgagtgcacaagaatttgtcatgaactggaagtgtcctcagtatttataattgtgtgatccaaggacctagagtacgtgctactagaatatgtttttttaaatatacttcactaggataagtttatgcaaacgtataaaaggatattatttgtaactagtgtttctctgtggggatactgacattttgtcgctggtaaacatttttgtattgccaacattttattagtaccgtccatgatagcacaaattcctgaaattagtaatttgataaaaagaataagttgcatgcatctgctcctacaatttggatgctcacggcttctcttccaagaatatttagtcttcttgttcaagtaaagattataaatctagtagagctggcctatctcaacaaaacagggcgggaaaccaacagaattttcatggctccatcccaacaaagagatcatatataagggcgaaaataaatttcctgcatagacgtcagcaagcttatcgttgagtttattattcgttcttgagcaattgggagtttgggactaacataattagctgcattaggaagggtccttttttttccctcttaaagtcagaatcatgcacctgttatgcatatgcatatgatagaaaataaaacagaaggggaaaggcacaaaggcactccaggatgttctatccagagaatagcagaattgccacttggattatcaccaccaatttctcttctgctctttcacaggaaaatgtgtgacctgtgtgagccgtaagcccgtgacacgctaggtcactagcgtacgtagttagtctgtggcccttcaaaattttattttgtacagaggacgccaagatgaagcctgcatatcaccttgatagagaaactagaagtaagattcccttttttctttatttctcaatgatgtgtgttgattaaggcttggagtgtagagtgaagagtctcttctgtgcaaggaaggaagctagcagcagagctattggtttcttatcggaataataattagtttcccgttttttcttctagactcttatccagaggtcgatcaattgaccaacaatcgcttgcttggatactcaattatttggagttatacagctcaataattggaaaagagcattaatttgtgttgcttaggcctcggcttcacggtgatgcagagtcaatcggaagtcctggtgcatcatttctcatccctaataatagtgtgcaagtccctctagcagatgacggcaacacttaactgcctccccaaaccaacataaaccaagaaaccagagaagaacaaagcgaatatagttagattaaaataacttaatgagttgtaggttcgtgtcagactgaatatttgaggtttgcatgcagaggctacatctaaaactcctttcttcttctgctccaccaacaaatgatgagacatcaacagattatgccgacctgggtggatggttttgaggcacaagaataattattcatatacggttaaatcaaaacaagcgaacgaaagattatggccaaagattaggtgaagatgttgaaagatgcttgttttatggggtccaaagaattgctttcgtgagtggcaagaactcacgcatcccttgtgtgcaaccgagatattgttctcatgtggaataggccggtgcaacttcctttaagtacgcctacaaacctgagtttgatttgatttgcttggatttcgttatctcaggatctaattattatatttttagatccaaaatttgattttactttcgaggtactgtactaaggttagtgctaaaaggagatgtactcctattgaatatagttaatagacggctgccctctcctctacgaaaactctaccattggcagagcttaaccatcaaacaacaactaatcatagattcacaggtcgctcttgggctacctagacagcagctaataattaattactactaataaagaactcaccatcacggttgttgtaaacaatcacccgattttcagatgagaaacatttacactgcaagacatgggagacaactaataaccggattaggggcaaaaccaccccgatagtcagaaaccatggcctccgactccaagaaaagggccagattaacccataccagatctttggagacaaatcatttgtttaccgaaagtaagaacaaaaagcggaagaccaatcgaacaagacagagttattgtcctgtggctgttatattagtagtatactctgacgattgagacgggaagttgataaatttcagaaaattttgatgacaaagcaaagcacgcgctgcgcggcgcaacacaaagtttgggattattcaatggagagcatttgcggcctgtggccggcgttgtgcggtgaaaatgccaatttaattggaacatcgtgatgtcaaatgagctgaggaagaccccacctctaaaaacttgtaatattaaatcagagccttctcctaccctctagcaagtagaagacctaacctgcagattaaaccctcttgtagtcttgcagattaaccaagtggaatgcaaagctgatctaagaactgcctgaaaatcattagcgaagtaagggtcacatgcatgcatcatgccgtccgtcaccgaatgaaagccagaaacagcaagttaaaagttagtggcatactgtatagggtgtgggcaagtgctctatctctgctattttaaaattctatagtggtggcggtgactccaacactggcagacacgcggagtatgagccatccgatcgctaaatccaacggctcatatcgtctttcccgtcgtttgcatgcccccgcatccgcatccccatcgtgagcacaccctgttgttttttagcgtttctctcccctaacaacctccaacgccgcacgcccgcaccctaatcaccgcccgcgccgtctcccaccttgccggtgtcctccgcgccgcccccaatctccgacttgtcgaccgcctccgcgtgtgccgacggcttcgccgccaccgatccggagtcgcctgagtcgtcgtcgcccccccccccccaccccaagccgatctcccacacccgcgccacctcccccatcgctgtttcatccatcttctcgtggtcgcctccgcgctatatcgcccgccgccccgcctcctctgcttcgacgcttatcccctcagccgccacctccgccgcggtcatcgacatcatcttcccgagcgcctgaggaaagggattcacgccgctacaatgccgagaccgagcggagaggtggtttgaggccagtagagctgtacggcaagttttctcttttgttgtctttcaatctcttctcccttccgatttgattttgattgtgatgagcaaactattttgacttatactacccaattgattttgattgcgatgaacgagtaaagctattttgcccatgcacatgaggtgttcgattgaatgccgcagaaacaatctgccactctgttcatggaaaaactttagaatccagtgtcaaaatccccaatgatatagtgaatcacaccctgctcatccagcatcggcttctttaacccagtaaaatgcattttaacaaccactgacggattattttgtgctgtccatagttccgatagagcaatcagttttgatcttgtaaattgtaagcacctaatttggagttcgacagctggcaacggcatgttttgtcagggtacccgtcgccaggacgccgccgacgccttacacggtgactgcttctcactgccactgatcctttctcggtcccacggcacggctgaggctgtggaatctagcaatcgatccgtattcttttaaactatatgctactgtatgtgtgcaggtggttattgatctccacgccttggcctacagcaatggacaacgctgttgggatccctaaactcatgatttgtatctaataacaggtaatgactaatgacacttcaaattgctcttcagcttttgcatccgatgtaatcacttttctgttgagtcacatccaatacttattagatgctaataaactaaatctgtatgacaacaattacagattgactcatctaattttctgacagtagatgtgctgacgttcctatattgcagttgaatttaacttcagaatattgctgccagcttccggcctcctcaacatcagatcagtgtttcaggtgtgtgtgtctcatttaaattagtcttcttttcctggtttgaaatttccgctttgcaaatggcacgagaattttaagtatacgtcagtgtcgatgaatttctcaaaacaaaaaaaagaactccagttcagtctgcattgcgtggtgatgcataacacacaatagcaagaggtttgctctgagagtcacaacgtcagtacacacatggatggtgaaaaaacactgataatttccctctgttatcctgaaagtaattttgaaccaatataaggatctggccacatgcatcgaagaggagtaaatgtgctattatgtgggatcctggcagtttttttttttgggctatcagattagagaaagcaa

SEQ ID NO: 66291 - DNA, 1631 bp, Oryza sativa
cccttcccattccttcgttaattgcaaggttccccctccccccagatcgccatattcttctctcggggtgcagtgtgagatcaattaagaagaatcagcactgtctaggctagctcactgctgtttcattctctgttttctcattctatgtctaatttatcttcttgtaggctacagccatcctggtgtttttagtgctgcacctctctatatatatcctttctaggtaaattttaacccctaatgttcactttccccgagaaaatccaattttgttgctttaatttcaggtagtatataacctggttttacagtttataaactgatgcttcttgtgggatgtcatgtctctgattaatttattttttaacatatgcaccaaatatatgtctgttactgccacacatgttttatattggattcagtaaatatctcctattacttttcactgccatcactctaggaatattacactctccaacgatatatatctgagttgtgaagttactggttttacatgtctgtgtctgagttgtgaagttactgatgaaaacatccagactcaatgaagtgtgattactgcatttaggcggtctgatgtgttttgtttttcagaaatggataagattgttgggggctccacaacatcaactacaaaatcaggttagctatgtgcatgttattaactcgaatgtaaactctttgcatgctaatttcacccatgtgttcctttcttaggccctcttgctgacataaccaatataagtggttccggtttggcaaattgacggggcaaggttggaaacaagtcgttacgtgccgttgaaagatacgacgagaattgtgatgtctttacaaataacactcccaactgcttcaaatggtatcttttacatattgcttgtttcctattttaattcaatctcaatctgtatccaccaacaccaatgtgatgagtataaacttgtgatgctggccatgaagttgtgcatcctgtggtgacgcctaatagtcatccatgtgcggaaaaccgcgatgcgtccttcaatacacccagcaatgtgcatatgtgtacaggtttgcatgaagatgttagtcaccttagtgtggctgaactaaaaagaaagcgtgctagagaccggtacgcagcattgaccccagagcaaaaagatgataggaacaagaaggcacgtgaaagaaggaaaagaaagaaggaggaaactcaagtttcaggtacaactgtaatatttatctgtacaaattaaaatatgtctggccaattatgcgaaacaatattataaattctcgtcgtgtgaacagccccacttggcgatatttcaaatataagcgctgttgatataatgaagtgccaattggaagtgactgattcttccccgctgcatcaaggaagtaatgtctttattgtttgtacagtttggttgaacaatatattattcgactgaatggaaattgatagttctatgtttaaatagaaagtgaagcttcccatcttaatatcacaccaagacgtctcccatttacaatcatcaacaatgtagctcactatggtcccaacgaagtaccaatgagtcgcttcactcaaagtacctaaacatgaatacttctgactt

SEQ ID NO: 66292 - DNA, 9930 bp, Oryza sativa
caatcccataatctactcatgatgatgttggcacatcgctagataatgaattggtgcgtgcgccaaccaatgagacaaaagaacgattgcagtcaaagctagctcgagctagggagaagtatgcaactcttacaccggagcaaaagcaagctaaggtggaccaacggagaacacaacgtcaatcactaacaaaagaacagagactagagttgaatgcccgtcgtagggttgcaaggcaatctatgccagatgtggaaatccatgatatgaatgcttgccgtagatcaagacgacaaaatgttactcctggggaaagatctgctcatctggcacgacgtaacgcactctatgcagctaggcgtgacaaaccatgcgctgaatccattgcactagagtgccctgagggatctatcccattgttgctaaatccaacgccttgcttggaaacaaccggtgatgtgccatctacatcgagcctgcaaactgagcatgctgtagatcatcaggcgcgatcatgcacattcaatgatggtatcatctatatatgttttcattcgtactcgcaatttgggggaatttaactatattccacttttagatttggcaactatccaaatgcccttcttaagtttgctcttaattttttgcccctcttagatggtggcttcttaactatttgtcactgttggccatgtggcaatccatggcaaaagtgccaattagttaagaaacgtaacaagggaatttggataactgccaaacctaaaagtggcaattagttaaattcccctataatttgtacccttccgcatactaacttctcatatctcattgtactaaagatgatatggattccttcatggatgatgactccgacgatgaatactacatgtttgctgggctaggtatcgtcgtcgtgatatcttaatgtctctttcacatgtataatttttgcggactataaatcctttgcgctaaaccataccaggcgacgatgaggatgacgagatggtacaatctgatgacgatgacacgcaatcaccgacctcttctgttcctgatccgtatgactatatgtacagcaacattccacaaagcacaaatgttctgaagcctgaacctgactgtaaacactgtggtgccaagaggttccagtacgaaccgccgagcttctgttgtcggggtggcaagatcaagcttgtacaaaatgaaacacctcctgaactgatgaggctttggacaagctcggatccagacgccaagcatttccgtgataacaatagatacttcaacggccacttctcattcactacccttggtgtaagccttgacaaggcctttgcaaacatgagttcgggcgtgtacacttttcgggctcatggtcagatatatcataatatacattctttcagtcctagagattctggtccagagcatctcgagttgtatttctacgatgacgatccaacattgagtcatagattccaacgttcccctagccttgaccaggatgtgattaggactgttgcagacgtccttcggaacaacccgtactcggagacatttagaagtctagggcaggctgaagacctcgcgaattatcgcgtgacactaaatctggatcataggttgcaccaaaggcgttacaatgtgccggtgacaactgaggtcgctgctatctgggttgagggaaatgagagaaggaagttcgagcctagcgtgacaatatacaggaacaaccgtacgcggaaatctatccagcctttctacgaatgttatgatcccctctcgtaccctcttttcttccctagagagaatggttggcatcaaagccttccaaaggacaaaataaccatggaggatgcaaacgcacggaatggcgatgatcctggtaagtttatcttcgtactatgttgccttagagaattgatcattgtgcgttacatgactgtactaacctagatgtttctcacgtgtagattgtaacagcaggatacgagtctctgtaagggactactactgctataaattccagatgcgtcgtgggattttcaatcctatacttcacggcggactcctgttccagcagtttgccgttgacatgtacatcaaggttgagagctcccgtctagactatgtgaggaacaaccagaaggagataagggcggacctgtatcaagggttgatggatagcatccaggctggggagagtcgagcaagcgcggttggcaaaagaactgtgttgccagctttgtttgtctgtggtggccgaaatatgaagcgtcgatacatggatgccatggctttagtatagaagtacgggaagccagatgtattccttacaatgactagcaaccccaagtaggatgagattactcgtgaacttgagcctggccagacaccacaagatcgtcttgatctcgtggtccgtgtctttcgagccaagttagaggacctaaagaagcagctgttcgagaagcacatccttggcaaagtcattgcacacgtatatgttgttgagttccagaagaggggtctgccacacgcacactttttgctgatcatgagtggtcgatacaagctaacgtctgcagagcaatatgaccgcatcgtctcagctgagctaccggacaagaaaaaatatccagagctatacaatatggttgtcaagcatatgatgcatggcccttgtggtcgactcaacggtaggtgccaatgcatgcgagatggaaagtgcaggaacaactacctacgagagttcaacaccacaacctcgcaaggcaaggattcatacccgttgtataggagacgtaatgacagtaaagagtaaggtggttagaggacatcctctcgataacaggtgggttgtcccgtacaatccttatcttctacggatgtacaactgtcacatgaatgtcgagatttgctcgagcatcaaggcagtaaagtacctctttaaatacctttacaagggacatgacaaggcctcgatatccataaacgaggcagataaaaacggtgaaatcgatgagattcagcgctacagggatgcgaggtgggtgacccctccagaagccttgtggcgtatatatggttttgacatatgccacatctcgccgtctgtgaggcagttgcaattgcatctgccaaacatgcacatgttggctttcgatgcagacaaggatctccgtgatgttctggataaggaagacgcaggcagatcgatgcttacggcgtatttcgaggctaacaggcagcatgtctaggctcgagatatcctttatagagatttcccaatgtggtttacttggcagacgccaggtaagtactggaagaaaagagatagaggtggccaggtcgggagaattgtgtgtgcccacccggcagagggggagcgctactatcttcgggtgcttctaaaccatgtgacaggatccacctcatttgaagacctacgtactgttgatggtgtgctcatgccgtcgttccgtgctgcagctgaaagaaggggtcttatagaggcagacaacaccctcgacgagtgccttacggaggccggtgtctaccaaatgccggcgtcgctacgcaggttattcgctaccatattggtgtactgcgaacctaccgatgtccgtgcactttgggacaagcatctagattccatgtcagatgtaacaacgcatgcccttatgctgtccaacagatggtgctgatagatatccggggcatgctacaatcaatgggtaaggaaatctcatcgttcccgctccctgaaatagatgaatcacatgatagtactcgaggagatcccagagagattattgaggagtcttccattgttgtggagagagatgatatgaacctcccagaccagctcaatgatgagcaaaggtctgcattcaataaaatcatgaacgcggttggtagtgctcaggggagcgtgttcttcgtagatggcccaggaggcacggggaagactttcctatatagggcgctactagctacagtgcgtggcaatggtgatatagaggtggcaaccgcgacgtcgggtgttgcagcttctataatgccagcaggccggaccgcacattcgcggttcaagatcccactcaacattgaggaagggtcgtattgcagcttcaccaaacaaagtgggacggcaaagcttctccagatggcatcgcttataatatgggatgaggcctccatgacaaagaggcaagcggttgaggccctcgatatgagcatgagagatataatgggttgtccacgttctccgtttggagggaagacgattgtgtttggaggggatttcaggcaggtgctcccggtcattaggaagggcactaggtctcagataacagaagccactctacgcaggtcctatctttgggattgtatggttcaattaaagcttgttcgcaatatgagggcgcagagcgacgcgtggtttgcggactacctccttcgagttgggaatggaaccgaggaggtgaacaaggaaggaaacataggccttccttcggatatttgcttagagtgcaaagggaatgaaacggacctcgaaaggctcatcgataccgtgttccctaacctaaacgataacctgacggacccaaactacatcatatgtagggccatattgtccactcggaatgagttcgtcgatcgaataaacatgaagatgattgagcggtttagaggagatgtgatgacatatcatagttttgactgagcagaggatgaccctcataactattacccgccaaaattcttgaactctctaactccaaatgggctacctccgcatctgcttaagctgaagataaactgccccatcatgcttttgaggaacattgacccagccaacagccaacggactttgcaatgggacaaggctggtggttcgtcagttcggaaaaaatgctattgacgcggagattgttgtagggcagcatgctggaaagagagttttccttcctcggatacctctatgtccttctgatgatgagatgttcccatttcgcttcaagaggaagcaatttccggttagattgagctttgcattgaccatcaataaggcgcagggtcaaacaattccaaatgcaggcgtctacttaccagagcctgtcttctcccatggtcaactatacgttgcactgtcaagagcaacctctagaacaaacataaaaatactatcgatgccggtagaagacaagaaacaaaagaaaaagtctaagcgtactggcgtgaaggacaatgagaagaaaggaaaggaattgtctaaacaagctgcaacatacacaaaaaatattgtgtatagagaggtcctcacagattagaaaaggtatattatgtgactaattaaccgtccacaatatgcttgcttaaattccattcttactgtaatttttatattccatgtctaacatttcttgagtttttttccttggacagcagtaaacatttactttcttggtctgccccttctcctgtatatgcctacatccactccttccccgagcagtccctccggccgcctcctcgttatggctgactcagagaccaaaaccgttgtagtcggctgctcgccgaggagttgcaggtgatcaggtaaagatatttttctatcagtccttggtgaaccaccctggcagctcttcccttgctcattatttcttattctttgctaataggagagaagcagccaggtccaggatgaagcaattcactgttatgaacaaattcaagatgaagtccttacttgtaagctgacagttatttcttcttcttttttaaaacaatcgtagttggtttgtacatgtcttgcagcttagtactgatgttagcagatttatgaggttctgctttagttcagatttccaattgcagtttagcatttcttgtaatcatgttgtggcagtccagtttccagtggggtactgaataacacttgagtggagatcatctgaactgaaagccaacatttgagctcatgctattagcctattactatatcaaataaaactttgatctttatcaaagaaaaaaattatacaatttttgtttctatcattattttggtatgagttttccctgctcatgctaagctcacttctgccaaactatttgatgtttctagcaagagagtcaaatcagtgatgtctttatttttagaatcaagaaacatgaatattcatataatatgcaggtcttcagtgagtgttaagttttgtgtgaggacgtaagcaggagccaggaactgtgagtactgatttgtaacggagcacatttgatcagtaatttgctccatgtgaaaggagcttcggattcagattaggtcagggattaatatgttttgctcaactggctattttatttaattgcaaatttcagtttgtcaaaccacttgtaaagttttttgcatgttgtacatgcatttggtaataaccatgaagtcatcttaggtaaagagtttgagcattactgttgcctgctccttaaattttagtcagcgagttgttctgaacactaattaaattatgttgaatgtagtttccttacgatgctatatttgtcttttcaacgccagattttatcctccgtgatcaacaaaattccccgtagcaacgcacgggcaccctactagttagtagcaaatcgtttgaaagtgaaggagtcgtctgggcaatatcgagttgtcgactgctcaagtggaatcttgttgccgtactgtttatgctttaaccccccctgctgccaacagatatggtgccaaaagaggcctaatttcatccaccaaagttagtgttagtgatcgcctttgtattttatttttctttggtcggcctgtcctttttggtagccacataggatgagttgacaccttttgttttcttgccaggggttaggttttggttaggggcccatgcgttttatccgtgcgaggagaggaaagcatgcctttgccaagtcagcttatatactagtactagtcgatatgggttcagataatctatttttcaattggaaaactaatctataccgagttcttcgcttcaatattccacgctttgtctctccgctccagaacctcaaatatgttaaatacgttttgtcgtctcgtctcgtcttttaccgcaacgccgtcgcggagcggctcggcagcagccagcaggtgatcctgctttgctagccggaagacgcagaattagggggagaattagcgtacgtgctcggcttctctgccctgctctccgctcatatgattgggggtgtggaactcatcccacagccggagaagccggtgcacatgtacacacggtgccgtcgcacgcgccgcgctcacccagacaggcttggaagttggatgaggaggttgggggcaagtcagcagtgctaggcagtcggtggtgttggcgccagcggcggccgtgcagtcgcagaggaggcacggcgtttgcgggtggggtggccttgcctaggccgcgacgctgtaccgattttcttggcacgacccaagttggcctacgagaattgtgggtcggcctcatgtgattcttgccggtgtcgtcgctgggtcgacgtcggcgcgacggtgcgaggctgcgggcggcacgggctaacgcctcggcccagatctttcttagaggattcgacccagttctgcgagtgaaacagccagttttatccagcaatcggccgaggaagaaggaagttcatatggcaacgtggatatttttcttttgaaaaattccattttacccccgaactattttcgtggagcactaacccctaaacaatttctctgttcatttatcgacagaactattgaaaacgattcacgttactccttaacggtatttctcttttttctctatatataagttgtgttttgcaataaaatttggaacttttgatagattcattacaacctactctctccatgttaaaataaattaagctcatatttagattcgtagtactaggatatatattgtattaggctaacttattttttgatagaggaagtgcctcctaatatttttagaattttattaacattgtttacataggttagaagcactagggctgatttaaacatcagggttttaaatttcaagcaaataatcatgagaaaattaaaatattataaaactttaataatggtgtcatctatggctacaaaattttagcttaaaatatgtctcatataaagaaaaaaaaagaagagaaatacaattaagtagtaaagtggaacatttttaatattttaggggtaaaatgagttaggggtttacgtaatcgggtgaaagagtttggggaagtaaaatggttttttcactccttttttttccttggatctgcaaggcagatattaatagagttaataacagggtaggatgggttaggttggagaaagacagctccacccctcacccttgacctctcattcctcccccgacgaccctagggtcggtgggtcctaaccctcgaccgggccctgtcagggaagataaggtgacgtccgggaggctaccacgttagtggagcactagtagccagtagccaccacatcgatatggagggagaaaataccaaggctagctgctatcggggcattactttaccaagaagaaggtagagaccggttgtcgtattgggggagcgtcgaccgccacgacattgggatggaagaagagaagataaaggcggatataatgttgaaggagcacacaccagctgctgatattgctacatcagaatggggagaggatatcatgggatagaggcctcaagaacataccgactgcaacttgtcagggtacgaggaagccaagtagttagtaatgtacgatgacgagtatgggatttaggcataatgatactgataataatagcatgttggaattcgcttaatgggttgatggccttttttaattgtaaacattatctcctgtcttgaataattttagggcccatgagtcacgtgtgggtggaacacaccattcaaccccatgtacctgcaagtgggaaactcaccccaccccatatggggacacgatgggtatctaatttcaaaggaaaattgtcacctctaaatattatcatcaatgtatcactattatacagaagacgtgtacgcgtgtgcacaccattatgcccacacatgtgtgaatacatcctctaaaacaaaaacaaacagaaagccaactataaataaaaaattttgtattaaaaatgcatccatgtgagtgtattatggccaccaggatttcaacgctgatggatggggtgcatgcatccacaatttcatctccacaatctgtttaattcccgggacttttttgaattatttgtaaacaatgttgtgtatgtggtgtacttctttttatgtaatcgaaaatgtgcaagtattggtatatcattgtttttccccctgaagttggatatatggaatgcatttttcttgttaaaaggcatatgaattgaaaaccatttaatctattgtcccaaccgtagcctgaccacgtcgcgactccatactgtgctattacagaacaaaatggggtgcgcatggggcgactcctgggcgatgccacgtaggataggaacaatgttagggttggaaattttacgaaaaagtcctccgatttatccgtaatttgatctcggtccctcatgaacagtatctctgagctgatattttacgtggaagcccttagtaaaaccggatattccatacgaaggagagaaaaatcgtgaatttcaaaagaaattaacagaccactgattccatgatcggtctcgtgacactccgcgtgaacctctgttcagatgcacctcgtactgaactgtgcgcgggacagcagctgcagcaaccaaccgaaagagactcccagcagtcccccccccccctcattttttttt

SEQ ID NO: 66293 - DNA, 14577 bp, Oryza sativa
gtcttcaaacttccatttgaggttcgtaatgttgcagtcttactttcgttttctgaaatgatgtatttatgtacacagaaagatatgtgcactcatccagccaaaagtaggagcattttatgacaactttgatcgccgttttatatatattatgggacatctgtaaaagaaaaatatggcacaattaaaatgcgatgaagttatttcgaagaaattggcatattattatgtcatacgggaaagtgcaaatgtctaactagaaaaaaaaatgatggtaatgggccacaattgacaaggaaaggtaaattattgtgtactatgtatatacatattttttcacaaaagttttcgccgggccgatattttttcacaaatgtagagtgtgtgatttctttttttagttagttgtttgatagaactacgatcaagttgtttgagatgtcgattatgtagcatgaaaaggacaacacatacaattgaattgatcaatcagttgcgtttcctatggaaaggtacatattgtgtacaatttaatcagtggactgacaactccaagccaaagtctcatcacaagaacaaaaatgtatagtcctaacaatcagatatactaggtgtgtactaataacatcctgtgacaaaaatatctaagctttataaataaataatttgaggctgaacacttctccttacacttgttagctatccaaatatccagtttatgattcgcatgaggcatattccagccccatggtgtaatttcctcatacaagtatttagcaccatttctccacaaatattttttatgagaattacacagtacaacgcagacactcacaacgcacgcgcactcacccctatggacgcacgcacgcaaaccctacccaaaagtttaaggtatactccctccgtactcgtaaaggaagtcgttttggacagcgacacggtctccaaaacacaactttaacatctttttcctataaaaatatttatttaaaagtgatatatgtattcttttttgaaagtatttttcaagacaaatctatttatataatttttacattttcaaactcaacaatttgagagttattcatgatttatattcctaaggtttgacttaaacattgtactaaacaactttctttacgagtacggagggagtatttcttttataatcaaaattaagaagaaattaactcattcatcaatgtgacaaaaccaacgaactatatacatacatgtaaccgatgagtattaagccaactcattagatttcgactaacaatttaattcagcacacagagtaaatatgtccaatttatttaaaaactaaaaaatgaaatatgtattaaacttttagatagaggcagtactagtttttttttgtctcagacaattaccttcaggctaccgtatcgtttggtagcttgactaacatattctgttggattgctaccgcgccatgaataagctccatggcacgtaaaaaaaaaaatagcacttcatttgaaacactctaacgctaccaagaaattactgctagcgattgaacatttcacgtcagacatggacataggatcctgtttgtatgtaaaattcgagtggtttcactacaaaatctcaacaaagttcgtgcttgaatggcctattcctgcctcgctctctctccgtcacgaagttttctgtagttttgtacaggattccaaactccgagatcccccccacggacaaaatcagaaaacaggaattgacagaaggcggggggcagcatccccaccccacggcggttcctcgggcctcccgccccgcctcgcacccggaatccttccttcccgaggcctacgtgtcccctcccgcatctccacgtgtgcaccccccgccaacgtcactcgccctcaacctcttccccctcctctccctcctccgaccgactcctactccctcctagctgacgctccgctctatactcttgtatccaccgctacaattccccccgctgcacacgcaccgctcgccgagtgcgaagcggtgagactagactactctttgagttagtatggccatggataccttcccgttccagtggcccatggatccagccgcgtcatccggcctcgacgctgggtttctgccgcctccagcggctgtggcgcccgacgacggcgtggggtactacgacccgcctgcgggggcggatgtggacgccgctgctctgccggagttcgccgcggccttcccgccgtgcgcgcctgatgctgccgctgctgtgttggccatgcggcgggaggaggaggaggtcgcgggcatccgcttggttcatcttctgatgagctgcgcgggcgccatcgaggctggtgaccacgcgctcgcgtccgcgcagctcgccgactcgcacgccgcgcttgcggccgtctcggccgcctccggcatcggccgcgttgccgtccacttcaccaccgcgctctcccggagattgttcccttcgcccgtcgctccgcctaccaccgacgccgagcacgccttcctctaccatcacttctacgaggcgtgtccctacctcaagttcgcgcacttcacggcgaaccaggccatcctcgaggccttccatgggtgcgaccacgtccatgtcatcgacttcagcctcatgcagggcctgcagtggccggccttgatccaagccctcgccctccgaccaggcggcccgccgttcctccggatcaccggcattggcccgccctcacctaccggccgcgacgagctgcgcgatgtcggcctccgactcgccgacctcgcgcgctccgtccgcgtccgcttctccttccgcggggtcgctgcgaacagcctcgacgaggtccgcccgtggatgctccagatcgcgcccggggaggccgtcgcgttcaactccgtgctgcagctccaccgcctcctcggcgacccggccgatcaggcgcccatcgacgccgttctcgactgtgtcgcctccgtccggcccaagatcttcacggtcatcgagcaagaggccgaccacaacaagacgggcttcctcgacaggttcacggaggcgctgttctactactccgcggtgttcgactcgctggacgcggcgagcgccagcggcggcgcgggcaacgcgatggcggaggcgtacctccagagggagatctgcgacatcgtgtgcggggagggcgccgcccggagggaacggcacgagccgctgtctcggtggcgggacaggctcacgcgcgccggcctgagcgccgtgccgctcggttcgaacgcgctgcggcaggcgaggatgctggtcgggctgttctccggcgaggggcacagcgtcgaggaggccgacgggtgcctcaccctcggctggcacgggcggccgctgttctcggcgtccgcctgggaagccgccggggacggcggcggcgacaataacaacaacagtaacagcaacgttagcggtagcagcggcagtgacagtaacaacagcggcagcagcaatggtaaaagcagtggggctcgggatggtagcagcgtgtgtttgtaaatcgcgggagggttagtttgattaaggggatcgatcgtaaatcgcaaatatgaaaatctgaatggcatggaacttttgaacttaccatctgatgaagagtttcctgtccatctatctctctcgccgatatgggagtatacttggcatatatttttcagatgcaatttggatattccaactgattaattaatatacttggcatatctttgttaatagtaggagtacaattatacaaagagacataagagaaggcgccgtcaaaacccttgttaatactgccaccatcctcgatctaatgacgcccttcccaagttgctagtagacctgagcaatttcagcgggcgaaaagactgacttgttttgggcctaaattcacacataagtctgggctggcaaaggtatcgggcttgctattctgatgctgggccaggactgggcgtaggcctcgttagtaagaggaaaaagtacaccgcaggtccctcaacttgtcatcgggataaaaaacatcctcgaaccgcaaaaccagatatgcgatgtcccttaactatacaaaaccggtcacctgaggtcctttggtggatttgaccccagttttggtctacgtggcggttgagttatcgtgccccccccacatgtcaggtttatccacgttagcctcctctccctctttcgcctcttctctcccttcctcatctctctctctcacacttctctgcaagctggcggggccgaggcgggagagaagaagggcggcgccacgagggcggccgacggaggcagtgtgcgagtgcaggagccgacgaagcggagtggagtggaggcgcggagtggcggtggcggcaggcgggcgagcgcgcggcgggcgacggatagggagcggcagccagtaggcggcgatggcggaggcggaggttgtggaggtggcagccccctagcgacgggcatggtggtcgtcggcgtcggtgttccccgcttctcccggtggtcgtcggcgtgcctcgcgcccattcctcccgacgagatcctctcctcctcgtccccctcatccccgccggatcccgccgcgttgtggtggctggcgtcctcctcctcctccaccgccgcatcgacagaatgcccccgcttctccctcttggccacctccgcggcgttgtccatgcggggtccatgagcagccggaccccactagcgagctcctgcatcagcccctccccccaacctattcgccatcaccggcagcttgccgctctcggcgagcttggtgtacgcgtcgacgccgccgaggtagcggcccatgacaaagaggtgtggcggcgctaggcggggaggtccacagcgagcacggcgaggagatccgcggcgaggacgtcgtcgtgctggaccatgagcaggtggaggctgctgcgggattggttctcgatgctccctccctgagcttgtgtgccgccagggggaagctcgagccgccctaggagccgccgtcgccggccgcaccatcctctgcccgcgcgcgccactgtgggcgccctagcgtcggcatccccatgccctgcgagtgtgagagcagagagcgagaggaaggaaggagagaaacagaaaaaaagaaagagaaaggggaaagagagagagagggggtggtgtggtcacctgacatgtggggcccacgtgggtcccacgctgactcagctgccacgtagatcaaaaccggggtcaaaaccaccgaaggatctcgggtaaccggttttatatagttaagggaccctatatatctgatctatggtttaaggacgttcttatcccgatgataagttgagtatcttctgcgtacttttcccttagtaagaagaacaattgaatacaaggcccaatcggagctgctgcttcagttcggcaaaagatacattttgctagctttcgcggatacacagtacgggggctgtggcgacgtggcgtggggttacgtgaaaaggaatcgtatattcctcggtgtatgggtctccactccaaactactgtaccattggatgcacactagtcacaaccgtgtggagagagagagagagagagagagagagagagagagagagagagagtcgtataaaacctgtcagctcaactaggcaaaccgacgtgcacgtctgcattaccacgactcgacaacatcgcgacttgctcgtagcagcctaccgactactatgctgcagtcctgcagcgaggaggcaagctagttggcgtcggcaggagtcagcggacggaccaccagtccaccgcggcgtacgagttcacgtgcccgagcgagggggcgatcagcgagctgcgctccccgaccggcaggcgcatggcggacggacgggtggcttggctcggcgcagcgcgtgcgcatgtcagccgaggccggtgtccctcccccgcgcgcgctctcacgtcacgtgctccgcccgcgcggagtgcggaccaccgggcggcacgtgctgtgtcgcgcggccggccgcccgtgtgatcgcgggtacgttgttgaagcgtgggcgcgtggcgcgcgtccgcagtcgctggttcgcagcgcggatgggattgctgcgggaaccttcgggtaggaaaaacgattgcttttcgatagtaggtgttgcggtgaaataggaaactcgctcgacatggtgagaagagatcgggaaagtacgaagtgggtgatccaccattgtaagtttgtaggtatcgaaacaaatcggggtgaccgccgatctcctgcgttcaggctagtaatccagtatcactagtggaatgagcccaggcggcaggcgtggcggaggagaaattttaggcaatcatgaggcatgctagaaattaattactccttccgttttaaaatgctcgacgccgttgactttttagcacatgtttaaccgttcgtgttatttaagaacttttgtgaaatatgtaagattatatgcctacatagggggatatatttagcgatgaatcaaatgatagaaaaaggattaataatggcttatttttttaataagatgaacgctaaaaagtcaataatgtcaacatttcgagggagtacatatttatttctactgtgttaaagacgttttgatcagatggcctattagctcagctggttagagcgtcgtgctaataacgcgaaggtcgcaggttcgagacctgcatgggccatactttttcctttttccgataaccacatttaaattccatctattttcttactttttccattttaccgataaccacatttaaattccatctattttcttatttttcgtatgactgcatttaaaatcatactttttccttttccgataaccacaaaattccatctattttcttatttttcgtatgactgcatttaaaatcataccttttcctttttccgataaccacatataaattccatctattttcttatttttcgtatgactgcatttaaaatccatctgaatcgtatgtttttcctttttccgataaccacatttaaattccatctattttcttatttttcgtatgactgcatttaaaatccatctgaatcgtatggctgcattcaaactccattttttccgataaccacatttaaattccatccattttcttatttttcgtatgactgcatttaaaatccatctgaatcgtatggctgcattcaaactccatctaaaaagaatgtcaaaactagtttgtgagctatttcccagtactattgtccaatgttcttaacattgctaaaattcgcctcatgcagcgctttccactaaacagataaaagtagaattatcaccattcaaactacatcaaagaaattaagacattttggttttgtcatataagttcaccattgaatatattttgatattatatttgttttattatatggaataatggaatgctgctatatttttctatagaattgatcaaaaagtttaacttaggacaaacctaaaatgttttatactggtactgacgagctattatccaatattatgaacatttcctgtaattttgccttcagcagcacttctcactctaacaggtaaaagtagaattatggccagtgtgcaagattagagaaaatggatgcagaaggtaaatcctgactttgctgttgtttctctacaggtacagtacacttcagtaaatacagttaattaaatgggccatattttctactaagtatattattttgtttcttcgtatgactccatctagaaaatgcgagttcacattaaactgcttcgttcagtcattcttcaaatatctccttcatttcaaaatgtatgatgccattgatatgtaaaagtataagttataattgagtcacaataagacaaatgatatttatacaattttttttaataagacgaatggacaaacgttatgcgaaaagtcaacggcatcacacattttgaaaaggaggtagtaattaataagttctctatgtttgaacttcttcgttcaatcattcttcaaatactgaaaaagttctctatgtaaaaactgggttagtggctagtgctgatttactatcgtccaatattctgaacatttgctgaaatttgccttcaacagttttaaaagcagaactatcaccagtgtgcaagagtagagaaaatgtgattatatggatgcagaaattaaatactggctttgttgttgtttctctcccgatatacgttagtaactacagctacttaaatgcacatttgtgcctctctttttcacctgtggctggctggccaaggattcagcacggagatcagcagtcacgcaggcacgcagcatacccacatgtaggcattattgtcttacccggctacagccgtggccctgcaagtaatctaccagttagccattcagttagaaatggtagctaggaaaagacaatagatgagttcgcaaacatatgaagtataaagactgatgagtaccagttagcacaatttcataagccttcagtgggcaactaaaatgttggtatgacctttgacgccagaacagatagtatcacacagggtttgtaaagcacagttcagtaatgcaaccaaacattctgtaggccatgctatagactatgctcaacagcagaagttaacctgagaacttttagatcctgctttagacatttgatattgagacagaaatcatgtcctgtagatagtgaagtttggtcatgccatgcctgacatcttgtaaaactgaaactgaatagtttacttctttatttattttttttgaagaaaactgaaactgaatagttacatacttacatttgctcctgcaaactttctatattttactcaatggtagatcatgtattcaagtgaagtttacatagtctgaactctgaaggtttatacctggacagaactgtgtccaggtgtcttctctatacctctgcttcccattagtcctctaacatgttcgacatcatcccattgactttcttcagcatgtaagtttgaaacgagcacatgcactcccacatcattaggagctacgttaacgatatgctgtccaattacctttcctagatccattctgtgatgaactctacaagcagcaagaagtgatccccaaattacaggattgggttctattggcatcttcttgataaagtgaaatgcctcgtctaacataccagctctccccaggaggtctactatgcaaccatagtgctcagtatcagggacaacaccaaggcttgacatcaaatagaagtaacggagaccttcatcaaccattcctacatgtgcacaggcaccaagaactgccttaagagtaatgccgtccggttttggatcctgtaactccagcatttgatcaaagagctccactgcttcttttccataaccattgcttgcaagacctccaatcatggcattccatgagagggtctgcttatgctgcatttttctaaatatttcagaagcagtgtcaatgcagccacattttgcatacatatccaccagggcactttctaggcacaaatctttggctacattcatctcttctatataagagtgtatctctcttcctttatcaagtgctcccagctgtgaacaagcagaaagtagactaaccagtgccatttcatgtgccacgacttctgcaatcttcatttcttcaaataggttgaaggccattgtaaattgatgtcccttcacataaccacaaaccataactgtccaggaaacaacatccttttttgtcatagtttgaaaaaccctttcagctgcagccatatcaccacatttggcatacatgttgatcaaagaatttgtaaggatattgtcacaacagatcccattatctttgatataactgtgaacatgcatgcctttccgcaactcaccaagttgagcacatgctgataagacacttacaagcgttataccatctggagttacgccatgcaacagcatctcttcaaatattcttagcgcttctttgtgctcatgattttgcacaaagccatcgatcaacgtattccatgatttagtatatcttgcaggcatggcttgaaatgcttctaaagcatcagacaagcatccacatttcgtgtacatgcttatgagagcattcctgatatccacatctgcctcgataccaaatttaccaacctgattgtacacccaccggccttcatcaacagcctgtgtttggccacaagcagaaagcaggcttataatcgtgaccttgttaggaataattccttctgcttgcatctcagaaagcatctttagcactttgtcccagtgaccacactgtgcacaagctgatatcattgacgtccaagacaccacgtccctctcatacatttcctcgaaaaccttgcttgcttcctcaacacttctaaaggcaccataataattaacaagacctgacatgacgaacacatccgatgtaaacccaatcctccgaaccagcgcatgaattgcgtccccatttgaccgccacttcaagccagcaaaggcagcactcgccgacacgaccgctgccatagtgtaattatcaggagagactcccctccgacgcatttccctgaacaccgccaatgcatcccggggggcttcgcagctgctgtaccctctaatcatgcagttccacacgaacgcgttcggttgggccattccgtcgaacaccttgcgcgcgtaccgcatgtcatgcctcgccgcgggggacgcgaggagggcgatgagccggccggcgacgaagctgtcggaggtgaggtgggcccggacgagccggccgtggagctccgccaggtgggcccgcgaggcgcaggcgtcgaggtaggcgaggaggtggtggcggataggccgagcctggcttgcgttgccgtggaagtagaggtaacgcatggcatgaggagcagactaaacagcggttggttgacgcttgacggagctagcagcccgcgactattggaagcgatcaagggaactaccaacggcttgtgagttaggatagtgggaaggcccgaaagaagatagcctgaacgctgcattgcagttacagcgcggaaaggagagctcggctgatcgttttggcctttttaggggctttttgcatcgattctgaaaaatcttgtatttcttgttctacatatatgaccccttctatttccatgttattaattaaagaaatataatttgctaaccgaattactccagtttctgaactattggagtagtctgatttaccccgttagctccaataacatccagtgacggatcttctcgtggccattgccaaggcactgtccatagctatgccccacaaccaaggtgagtttgcgacctggcgttggacatttgggcgttgatttcagatgctagtaatttgattaataggttagttggacactaatttaatgcctttatcggcctaattttctaatgttctaaaccaaaggcacagccggactaaagaaaataatagaaatacgagcaaacacacctgtataacactctcacgaaaattactttattggtaaaaatattacatgcaaaattttccattatagttgttcattgtagtacaattgtagtatagtttgtgtataaaaaaatatttcaccaatggaaagcacgattgtagtatagtttgcgcataaaaaaatatttcactaactgaaagtataatacgcctcatcctagtatattaatccgtcatagctaaaatttagtgttgggtttgccattgataacagccttccacatttccagaatcctcaaaccggataaacatatattattgaatggactattgctatagattacctatttcattacaaggagaaagaaactcaacagattacttacaacaagtagtgttaacaatatagcaagtttttagatgccaagttattccgcaatagatatattttcgtaacaaaatggtacttcctccgtttcacaatataagtcattctaccattttccacatttatattaatactaatgaatctaaatagatatatatgtctagatttattagcatcaatatgaatgtggaaaatactagaatgacttacattgtgaaacggaagggagtactggataccgcggaatcgtttgagataagcaggtttgtgaaagatattttcaccgtgtctacatcatttctttacaaaagcatttgtgatttgtatggtagtacaaaaggtttccaagtgaccacgcaaacaatgttgtccgctgaagtgtccacctttatcatgggccgaagagggaaatatcctcataccccgtcgtcacccagaaggccagaatgtcacttgacatccttgtcgcggccattattctcgttggaagctatccatcttgcgaagacgtacgtgcagaatgcatcatccatgatattgtttgtcccgtccctacatcacgccaaaagtcacaacaaaaacacagtaaagatagtttggaaagaaaaaagaagttattctcgatataaaactggcaatatttggctataagcgagtgtaatttccgtcaactaaagcccaattgaatcaaggttcatagtttcagaatatattctaaaataatggataatatttgaccatcattatgtttttggtcaagtaaaagccaaagccatatggttcgcacttcgcagtttcaagaatatttaaacacggtaaattacccaatctgaactgagatctttgggtggtatctcgtgcagtagctggcctccataatctttaagcatataccatccctgacagtgacatcgactatttaaggttaggtaggaattaacgcccaattacggatagtgtggatcaaacttgagttcactggactctgccactacggaaatctggatcgcatcttaattaagcctcgagagagacattagtatttttattcgctcattccaccggtcagaaacgtgtgcaagctaacaacatcgctaggcaaaaggaagtcgttgctttcgagtttcccacccatggcatcctccgccggcgacccgctcctctccggcgaggccggcgacggccgccgcaggttcgtcccgtccaccatacggctcaagacgtcggtgtggtcggagctgggcggcgcggtgggcgatctgggcacctacatccccatcgtgctggcgctgtcgctcgcgtcccacctcgacctcggcaccacgctcatcttcaccgcgctctacaacttcgccaccgggctcctcttcggcatccccatgcccgtccagcccatgaagtccatcgccgccgtcgcgctctcctccgcgcacctcaccatcccgcagatcatgtccgctggcctcgccgtcgccgccatcctcctcttcctcggcgtcaccggcctcatgaccaccctctaccgcctcctcccgctccccgtcgtgcgcggcgtccagctctcgcagggcctctccttcgccttcaccgccgtcaagtacatccgctacgtgcaggacttctcccgttcctcctctgcttccacctccgtgccgcgccccctcctcggcctcgacggccttgtcctcgcgctcgccgcgctactgttcataatcctcgccaccggctccggcgacgacgaggacgtcaacagggacggcacgagccgtcgccgtcgctcctgcagccgcgtcccggcggcgctaatcgtgttcgcgctcggcttggtgctctgcttcgttcgtgatccgtccatcctgcaggatctccgctttgggccggcgccgttggggctggtcaagataacctgggacgatttcaagatcgggttctgggagggcgccgtgccgcagctcccgctgtccgtgctgaactcggtgatcgccgtgtgcaagctgtcgtcggacctgttcccggaacgggccgagctctcgccggcgcgggtgtcggtgagcgtggggctcatgaatttcgtggggtgctggttcggcgccatgccgtgctgccacggcgcgggcgggctggcggggcagtaccggttcggcggccggaccggcgcgtccgtggtgttcctggccatcggcaagctggcgctcgggctggtgttcggcaactcgttcgtgacgatcctggggcagttcccgatcgggatactgggcgtcatgctgctcttctccgggatcgagctcgccatggcgtcgcgcgacatggggagcaagcaggagtcgttcgtcatgctggtctgcgccggcgtgtcgctcacaggctcgagcgccgcgctgggcttcatctccggaatcgtgctgtacctgttgctacgcctgagggatttggagtgggatatcagaggactgctcggtcgctgggccgcgggacggcggcaatcgaccaacgaggccaatgaagatggggctggagatgcttgatcgaaatcttgagaacatctgttgatttgagattttgagtgtggtgtgaattgttcgagcgaatatatatagtatcaacatgcatagcggatagccacgagtgattgaatttctgaatggagtaactccacataatcgcccaaactttcaaaccaactactccctctg

SEQ ID NO: 66294 - DNA, 6780 bp, Oryza sativa
agcacactaaatgaaattttagtttaaaatatagtacaaaatttttaataaaaattctgccacacataaacattcataataaattttaatcacattaaagaagaggtccgcgcatatacgtgggttacctagttttgagatataaataaacaaattcaacgtattaatagtagctagtagcgcattgctcatacctgaatttatcttttctttttctctttttgtgtaggttgaattttaacttgatttttggaaaactgatagatatgtatatactctacattaccaatttatttaagaattttcacaattatttgcatcggattttgagaaaaaaaaggttaaacgtggggacaacacattgagaaattagaatccattctcattaaaaatactatctctgtgccgaaatgagtactccctccgtcccaaaaaaagataaaccctggtttctgtgcccaacgtttgaccgtccgtcttatttaaaaaaaattaaaagacaagtcacgcataaaatattaatcatgttttatcatctaacaacaatgaaaatacgaattataaaaaaaattcatataagacggacagttaaagttggacacggaaacccaggatttgctttttttttttggacggagggagtacatcttaaattcgttcgttacaatgtgattatgccaaagctgatcaactataaaaacaaaaatgtactttgcatggatgaggcgtaccaacctcgccattgctcaacttgactccggcgctcagctttggctcacgtacgccgcccggcgtttttatttgccatcgatttcgcatgcatgggaagttggggacagattcggtttcggctcgcaccacttaaactaatggaattccgttagtaatcagttacagcttgttcaggacggatccgattcgatcgcgcggctaaaacgttcacacatccatttccaactcgcaaactacaacagtcaccccgcatatatagacagattctcaagctgcgggcatatatgtacgattgatcgccaggggcgatcgggtctcctccctcttttcctccaccctccacgtggttttttttagcaccacattacttttctattttagtaaatttatgcacctaaagtttgtacacttcaagtttacacatctaaagtttacaggcccttaaatcaaaagtttatatatctgatttaaatttaaatttaaatccaaatattttttatatatagtatttctatacatctaaagtttatacacctaaagtttatagacccaagtttataagtcaaaagtttatatacccgattcaaatttgaattgtatcggattcaaatttgaatttgaatttgaatttaaatattttttatatatagtatttctatacatctaaagtttatagacccaaagtttataagtcaaaagtttaaatacccgattcaaatttgaatttgaattatatcctgtcggtgatatgggaccgggggtatcgtgaccagaggcttgaggcagacacaatcgcccacgtggcctggcaccttcggggacgtcgggcccgagggtgaggtgtccgccctcctcctgatttcccccccgagggggggtcgggttgctcctgccccggccccgagggccgaggcaccccgaccccttgagggagtttgcgccacatatatgggataggtgaacacgacagtgctcacctaaccgcatttattgtggtctggtcaagcgtgtcacactgcatgcagcgcagtgcagcgcgttcttttatccggtctgtgactggtcacagaccggtcagatcacgggttaggtggcgactggcggtctgacgcacgccttgccccatcccgtcaagacgaaagcctctaggcacttgtctcaagccggagctagcgggttatctcttagagatggcacgttagccctggttagatttataccaggcttcatcccaaccattacatgcaagatgttacatgaagaagggcaaacatgcacgttgctaagctgacgcgtggtagacaaggatgactgatctgtgaccggtctgacactggtcgcgtcatccacagacagccataatcccacgtcgcacctgtttccggcggaagtgggggtaggtatgggccgtctcgtcagaagggcactcggacagcaatcgtaccgatctccgtccatttatgaagagaagaacagtccggtttggaaagggaaaggtgcatgtggtatccccttgagatataaaaggaggaccttgcccacctagggaggggactgagggctggatgacactttgtaacttgtccatacacagatccacaaaaacacaggagtagggtattacgcttcccagcggcccgaacctgtatacattgcccgtgtctcgcgtttcttcctggctcgcgatctttctacatacagcgagagcttgggatttcaccctaagcccccggacgaactggcaaaggggggcctgcgcagtctcccggtgaggagccacgagctccgtcatctggcgcgccaggtagggggctcagcgtgtgttttctgagctctcatactcttccgtgtgcgccaagtttcccttgttcagcctaatggccgagcaagcaaaggcgcacgacctctctccgagtgtgagcggcgacgacggggagccaaacccacgccgtcgagctcgtactcccccacctcctccacaccaaagtcctaagcagggggaggcgctcgagagggttgataaatccatagcatcaccggtcgcgggtgatgcaggagaacggcgagatggggagcgtcgcctcctcgtctacggcgacggcagcacgcctcagggcgcgcttcaggctgctggcgcgctcctacgtcacccgcccgtcgttcctgacccggagtctccagcccagcgatggctggacgacgtggccaacttggtcatgacggcacagcagcgcctgggtgctggtggacggtccgccaccaccaagacctccggcgccgccaccaccggctccgtgtcatcaaggcggagggcgcggcgagcggcggcggttgcacgtcattcggctgccactccctcgtcgacacccccgactcgggaggatcagcatggagagccggatgcccgcctcgacatcgagcgccggcgtaataaccggcgtactccccgcgcaacggagggcgcctcttcgtccagagtgtcgcctcgacatggacgtgaggaccagccctccgtgcccccggctggtggtgtcggctgtagagcctttgtggcgagtcttcggaatgtccgttggcccccaaggttccggcccaccatcaccgagaagtatgatgggagcgtcaaccccaccgagtttctccaggtctacacgaccgggattgaggccgctgggggtgacgacagggttatggcgaatttctttcccatggtcctgaagggacaggcgcggggttggctaatgaacctgccacccgcgtcggtccactcctgggaagatttgtgccaacagttcaccatgaactttcaaggcacatatccgcgcccaggcgaagaagcggacttgcacgcagtacagcgaggggatgatgagtcacttcgctcgtacattcagcggttctgccaagtccgcaataccataccatgcatccctgcacacgcggtgatctacgcgttcagggggggtgtgcggcacaaccgcatgctcgaaaagatcgcttccaaagagccccagactaccgcagagctttttcagctcgcggaccgagtggctcgtaaggaggaggcttggacctggaacccctccggttccggtgtggcagcttcggccgcccccggatccgccgctcaaacagggcggcgtgacaggaggaggaagaagaggtcggtccattccggcgacgagggtcatgtcctcgccgtcgagggcgctccacgggccacccgaaaggggaggcctgcgagcgacaaaaagaaagaggctggtactcccagcagggagcgctcagccggcaagtggtgctccgtccacaacacctccctccatgatctcgcggactgccatgcagtcaaaaatttggcagagcgaacgaggaagtgggaggaggacaggaggcaggagcgccgggaaggtaagtccccggcggttccttccggcaaacggcgaagtgaggccaaacagaaggcccccgctgttgacatcgatgacggtgatgatgacctaggtttccaagaacctggggccaccattgccactgtcgatgggggagcgtgtgctcacatctctcgccggagcttcaaggctatgaagcgagagcttctcgccgcggcccctactcatgaggcgacgcgtcgggcgcggtggtcggaggttgccctcacctttgaccagaccgaccacccaccgtgcgttgcccggggagggcagattgcgatggtggtttcccccaccgtttgcaatgtgaagttggggcgagtcctcattgatgggggagccgccctcaacatcctttcccccgcggcctatgatgccatcaaggctccggggatggtgctccggccgtctcaaccgattatcggtgtgacgccggggcacacatggccgttaggtcacatcgacctgccggtcaccttcggtggatccgccaatttccgcacggagcgggtgaacttcgatgtggcggacctcagtctgccctacaatgcggtcctggggaggcccgcgttggtgaagttcatggcggcggtccactacgcctacctccagatgaagatgtcgggccccggcggccccatctctgtccatggcgacctgaaagtcgcgctcgcttgcatggagcagcgcgcggaccacctcgctgctgcgtccaagcccgagggtggtgacgagaggcttggcacctccgcccccaccgccccgaggcggcggattgtcacatgcgacgaggtcccggtcaaggaggttgccctgggcgacggtccatccaagaccacacggatcggtggtcttctggatggcaaataggaagacgcgctcgtctccttcctgcgggcaaacgctgacgtcttcgcatggagaccggcggatatgcccggggtccccagggaggtgattgagcaccgtctcgccgtgcggccgggcgcgaggccggtccggcagaaagtgcggcggcaggccccggaacgtcaagccttcatccgcgaggaggtggcgagacttctggaggccggattcatccgtgaagtcatccatccggagtggctggcgaacccggtggtcgttcccaaggcgaacggcaagcttcggatgtgtatcgactacaccgaccttaacaaggcatgtcctaaggacccttaccccctgcctcgcatagatcagattgtcgactccactgcggggtgcgaccttttgtgttttctagatgcatactctggttaccatcagattcgcatggctagggaggatgaggaaaaaactgcgttcattacccccgtaggaacctattgttatacatcaatgcccttcgggttaaagaatgcaggtcctacttttcagcgtactactcgaatttctttgggtagccaaataggacgtaatgttgaggcttatgttgatgacttggttgtaaagacgcgcaaccaagagactttactctcagatctagcggaaacttttgaaaacctccgctccgcccgcataaaactgaaccccgataagtgcgtgtttggtgtacctgcgggcaagcttctcgggttcttggtctctgcccgaggcatcgaggccaaccccgagaagatacgagctatagagcggatgcgcccccccagcaaacttagggatgtgcagtgcgtcaccggttgcatggccgccctaagtcgtttcatatcgaggctgggagagaaggcgctacccttatttaagctcctcaagcgctcggggccgtttacttggacggaggaagctgaaaatgccctcgctcagttgaaggcgtatctcagctctcctccggttctcgttgccccggagccaaatgagcccctgctactttacttagcggcgaccccccaagtagttagtgcagcgttggttgtggagcgcgatgaggacaatcctcattccgcgcacccccaccctgtgccgacttggcccgggagcaagcagggaggagaggcccccgagtcgaacggcggcctaaggcccctgacgaccggagtcggccctctacccgcttgtcagacggtgctgggtgcccccgaccctcaggaaggccccgaggccactgcgggaaggccgcacctatcgccctttggccccgaggctaaccctgtgctgactcgacccgggagagagcagggaggagaggcccccgagccgaacggaggcctgaggcccctgacgaccggagttgtccctttgcccgcttgtccgacgacgccaggagcccccgaccctcaggacggccccgaggccactgtgggaaggccgctcctgtcatcctccgaccccgaggtcatcggcacagaagacgagtgcgccccgagaggccatttggacgaagaacgccccggggatacggcccctagcgaagaggatcggccccaccgaagggtgcagcggcctgtctactttgttagtgaggccctccgggacgccaagacccgataccctcaggcccagaagatgctttacgctattctgatggcctcgaggaaactgcgccattatttccaggcgcatcgggtcactgtggttacgtcttaccccctcg

SEQ ID NO: 66295 - DNA, 6630 bp, Oryza sativa
acaggacgggtggtaaaatgggcaatcgagctttctgagttcgatctgcactttgaaccacgccacgctatcaagagccaggccctcgccgattttgtggcagagtggaccccgactccagagaccgtctcaattcccgaggccagcacggacccctcacggctgcctcacaccgcccactgggtgatgcagttcgacggttctctgtctctccagggcgccggtgcgggggtcacgttgacctctccgaacggagacatcctcagatacttggtccgtctcgattttcgagcgactaataatatggcagagtacgagggactccttgccggactcagagtggcagctggactggggatccgccgcctcttggtgttaggcgactcccagctggtcgttaaccaggtctgtaaggagtaccggtgctctgacccacagatggacgcttacgtacgccaagtgcggcgtatggagcgccattttgacgggatagagcttcggcatgtacccagacgggataacatgattgccgacgaactctcacggctcgcgtcctcgcgagcccagaccccaccgggcgcctttgaagaaaggcttacccagccgtcggcgcgacccgaccccttaggggagacggatgcgcctgaccggcccccgaggcccgtcggagtccaggcctcgggacccgaagggagcgctccaagctcccttagattgattgcatggatctctgagatccaagcatacctcacagataagactctacccgaggaccgcgaagggagtgaacacatccaacgcatttccaaacgctacgtgctggtagaagggaccctctatcggcgcgcggctaatggaatcctcctgaagtgcattcctcgggaacaaggcgttgagcttcttgccgatatccatgaaggcgagtgcggagcccattctgcctcgcgcacactggttggcaaggcctttcgtcaaggattctattggccgccagctctcaatgatgcagtcgatctggtccgccgatgcagagcgtgtcagtttcacgccaagcaaatccatcagccggcccaggccctgcagatcataccactttcgtggccatttgctgtctgggggctcgatatcctgggaccgtttaagcgggccccgggcgggtttgagtatctgtatgtcgcgatcgacaagttcactaagtggcccgaggcttatccggtcgtcaagatcgataagcactctgcacttaaattcattaagggcatcacggcccgttttggagtgcctaaccgtattattacggataatggcacccaattcactagtgaactcttcggcgactactgcgaagacatgggcatcaagctctgcttcgcctcacctgcccaccccagaagcaatggccaagtggagcgcgccaatgcagaaatcctcaaaggccttaaaaccaagaccttcaatattctcaagaagcacggcgattcgtggatcgaggagttgccagcggtgctctgggcaaaccgaaccacaccaagccgagcaaccggggaaacgcctttcttcctcgtctatggcgcagaagcggttctcccatccgagctcaccctgaggtctcctcgggccaccatgtactgcgaagctgatcaagatcagcttcgcagagatgacctcgactacttggaagagcgaaggaggcgcgcggccctccgagccgcgcgctaccagcagagcctgcggcgctaccatcagcgccacgtccgggcccgatcactctgcgtcgacgacctcgtcttacgccgcgtccaaacgcgtgctggattgagcaagctctcaccaatgtgggagggtccgtatcgagtgatcggtgtcccccggccgggctcccgtacggctggccacgggcgacggcacggagctgcctaacccgtggaacatcgaacaccttcgtcgcttctacccctgagaggggggtcgagtgtcaggtcttggctcgggccaaccccgcacccccctcgggtgtgcaggattggccgggggctaccacgcatgcacattcttatttctcttatttcagcatttcaataaaagcagtttcaatttcctaaaggttgtgtctgtgccgttttttccttttgaagaatcttgacttgaaataaggtcactcgtgctcaaccttgccctcgggggctcggttcggtcagctaaaatcgccaaacggggcccagaaccgagccgtgccccggggcgtggtgaactccgggggggaatcggcaaaaacccacaatcgggtcacccataaccctcggtcaccacgttcccgggctggccagcctcgacatgtggatctccccaggcactagccccgacccgagccattagaggactgggacttgggcacgagcccttaaatcaagctaagacacaaaagaggaccacggcacagatcatcctcatctcatacgcatagcaaaataaaattgacacgaagaattttttcatcattttttccagattaagttgatctatacaaaaaagaggcatgaaggccttagaagaaagaaaaagaaaaaattggagattggcgggggcctgggggctcattccaatgcgcccgggtcgccggcctcgtcgccatcgtcgtctgcaccgctggcgtcgccctcctcgtcggagttgggggcgaacgcgagccgaggggccgagccctcgaagctgttgacgatgtggtcggcggcgtcccggacccgcgcgcgcgcgtcgtcctcggtcccgggagggaactcatccaacgccatccatggagagaagttggggtccctggcctggtaactcgctaatacgagttcgaccgctccttgggcgaggtccctcgaggatgacttgatggtcttctcgagctcctcggggagttgttggagagcccaggccatcttcgtgaggcgcggagcgaggccttccagattggtggagtgcagcattgtttggcctttccagaggcccgcttgtcgaccggcgcgatccaggcgggagaccgcatcccaaagagtgccgggccctatctcgcccgccaagcggagggcctcggcctccccggcggatgagtcgagggcgcgctgcatgtcggcgacggtgtgttcggcagctgcgaggcgggcggctaagtcgctttcgcccgcagccgccctaccgatgggcgcccttgcggccagctctttttcccgcgcctcgaggtcagcagcccgctgctccagtgcggctctctcggcgcggacgcattccagattgcggcgcgcctgctcctcttgcgctgcctcgcggagggacaggctgtccgccagccgttgcgccgcggcctcggcctcctcgagagctcgctcccgctcagcgagtgcgtcctcgcggaggcggagcgcggactcctcttcggcgcaggcggcctcatgcaccgctagcgttgcctcccggatggcgacggcggcctcgcggtccgccaagcccctctccacggcgccggcgtgttcttccagtgccatggcacgggcctcaaggacctcctcgcgccgccgggatgccgcttcagtctccgttgcccgccgctctcgggcagcggcggtgtcaaggaccccttgggcagcgtcgagctttttctttagctccgcctcccagtttgcgtgttgaaggcggagggtgtcctgcgcctcgaccatcgcggtggtggcgatgagggcggcctcccgctcctcctccacctctcgggcgatctccgccagcaccgctttgcgggcttcaagctccgagacatgacggcggtgagccttacggcccacctccaccatgacgtccaccgagcgccgtccctcctcgacacgcgcccatgcggcctcgagctccgctcgttccgctcgcagggcctccacttgggcgctgaacccatctagcaccgcagtgtttgcggcggccaaggcctgcagaaggggctcggcgctcagcggggcgacagaagacgaggagaagagccgccttggagagaacgcgacgcggctcggcccgccggaggatgcgctgggctcggggatgtcccccggacccgtttggtcctgggcgtcgcccggagaagtgggcccaggcgatgcgcccgcggcctcgtcacgagccgccccggaggccgtcgcttgagcgtcgcccgagggagtgggcccaagcgacacgccagcagctttgtcgtgagctgcctcggaagacgccatcgcctcagcctggcgagcccgggcggcctcctcccgagcggtttcctccgcttgacgaacccgagcggcctcccgggcggcctcttcagcttcccgaaggcgatctgcggcctctcgccggtcattttctcgcctccgttcctctgcggccgccggatcttcggcctcggactggccggacttggggtggcgggaggaacgcgacgggacatcgctgaagcagaagaaaaaaccagaagacgaacaagatgggtaagagaaaatttgcttttgggataggagaaagacggtcgcaaggagagtgggacgaacctgcgagggggtcggttaaatgaccaccttggaggggaaatcaggtttccccgggatggttccgtctcccccatcttgcggagccgcttcttcttgcgctccccctcgggttgcgatgacggcgcggccccctccgggcgcagattgctggcacgcgccgccccgccccctcggggaggagatgggggaggtgttcctcccagcttcctcttcccctgggcgtcggcagggcggctgctccccgagcccccgacgcgaggcccagaagcacgaccccctcctggggtagattgatccccccggcggctctcgcccgcgccgtcgtggcccttaggagtttcctcctctgaggccccgacccctatcataatggtcagaatagaggcgcggtcgggatcgctgcagagggggaggattcctcgaggaataagagacgcctccacggagctgagattcagcaccctttggaccacgatcttgaagtcctcgggagcccaatcccatctggctccctggtgggtccgcatgtagtcttcggacccagtgtactcccaagcgctccgggcgcgccgctggagcggcgcaatccggcgacggaggtagtcgccgtacaccatggcccctgtgagcccctgggagcgcaggcccgccaggcggtcgaggacggcgtcatagtcatcccccagatctaccggcgcccgccagctggagacctgcgccgggggctggcttggaagtcggaggcgcgcttcgttggcgaggggggtgtagaaccagtcgctcttccagtcgtcccacttcttgcggagggcgcaggggatgtagcggttcagcaccggcccccgcggctggaagtagcaaccaccaaccaccgacggtggcgacaccgactgcacggtgaagaaccaccggaacagccgaagagatgggcgcaccccaatgaacatctcgcacaggtgcgcgaagatggccaatgtcatcaccgcattgggggtgaggtgcgccatctggagatcgtagaactccagaacgtccataaagaagcaagaaaatggcggaaccagccccgccattgcgaaggggaggaagaagacggaccgccccgggtagtctggtgccgggcgtcccccgcccagcatcactatctcccgaccggtggcggattccggcatgaagcggcgcggcagcccggcgtgcctctcgctcacgatgcgggaaggcggtagaacgctaccatcgagcagagcggagccccgtgccatggcgccggaggaagaggtgattgaaagcgagcgcgtgtggcgaaggtagggcgcagcagagaaagagggagggctcaagcggcgaaggcaagagggataatggcgaaaggaagggagcaaaacttttcctcggtgtttttatacccttgccatcgctgggcccggctcctcgtttctcgcgcccactatctcgctccctcgtttctcactatctcgctccctcgtttctcgtgccctcgcttccactaatcccattcgcccgcttgcggcgcatgaggtggatatgcggttgtggcagtcgagatagatcgtatcgtgcgcgcgttaattacgctcgccggccgaagcgacgttaccatatctccaggcgaagcaaatcagctcacccagattcgtgcgctgcttaagtgatgtggcagtcttgaagagaccgcccattatggacagccaagttaccatatgtgcatggtttgagaccgttgggtttctgcgcaaccatggaaaccggtcccacctgtcaccaggctttaggagtggcattacgcccgaccgcttcccttgagaagggcgatcgccctggcataacgccgggggctactgtcggtgatatgggaccgggggtatcgtgaccagaggcttgaggcagacacaatcgcccacgtggcctggcaccttcggggacgtcgggcccgagggtgaggtgtccgccctcctcctgatttcccccccgagggggggtcgggttgctcctgccccggccccgagggccgaggcaccccgaccccttgagggagtttgcgccacatatatgg

SEQ ID NO: 66296 - DNA, 1494 bp, Oryza sativa
tgcccacctagggaggggactgagggctggatgacactttgtaacttgtccatacacagatccacaaaaacacaggagtagggtattacgcttcccagcggcccgaacctgtatacattgcccgtgtctcgcgtttcttcctggctcgcgatctttctacatacagcgagagcttgggatttcaccctaagcccccggacgaactggcaaaggggggcctgtgcggtctcccggtgaggagccacgagctccgtcatatccgattcaaatttgaatttgaattcaaatattttttatatttagtatttctatacatctaaagtttatacacctaaagtttatagacccaaagtttataagtcaaaagtttacatacccgattcaaattcaaatattagtgtatagacctaaaatctataattcaaaagtttacatacccgtttcaaatttgaatttgaattcaaatattttttatatatagtatttctatatataatttttttcaactttgttttttttatcttttttaaatttatagtgtagtaggaaatagaataaggggaggaggaagggatgagagggtggggggggggggcgctggttagcgaccagtcgcgccccccgcgccgcgcgcggccacttttcctttcttagtctctcttctctacggcacatgcatatacatatatacgtatacgtatagttatatatatatatatatatatatatatatatatatatatatactacttttagaaaaaagaggtgcttccatcgttcgttaaaaaaccgtgggagaaaaaaccgggcgaaaaaaccggacgaaaaaaaaactatgtccgataaaaaaaggacgaaacaaatgaaaaaaatccgctggcgaaaaaaaaccgtgtgaaaaaaaaactccgataaaaaaggcaaaagaagggaaaaaaaccgggaaaaaagaaaaaaaaataataagtccgatccaaaaaagttgaggcaaaaaaaagaaaaaaaaagaaacgaatctgactcggtctacagggtaaaaaaggcaaaaaaaataaaggaaaaaaatcaaaacgaatccgactctatcgacgcggtaaagaaaagggccaaaaagaaaaaaggtatctgtccgattccaaagaaaaccgaatcctattatatgtgacacggtgtggtaaaaaaacaaatcgaatccgactccatcgacgcggtaaaaaacaagcgtaaaattttttttctgtccgattccaaaaaaaaaagttgcgaaaaaagttttccgtttctctttctctatctctatctctatatgtacaacttaaaaataaaaaagtgtttccgtcgtctatccgtgaaaaaaacgtgaaaaagaaaccgggcaaaaaaaatcgatatatgtgacacggtaaaacaaattaaagatgtttctgacatccgtagtaacgaaaaaagggcgaaaaaatgaaaaaaaaggaaagtccgattcaatatctatat

SEQ ID NO: 66297 - DNA, 2360 bp, Oryza sativa
aatgtactaaggcagagctcaccttttgcaggtcatattaggtaccattattggcatctacaagccatcgatggtaaaatttctaacttgacaatacccattactgtctgtactcaacagcaaatgccacagaaactgactttatagttttcttggaaaactttcaggttacctggttggagactgatcttttcactgtgggcctaggattcctaatgctatcaatgggactaacattgaccttcgaagatttcaggagatgcatgaggaatccatggactgtatgtttctgctcctgaacgtcttctcttaaagaaatagtgattatttttctgtacttgaggcctccaacttgatataggtttactaatgcaattgcctgttgcaggtgggtgtgggatttcttgcgcagtatttgatcaaacctatgctgggatttgctattgccatggtaatgctaggccatgccttcctattatttctaatgaaagaacaaaaaaatgaaataaacacaatctgttattcctttgtttggatatgctgctatggcagctatgctaggctttcctttcatgcgaaacaggcttgttaaagattctcatgtaaactctgggaaatattaaattgaaaggttggtgccttgctcaaagaaataattgatttgacaagcccttccctgaaaagatgcacatgccattatgctacggtttcttttcatgagatttttcatgcaaatgttaattgtaattaaattaaaaaggttgatgtcttgattaaatcaataatcaataaactgatctgacaaagcaaccttaaagatttgaaggttcaagatcaacatcaaagatttttttaaaggttcaagattgttctctggtttcatttttaggaccttttcctttcatttcctgtgtcttggatactttgagcatgtcacgtatctcaagtttcttttgtttttccatttaattttacctttttcccttgtaaggtgatatctcatctcattgcaatttttatgtgaagaaagttaatctatgtagggtagccgatacaattttatcatatcaaatgtaaactctacccgttatctgcattctttgttttccattgctgtctatttgaatccatagaatacaatttcagtggtatagtgtttctctttggttattgcaaaaaaagtttgaacctaaaattccttctagtgcattttttttcactaagatatctgcacaaatttgacgtctatatttaggtgcaacctaatatggatgtttattttacagaccttgaagttatctgctcctcttgcaactggtcttattttagtgtcatgttgccctggtggacaagcatcaaatgttgctacttatatatccaaaggaaatgtcgcactttcagttcttatgacaacgtaagcttcagatttgcttgagaagaaatttctttggtgcttgttctgatctacttgttatacatgtaccttcatctttcttgaggttctttatccctaattagagtgacagcctttataattgatttctgttgtgctcttatcattctgttatcatggtaaattacccgtttttttcttggaagacacattttcatgctagccagtctcaaaaatattgaatacattggtttagattgtttgtatgtgttaccagtttcgcaagttttaaccggcatatttatttgatgccaacacttttgtattgtctgtactcgcatgcgtagaaaatatctgcatatcatggttacacactcaacaagctttctattgagacatcaaatttggacacactatttacgattccaaagatttagttcacagattgcttttagcatgccaattcaatttgacatgcttccagccatgaagcgtttaaagaatgttactaccttgtaccttttctagtaggttttcatggcaggcttcatacataaactctttttttggatgataggaccatgttccaaaactattatagtttgatgtaattattatctgaatgaatgttgacacaattttgtttagtcgtgtaagcaaaacaacctaatatgcatggcttgattggacaaagtatagtttaagggctggaattgagggcatacggtgctattttgcctatgtgctattattctgctattttgttgtgccatttgattttaatacagaaaccacttaggatgtgttcaattgtgctggttcgtaactcattctccccgcacggaaaatgaggtagctcatgattaaggctgcgttcgacaccgatggttcagaacctctctccggcatgaaaaaagggatgactcattagcacataattaattaagtattagctaaaaaaacttta

SEQ ID NO: 66298 - DNA, 1289 bp, Oryza sativa
ttccccgacgcttttcaacatcacctggcttttttttctctactaacctaatactattgttctgaatatcattattcgccatgctcctctcattcacatcccctctgttcctctgagatcccttttgcctatcaaaagatgtactccttccatcacctgacctctcgtcccctcgccgaacaaccggtgcatcgccatcgcctgtaaacctcctcctcgagctccttccatccgattctgtgctctctaaactcttgctcctgtccaacttcaccgactccatgatcttcacatagtcggtgaagtcgggctaaacgtcagctccttctcgacgtgccgcaactcggacgaaccgggaccagcctcgccgccagccaccgcgcacatagcaccaaaaccatccgctctcgcgtcagaaacccggcctctcctcgccaaaccccaaccaaacggcgccacggagaccctcctcctcctcctcgtcggaaccacgaacccgtggcacgcgctcgaatcaggcgccgaggcggggagcaagaccccgcgccccgccaggttgggaatcagccccaccgtcgcgctcggcggcggcgccgccatcacacacacacacacaccacgaggtttcggccgcggcgtggctaccacattctccgccggcggagcaactccgagcgaggtaaaccccttcccaaccgcaagagaaacgcacggcgagtgctggtcggagcgccggcgaggctcgagctggtgggttgcggggaggaaggagcgcgagtacctggggagtttgcgccgcgaggcctccgcgttatctcctcctccgccggtgcccggtgccgtcgtggcgctccctccggtggagcccactttgtgtagtgtctagtgcagcgaatatatttccgcgtacgggccgggccgggccgacaatctatgcgttgttgggcctccaaagggtaactcaccaaggtgtggccgagccaagccgaagacaaatttgggcttaggctgctcgttcactgaagaagatttatctcgttattcatcagcgttctaaattactatatggtatgtttttacagaaaaagttatataagaaagttactttaaaagatcatacaaattcaattttctaagttaaaatcctcgcagacaaattatagttaaataattaatactaaattaatcacatactaatcgctcatctcattttacacatcttctcttttcccctccccttgaacactcttagtttggcaaaaattgacaggcagaatgtgcaggtgcac

SEQ ID NO: 66299 - DNA, 3532 bp, Oryza sativa
  unsure (1)..(3532): unsure at all n locations
ggtggtggagggggaggacgggcaggcggaggaccaggaggagaggtgggcgcggctgctgccggagctgatgtccgaggtggtgcggcgcgtggaggcgtccgggggcgagcgttggcccgcgcggaaggacgtggtctcctgcgcctgcgtgtgccggcggtggcgggacgctgccgtcgccgtcgtgcggccgcccgcggagtccggcaagatcaccttcccgtcctcgctcaagcaggtgaggaaaggggggggggggggtgatgcccttctgctgttttgctaagagctcctatccctcgattgatgggggcttctggccgctgattcgaagtatggtggtagggagtggaaacccccattacgtcgatttgttttagcaggtgtcgttcctagatgcgatttgttatgtctctggttggtgatttagagagtcctctatgcttttgattgctaaatttggagcctgcgtctttaggttccctcagttctggccataggatgctgagatcacttgctcatgctatttttagaggattatttaatttttgaggtttacaaatttaccttttttattcgcgatgtttcgtgggattagttaatttgtttatgtctagtcctagctatttgtttttggagtaagttaactttcaatcgattttgatactagtatttttttttataagagtttgtggatttaacttaaaactaggctcgggagcaactagatttagttagtacaatggatgatttatatcgcacttgttctttttatggctttggcaaaatcaccacatcgttggtagatagcagtatagcacactggaggcttggaaggaaaaacaaacccgaggagggtcgtccgctatgaatgaatagttggaaaatcttatcaccagcagtttgaattttcatgcttttggctacagatttgatgttaggaccatattccagcatgtatatagtctagctttacttagtcccgttctaagctccaacaacatccagatttttcctcgatttccgttagcacgcttttcaaactgctaaagattgtatttcatgcaaaanctttctatatagaagttgctataaaaaatcaaataaatccattttttaatttttaataattaaaacatcattaaccatgcgctaatgagtctcgttttacatgcgcacttaatcttcatccaataatcagattcgaacggggccatatgtgtttagctatttactatcctatcacacagagggtgatttcacttataagtgggagtttagtggctgaaattccccatgagatgagtagcatagttttgttttgggtgattcgtctacgtaggattttagttgcagtcttgcagaggagtgtcgtagttttgatacacagtatttgtatgcaaattaatcggagttcttacaccttttgtcaagcagccagggccaagggagttcccaatgcaatgtttcattaagcggaataagaagaactctacgttctacctctaccttggtttgacaaatggtaagtgtatgactgtacgtgatgtgatatgagaacttccttgactctcatttattttgtgctgcatatgtgcaggcatcaatttgattatgtgcatctagataatcaatttgatttgccatctcaatgtaaggcatgtgacatgctgttttatgattgctgtgcgggttctgtttttctaggaatttgttacttgtctgtggttgacacttgatgcctagcagtagtcaagttgaatgcttttagatttaactcagattcgttgtggctttaattggagatgcatcgcttgtttctcgtagttgatggcttgatgttgacctatcaacttttggcatgggcagtcccatgcacatttgcttcctggctttcattttttttctatagattcaaattatctgtcaaaccagcagaaatgcacagtatgtttgcattctaggaccatgtgatattttgcatttggatcttttggcataattggtatgggatggtgggaggataaggtggaggattggagcacctaatggattagaacctacagcattttacttgaattaggaactaatattgttttgtacctgcctattttttgtgtagcaactgataagaaattgataagagatgccccttcgggattatgtactatgttatgtcctcatgggccaatgggcctagaatatatgggcccgaatatacttaacactgtttatttatttggattggctagtttggacataattgttgaagggtttagctgaattataccaaagtcttcgtgtcctgcaaatagtgattagggtgactggaagtctacttgttccattacatttgatggcctgcttagtcaagtgttttcaaatttcttttattttgacaatcagatccaacagcactcaaattatgtatctagaagcaacatttttctctccttacaggcttacactcagctgttcaagtgtaacatctaacatgtgcggatatgtgttttttttaaaaaaaagaaaaagaaaaaggatgggggttctgtcagttacaccgtatatttttccttctggtttttgtaccaactgcaatgccatatggactttttcaccatcaaatgtgcttgatgattaatatatactttttgtatatgatagcaactgtggataaagggaagttcctcatggctgctagaaggtttagacgtggtccccataccgagtacatcgtatcccttgatgctgatgacctttcacaaggaagcaatgcatacatggggaaactgaggtgaggttctacatggctgcatgttcactcttaatcattcttgcatattctgttattcatcctgcttagtgctaacaaattggttgcagtaatatatttacaattagggaacatgctaatgcactaaaaatatgtatttagctgatctgcagatgttttttttttaaaaaaaattgggtacccataccataagacaatataagccttctgagttctaaatagtatctgtttctttactatcttgtttttcaatgaggtattggtctgttttatagttcaaatggtactccctcgttttttatatatgacgcttgttagttcaatattgaattaactaacgtcgtatatatataaaaaggagggagtatatccttatgttgtaagattgaaccccttaacatggtggcatgctgtgatgccccaaggtctgaactggttttaagtctataatctaaattctaaccccattttggatagagtacacactcacaccaacacacttgcactttcatcctttgtgttcgtgttcaagggtttggttgataccttggactttttctgttttgagggattgataccttggacctggtaagcctgcaaaagtaggccttgtttgggaaagacccggcccatcccctgggattttagccttgccaaacaaggccacaaggtgggactaattcacaccctcatgtgtggacttactcaaaccaccgtagggtgtcacacatgcct

SEQ ID NO: 66300 - DNA, 1430 bp, Oryza sativa
aaatggatttgctggtctcgcaaggcatgcgttgagcgttgttggcttgttgcgtcgccgttgagttaggctgcgttgcggggggtaaacgcgtgcatgatcctggatgaccgctggtggccagggatgaaaacggagcctatcgagaaaattgaatacattaggatggtacagatacggatacaatcatacaaatacaaatgtttttcccacatgaatagttgaatacaaatatggtattagactttccgacggatacacattttagaagtttaggtggatttcgtgttccgagacatatttgtttatgtattgtgtctggtgttattcaatccttatttgtattcgagatcattcatatttatgtctatatcccagctattcgtatttgttttcatatccggctaaaagtacgaaaaccgatgtgatatgaatgctatccgcatgtatccgctctattttcatctctattggtgacatgcagcagcgggggaagagggcaagaggaagtatggcgaaagttcataagatggtgcaatgcaaactttgcaatcccggcggacagtgacagcatgcttgctgactggtggcttgcaacgcggcgccgttttaggacgagctacagggtggacttcgacaacgcctttatgttaatttgctagcttatttggaaggaacaaaatgctagaatttttcagcatgtgtcaaagattccgaagcaactagccgaggatataaaagaagaaattgcggtgtggagggtagctgggatcttctcccattttggagagtaatcgtgttgtgtattgtcagggttctgccctaccttccctctttcccctttgcttgttcacgctgggtctgggatctctcccggactagcgcgacattgtaatgtcgttgtaacattctccttgtttttctttccaatcttaatgaaattggtcgttggccgacccggcaaaaaaaaaaagggcaagaggcaaatcttccgagtgtggtttcgtagcattacaaatttattagcatatttgagtaaaaataagaacaagtgggattgatttgcatcttggaggatcatgaaaaagaaaaatgcattaggtgaggcttgcgatttgtcagttagctgaaaatgcgaaaaaatatcactcgagttttaaaatactaggatggctttaagaatcttgcaacaccctgtaagccctacatgtcacttctcttattcctcaccccactgcccttgtcaccgccatcaatgtacctctctgcctcaccagcgtggaaggcaccaacaatgccaacaagggccaccataccgacctccttccccctatcccttctttcgcccgaagctgaggcgtggcaacctttcccgtctctagcggcttgcatcgtcgagataccaatgtgtctccaactctccatctcct

SEQ ID NO: 66301 - DNA, 2645 bp, Oryza sativa
atcgagtcaaaaggcaattgcagacaagtttactttcaatattttcatggaggcctgtgctgaagcaaagaggtggaatgattttgagtatgcatttcgcaaaatgttatctagtggctaccactttgacgaacgaaggcaccttcgtatggtgcttgatgcatataggaacgggaaggtgcttatctcatattcctaactctttaactatccatgaatctccgtaagatgtagcttataaggatagaatattcattgtgcataatctttcatatctgaagttgaagatgtttggttcataacataggtcatgttattgcaatgaatggaggatgtttgattatgctgtttttcccccatatgtatgggatcataagattgcatggtgactgatcttagtagttctgaaatctatacatgtgggccttttagcttatatttctatgccctcagagagaacaaacctcactagatttaaaaggaaatttcaactacaagcacagcataatagtactagccccagtttggcaacaatttgagccaattccttcagtattttatggcttactgtcaatatgaactatgcttagagttcagattttatggacaatgatagaatgcaagatatatgatcattttcccattaaactgcttcgttaattatttggtgtagctattcttagccttactgcctttcactattcaggagcagttattggaagatgtatgggactacatgtgccaatatggccgagttccgcctgcccccatgataatggaaagattttgcctgaaactgagacaaggggacacagtggcggcgatgtcctgcatcaatacctttcaggagagcaagatacgcaatgtttcatccatgtcctggttcaatctgctgaaccgtaatggggatcgcttgaaggaggatattattatcaagctacttcatgaactcaacaaccttgtaagctcaagtggtcactctgattctttgtatcaaaatattataagtagctgtacagaattcctttctgtttccacctctgtagaaaaggcgtcttctgatcagcagatgcttccctgtacgtcatagctactatatattaatatgccattatctaaaagaaaatcagagtttggtcattggtcatttggttcgtgctccaaaaagtttgatcatcaaatccatcggtttgctcactgcatcatactattctacgaggataagtgatcgtatgcatgtagcttggtgggctagttatttgttgggattgcatatcggcagaagtaactaactctgaattggtcgtcatcctgagatgcatggcacttcgcctcgttttaaacatcacctactccgctactcactacccgtgtttctcatgttgatatcaattttctcatgtcagtatgtcagctgcttggttaggttctctttggttgttccgacaaaactttgatactttcagctggtataccaaagaacacatggagaagagctacaggtgtgaaaatttctgggtcaattacacacatagatgtcctcgcataatgaatttacgcatgcagccgattgggaactatcgagcctgacgagtagtccaacaccaggcacttgtttgctcgcacgttcggacaggtctgaatccatcctcttgtctggactctgaagcctccatcttgcgacagtcgcctgattggcgctaccaaccgcgcgagataaggttagctcaactttggagaagaaaacgttgcatctgatcgtcgtgtcagtctccatgagcagtgtctctgtacccctcttgttcttttgataaagaaagaaatttttgaagcttcgtggatatttctattttccgtcaggctagacatatgttaagattaactataagatttcggtaagaatttcaaataaaacactctaattttgttagatgtttgaaatttttcctggagaatatatacaggtgatcagacagcaggaggaggatggcgcgcacgacgaaggcggctgcgcgacgtgggcgcggcgacggcgtcgtctccccaacagaagaggaagttattattaagctggcaaagtggcaactgatgaataaaacagaaaagaaaaaaaaagaaaagaggaaaactaacagacggacagctaggcccgggcatcaaataaaatcgtcggaaaaaatcaccaggaataaaaaaattccccttcctttgcgcgtcccacctgtccccttcgtgggccccaccaccgcacgtctccaccttcccccacctcgccgccggccaccgcctccgcctccgcctccgccgccgccgcctccacatcccattccccgtgccctcttccccaacccccctcgcgccggggggcctctgcgtgaaggaagagggcgctgcgacgccgaccgcgcgccggtaatgagctacccatccaccaaatgcgatctgttcgttcgtctttagatgaatcgatcgaggcttagagccttagacccggttttgctggccacttcttcgttatggaagagagagtgttttatttttgtttatcgttttcgagtgcaagcatttggcgccgctaagaccccctgattgcaattggtcactaaacaaatgtcaatgtgaggaggaggagggtattaacccta

SEQ ID NO: 66302 - DNA, 738 bp, Oryza sativa
cccaaataaaagacacatgagttaaaaaaaacagtttatgaattgatctagctatactcgatgtacgcgtacatgcttggctttgtcggctgaatttgccggtacaagctgctgactcttttgttaattaagtaaagaaattaagaaaatgtgctcctcgtcgtcggtaccgccgctgacatcatcagctggaacaaatgatcaatcacgaaggccggctgacatgtagaaaacaaacaaactagagatcgacctttggccctgtttggataagtagccaagagttattttaagacctattttttactcaaggaatagctcttcaatgaaataggccttaagctgttttgatgaaagagctatttgacatttagtacactttctcaatcataactaccccttttctctctttctccactgtatcttttgtgcatgtgtcttggtgtggccggctgcatatgccatgccgttgtgctctatcactaggacagggctctatctcataagcttgtagcataaagggagaaaacaacaaagttttttctttaaaaaagagagatcaaattgctctgtggagcgcgtggactgttcattccattgcataagcactgatccatcaaacgcatccacgctgacacggggaggaggagcatggccggggccggtcgctgacggctgcgacggccagacgcttggatttggatcttcggagaagaaatcgaagccaccaccctccat

SEQ ID NO: 66303 - DNA, 1425 bp, Oryza sativa
gtgtcagtgaccgcgggcgcctcgagaggatacgtacgagccgtacgatgcgccaggtgacggctcgatgggcgacacgtcgcgagcccggcggcgggtggcgcgtcgctcgtgggttcgtggctctccgccgcgaggccgcctccggttcaaagcctagccctctctgatctccctgtttttacgtctcttttgcagctagcaccctgtgtttcgaggtgatttgctaaggattgaatacacactttataggcaagctcttcggttatttcttagaaagcacttaaagcaaacgttttcaggtatggagagagggacgccgatttggatatctttaagattgccgcaccagatgcgtgtagcacatggcatgaatcaatggtggttgttgtgtatatatgtttattagtagtagtgatctttatatatgcatcctaacatagaggagttgtatattactatattggtatgttcacatggatgtattgtagagttcctcccgttttatcatgcactaccttgttggatataattgtaaatgagtagaactggggatggtcatatacaattggtacttatgatttgagagagtaacaatacttttatatcaacaggacaaacacttgcaaatacatacatatatactccctccattctaaaaaaagtgagtacatcccaaaacaatatgtaataggggtgctaaaatcaaattttgctcggttatccagcatgtaatcgtttaattcatatgatacgaaagacaacttgctctaatagcatgtatccacacaatcatgttaatttgaagagtagatctattggtttttttgttgttatgtagtcctcgttctcgattcactttttttttccgaggttcacgattcgcatttcagttacacttaccagctgcaaactaagttgggaggtaataaaaacattatcagattttaatattaaattaataggtttcaaatattgacaatgttactagcttgtggtccgtatgcttcaaaataattcaaaaataatacagcttgctgaagacagcattaatatgccaccacaagaataatatactcaatttttagtatatgaccaaactagtcaataatttttattttctacactataaaaatataaaattaggaggtttgtagctaaggatacattttttggtgggaaccataaggctatcaactagagataaaaccatagaattattatatattttttcaaacactgaatcattgatttatatgagaagccgcaaataactagacacgagagaatacattaagcttatacatcccactatttgtcgatgtgatattaaacaaaagatcaatacaactatatatgctcttcccacatgcaaaaattttggagaatacaaacttcaacaaccaaattaagtgttgttttgcc

SEQ ID NO: 66304 - DNA, 851 bp, Oryza sativa
attttttttctctttcctctagacttttgttttgggtactgcttgtgctgctgtttcgagattggttctgggaattctggaagtatttggtccttttgatctgagattgtccttttctagattggtttgagcttaaagctatctcctttgttcctgtccttcctgttttaactatagatctatgatctccatgtgttaatatgttagaatttgggttgcagcgggaaaaaaagtctgaaagttaacgcgtccttcggccgcggattcagaattctgcgaatataagtacattacggtgggccgtgataccaatttgtaccgagcaattaattgaaggttagagtttgagcttataggagatgaagtgattggagctgaatcctgttgctgaaagcagcgatttcgtgtcaaaatttgatgcctttgcttggttcgagagctgtacatgcttgatactgttgcgatcctgcaatgtcccgaaggaatgccggggcaatgcagcgggaggggtcagtcaaggactgggaggaatttgacccctcgccgtctcccaagctggcgtactcgcagtcctatgttgcaatgagggggcttctgacatcggtggcctcgctggaccttgtcctgatgtcgagcagcctcaagtctgcttgggcagctatatcatcccacaagcatgcccggtccttggagaggtcaaggtccaagggaatgagcttgaagagggccatgctgcagttattagtgtgcttcatggttggtatcttcattgggttcacgccacccttttccgtggatctaccaggaaagatagcttctgaaaatgggaggcttccatttgatggggatgc

SEQ ID NO: 66305 - DNA, 1071 bp, Oryza sativa
attctagcatttctcacattcatatagattcattaacatcaatatgaatgtgaaaaatgttagaatgacttacattgtgaaacggaggaagtatgtctttaggctagtattatgtatagctttcttgtttttaatcaatatgcaatttcgtataattcacagtgacttgacctactatctctaataattggctatatcttctttaaattaaagaccggaatgaattatattataaaaagaaatactacaaccagcgagggaaaaaagttggtaaatttagcagaaaaactattgcatgagtcaaagcatatgaggtcaaacatacaagcaaataagctggagagaagacaaggtcgatctggagagaaggctggagagaagacaagggccctatttggatctaagggctattttttagccctccctcaaattgcccaaatagctcaaaagatccaaaagggtgagttatttgagggctatttgaaaaatagcccacccaaaaaaaactatcctacccaagaggtgctaattggagctatttgaaaaatagcccacccaaaaaaaactatcctacccaagaggtgctaattggagctatttgaaaaatagcccacccaaaaaaaactatcctacccaagaggtgctaattggagctattttgagtagggcccactaaaaggtgtcttttctctctcccagcgcacgggatcagaaaacgcgacctcctctctctctccgtacgaccgcgcgcgcaggcgcggggcattttcgccgccgccgcctccaccctcgccggcccccaccagcaccgccgcccccacctcctccccaccaacgccgccgcctcaccccagcagcgccgccgcctccccccaacagcgccgccgccccacctcctccccacgaacgccgtcgaccccgctcctcgccgaccgtcaaccgcgtcgccgccgtcccccactcaagccgccaccggccccccactgctcgatttgttttcttgtccatggagggtggtggcttcgatttcttctccgaagatccaaatcccagcgtctggcacccgtcagc

SEQ ID NO: 66306 - DNA, 1835 bp, Oryza sativa
gtagaagcagcagcctcacccctcacacgatcgatcgatctccagagagtgaaaccgaacaacattttttttttttttgacaaggcctgttcgctcgttggccggctggtaccccgtccttgttagagtttggtatccgcgactacttggcgtagtggtacgtgaacaagatttgtgccgttgccaggtcccctttcacatgcagtctcgatcgatcgatcgatcgatcgaatgcgtactactcgcgagcagtagtagactagtagtagtgcatggctaccaaacaccccctggcccccggcgtgctagctttttctatcgacaacattgtccttttctaccacctaaccacggctgcgttctcgctcgttctcccacgccgcaaggcaacacgggcgccacgaatgtgcgaaaccgccgtatgcatgcgcgcacagagcgtgtgctgcgtgttagcgtgtatagcgacgaaccaaatgcaacttacctgggtggcatgataatgaatgcacgatgatgctttcttttgtcactgttaagcacttatacccgcgataccgtggaacagagatagagccttccatggggtacttccgcgactgctgtactccacacgtcaacaaacattatgctgtactttgagtctttgacaattagtgcgtgatgaaaaaaacgtaaataaaagcatatgtcgaatgcacaacatctttattttggggaaaaaaatgccgagtgtggttaaacttttttacaaacgttaaatgaaaaagaaagggtcggcatgcttgctaattagatactcactccattccagattataagatgttttgaactttggtcaaagtcaaattgttttaagtttgactaagtttgaaaaaaaataacattatcaacctaagataaatttattatgaaaatatattcaattattgatttaataaaactaatttggtattataaatattactatatttgtttataaacttagaaaacttgaagtaacttgaactagtttgactttgattaaaatcaaaacatcttataaacggatggagtctagcgtgtgtttggttgaagggttttcctgggtcgggttgggtcgaacccatttacataggtgtttggttagagtgctagctgggatgggttaggtcaaaaaggaatatacccctcatatacgggttgacctgatccgtgaaaaatcgctcggacggcgccgacccacttcgccagcgctgcaatcgcgtgatcctcacgcgctcctcgcagtgacattatcccttacccgtggtgagggtgtgtttagttcacactaaaattagaagtttgattgaaattagaatgatgtgacggaaaagttggaagtttgtgtgtgtagaaaagttttgatgtgatggaaaagttgtattctctccgtttcacagtgtaagtcattctagcatttcccacatttatattgatgttaatgaatctagacatatatatatttatccaaattcgttaacatcaatatgaatgtgggaaatgttagaatgacttacattgtgaaacggaggaagtaagtttgaagaaaaagtttaaaagtaaacaagactggctctgttcttttggttgagttgggaacccatccctccggtacggaaaacgaagcagtccattagcacgtgattaattaattatttgctaatttttttttcaaaaatggatcaatataatttttttaagcaactttcgtatataaactttttacaaaaaacacaccgtttagcagtttgaaaagcgtgcgcgtggaaaatgagatggggagtcgggaactccaggaaacgaacagagcc

SEQ ID NO: 66307 - DNA, 2917 bp, Oryza sativa
gatcatgatgtgcatgtattataccggttgagattgattagatatctatagtaatggaaactatctagagaaattaatcctactcagacttggtaaaaaaaactttgctactctacacaacaaaacataaattatgatggaattatgtccggacactcaatcggacagggtctttctatatagtatacatttttcttaataatatctatagtacacgtatacagacaccacgtacaacagtaacacaaggcctcatcagtatatacatttatggataaatatatatggtggactgaggatatatattattagtttggttgattgatggctgataaagggcatcaaagttggcaagtacatgcagcctgttactgcccagacagaaacaaaataaatctaaaaataaaataaattctgaataacaaatagaataaatttagaaaacaaataaataattataggagttcaagtagcaaaataatttataaataaaaatatcgaaagaaaaatatggaattttcaaaaaaaaatcatctagaacacagataataaatgacaataaagatgggataagtaataggcctgtaaaggagtacagtggtgatggttgatgggacatctaaaaagtattaacaaaaccccaaattgaattccaaagactattaaaaggagggacggtggacatgttgttaagcaatatggtcatgacggttggcgggacttctaaaaagtaaaaggtaaacccccaatgataatcatgtctgattttaaaatcttaatgccagtaaagaggggaagcagcggatgagctgtaaaggagtatagtggcaaagccccagatggtttggcgggacttctagaaagtaaaaaattgacccacacgatagttatgtttggtttttaaaatcccagtgacaataaagagaggaggcaacagacggaccgtagagaagtatagtgtcagggtttgatgggacttctaataattataaaaatgaaacccaacgagacatgaattgaaacattgacacgatatgctaccctgccataaaactttcatgtccaaatttaatttaatcattgagaaacaaaaggtacaaatatgtagtactccggagtatgtgaatggaataaaaccaagttggctccggtgtaagaaactttagatggccacatccatactttgggtcgtgttttttttatttctgcagtttttaccaacgggccctgactgttgaaggatacaaggtgatcctgtgcataagtgagatagtagtacaacagttcatctcatcaaatatctttataaaatacggccatttatatgattaaatctctaaagaaagaaacaatgatactccgtctctttatagagctttagctctatttctcctgaagcttgaagccagagctcgacccaagaaaacgaggcggacctaagagctctcacaaaataaactagataattaaaatagggtttaggctgcttcataatttctatacgaactcagcttttgaagttaaatttagaaacctacccctccgtcaaaaaaagttaaatactagctacaaatcttaacccacacgtatccagatttatagctagagtttgtctttttttaggaagagtattaaaaaccgacacagcatgactatagcttataaaaagttaaaaactcacttcgctgtgagatccgaggaacgcgatcataattaggagtacacaagttaaacaacagtacacttaaaccttgctagtagtggccaaaccaaaatgggccaggaggagttgacttggagttgagcagagccacgccgtagcagagcccgctgtcccgcgctagctagccgctagtagctgcagtcccaacaacacacacgcacaggcaggcggtcactgccactgctcgctgtttacgcaggggcgccgggccgagggcgtggccatggaagaagaaaaagcccagtagacatgggcaccttttggtcatattctcacgtacacgtacgggggcagagaggcaggcagctgctgcccccaccgcaagaagcaaacaaacaacaatcgctggctcttgctcggctttaaacttccctttaccgtacgtctccctgcgcagtggcgccggggagacgggggacacggccgggcgcccggccgcgcttgggagagagggagaacgctgggagagtggaaaaaggagccgagatgaaaggagctcatcatgacccatggcccatgcctcctgcggtagtcctgccccgtcgtcgcacggctcctgccactctctggccccgtcagtcccatctataccttcctgacacggctaaaaatcctgtagaagctcggacatatcccctccgtccaaaaaaaaaaaagacaaacctgatttctgtattaatcatgttttattatctaacaacaataaaaataataattataaaaaaatttcatataaaacggacagtcaaacgttggcacagaaaccaggatttgcctttttttaggacggagggagtagagtatggagcacgctcgctcggttgcattgttgcgccttaattcagccgtgcaaagctacttgaccggttaaggggtatttagattcagggattcagggatatatcggatattatatagttattgtataggttgtttgagcactataaaaaaattaattatagaatccatcagtaaaccgcgagataaatttattaagcctaaataatctatcattagcatatgttactgtagcaccacattattaaatcatagagcaattaggcttaaaagattcgtctcgcaaattagtcgcaatctatataattagttattttttaaatatgtatttaatactttatgcatgtgtttaaacggggaaattttacgtgggaactgaacattcatgatacacca

SEQ ID NO: 66308 - DNA, 2283 bp, Oryza sativa
tgttggagcagggcttaagtactgttagaccatgccctacgcgtgatcttaaaactgtggttctagcctccaactaagctcatatggcatggtgaaggttcgggaagagttttatttgtgtcacagtactatgtagatgccgcagtgatttaagaaagaaaaagagtgatccaagcccggatcgagatccatccaaagaaaccctttctctgtcgggaggaccccactaccacggagcttgctgaccacgccggagtagggggaggagagtggggacgccactaatgatatatccacgctaagctcgccaccagatccgtgcttgttgccaggatttcgttgatcacatcgtcgtcgagggctcgccctcccgacggcttacgtggtctcccaacaaggaggggatgtcgtccgccttgatatgccacgcataatcatcattgtgctttctggagaggaggggaggcccgccgcctcgatcaatcgatggggttgaaaggctcacgagcaccacgaccgaagaaggggaaacgagagtcgagagagtagcagatggggagtgggagagaggcgggtggtgcttagacgaggaagagaggtggcgttgcggctgcggtgcttagacgaggaagagaagcgacgatgcatttggttgggaggggggagagaaaggcgaatcaatgagaaagaaggaagggtggtgaaaaaaaattataagagtgactggcatgtgggtctatatttgttaatggtacacatgtatttatcttatagttgttatacggtacaaaatataacagtttcagtgggatttgataacaattagtatttcaataattgacataagggttgaaacacaaaatagttggatgtgacctcaattgtgagagttgtaacctatgtgaggtatcagtccatataacctactcactatgtcccataaaaaactaacctagtatcgaatgtgacgtatgtatgtccagattcatagtattagcatatgtcacatccgatactggattggttttttatgggatggagggaaaatctaagaacacttttacatggggtctccattatacgtggctttaggacaaggccaatgtttatgactcgatgagcgataggggtgtgacccgctaaaaggagccacaactatagcgatccgtacaatgctatgtctatcagtctatgtaaaaaaaaggtgagccttattcagttgcggatctaggaagaaatagcaagcggtttgaataaactagacaaaactacaatctcctcccccatgtatagatagcaaaaaaaaaaaagtcgggactttcatgtacctcgcgtcagtagtggatgcttgagactctaccgtctccatgctagattcgctcttagggctactttggattgatgccaaaatgtgccatgccaatttttttggtagtttgaatagtaaatatgatggtttggtttgaagccaaatgaatggtactgcccatgcttaatttggtataattctagaattttcttcaccataatataaattttggcttccaattggtattaatccaaacacattacttagaattctaccctaccaaattattggtagtgtcaaaacatgcttaagttttagcactaccaatgtttttgtatggccttaaaccaaacaagctagcccttagccccattggttccccaaatgaaagaaaatttcaattgtcccacgtagcagactagcgggatttgaaaccaaagaggattgaagattaaatcggtgcacgtaaaactaaaatgtcattagcgaataattaattaagttttaattattacaaaattaataaatgaatatacttgacattttaaaataacttttatataaaaattttttcgcacgaaatataccgtttagtagtttatgttttattagtatgattttttttgtgttcatactttataagtttaaggtgtattttgatttggtaatgattatgatatcaaatgtttaatgctactacttttacaaaaacattgtggataccatacacgatgacttaccgatccgaagctacagaacatgacccaaccacccacccacccggcgatgcacgctgtcttgccgcctcctgccgttatgcgcgtaaaacatcggtgatgcgcgtagggacagccagaacaggtaattaatgtgagtggttttgtggatcatatagtccgatactccgatgggttgtgccgggcgggtgctctagccgcgtccaggcgagcaaggacagtgacacggcccgggac

SEQ ID NO: 66309 - DNA, 1154 bp, Oryza sativa
cggctggacgttggaccggaccagaccagaccaaaaccaaacacgccccggcagtgccgtcgcggtgccagctccaccacccgctcacgaatgattagttcgtacgtattgcgcgcacaaacaaatgtatcaccagtagtagtacaaccaaaaccatatgtagagtggcactatacggtttcaccgaggactgctcgtcgtcaccaacacagtatgtacctttcgttttgactttgccctgcgagccatgttcgattgcaaccgaatctactgtgctgagccaaacccatccttgcttgctcatgtcatccacctgtggtggttctggtgtgctcgagctagaatcggcttctgcagagcacaagacgaccccagggccaaagaccagcgaccagaatacaaacgccaggacacaagaggacaaccggacaaggccacagaaaagaaaggagacgcgaaaaaagaaagattagaaaaaagagaaaaaaaaaacacaatagggagcttgggcggaaaaaaatccggtcgaaaatcctcccggtcggccacttttaattaacaagtcgtctcctcctcatccatccaccacaccacttgcctccaaacaaaaatctgacctgacctgacctcctcctcggctcctcctcctcacccacaactcttcccaatgtcgcctcccctcgagccgcacgactacatcggcctctccgctgcggcggcgtccccgacgccgagctcgtcgtcctgctcgtcctcgccgaacccaggcggcgaggcccgcggcccacgcctcacgctccgccttggctcccggggtcggagtcccccgagcgggaggtcgtcgccgcggggctcaccctcgggccttttgccccgaccaccaccaaggcgggctccaagcgcgccttccccgactcctccccgcggcacggcgccagctccggctccgtcgccgccgccgcagcttgccaggacaaggcggcccccgccgccgctccgccggctgcaaagtaagattcgtgagattcgatgtggggcgggtgtgtgtgcgtgtgctgccgtgctggtactgatcggcgatggcgatgtggagcccagggcgcaggtggtgggatggccgccggtgcggaactaccgaaagaacacgctggcgg

SEQ ID NO: 66310 - DNA, 702 bp, Oryza sativa
aaaattcagtactgatcttaatgcaaatgaagggtctaaattacatctacttattgcataatttttcaaagagtaaacttctcattttctttcccttgcattaatttattgggctaggcatatgatgtgttaatctgttacctgccccaatgttcgggctgaccattttgagacattattctgtactgaacttcaaaccgagctctgcacattattagttttgatagcattgaccataaacaaatgtaggggacattggatgaactatgaacgtagcttagatttaatgattttcccaaactaatatccacaacctgaggccataacaggataaaccccgccaggaggatactagggaagagatgtagatttagactagggaagaagaacattgagggagagcttagattaactttgattcattattcattgcttaaccctgaatcaggatacaattcatccgcatatagatagagggaaggaccagtctaacatttaatccatgtacctatctaacagtctctaaccaactgagctacattacggttataagttatgggttgaattaccgtattactgttacaggtgaggtgaggatagggttactcgaccggtactggttgttatcctttgagccttagcctctcggcccaatgacactaatcactaattttgattcaagattacagaccttctatattg

SEQ ID NO: 66311 - DNA, 2930 bp, Oryza sativa
tgtctccaaggcttcggctacgaactgccagttggttgtagggccacagcttgatccacaaaagaggaatttttctagccacattagcagaaaagctacatgttctcgaggagtgacagaaccttggcccatatatgctgctacatagcctgaccaaccgcctatgctcttggtcctgaagtcatattggttcttcgtgttcaagctcatagggttagccgatgaggtgatgtccagacccgtaatcattatgatatctataagagttggagtcatcggcccttgattgaacaagaaggcattgatggtgttggaccaaaaataggaggcagctgccattaggggctcgtctttagctgagttgcctatggtgagatcaagtgcttggccgattccgatttcatcccaatgaactcttttgctagccaacatgcgcttgaaccatgtgatccaacttttctcaggtgaggttttctcgagagatggccaggatttgaaagtgtttctccagtgacctaaatctgggttggtcagtctgaaaggaatcctataggtttcaccaataacgaactcggtgggatcagggttgccaactgggccgagaaagtactaattttcgtgcgacaggttgggaattgcaactaggttggaaagatgctgcaaatccaaaagaaccaagaaggggaaaacaagatgaggtgttggaagatcggtctgatgctgagaaaggggatctagtcgatgggaacttacctagcgtactcagctgacggtgcggcagacgagctggcggaagaagacatcgtcgcgggtggagatctagccggagatgaagtcgcctggggatcgccttgtgcatcggagaaatcgccggagaagaagaggacaaggttggctttggcggtgaaaacggaagtaacgggataaagatttttcagggcggcggttagtatttaaagcattgaggataatggtcggaaaacggcggagtgcgaaacttgctcggagtcgatatgaggcaaatccgaaacattaccgaatattctggacttggggggcatgtgttaacgaccaaatttggtaatatcagtatcggagatgaagattagattgaagcggggtcgaagatgaagattgtcgcgaaaacagagtaagaatcggctgaagtccggattggctatgattggatcggctgagttggagtcagacttggttaggtgatgtacccgattccaacaatacgacttggtgtacgacatcgggttgggttgaggtgcttcaagatgattgccacgcatggatagagtcctgggaaggcaattgtatctattaattaggacattttatgtaatttccttaaagatatgtttgggcaaaagtctgccgtaaagacttgtggtatcttagagtttgttagagataatagtcgtgtccggtatggacatatcttataattctcgggtataaatagaccccgagccctatgtaattaaacacacacacgttcaatacaatttcagcgcatcgccacctttttgctttagttttatttcgacgagttcttgctttcgggttgagctgcatcagtttcgatcttcaacaagaggtaaaacttgttatgatggcttgtgttatcgggattagtgcttccatctttatgatactctaatcttgtttacgtaattcgtcgagttatcatatatcgtacataatctctggcaatatcactatctaacctacaatcggctaacatatgttagtagagggcagccgattaggttagattttgatgttgatttagattatataagatatccaccactctatgaaacttccagcggcttgattgtctagatattgttcttcctttcatacttaatgctgcatcagttgagtttgatctattaagtcgtgcttagaatatcaatctctagcctgccttctggttgccgattagggtagtatcggagtttcagccgatcttatctgatttaaccatattcgctctatatgcttcagtgacatgttaaatccgccatttatgtcaagatcttattgcatttaagtatattaagcttttgtttgatatattatacttgttttaatatcctgatatatagtagtatcggagtattagccgatacatgctcgatctatatgatcggctatgctataaacatatatagtcctgttattaatatatatttcgatccaagtgatttatactgtctcggcacggcgaccgatctatcccaatcacttgatttaaatatatatcgatataagaactatatattggtaatatctacagccgattgagtaggtttagttctttattatctatttatagtcgccgatcgattcacatatgacatcggctcaaagataaatgatatgtcatcggcacttagccgatcggctatcatttatatatttaactgcgatctctttgtttctattttttgttgattgcaggatcaaattaactggcacgttaacacacccgaaggcgagctttagacctgcactggagttaagcagatctcccaagcctcatgttttacgtcaacaccggtcagccgcaaccgcacacactcatcgtgcaccgctaggtacaccacaatccctggcatcaacttctcattgatgccctttgcagcctcgtagatgtccctgcgcaccagcacccttgtatcctgaggggctcatagatggagacgccgcaaaatgagctctacttcaccatatgtattcgttcagtttaagctcttcttcttcttcttcttcttcttcgtcttcttcttctctctctctctctctcttcttcttcttcttcttcttcttcttcttcttcttcttcttcttcttcttctttttcttcttcttcttcttcttcttcttaatatgttcaagagctcgagaagaagaat

SEQ ID NO: 66312 - DNA, 1866 bp, Oryza sativa
cttacacgtggcctccatgtgtttttttttaatttcgttgatgattacgctgctacatggataccatgtcagtgaaaaccactctcaaacacagtgaaaggagtcattttacatggctttaatggttgaaggataggaattagatttgaccaatagtttaagaagtccaatggatcagctcatgtgctggccgtttccccttcccccttgttaagatgtttgcagcctgttttccccttctgccttgttaacatgtgcgcagcgtggtggctaattggcgcgtgcgccacctggcaccacctcccccgcgcaattttttcgctttttcttttttttttgcaatttttttcgatttccttttttgcttttttctgattttttttaatcttcagcacacgtgtcttcaaatgttttgagttgaaagtttttaaatcttgactagaaagttttcaaatcttaacttaaaaattttcacatctggacttgaaagttttcaatctcaactttaaagttttcaaatctcgagttgaaagtttttcaaatatcgagttaaattttttcaaacctaagttgaaagtttttaaaatttgtcttacaaattttaaaattcgagttgaaaattttcaatgtttgagttgaaagttttcaaaattttatttcaaagtttaaatcttaagtcgaaagtttttaaatctaacatggaagttttcaatatgtcagtaaaaaagaatcttacaagaaaagagaattcttaacttaattaccatcattatctaaaactaatttagttagttaggccaaaatgctcccggaaactggtgacgcgcgcgaaaaaaaagagaggaaaatcgagagagaaaaaacgtacatgaaaaagagacatacgcgatacggacatgggtaccgtcatcctaagatgagtgccaactacttcctctatcctataaaagaacaacatctggctatatgtacagatttgtagctagatgttagcttttttttttttttgacagagggacaaattagttctgtcggtgtttatatgccttcattttggaccgtttgaagtcaacctcaatcattttcgagcccagcaagtaacattggggaaaaatattttaactgtacgcgtagaaactttatacatgtaaaaatattccgtgtataattttttacgagcaagataggtatttctgtccagcaagaaattctgggccgacacgtggtaaacctctttatggtatgtccagcaagataggtattaggtatttctcagctctgggccggtttaatgaaagtcaaagagcaatttcttaggtttggttcttttagatgtggcaatgggacaaacataagattttgggaagacacgtggttgggatcgcgtgctttcaaagatcaataccctacattatataatgtggctcgaaagaagcagtctactgtggcagaggtcatgagcacaacgctgctaaatatctcttttagaagagctattgttggccaaaagctaatcgagtggaacgatttgatcctcaggctagctaatataagtctatcaaatgaaaaggactgttttgtatagtcgctccataaaaatggtcaattttccgtcaaatctatgtatgctgcgatcatgaattgtaatgttcggatcaaaaagagaattctgtgggacttgaaaattccactaaagatcaaggtctttatgtggtttcttcacaggaaagtaattctaacgaaagataacctggctaaaagaaaatgggggggcaaacattgttctttctgctatgcacaagagacaatccaacatcttttctttgagcgtcatgtcgctcagtttgtttggagatgtgtgttttt

SEQ ID NO: 66313 - DNA, 1541 bp, Oryza sativa
attcctgcagccctgattctaattggagctagcgctgtatattggtcaatttgacgttgtcgcaatgataaagtttttaatggtaaacaattatctaaccctatgcaggttatcttcatgtcttcctactggctccacttctagtctacaatgctaccacaggaggagcaggatactatacgcaatggtgctacacttttggaatcggtagccaatggtctcttattccactatgggtggcgtagttctataagaattgctagctaaaatattttatgtgatttaacgctagtcaataataaaggggagttgaggatttgtcccatcaccttatttctcattttgatttacttttatcttacatttttattactattaaacttatggctgtgtgtcttatgacagaagccagagatataattcatttccattattaaaaaataaacttttatgagccagcgctaataatagaaaggagtcgtgccatataactcacctgattcacaagccaaaactagaaaaggaaatcaaaaagtgctcccaaccaattcagtcagatacatcgcgtacctttcacattataagatgttttgggtaaatagattcatatatatatatacacacacacttactttgtatatgtgtccaaattcgtatttatattagtgaatctagactaaagatgaaggaattttatagtatggaatggaggagccaaaacgtaatggaaaaaaaatacttttttccaatccaaggattcaaaagctctagaaaaaactcatggaaaagctaaattcatcgagattgctagtaataggccgtattgacgctactggcgcatacttttttttaagtccattagtaaatttgtcaattgggacctccagaaaatttggttggtagattccatatgctagaaaattaggaaaattctatactactggttattctacttctggagataccaatctcagagtacttctggaggcccagcacatcttacttctagaacggtcggcccagcccatcagagacaccaatcccggcacggactccgactccgactccaattcgcactccgaaactgacgccgcttcgtcgtctcccagccagcgcttgcgtaattagtacgtctcggctccgtttacgagccgagcccaactcggactcgggatttctacgcgtgaccgcgccccatataaacgcggccatcccccgcccggagtctttcaccattcttaccccgacgcggcgtctcctcccctctcctctccccttccctccatcgcatctcctcccgctccttcgatcccaaatcggccgccgccgccgctccgccatgtccccctcccgccccgacgaggcggaccccgccgccgacttcggctcccaccccaccgaccaagagctcgtcaccaaatacctacgccgccacgtcgactccggcgggaacccgtggcggtacgtccacgaggccgacgtgtacgccgccgatcccgacgacctcaccggcaagtactccccggccgtcgccagcgacg

SEQ ID NO: 66314 - DNA, 1337 bp, Oryza sativa
gccccacctcccaccgccacgaaatccaagacggaggaggctacaccacctcccgatgacgtgaaaccggtggtggcggctgcgcagactcccgacaccaaaatactcagggcggcgaaggaggcggccgcgactggatgcaagaggaaggccgacgtgaagagctctggtgcaagaaggggcaagcggctctgctcccgctgccgggcggagacatcggaatcggacagcgagacggcggtacttgacaggtcgccgtccatcgaagacgaaacggcggactcttcagaaatccatggaagcagtgatggcaaattcatcaggttcttgtgatttagttcgatctggagccccgagggtgctagcctagattggaatcagcgtgtaccaacaaaatggatagagctgctgtagttctcattttgagttcttaagccctagtataatgcctaccccaaatcatgcgttacccgcaaatttcagcatgatacagacaaggtaagcatttattttcagtatcagttgcaccgtatggtgcacttgtagatagaagttactacagcatggagaaatttggagattaacatatagacattagacattttctttcatgtaatatagtagtagaacacacaagaggttcaagcttgaatgattagaaaagcttcttgccatattatccaccatcagttcatgtgtcatgatggataatttttgaactgactaggatttagagaaataagcggacaagagcccgacttgaccttcaatgcaaagaaaagagggggcaacgcacaattgcacgatctgaaaggaacaaattacagacatacaatgcacaggtctgatgaacacattaaactacacagacattgagatatttgggatacttgcgatgaacaattccaaagctgctagatcagttgcctttctcgtccggacgaaggttaatcttatctgctctgccctgactgctctattgatcttggagctgcaaacagatggatgtatttcagatcaaaagcacaactgctagccaaaggtacttcttaatgaagtacacacacatgctgttcaaaatcaggcaaattcattgcgagtggtgtaaagtgttatttgcagagggactccagctaccatcacaataattggcttagatttatgcttcactaagtcagacaagagctaaattatccatacatgaaagcatcatctgagctatataatgtggtactagaaagcagatcttgggctccatccattacagctaacactgatttcttagtttgcgaattaaatttccagtgaagcattcagttcaattgcaggcatattcc

SEQ ID NO: 66315 - DNA, 1701 bp, Oryza sativa
attcctgcagccctaagcaaccacgcactaatgcatttatatacagaaaactgcataacacttgggtcaataatgcttcagttcagctgcttaaatctgcctttaaaacttatggtttatgtacatacctctggttcaaagagtggcaatgtgatgctaggattatgtgtgtaatgtggggcaccatagatagtactgctgcttggtgatctggttgcaatataatgcaatgggaaaatattcagtattaattagagctcggtcacaaaaaacataatgcaaatgaattgtaataatatatcttgtaaggttactgaaactgatctagctgatcatatatgtgtgtgctacctcatgatgggagtttggaattcaccgtatcgtacgtctcctcgttctccatatgccatctacacatgataaagtcggcataacataagagatttttctcagcatgaagttcacacgcatggaaatggaacactgattggtagttatatatataattcatacagtactagctagtgactactactgctagtagacggcaagcacccaaccagatgatttttgaaaaaaaatcatcacgtatactggttcttataattgaaatagtaggaaacgttttcttgagaaactttacagacaaaaagagaacatgatgatggacaagtaacaaataacaaataatgaagaggaaaaattatacatgcgcgtatatgtagagctaacgaaaacagtgcagcaaagatcaaacataaacatgtttttcagggaaaacaaaaacaaaacaaaattaacgagggctaattttctcgcactagtaacttcttatgtagttgagcccaaaaataaaatctcctgtttttactgaacaaattaagaagaaacaattttctcccatgtgtggcacatagttattagtacatgaaaccgcaagtcatccaaagaaaaattcactaaaactttcgctcatatgtgatagctatctctcaattttttagatgccaaattcttcctgaaacaattagtatacatgcagaactcagagaagtttgtccatgtaccgcaagatttggatggattgggaacggagacgagctaacggcggtagcatggaagggagacgatggggacgacgacagcgaggatgtggacgcccgtgcatcctcctgctcgatcgatccatgccaaaaaccacaagaaattagaaacgcctaattctctctagaatggccacacaggaaagacgaaatagatgcatatactctatgttagcagcatatgtatatgcatcgatcccttgacttaccaagttaaggctgccggttctgtggatcaagcttcccggctggccaagagggttgaagtactcggccatttcgctctgtaacctgatcttctccagctgcgccaccccgagccctcgttgcggctgcttcggcttatccgcgccgccactgccgccgcctctcttgcccttcctggaggagccggccggcgacgacctcccgctgttgccccatcccatgctgtctccaaagttgctcccactcatgtccaagaagaagaagacctagctagcttgccaggaggaagacttggaaggacaagatgaacaagctagaaggggaggacaaggaagggaagagagagagagagagagagagagagagagagagagagagagaggagagtgat

SEQ ID NO: 66316 - DNA, 929 bp, Oryza sativa
cgtaacaaattttttaagcccacttaatctataattagcgtatgtttactgtagcatcatataggctaatcatcgattaattaggttttatagattcgtctagcgaattagtttaggattatagaatgagctttattaataatctatatttaatatttataattagtgtccaaaccttgatagggacttgaaagtctacacagtagtacagtaccactcgtatatccgcccaaatttttgggttcacactcggcggcacactcgaagctcccaacaaccaaccaaaccccaaagcatatcacaatcagtggggagggaagggccccttatttattcgcattcctctcctcatcatcactcatctcccttccctgtcgattaccttctctccttcctctgttcctcctctcctccacacatccaggcaggcaacacaagaatcatccgggagagcgacatggccccggttgccgtgggcgacaccctccccgacggccagctggggtggttcgacggggaggacaagctgcagcaggtctccgtccacggcctcgccgccggcaagaaggtcgtcctcttcggcgtccccggtgccttcaccccgacctgcaggtctcttcctccttttttcgatttcctctcccccctctttcttggagacgttatatttccctgaaaaaaaaattccttaaaaaatgggacttctttttatcagatcgagaaattttactgcaaaactgaaatgtgtactagctgatgtccggaccaaatccaagattactgctttattatacagatactcacaatttatgggattgatttgacgagctctgaagtcactcccacttccttgggtgtcagagttagggttaaaaatcttgatgtgggtttatatattgctagttgcatgactaaaaagtagacttcga

SEQ ID NO: 66317 - DNA, 1989 bp, Oryza sativa
attttgcagttaacgacccctttgtcatgaaggcgtgggcaaagtcataccctgagaataagcatgtgaaattccttgccgatggtttgggaacatacaccaaggcacttggtcttgagcttgacctttcggagaaagggcttggtattcgttcgagacggtttgctctccttgctgacaacctcaaggttactgttgcaaacattgaggaaggtggccaattcacaatctctggtgctgaggagatcctcaaggcactgtaagagcttcagctcttaggaacggcagcgatcacttggacctatcgtgtcaatcttgtttaaatttgtctgcaaaatacttgtgcgaataaaattgtcgatgagctgcctagttgtgaggactttatgataatgtttgaatctgtatccactgttgaatcaagtagtaatgttcagtgctcatgttaagttataatcttcagtttatatctccagaaaaaggtttgatctttccgttgacacttagacagtgacttctagagtaaactggattattggtcaagaagagagaattttatggtagaaactgatcggatcgcaacagcaatgcccgttctctgaacaggcatatactgcctctgcacagcttaatactcttttaatagatgacgctgttgactttttctcacacatttgaccattcgtcttattcaaaaattttatgcaaatatataagatataaatcacacttaaagtactatgagtgataaaacaactcataacaaaataaagtataattacgtaaattttttgaataagatgaatggttaaacatgtgagaaaaagtcaacggcgtcatctattaaaaaagaaggtagtatcagcgtgcgaagatggcaataaggaggctgtgcggttatttcatttacaaggtaaatatggtgataaatctaggcttaatgcctgggccatcttgccaattacttatactccgcatagtttacagcaactgtagcttgcatatctttgtgttactgttggtgcgcgcacgtctgcttttgtattccgaaggaaaatatgctagtgtgcattctgttattcagatactagcggtttcacattttgaatttctgatctattcatgcaaaaattttccaaccaaaatgaggccgtgaaatatgcatactgatttcatctcaactgagatgagcagattacaccgccaaatcgccaatacaacccatccagcctctctgaagtttgagctatttacaggtgctccccccggtagcacaaccaagcatgcagctgtctgaccattttttcaggctacagctacctatgagaaaagcttttcaacccaccccccaaattatcaactttctcaatgtgcaaaagtttctttgtgaccatgcggtggactttcctcagcctcgcgcctttgtcctcgtgttcttgctcttgccagtgaatagagttgttggtcacttgtgaattggcatctatgctgttcacagtctcctcttcctccagtgcattgtcaatgatctcggggatgtcaactagactgggccttctccttgatttcgtgcgctttgggtctctagcaatggcatcagcgtgaagaacatcctcgatccgagataaaactgcaaaggctaagctctcaagagtcctggagtagctctccaagatggcatacccaacatcctgaagaaaagaagtagcaaatgcaggtggcatgagtataagtactgtagcaaatccgaaaaaagtaactaaacatgcagctatggttttttttttttgaccttgttgtattgtatcttgctgatgtcaagtgatgactgaggaaccccagggaactggtgcttgaggatgagtaggacagtttgcgcccgctcttcaaactgctctcgcttctccaagctaacaccggggccccaggaaagcttattggaaattttcctctgccaaattacaacggaggcctcaattcggtctttga

SEQ ID NO: 66318 - DNA, 4620 bp, Oryza sativa
cattttttccccatattcatccagctagatatagccatgtacatttcattttttttctcgtttctgtccgttatatacatacatatcacctcacagatgtgaatgttcccctccattggaactgttgaagagcaaagcagatactctctttgatatacatgaacaaaggttaaatcaaaaccatagattgtacacacaatggtgtgcttggtcctaactcgcaagttccttttcaatatttcattctcctcagctgcgttgcaccttgctctgttctgatctctgaattcctgtcaatgcaaatatcgtgttgcgtgctaatgtatcatgtattcactgagaatgttcgtggcttggcttcctataccagctgtagtaccgaaatttccctatgtaaagcctcctttggaacggagaaattcgtggtaattttaagggatttgaactaaaatcctactagtataaaattaatgcattgcaaggtatggtcagagctcagcattttcggaaagcaagcaagctcacctgacgtggaaaggctaacgggcgatcgattgctgtcggcgatcgttttttttttctttttctcttttagtaagtttatacacataaagtttacacatctaaagtttatccatctaaaatttgtaaagcgaatgtttataagttaaaagtttatatacccgattcaaattcaaattcgaattcaaatattttatattttcctcttttagtaagtttatacacctaaaatttatacacctaaagtttacacatctaaagtttatccatttaaagtttttacaacgaatgtttataagtcaaaagtttatgtacccgattcaaattcaaattcgaattcaaatatttgatattttcctattttagtaagtttatacacctaaagtttacacatataaagtttatccacctaaagtttgtaaagcgaatgtttataagtcaaaagtttatatacccgattcaaattcaaattcgaattcaaatattttatatttttctattttagtaagtttatacacctaaagtttacccatctaaagtttatccacctaaagtttgtacaccgaatgtttataagttaaaagtttatgtatccaattcaaattcaaattcggattcaaatattttatatataaaatatttctatacacaaagtttatgcatgcaaagtttacggtataaagtctatgcacatgaatgagagtattagatttttttcctaattttcttttactattttttttaaatttatgatgtaataaaaaagtaaaaaagagagatgaaagataagtattaggagggagggatgggtgatcgctaggaggagagggaagcgatcacccgcccactagcaacctcctttaaaaaccatataaatagttaccaattttttttaataaattgataatattcatataatatacatataccgctctacaaaatattaagttccaactcaaacttatacaccatataaaatagttaccattttttttaaaaaaatgataatattcatataatacatataccactctacgaaatactaggttcaaactcaacttatacattgagatataaaaacacaaattcagatacaatatttttttacgggaattcagatactatacagaatggccatttgtgcttgggcccaggagtaatctgaaccaaacgggccaactccaacgatacgagtgggccctttccttctttcaacccacggaaaccggaaccccaccatctggccatctccaactccaatcaggcgtccaaatgcaaaaatccgttaccaaaattatggaaagcctccttccccacgccggctcattctaacaggctgcgttacccactcaccagtcggtatgccgtatgccaatcgggctgcgccctgactgcttacgacgatactatgacaaaataaaagcgaaaatgattatccagtcggttgcgttgcattccattccgtgtcggacacgatgagtttgccctgcgttcgcagcgatcgccctggactccgatcaggtctcgaggcgcatacgcattcgcgcctataaatccagggcatatgcgccatccaaacccccttccatattgagttcccgagggagaattcgatcgaagaatacgagcaaattaaaatcgatcgcgatacttcggtgttgacgaaacagcgtgatctctctgccccgcaatatgccgccggctgctgcgggctactccgccggcatgaagcggcctctcgccgcggtggcgccgtcgtgcgacgtcgacgggcgcaatgccgctgccgctgccgctgcgaaacggcgggaacgacgacgggaggccaagcgggcgcgcgcggcggcggctgcggcgacgggcgctctggtcccgtacgtggcgcccatcgacgcccggcccatacgcgccgtcccgctcgccgccgccgcggccgcgcggaggaaggaggccgacgaccaggcggcggcggcgccgtccgcggagccggcgtggatccgcaagatactgctcgagcggctggggatgacgtacgaccagccggtggtgttcatcgcgaggaagacggtgaccaggaccgacctcgacccgcaccagaaccggttccgcctcccgatcttcggcgtggagcgccgcctcctcccgatgctcaccgtcgacgaggccaaggaggccaacctggtggagaacgacgaggagaagggggttcctcgcccgaggccgaggcccaagaagaagcgacgcacggagaaaggcagcgtcgtcatcgccgccaccgccgccgccgacggggagctgcagaagccgcagggaacgacgccggagacgaacgtggagggagaggatcaggctcctcctcgcccaaagccggtgccgaagaagaagaagcgacgaacggagaaaggcagcgtcgacgtcgccgacggtgagcagcagcagcagcagaaggggagggagaaggagccgaggaagaaggcgcaggggaaggaccacggcggggtgccggtgacggtgctgcacctgagcggcgccatgaaggagctgcggctggtgctctgggacagcagccatggcaccatcatcaaggggaccggctacatggacttcatcgccggaaccggcctgagggagcacgacgccgtgcagatctgggccttcaagcgccgcgggttccgcctcttcggcgccaccgtgccggagagccgcttctacctggtgatcgtcggcggttcgtggcgcccgctggaagctccaccgccgcagtgcatgctcccgccatctcacgcgcctgtggaagtatgtgcttaggcaggatgggtatagactgaatagagtagtgagatattttacagtgctggcacctcccaatgtactgtacatcccatctctaactcatctctcgagactacgagtatgtaattttttttaaggataataaattgagatttacaaataaactttaataaatgtgtatttcttatcctatatgggttatttttcttcttagtttggtgttcttaattttatttgaacttcgctcgttttagagtgctacatctatctatctatctatctatctatctatctatctatctatctatctatctattatatagtaaaagtccattaaacttcctacaaacgctcctaagccgtcacgtagcaattctataaacactcctaagtcgccatgtggcgttttaatatattagaaacatctggcccttaattttcatttaaattggtgggtccataattttacaccattagattagattaaaaatagaccctcatacgtatgcctccctcaccgcctgcaagtacgtacatatgagtaagaacgtaacataccccacttttttccttttttattccccttcttttattattttgctttacctaatatacctccataatattattggcgtttgaacatatgtttatttactaaagaaatatgtaattatcatttattttgttatacttttccattaaatttcctacaaacgctctcacgtcaccatgtgtcactctacaaacgcttctacgttgctaagtagcgctataataaattaaataaaataatataaattcttagttaaaataaaacatttaattctcgattttcacttaaagctaagagaccattattttagacaattaaattattatatctataaaaaataatctctccctcctaatatcccgttcaaattattaaatctataaaaaataatctctcgctcccaatatcctattcacatagcctagtggttacaagagcttcagtagcacctgaggtcctgggttcgactccccgtgggagcgaattttccaggatttaacggcgttgtgcttttagtggtaggcgacgtacccgtcgacagcgagacgcctacggtgacttcatcaatctctccaggatttgccggcccagtcttcgaagatgctcataggagtagggtttgcgtgcgtgcgttcataggggtgagtgcgcgtgcgttgtgagtgtctgtgttgtactgtgtaattctcaaaaaaaaaaaatcctattcacatacaagagaaaatcgttgcgtacaattcatctggttaaaa

SEQ ID NO: 66319 - DNA, 848 bp, Oryza sativa
acacattcggaaaaacttcaccgttttttaataaccatacaaaattaccattgtcttccgttacgtacacacgtgacgttttacgtactacgcgttctctaaacaatacattttttactaataatttataatgctactacgatctgttcttcctcccatgcatgactctaattcttttttgtgtttctcatatgtgtataccaactacaatttttttaaaaaaaattcttatatttttaattcgtgtagaaactcgatggacatgacattatatacctaccttcccattcctgggttttcttattaatctttttttcaaaggggtctttttttttccttttgaaaattgggcttgaaactgattaaaacgacattttccatgaatagagggttagattttgaatgtcacgcaccgtccccgaaaagctagggttatatgcttcacaaaatacagccgtattgcattctcatttgtacttcatatttttacggccaatagaagcatacaaacaggacagcaacgcagatgatgtggccaaggcacgtaatgttagctagtaggcgttggaaaattgtttgatactaagtagtagagtataaataaattgtcacctccatccactatcaagtagtcgatatgtccgagtggttaaggagacagactcgaaatctgttgggctttgcctgcgcaggttcgaatcctgctgtcgacgtacttttttctttcaagtaaaacagcaccagacggcttattagaaataaaaataaatttgtatataaaactttttatatttatatatgtgttctttgtgacttaaagccaatgctgaaaaaaaaagtaggttaaa

SEQ ID NO: 66320 - DNA, 2214 bp, Oryza sativa
ctttcctggaacagattataaggagtagaaggatgattccttgaatgacaaaacaagagataacgtcggggccgacgcttattttatcggaatgattccatctacatccagtcaccatatctatgattaatcaaataagcaagagctccgtatggtacttgacttgtgttttctatagataatagttaaatatatggtttaagggaattcgggtttttatgttttactctaaatattccttatgttattcatccaaggagtgggctcgtgatttgcggattggacaataaacgaatctccacctcaccaccaccagaggggagcaaagaaaatccaatggccctcaagaaaggcagcagcagtggcttctctttttggaagcttgcagagtgtgccatggtaggaggcgacggggggcacaatgaggaaggaggatcacgatggcctggagtgaacaggctttttgtgcctggacctaccgacatcgggatggatgagggggaatgtaaagaagtataatatgttagttagagataagagtcaaaaataaattatagagataagatatattttagagatagaatctaagatagagtcctagagatataatcctagagataaatctactcttacttgtattgtactctaagtctctatcccatatgtacttctatatataccagaatgattgtgagtagatttgaaatcttctatttcttcatcttcttcgagtcaccatcatcgattgcatctctggtggacggtcctccacctggtgcctgcgttcccttctgtgtcgtcccttgactctcctctatttcctcccgcagtcatagcgggagtgtcatggacgatagcggtgacacggacgctttgactggagtttccgtagatgattcttgttgtagacattcgtcgatgtaaccgatcatgtagtagccgtggtcgtggtagtcatggtaattgatgtagccgcaaatagccgaaggcgaaaaaaaatatttacactatagtgtgaagacgaaactgcaattgtgagtatcttgcaccctgtagatgtcagaggatgccattggggacgtcttgcatatgtcagaggacgtcgttggtgatgaggccaccacttcggttggtcctttcgcaccgtgtagcagtcatcacaaaagtgatgccgagttgatgcagtcgttgttgtcgtagatgacgtgatcgatgccgtcgtcggtgacgcggtcgttgcggtcgtaaaggacgcggtcgatgtcgtcgatgaagcgtcttgcagattaatctgtcagacgacgtgagatgtccatcttcgtggacgagtcggcggcggcatgttaccatgttgatgaagaccataggagtcgatgtagtcgtacaactgatgatgagtattgtccgtgaagaatccgaagacactgtgttgttggcgcggagggagtcgatctcggcgaccactgatcgcccggccgccgcaaattcatgcatgtgaatcctcctcgggctcggtgcatcgtgctgctgcttgcctgctgctgatgtgtgcacgcgctagatgcctctctgattcttgctgctcgatatgacgcttgaattggcttatacagattgatggacaatggttgcttccgctcaggaggatcgcttttatgttgctaatgaagaaactaatctaatctaatgctaattaatggaattggcgctgattaggcacttgcttcttcggctaatgattgaagaggcatataatggcgttgccacagggggaggcgttgccccagggagagcttatggattcctctagtctccctggggcagcgcgaaggatcggtcgacgctagtctatagctctgataccatgtgaaaaaatctatttgttgtattatgttgtttttatgatatattagatcgaccctctcatggggtatatgtaggagtacatatgggatagagacttagagtacaatacaagtaagagtagatttatctctaggattctatctctaagactctatcttatctttaggattctatctctaggatatattttatctctataatttgttttagagatctctataatttgtttttgactcttatctctaactaacatattatacttctaacagggactgccatattccggcattcttaggtggcatgtggaaaggactttaattaatgacatcggtgacacctgtggacgct

SEQ ID NO: 66321 - DNA, 6905 bp, Oryza sativa
ttcgatgggccgaattcctctcggcccatctctccctccctccccatctctctctctctctcccccgctctgcccgtgcgctgcgcgcgcgtgcgcgtgagccgcgccgagccgagcgccctccaccctcgctgccgcttcccgccgacgccgcccaaatcgccgcgccgcccgttgcttcccccgcgcgcgcgccgtggtggccgaccgcctggtcgccgccgccgtcaacctctgccgcgcctgtccacgcctgccgcccgtgtcgccgctccgttccaaaccgcccccgccgtcatcgccgtcgtcatcgactcagccccgcctctccccgcgcgtgcttccaaggaaaggaggcagggctcctcctcatcgccctctctccctccctcttttctcaaagaggcaaggggcaagccccctttctctcctcctttttcccttttctctcccgccggcgtcattcccctcctccctgtcgccgttttggccgcgagcgccgagcgccagctcgcgccttgaccacccaaggtcggtttccaaaccgacattgccgccctataaacccaggtgccctcccttcctttttccctcccaatcttccccgtttttagcccgcgccattgccgtcccgttgtctctctcgccgaccgccgccgtcgcgtgtgccggaggagccggtgcgtgccaggacgcgggtggggactccgggcgctcgccttcttcctcttccccggcccgaggccggagagatcactcccgtgccgtcggcctttcgtctcagcgccctcctctgcagcggtagtgcatcatccccgttctccctcctcgctcctcctcctccccttagctttgagtagccgctcgagtagtgccccagtagctagctggcgccgccccgactgctgccgccgctcgctgtgtgctcgccgccatcgccgcccgagctcgatagcgcctctcgtcgccggcctcgctgggcgtagctccgcctaatccggcgcaagggatggattcccgtagccgcgtagatgctctcaccaccgggaatcggcccctcgtgacctcgtcgccgtttccccctttcctcgccaccggttgccgccgccgcaatccgccgccgtcgagctccctccggcgaatccaagccgttggctcgctccctctcgttctccctcgtcattccggtgtacaccccatcgccccttgtcgtcgcacggcgtcccggagaaaccgccgccgcccaccgtccattcgcggccggcgccttcgtcttcctctcgccggcccgcgtggctgccacgaaggcgccacgtcggtgccacctcggccgcgaccgggtcgagccgacctcgatcggccgctccctccgttccaccctccccgtgagcgcggtccaccgcgggccgagaggctgcatgtgggcccgccgcaccgcgtcctccgcgaaccgtgcgcatgcgccgagcctaccctccccaaaccctagcacgccccgcgtgcacctcgctcacggtgagccgagcagccgacaagcgggtcccacccaagaccacgcgagatggacccggcccaccggcttcctctctcctccccgcccgcgcgcgccttgggccgccttcttgggccggccggcctattaagctcggccttgccgcccctttctctcgggccgcgccctagccgcccgagggaagtctaattcccctccctccttcttttcttttcttttcctttcaaaaaggatttaaataaatccttttcctttagaccaaaaatccaataatcttagaaattcaatatcttcccaaccgtacgtccgtttgactccattcaatttcgagatctatctaatggcacgcttagaggtcattaatagggctttattttcgccgtttgttgagttgtcccgtttcgcgtgtagtttcggagcccgaagacccgcagtgcgaggatttcgaggatcaagctcaagatctcgagcaagacaagccacccttgaacatattgagcctatatttgaacttaattatattgcttgcaaaatattatgcattgataggaatgcacttaatttgtttgccccgtctacgaggcagaccggtgggcctacctaacttgttgcatctgatccttcgattgttaattgttatatcatgttccgttgtaaccatctagttgcacctcgataattcgtgcactctgtgcgagtatcgacggtcgccttcaaatataaaatttgagtaacatcttgggtaaaacttgggttttacaaaagacttggaaaacccgacacctgggtcggtgcttgcgaactaaatgaatttccaaaatcgtggaccggggaacgtaccaggtgtacggtttcccgctcctgcacttaaggaccgttttcttagaatttcatctgaacataagacaagtgcgaccacatgggtggaatgggacgcccctggctgagtaaatagctaaacaggggagccttgatgccaagagacatgtggattcaacggggtggtgtcggggggaacccccgggcttcctagcacagtatggtctgggacctaacctgttgttggtctgggacccctctcgttggcatatggcaaccctgtgtcagctttggaaatgccttgtcatgaaagcctcaaagtcaccagacgtggctgttctgcacgggctgggtgacccgggttagtaacgtcgtgtgggtaaagtgtaccccctctacagaggttattaaactgttcgaacagccgtgctcacggtcataggcagatgtgaggtgattcctagcgtagttttgtttgactactgctttgtgaaatttgctgttgtggattgggttcgatgcctggaaaatctgcggctgatgggatcagccaggcccgggtggccgtttgagagctgttggccggatgccaaccttgatcaattcaaaagactgataccttgcacatactccgaccggacgagacgcactgtctcatccgtgtcgtttgagaagcacacacttagttgtttcagaaaagagtttaaataaaatcaattgcaaaaacaacagccttttcttgaagcctgcattaaacacttaatctccatggcttgctgagtactctcgtacttacccttgctctatataaataattcccccccagttgctgaagaagatgaagtggatctcgctgacgaggagttcttccaggagcaagtcggctacgatgagttttagggtttcagcctagttcccaagtcgcgcctgtgatgtttggtccaagttttggcttccgcttctcttttgtaatgcagttgtgagctcgggatctgtccgcagcccaacatgactgtactcctactctgtaataaagagaccactgttgctgtgatattctgtcttcctgtgataccagcactgtttcctgggactggtatcgattaacaagttaatttggagcgtcacgggctagttccgctcggggctagttcggggcgtgacaagagatggtatcagagcacaggcttggccctagggcgaaacccgacgtttaggatgaccctaaggatactaagttcaaaactacttgcgaaaagctaaggcttcttttggtttctttttttttaatagtttgttgctaaaatggttactgatcttttctccttctttcaaaattgtagatggcagtgaacgccagcttcagttcccacggttttggtgagggtcaccacgtcgctcagcttcgtgacctcgcccgcttccttggcttctcgtgtcccgagtacacggggtactccgtggaccgtgttccccctcgctgtgagctttcggtgtacctttaccctcgtggaggtatacacggagctggccttcgcccacaccacttcactgtggccaggcccactctccagatcgcgtaccaggacctctcctggacagcgcttcgtcgcttggcccacgactacagccaccgtctcgggggctctgccttccggcagctcccacgccttccttccggccacacagacgccaggtacccttgtccgtacagcgagtctcagccagtgctgactcgcatggttgagctttcggaggctcaggccactcagcacgacctactccttgaggcttaccgctcccttgcccgccgctacgccgctctggaggcccgtctggccgaggagggtgtcaccttagttgacactgtctcttgggactcaggccgcctttgccacgccagccacctgtcctcccacagctctcgcggctcagcccgcactcccccagctcgcgtgcgccatactcaccagtgtacttcccctacccacacccagttagccccttctacaccccggacataccccagttgcttcctcccgccgtggcccacgctttatccgcactgcgcggaagcgtgttgttggttcttccactgtgttccgcttcgactacccagctcccccactgccagcggcccgtgctgctgccggccctcgataggttccgctggtcccttcgcgtcagccgatcgatgtttcttcgactgaggagccgactacaggaggcagccaggcagacgaggagtagaggaggcagtcttcagcagccgtccgtgtgttaggcccttttgttccgccgccaactcttttggaatcgtggcgaggtagtgcgtgcgtgtgattgatgtgggtgttgtttggtagtctggttctcctaggtggtgtgcgtacagtcaagctcggcgtaactttgtgacttgtccacgcccgttgtatcatgtgtttttatgatttgaaaaatccagtttatgcctagtgtgtgctatctgagttgttatttactttgctccttgccctcctaagtgcttatatgattcttacctcgccttcttctgggagtttagatggctagccgcccccgccgtgctgctcatgcaccagcccgcttcggttttgaggaaggtagagttgagccagaagcaaatcatgagtcagctaatcagcagtctcaccacagcaaccgttcgcaccgtactgcttcccgcaatgcagaagttgagcaaccccaccgcagcaaccgctcgcatcacacagcttcccgtaatgcagaggtggaacagtctcactgctctcaccgtgctgccagtcataattctggagaagaacgcatcccctccctacctcatgtggaaaacaacatgcaacacttgatggcagttcagacacagatcttgcaaggattagccgcagccatagccggcttccagcataatgcgcatggaaatgaccaccctcacatgggcaacaatagatccaagctgacagactttctgaggtctcgtccgccagagttctcttagaccgtcgagcccgtcgaggctgacgattggctgaaggatgttgatagaaaactcaacttagtgcagtgtactcctgttgagaagacgctctacgcctctcaccagctaagaggacctgctgcagattggtgggagaattactgcaatgcacaccctaaacccactaacattgcttgggatgagtttgctacggctttccgtgcagctcatgtgcctgaaagcaccattgatatgaagaaagaggaatttaacaggctcaagcaaggcaacaacagtgtcaatgagtacctaagtcagttcaacaagttggctcggtatgcccctgaggaagtggacacagacaagaaaaagatcaggaagttcttgaagggaatcgcagttggaatgagactccagttgcttgctcatgactttcccacttttcagcatatgatcaacaaggcacttctacttgaggatgccagaaaggagaccaccgaagaatacaagaaacgcaggtctaaccatcaggggaattcttcccgaggcgcacctcgccctcgctttggtcaacccatgcaatatcaccagtcggtcactcaggctaactgctagccaggctatgcccctcgtcctcagggttaagcgtgcttggcctggagcaatttgggatgggtgactgaccgggaaattctttccaggtgcacacgagtgaggacaaagtgtgcagaaaagacatgtgttggtctgtgagggcagtctatgacctatgaaagctatcagatgtaagtgggcccggcctgggggaaggcgggacgttacaaaatggtatcagagccgactctcgcggtttcacgggcgcgtgtgtcgcagttgcgcaggcatggtgcgtatggctggtgtagaccgggagtggttacacagcatggcacatgcgctggcactggacacatggacgtggccaagagaggacgttcctggcctggggttgatcgacgggggcgtcgatctctcttaagggggtgagggtgtaacatcccggcctaggacttaataggattaatagaatatttatatcaacaagttgcaacttctttttcggaagccaatctccaaagaactccagggttaagcatgcttggcctggagcaatttgggatgggtgaccgaccgggaaattcttcccgggtgcacacgagtgagacacgagtgaggacaaagtgtgtagaaaagacatatgttggtctgtgagggcagtctatgacctatgaaagctatcagatgtaagtgggctcggcctgggggaaggcgggacattataattacatgcatgttagattgttatcattttgaactttgccaaaaaaattgggaagccaaaagttttagggatgcctcctaggagttgaatccccagatgaacagggttttcatcacaagaactctaagggcattagcagtgcgccacccatattgcggagcttgggactgtcacgtaggacgaagacacaagaagaataatacttgccacaagtttcacattgctatgtagcttcaaacggggtccacaca

SEQ ID NO: 66322 - DNA, 832 bp, Oryza sativa
gcgatggcagcgactcgccggatctccccttctccttgccggcaggtgctagacgatgccattctccgtcgcctccctctcccattctcttctcctccaccacacctcccctctcctccgaccgccgcaacgtagaatggggtggacggggtgaggtggcactcgaagcggctcggcggcagatcgatgacagatccatcctcgtcttcctcgcctctccactgccctgccctctccgtgacaaggtcgggacgtcgtgtggagtaagggctccccggcggcggcgtggagtagcgagcttccccatcgagccggcgagcgcccgacagctctcctcccttggcaatggtcgacgcggcattgagcgtggcgatggtcgacaacagcgtggagcgtggggatggtcgacgacagcaacgaggtctctctcctccatctcctttccctgacgatgcgttgctcaattgtgggccccacctgcaaaactgatgaggaacggggagctcaaattggctccgcggtcttgagcaggctacacggtttgcttatgtggctaacaatattcgcttttttgctacgaggctgaacgccacgtccttgcactgtaaacgccctaacaaacttacctacgcttatctcttgtatgttcatttgtatctgttgcaacatgcaaacagtagagaattgaaagtgtaaataatctactctgaatttgataatgattaaaccatatccattgtgcacttatgtaagttgagacagattacaatacgaatcagccagatgtacgttgaatacgtatatggataggatactagcgcattcgggtcaa

SEQ ID NO: 66323 - DNA, 1835 bp, Oryza sativa
gtgtaacattcataagcacctggagcggatctatagtataatggtcgatgtcgggtgacaccgatgacttttgacaaaatctatagttaaattgcttatccatatatattataacactatgatctaaacataattagtatattatgacacaccagtagatacgttataatactaacgaatcaattttatggattcgccactgataagcactaggttgtaaaccctgagtaatataatagtcatacgatcataacttcaccacaataccacctgtgtttccccgaatattattctatttttaaggctaaatgggcagctgtaggcctatatgtaaataataagattgaaagatatccttccacgttagcaaaaatagattttatttgatcaagatcatgttatcaaaggcaccaatagaatagcagggcacaccacacacatacaagcttcgattggactccagcctggccatcgaatcctgtcaggtcacataatagtacaacacaagctaaagcctcctaacaatataagatcagctaaaaattattgcgcaagcagattatctgagaaaaaagattgtgcacacaggagatgagctaaaacaacatggcaaggagtggagtacatcttgtcaaagaccatcgagatggctgtgtgctggctaagctggcttacaattttcggtgaaaaatatataaacaggagaatctttgagtcaagctggagcgtccgtccctgtcaaactccttaaaggagacaacatctaccccgcatggcctgatacccttcctttccccctaatttaagttaatttaatggggggagttagtgaaggatcagattagaaataatgcatcacgcattgcatgccgcgtagtattttatcactatgcctaacgccacggatcttttttaatatcaattgcggctagctcgatcatctagctagctgtctgcattccttaattagtcgcatcagcaaatatttttctaaagtgtcactgatgtttacagtttggtaaattttcagaaagttgctttctagctctgttcaaatgcttattgctggttccaattagcttggacctcaaacaaggctgaagctctaggcccggccctaagaaaatattaattcctttgcctagctagtcgtacaaaacagaatgtagacgctgaaaaaactagcgatacgtggatgtcaaacaacacttatcacccgctctgctaccagcctaccacaacttgagacatcgcctttcaccttctcgttgagtgtatctacatacacgaaaaaaaatctgggatctgatgggaaccaaaatctcgtgcgagcaagtcaagccattggaaggcaatatagatagtacatgagcggtaggaacccaaacatggggacacactccattgcttcctcgtcctcctcgtatcctagaaattatggaaggaaagttaccaaaagtatttttagataaagtactttcaataatagttttattaggatatatacaatggttattaataggaggatttttaacattgctaattagaaatatttactgacatagaaaagagagaaagagcggagagggaaaaacatcgttgctatggttaacaatggctttcctttcccattttctactctctcatttttcaatcgcatacttccaaaccactaaacggtgtgttttttcaaaaaaaaagtcacttaaaaatcatattaatatatttttaagttaatacttaattaattatgtgcgaacgagtccatccatattttatgcgcgggattagtttcataccctctatgccaaacacaaccttaccctttataaaat

SEQ ID NO: 66324 - DNA, 4705 bp, Oryza sativa
  unsure (1)..(4705): unsure at all n locations
agcgaaaatcaagaacgttgtaaacaacaaaggcatctctccctgcaggctgaagcacatatcgtccattcatgatcgggaaagcttcgaactgaaatatatagtgaaattcttttgttaggttagctgtgcagccatcagcgagatgccgacgctacgcacgtgtggctgcagccatcagacgatgatcgatggagtgagcggaaagcgaggcatcacctcgtaaagatccaggcaagaatctcttcaaatctaacttgcagcaaccagcaagaatcccgccgccacttgggtacagaaagctctcgctagatctcaacgtcaggctgggtgatcgaccggcgtggccaccctgtacacatagcggccgcatttgccaaatgccataggcattcggcagatcagggatccagtttctacttgacttaacttacctaattcttcagccttttttcttttactttctttctgacctactcctccttcctttgtctcgttttctttctgaacatcgccttccgcaattgtttaattgagagggccatggaagctcatggccgtggattggccaggttgcctccctaagtattctgctttagcaaatcatcacaagctaagtattctgctttggcaaatcatcacaagcactagttgatggtttcccagctgcatcaatcaccatcctagctttcttgcactagtgttaaatcacacgagcacttctgtacaatcttggcacttacttatatttttcaattataggaaaaggagaagcagataggaagatagtagtaatttatacttttatagtacaagggatttggagaaattcaaagagtccgctaacttgaaacaaaagaaatttggcgtctcaacgatgtttttagcgacattaggctgacataagagcctttgactaaaactagcctaggttcagcattcagatttgagagttcttgtccaattgtctgcatagctagagataattattctgatccttattgatacttccatgaatgaccagtgccaaagtttgattggtgaaacacctgtcgatcagctgttgatgagcggctaatgatttttttttcaaggaactgattgatcacatgtctgaattggcaaggaatacgtcgttatcaaaagttcagaacacagagatggcaaattggcttggcatgcaggcatggcgtggcacacgtgttcatacgacacacgtacgtaagcatggaaataattttacgatgcaaacgttaatggcatggctaatctgatggattattgtgcttgatctttgattctcttgtcgagcgagccttttgtgaattttgctgagtggagcaggaaacgtggatcggttattttggcgcgggacacatgctgagagtgaaacttacttaccacacacagttgatagtatctttacttctttaaaaaaaactttattaccggtgaatatgtcactcacatactcctataaaagattttacatattgcccccttaaacttcttaacattacataacgtgcttttacaatcaccatctgtccattctaatgtttctttgttgatatatattaaggaaagtaattcaaaaattaaaatatttttagtacattccccatttgggtttgtcggacccgtttcttgtcacaaactgtcacatatttcaaatctaaacacctttcgacccatgccgctatatataatttatactgcaatgtaatattgtccaatctatacaaagtaaattgcggtgcggcgaagattaattattaccccatggcaaaaggttattaaaaaatttatgtgctactctttttcgaataaggaaatttctatgctaatcctaaaatagagccagaagaacctcatgttggctgtcgaaggactatatttacctacatgtataaccacagtggatcctggttattaccatgttaatagaacataaaagaattacctacatgtttaaccagaatggatcatatgcattacagcgataaatatgctacaattgtataagaaatgcaattatatttatcaaaataaattaagagttctgtaagaaatacagatccttgtaattgatgagaaattcgatcaattctattcaaaatgttttttttaagaagaaataagttcatcggacatccctcaacttaacagcgagattttttgagatcccttaaccacaaactagaaatgtgtaccctaaactcatacaaaccgtgcactcaaggtccattggcagtatatatgggtggtttcgctgacgtggcatcctagtcagaaaaaaaaatacatgggacccacatgtcagctgcacatttttttcttctccttctcttctctcttctctcttctcttctcaagcgccggagtgcgtccggagtgtggcgtcgcctcgagcgccacgacaggaggagggaaaggggaagcaaccggcgggagatgggggaggggagaggtgcaacgatgtcacgccccgaactagccccgaacggaactagcccgtgacgctccaaattaacctgttaatcgataccagtcccaggaaacagtgctggtatcacaggaagacagaatatcacagcaacagtggtctctttattacagagtaggagtacagtcatgttgggctgcggacagatcccgagctcacaactgcattacaaaaggaaaagcggaagccaagacttggaccaatcatcacaggcgcgacttgggaactaggccgaaaccctaaaactcatcgtaaccgacttactcctggaagaactcctcgtcagcgggatccacatcatcttcttcagcaacttggggaggggttatttatatagagcaagggtgagtataggagtactcagcaagccatgggaattaagtgtttaatgcaggcttcaaggaaaggctgttgtttttgcaattgcttttatttaaactcctttttgaaacaactaagtgagtgcttctcaaacgacacggatgagacagtgcgtcacgcccggtcggagtatgtgcaatgtatcagtctttgaattgattcaaggttggcacccggccaacaactttcaaacggccacccgggcctggctgatcccatcagccgccgattttccaaacatcgaatccattccacagcagcaatttcacaaagtagtagtcaaacaaaactacgctaggaatcacctcacatccgcccatgaccgtggacacggctgttcgaacagtttaataacttctgcagagggggtgcactttacccacatgacattactaacccggatcatccagcccgtgcagaacggccacgtctagacaccttaaggctttcatgacaaggcatttcgaaagccgacacaggttcaccatatgccaacgagaggggtcccagaccaacaccagattaggtcccagaccaaacgttccaggaaaccctggggttctctccggcaccaccccgttgaatccacatatctcttggcatcatggttcccccaattagnagttactcagccaggggtgtcccattccacccatgtggtcgcacttgtcttatgttcggatgaaattccaaggaaacggtccttaagtgcaagagcgggaaaccatactcccggtacgttctccggtccgcgattttggaaattcatttagttcgcaagcaccgacccannnncgggttttccaagtcttttgtaaaacccaagttttacccatcgttggatattttaaattttgaggggggtgttccgatgcgcgtacccgaaggcccgtgcatcgaagcacaacagttgacaaaagaggtttaagtgttcaataattcaaggagggtaattgcagcaattaggattgggggccggcaggctatctcgcaagccgcggccgaattacttgtgtaaatcctattcatgcaatatttgcggaaaagaaatacttagatttaaattataggtgcaagatgatcaaaggtgacttgccttgctcgagaccttgagcttgatcctcgaaatcctcgcactgcgggtcttcgggctccgaaactacacgcgaaacgggacaactcaacaaatggcgaaaataaagctctattattgacctctaagcatgccattagatagatctcgagatttgaggaattttggaagttgaacggagtcaaacggacttacggttgggaagatattgaatttctaagattattggatttttgatctaaaggaaaaaggatttaattaaacccttttgaaaaataaaagaaagagggaggaggaacggacttcgcgggcggcttgagcgcggcccgagaggggttggcacggcccggccttgccattgggccggccggcctgaagggcggcccaagggggctcacggggaggggaggagagagggagccggtgggccgggtccaccttgcgtggtcccgggtgggactcgcttgtcggcggctcggctcaccgtgagcgaggtgcacgcggtgcgtgctagggtttgggaagggaacgcgcggtgcacgcgcggatcgcggtgggcgcggatgcggcgagcccacgcgcagcctcacggctcgcggtggaccgcgcgcgcaagcggggccgaggggagcggctaaccggggtcggcttgacctggtcgcgcccgaggtggcgccaacgtggcgccttcgtggcagccacgcgggccggcgagaggtagacga

SEQ ID NO: 66325 - DNA, 2330 bp, Oryza sativa
attagcttgttaatcgataccagtcccaggaaatagtgctggtatcacaggaagacagaatatcacagcaacagaggtctctttattatagagtagaggtacagtcatgttgggctgcggacagatcccgagctcacaactgcattacaaaagggaaacggaagccaggacttggaccaatcaacacagacgcgacttgggaactaggccgaaaccctaaaactcatcgtagctggcttgctcctagaagaactcctcatcaacaggatccgcttcatcttctacagcaactgagggggggatatttatatagagcaagggtgagtacgggagtactcagcacgccatgggaattaagtgtttaatgcaggcttcaaggaaaggctgttgtttttgcaattgattttatttgaactcttttctgaaagcaactaagtgagtgcttctcaaacgacacggttgagacagtgcgtctcgtccggtcggagtttgtgcaatgtatcagtctttagaattgatcaagatgggcacccggccaacaactttcaaacggccacccgggccaacaactttcaaacggccacccgggcctagctgatcccgtcagctgctgatttttcaaacatcgaacccctttctacaacagcaatttcacaagcagtagtcaaacaaaactacgctaggaatcacctcacatccgcccatgaccgtgggcacggctgttcgaacagtttgttaacctctgcagagggggtacactttacccacacgacattactaacccggatcacccagcccgtggcgatcagccacgtcgggagacctccaaactttcatgacaaggcatttccaaagccgacacaggtttaccatatgccgacgagaggggttccagaccaacaacaggttaggtcccagaccatactgtgccaggaagcccaggggtcctccccgacaccaccccggcgaatccacatgtctctcggcatcaaggctcccctgataagctagttactcagccaggggtgtcccattccacccatgtggtcgtacttgacttatgtttggatgaaattccaaggaatcggtccttaagtgcgagagcgggaaaccgtacacccggtacgttccccggtccgtggttttggaaattcatttagttcgcaagcaccgacccaggtgtcgggttttccaagtcttttgtaaaacccaagttttacccaagttgtttttcagattttaagtttgaaggcgtccgtcgatactcgcacagggtgcacgaatatcgagacgcatctagatggttacaaggggacatgatataacaattaacaaagggagcatcaatgcaacaaattaggtatgtccgccaaactgccttgcaaacgggacaacagattaagtgcgatcctatcagtgcataatatttttcaagcaacataattaaatttcaaatataggctcaagatgttcaaaggtggcttgccttgctcaagatctggagcttgatcctcgaaatcctcgcactgctggtcttcgggctccgaaactacacgcgaaacggatcaactcaacaaacggcgaaaataaagccctattaatgacctctaagcgtgccattagatagatctcgagatttgaggaattttggaagttgaacggagtcaaacggatttacggttgggaaggtattgaatttctaagattattggatttttggtctaaaggaaaaggatttaattaaatcctttttggaaaagaaaagaaaagaaaagaaaagaaaagagggagggaaaatagacttttctcgggcggctagggcgcggccgaagagaattggggcggtccggccgagctaaatgggccggccggcccaagacggtcgcgcgcgcgggagggaggagagagagccggtggaccgggctcaccgcgcgcggtcccgggtgggacccgcttgtcagcggctcggctcaccgtgcggagggagtatgcggcgcacgcgcgcaggcgggggagggacgcggtgcacgcgcacggtctgcggaggaacggatgcggcgggcccacgcgcagcctcacggctcgcggtggaacgcgcgcacgggaggggctgaccggggtcggcccgtcccgacctcggctgagctggcgccgacgtggcgcctatgtggctgccacgtgggctggcgggaggtagacgacgacgccgaccggaacggatggcggacaacagcggcgagcggcggagcgaaccacggcgataccggcgaaaacgagcacaccgggtggttgcacgagacgaggggagacgagccaacggctcggattcg

SEQ ID NO: 66326 - DNA, 2217 bp, Oryza sativa
  unsure (1)..(2217): unsure at all n locations
ggctagcgctcggcggtcgcggccaaagcggcaacagggaggagggaggtggatgacgccggcgggagggaaaaaggggaaaagaggaagagaaaagggggcttgtccccttgcctcttcgggaaaaggaggagggagagggggcgtcgcggcagagggaggagggaggctctgcctccgtcccttggaggctagcgcgggagtggtggggccgaggcgatgacaacggcgatgacggcggggcggtttggagcggcgcgacgtcacgggcgacaggcgcgggctggcgcggcagagggtgacggcggcggcgaccatgcggtcggccactcggcacgcgcgcgtgggaaacaatgggcggcgcggctgggcacgcgcgctggctcgcggggccgagcggctgcaggcgcggcagagcagcggggccgggcgacgcggacggcgcagacgacacggctcgggcggggaaccacgcgggcgcgcgcgcgaacgacggcgcgcgggggccgtcttcgcgagcgggaagctcgccagggagaggagaaggagagcgaggggaaggggcgctcggcgcggcgcttgcgcatgcgcgggcagagcgaggggaaagggagggggcgctcggcgcggcgctcgcgcacacgcgcgcgtggcgcgcgggcggggcggagcggagcggagggagaaggggagagggagcgcgccgggggaggggagggggcgagagagagagagagagagagagagggagagcgggagcgcgccgggggagagtagagggccgggggagaggggnagatgggccnngagaaagnnngncnatnnaccccgggggaggcaaaatagacttttgcggaggaatttgatttggaaagatttggattcggatttgaacttgacgatagatcggggattgagatcttgagatggcacggaccctagacgacaagcgaagaaacaaatttcgcaattagggtttttaagagataattttcccgctaggcgccacgacggaacgggcgctacaaatggcgggcgaaccacggcgatacaggcgaaagcgagcacaccgggtgcttgtacgagacgaggggagacgagtcaatggctcggattcgccggagggagttcgtcggtggaggattgcggcggcctccactagcggcgagagaagaggggaacgacgacgaggcgactagggttcgattcctccggactagagcatctacatgacctcgagattgcattcctagcaccggattgggcggagctacgccgagagaagctggcgacgagcggcggtttgcggcggcgagcggcaacggcggcgaggccgcgccgggcggtggcaaggttttgggcggcgcctgcgagcttctaggggtactacgagtgctaccacacaatctaaggggaggatgaggagcgaagagggagaacggaggagagctctaccgagacgggacggggcgctgtgacgagaggccgacggcacgggagtgatctctccggtctcgggccggggaagaagaagaagacgagctcccggagtccccttccgcgtccacgaacgcgccggctcctccggcacgcgtggcaacgtaaggcggcggcgaacagagcacgggaggcggcgacaatggagtggaggcgatgggacaaacaagaggagaaggaagggagggcgcctgggctttataggatggcaatgtcgattcggaaaccaaccttgggtggtcaaggagcgagctggcgctccgacgctcgcggccaaaatggcggcagagggcatgacgccggcgggaagagaaaagggaaaaaagagggaagaaaggggggcttgccccttgctactttgggaaaagcaggagggagagagagaacgatggggcagtgggaggagggctctgcctccatcccttggaagcttgcgcggaggtggtggggccgggtcgtgacgacggcaatgacggcgggggcggtgtggagcggagcggcgacacgggcggcaggcgcgggcaggcgcggcaggcgctgatggcggcggcgaccaggcgatcggccaccacggtgcgtgcgcgtgggaagcaacggtgcgcggcgatttgagcggcggtggcgggaagcggcagcgagagcggagagggagggcgcttggctcgacgccgctcacgcgcacgcgcgcgcggcgcacgggcagagcgagggagagagaga

SEQ ID NO: 66327 - DNA, 1072 bp, Oryza sativa
acagacacgctctcccgggtcccgaacatatcgatccccatctggatcgctcacgatccctcgccagccgccagccgccagccgccggccgccggccgctagccggtgctcatgttccatcgcgatcgagaaaggcgcggatgattgtcgcgtgcttaaactattctgaatagtttacaaatacttttatacacttggaagtgtgaatgataatactactggctatttctgtaccattatattacaaacggtatcgagcacggttcaaaggtaactccccactatatatataactggcgaatagctactcgatctcaaaacctatggggtcaagcctttgaaatcggtgttttatatatgtatttcaatgaagatataattgtattccaaaaaatgtgagaatatcccacaataaatgtgaggtttataaaccttcagtgtcagaatggactttagattaatttctcgggaaaaaataggactacagataagaaacttgtaagctgcatatgggaaaaaaataatatggaaatgcagcttttaatgaaagaaaacaaagtataacacttgcatgtacaatctatttacataatgacatatattatattttatatcatttggttgatccatttggctactacatatatatgcatatggacattcgaaaatgatcgggtctgcacatacttttgataatattatatacgcattgatcaactagcgcttccaatggcttgaacaactccaacttggttgcattcctccaactacacctagtacgacgtacagtgatttggtatacgttgtactacgggaataatgcaggcactgtgcaacttacaggggccgatgagagcagtgatcaatctagcgctaactcccaaagtaaagcctttttggcaggtgggagatttgcagttcaatatatccaacttgatgtggccatataacataacgtgcatgcctgcatgcagcctctgcctcttgtatgcctagtgggtagtacatacacgtattaaatacttcatccgtttcgtattataagttgtttgattttttttaagtgtgatta

SEQ ID NO: 66328 - DNA, 972 bp, Oryza sativa
tgtactgttaaacagatggcaactatacagtacatcatattttcaggccgcattcttttttagcctaaattcgcattccgctacattttctatctatattcatattcgtatcaacatgtttctggccgatctgtagtatttagcaatttgttccaacttatacgaactaattaaccggatctggttttttgtttatattatccatttcggatgttgaaggtgcattcgtgtatacacatatatacgttaggattggcaatatatatatatatatacacacacacacacacacccgatatgtatatactctatccgtcccatttaagtgcagccatgattttccgtgcccaattttgatcgtctatcttatttatcatctcataacaataaaaatactaattataaaaacatttcaaataagacagacgattaaagtttttggcacgaaaacttatagttgcacttaaaataggacggacggagtaccctgcgaggctctctgatgatcagaatctatggaaaagaagcgaacctacaatattccgaacacaagtgcgcgagcaaattaaaagaacgaagagcatatatcggcgcgcgtacttctgaccgaactgatgatctgtacctttgtcgcgcaaaagaaccagcccagccgcgcgcacggacacagccactcacgtacacattcagagctactcgagcaaacaagcttaagcccgaccagtcgcgtgcctgctgaggccggcatatcgatctataggtggtccacgtgccggagtccgaaaacccaaagccggtgggtagctagtaggcacgcatgacaagctgccgaacgcccgcgtgtgcaggtggggtgggaggtgtgcaggtggtgggaggctgcgtgcgcgggggcgccagcgaagcttcggacggtggcagggagagatcgagcgaatcgcgagatcgctctccgacacggcgaaatcgcgc

SEQ ID NO: 66329 - DNA, 2194 bp, Oryza sativa
cggcttcccattgacataatcatttatatacaatggcttaagatgccgattctctgccccctctggcttctcaaaaaccgcttgctctggcgacaaaatcaatttagccgattcttcttcaacttcatcaacatcggcttgcttgctcccaaactcagccggcaatgtgaaaaccatgttaatcgaagcagttacgacacttttcccttagctaacctttttgcctcatcggctgcggcctcatcggctgcaggaacctgattattaacacgccactcctacctcggctttggtttcttcagccgatggttaatttcctgtttcttgttcaacctcctgaaagcgctccctgttcctcaatctttgaacccttcttttctgattcttcatgaaaataccagaaggacaccactgatttttcctgatttcattgtcctcttggtcatgatcttgattcactggacccaatctttgatgaacaggaactcttgtctgccttagccgactacccctaccatatgatcggcttgaattctcggcaatatcactgcacccaggacagtcttcaatagaaggcagcctcatactttcattccaacaaaatctaaaaaactcgcaactccaatgaggatcaaagccatcatcgtctgctttataatgcttccctactgcttgtcatacttcctctgatatttgttgataatcttagccgaattcatctgaaaaccccttacacggcccctatcggctgtttggccagctgtatgcaccatattaacaggaaaaggattgccatcaaccttcatcggcctcttagagtcgtcaaacttaattttgccctcttcaatagcctcttggatttgctgcctgaagaccttgcaatcattagtcatatgagacccagagttgtgccacttgcaataccttttcttgcccaattcttcagccgatggaattatgtgatcgggaggaaattgaatctgcttctctcgaagtaacaagtcaaaaatcttatcggccttggttatgtcaaagtcatatctctcttcttttccagaactctttacccattggcacgatatgacctttttactcctcacccattcggctgcagctatttcagagtcatcctcatcatcatcatccgacccatatatgtaaggacaaacatgattaaccttcttagagcttttcctagcttccacagacctatgctcgtgcaaggttaccttctgtatcagatatgacaagctatcaaagtcttcagacgagaatttctccttaatcggagcaatcataccctgaaaggccagatcggctaactgggcgtcagttaaactcaagctgaagcatttgttcctcatctccctgaatctctgaatatactcgtgcacaggttcatcatgccactgcttaatcaccgtcaagtcagataatttcatctcatgaaccccactgtagaaatagctgtggaattgcttctccaaatcggcccaactattgatcgacccatacgacaaagaggaaaaccaagaaaaagccgatctagacaaagataactggaacaacctaaccctcagagcgtccacagccgatgcttcaccacactaagctaaaaatcggctaatgtgctcataagttgacacaccatcttgtcctgaaaatttggagaagtctggaactttgaaccgattgggaagaggaactctctcgaaccactcagggtaaggctgccgatacaagtttccagtctcttttggtttaagcccaaattgttccctcattacgtcggcaatcacatcggcccacagtcgttgctgaactgctccctgtgactgttgttgcatgggttagaactgaccgtactaagacgcaaactagggttgagccaatccccctggctgatattgggcttgcggggaaggaggctgatattgataattcaagttgcccccctggtaattatgaaggttcggctgaatattatgtgccaagtgctcgggaacaacttgaggcattactatgccatctggctgtacatggtgaaccaagtgttctgggacaacttgatttaaaaattgttgtacaggctgtccaccaggcgtcgcaaacccggccgatgcgctcatcgagccttggtgctgaatcggctgaacgatttgctgttttaacggcgtctgctgaatcggtcgcg

SEQ ID NO: 66330 - DNA, 4319 bp, Oryza sativa
  unsure (1)..(4319): unsure at all n locations
atgctgtggctgctctcttattaacaaccgagggttcaccagctggcctggtgccaacgctgacggagcagataggggagtcgatgcaggcgccgtcggctgagctgatggtgcaatggggggaactgcctgaatagatggttgagcttcagtgatcaaaggccgataatttggaaagacacctccttgcaaataaactgggcctgcagcctgatgctcacctattgaaccatcggctattgatttcatcatgtttgataaggtattaactagcaccccagactgattgatcaaagcatggtgcacagcatagtcgacccgatcctggaagttattaaaaaattcctgtgatgcatttccatcctgattaaaatttcctccctgcaacccctgagccatcactttgaactccatgcgccccatcaccttgaaccccatggactacctgagaattgtcaccttgacctcctagagaaccgtctgtagcacctttgtcactcggttgagctgagccgtccggagcttgtttcccgtgttcacctttagaagaactggtcccaggatcatcggcaactacctttactttatacttctgaaccaatgttcccttgcgagtctgcatgaatgagttcaagaactgatcccgtgcctgctgcatcatcgcgtcgaaatctttcttctgatcaggtgtgaatttttctggttcaatgggcacgacgtttccttcattgacgtccgtcaatcccaacttctggatcttttccttaacagtgcctggactagcctgggatggcgacagcggtggtttctcaaccatgaggaagaattgcttgctgacttcttatctgtcccactgggcgtgccaaatgcgtgttgacgtaaaacacgaggcctgggagatctgcttaactccattgcaggtccaaagctcaccttcaggtgtgttagcgtgccagttgatttgatcctgcaatcaacaagaaatagaaacaaagagatcgcagttaaatctataaatgattgctgatcggctaagtgccgatgacatatcatttatctttgagtcgatgttatatgtgaatcgatcggcgagtataaatagataataaagaactaaacctactcgatcggctgtagatattaccaatatatagttcttatatcgatatatatttaaatcaagtgattgggatagatcggtcgccatgccaagatagtaaaaatcacttggatcgaaatatatattaataacaggactatatatgtttatagcatagccgatcatatagatctagcatgtattggctaatactccgatactactctatatcaggatattaaaacaagtataatatatcaaacaaaagcttaatatacttaaatgcaataagatcttgacagaaagggcggatttaacatgtcacttaagcatatagagcgaatatggttaaatcagataagatcggctgaaactccgatactaccctaatcggcaaccagaaggcaggctagagattgatattctaagcacgacttaatagatcaaactcaactgatgcagcattaagtatgaaaagaagaacaatatctagacaatcaagccgttggaagtttcatagagtggtggatatcttatataatctaaatcaacatcaaaatctaacctaatcggctgccctctactaacagatgttagccgattgtaggttagataatgatattgccagagattatgtacgatatatgataactcgacgaattacgtaaacaagattagagtatcataaagatggaagcactaatcccgataacacaagccatcataacaagttttacctcttgttgaagatcaaaaccgatgcagctcaacccaaaagtaagaactcgtcgaaataaaactaaagcaaaaaggtggcgatgcgccgaaattgtattgaacattgtgtgtttaattacatagggctcggagtctatttatacccgagaattacaagatatgtccataccggacacgactattatctctaacaaactctaagataccacaagtctttacgacagacttttgcctaagcatatctctgagaaaattacataaaatgtcctaattaatagatacaattgccttcccaggactctatccatgcgtggcaatcatcttgaagcacctcaactcaacccgatgtcgtacaccaagtcgtattgttggaatcggctgtatcacctaaccaagtctgactctaacttagccgatccaatcgtagccgatccggacttcagccgattcttactctgtttccgcgacaatcttcatcttcgaccccgcttcaatctaatcttcatctccgatacagatattaccaaatttgatcgttaccaacgggctactcccttagcagttgcctggcgttgctagcgagcttgttgttggtggcgagcagcattttctgcccgaaggctctgcttcccttgatcacgttcggtgagccatcagtgttctgcagcaggcagcgcgtggtggccgggcttggcgtcggtgagggccatgttctatccgtggtaaattggccccatgcattctcctagcattaccttgccatgccgtcgctctcctcaagcgcctcaacggcgtgctccgcaaccatccttgcctcaacaaccaaccgagccacgtcatcgccaccattgcgtagctagttgtacttgtaaccatagttgtggtctactgccattgcgccatgtgtgagttggttagagttcgcgtgcagcggctgcggcacggttgtgagtgatgctaggctcggaggcgacctcgaggctgtttatgctcgacgcctacctcctccacctcctcatcccggcctcctcctcgtctcatgtgccgatgtcggccatcgcacacgagatacatgcacgtgctggttagcatgtgtttgccgctatcgctgtctcccttcgtgtgtggacaggcggtcgagcgcgagctcgctcggggctcctcctgagtcctgactgtcgtcgccattgttttccttcacgcgcggatgggtggacatacgggatgaggaggaaactgattttttttttttgttttttccccttattacttatagtctttttggcatggctctagctccagctccacctctactgaatctatagtctagccaaatagtttcagctccatctggatggaatattgtcacaaaataaactagatatgtgaagctgagtttgggctctccataactccactctagacccaactcctgaagttaaatttaggagttggagctttaccaaatgatccctaaatatgtggtcatatgcgtatttttttttatttctttgatttgatgactaggtggcacgtaggcgccaagtcagcaaaaactaccgtcaatactaataccaccgaggaagtcattttgcaaggttttaagtattagaggggtagatatacccagttttgcggataaggaatatgaagcatatttagattatggagtatttgagggagtcgtattgcacttttccgcatgtgaagcacaacacgttcacgggccgaacgcgtggcccattagatccaccctgagttggggcttagagaattcgcagtctactttctagaatcggcctgttccttttccattgattttcacagtctttcttgtttttttttcctcttaacaaaaatcccaatcccacaaatatcaatcaatagctttgcggcgacgcccttcctcgcgcggcctttttttaagcttatctctatcactcgctcttnnnccacgcctcatccgccatggccgcctccttcctccgccctctcctccccccgaaacccttcctctccgccactcctaaaccccacatccccgccgctacccccagtgccatcgtgcgctgcaccgcggcgcccaagccggccaccggctctatcgccaagcccagccaagaagaggccaacaacaaccaggagcaagaacccaacgccgccgccgccgccactccggacgaggccggcgccaacccgcaccgcatccccgacgacgagaccccgccgtctgcgacggcgaccacgtcgttcgccgtggcgcggcgcgtgccgtcggccatctcccccgaccgccggcgccggacggcgctgacgcagggggagccgccgaactacgagatcgggtggaagcgcaccaagaagctgccgctggagaagcccaaggggtgggccatcgcggacttcatggagaagctggaggggctgatggcgcgcgggcggtacgggtccggggagctgctgggcacagtggccggcgtgg

SEQ ID NO: 66331 - DNA, 1743 bp, Oryza sativa
aaatggatgggatagccaactacgtgcacttattatgctgcataatttcaaccggcaagcatgacaagcagaggaaacactagctaagttttgcgacattttgcagttatcctatctctttttagttaccagatgatttcctgcgcgttattgtgaggattgattcatatggagcaaacaaatagtttgagcaaatgactataaatagcatgggagaatgaataggaaccatcaaaatcaaatctatcggctcaacttgttgattgatgatacggtgtgtcatggatgtgcttatttgtaggagttagacagttagtaggatatagttataactcattcactgtcgctactgctacaaagtagccaccaagaagccgcctaatcacttatctttgttctacttcaataatagagtcagcatcacatgtactcctaaatcctaaaaatagttgagttaaaagttttaaaatttgtgtagagtttcttttttcaagtgctgagctgaaaagttcaaattttgggtagttttttttaaaaaaatatttgagttgaaagtttcaaattttgattaattatatttgaattttgagatcaaagttttaatttttttcatagaagtttttttatttaaaaaaatgagcttgacactttccgtttaaaaaagtcagataaaccgtatagatgaaacctatatatatatggtggttgcatcgcatactgcttcctacatcgacactcgaaatcagcacgtaccatgttccttgagtgggccttatatgggtcaaaaccatgtgttccaacacagctacgctaattagaccgaggacggcgacgatcaatggcgaggaggaagccattacgccatttgccaatagcgatggagatgcccttggcttcaaagggggtgttcagataaagtttgagcgtgacacatcgaatattatatagggtgtcacatagggtgtttgggcactaacaaaagaattaattacagaattcgttagtaaaccgcgagacgaatttattaagtcttaattcgtcattagcaaatgtttactgtagcataatattgtcaaatcatggagcaattaggcttaaaagattcgttttgcaaattagtcacaatctgtgcaattagttatttttttaagtatatctatactttatatatgtgttcaaacgtttaatatgataaggcataaagttttaccgtgggatataaacagagccaaagtctatctttgcctcccctttcgatcgctaccaggaggcagggaccctcccctccgcgccaccattctcctccggtgcgtgctcctgcgcatgctaagatggcactggttttgatagtttgagtttgcggttaatggatgaaaaagaagctcgatccataatggagggcctaaagtggactttatacattagtaaatacgcacggcaggtcacgttctcttccaagatgggctttgtgtcagtgttctgggccttggtagctcagccttctattgtatcttggcccggtgtggcggtgcctccggtgtgaagtttaccctcaaacattcttaaaaggaaaaagttcatcgaaggtccctcaacttaacagcgagattttttaaggtcccctaaccacaaaaccagaaatatgtacccctaaactcactcaaaccgttcaaacaaggtcccatggcagtatttttgcccggttttactggtgttgcatcctagtcagcaaaaaataaaaaa

SEQ ID NO: 66332 - DNA, 8720 bp, Oryza sativa
  unsure (1)..(8720): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctcccagaatgctccgcatagaagagtgatgccctctccgcatccagctgaaccactgcctctttgacgatatcaaatccagactccaagatgacctccttgattctctccgtgtaattaccagatagaccgtccggtttgatcatcgccagcgtcctctccctctcgatagctacgcagctccagcatctgcccaaaatcaaacgccaaaacaacattgtacatcaaaatgtcacatgagaagaccttaacattgtacagccacttcttcagctgaatgcaccaccaaaaaacaaagcatccctgaacaaagacgtttcatttcatctcaatcacgcttagttaaaattacccatgtttacaaactacagtcgctgtatgtatccaagggatcctaattaagcgagagagcgatccagagtgggttgatgatgtgagcaggggggattaggacgaaatcttgctcagatctgtcgaagcaggcgtcaataacacaccaaatctagcatttctacggccaacgcatgctaagacgctataaacccaagacacctaggcaccgaggttcagtacggtacagtacagcacagcagctataaaccaagagcggtgagagcttggggcttacccgtggaggaagaggaagaggaggggcagcaagcagacggagagacagggcgccgccggcgaggtggcgccgcccatctccggcgaggcggaagcgccggagagaggagggagggagcttagcggtgggtctcccgtgttccttgtgctgatgcacgagtgttaattcgcttttggttttatcgcggttatcacggagcaggtttcacttaccgcggtacctgggaaatttggacaaaattggcattctattttcatcgaaactttgccaaaaataccacttcgtatttataacattaacatttaggagttaatttcactttgggccatgttttatggttaaaggttcactttagactactttttatctaatcttttcactttggatcggattaggtaactttatctttattgtacaataaaccaccccaaaccacattttcaattcttcgatgactttgatgaagttgttaacgacgtgccagcaaacttttgtacctatatgcatgccatacatttgtcaaaagaaacgctagacatcactagcgaaaagaattagggtggtccattatacaacaaaggtaaagttacctagtccaaagtgaaaggattgtgtacagggtggtccaaagtgaaactttggtaataaaatatggcacaaagtgcaattcactcatttagagttaattagaatgccactctcaactacggacttcgtccaaatgccactatcttctatttttgaaaaataaataggaattgtttttgtccctttgcttctatttttgcttgtattggtgccgttcatcgtcgacgcgctcacggctgagggctccaaggtcccctaccgttgcgtgctcctaacgggagcctccattgatattgttgtcgcagcaatgtactggatggagtcgctacgcgtacctcacgaagtgtgtgctcgccgtcacctaggccgtcgcggcatctgtggtcatgcggtcatgccacacgtgtcttccctttcccgtcactggctgctacccccgtccgtcgccagatgccctagagagaagagaaaattggacaactgacattgttggatatagcagtgaaacaatgacaagccgcccaacaacgatgacgatgcctctgtctggcggcgagcgcgcgcgaagaggaaggaggtgaggaggttgatagcgagcacgcggagaaagggagatgtggtgcgggagcaagccagggctccgagtccagctccatggtgccgggcctcgcctccacctccgcggctaccgccacggctcctagcccccacctctgcctctgcctccgagcccaacgctgtggcgcccacttcgccggcggcggcgacacagcgctcgccctcaccttctgtcgcatcgcagccgctgccgcttcatcgcccgccgcctcctcctctcctgcctcgccgactggcttgccagagaagagaagagaagagagagagaggaggatgaagggagtggagggggaagagtgagggtgctgatgtggcatgctaacatgtgggttctacactgactcagcagccacgtagaatgaaattagggtcaaaaccattgaaggatctagagtaaacggtttttataagttgagggatgtcatatatctggtttgtggctgagggacgattctgtgactcggtgacaagtagagggaccttgggtgtactttttccccaaaaaaatatcaccggtccatccctgcaaaaaaaaactcggcgcacccacgcaagcgggccggagattaacgggcctcccggacaggcccctcccccattaattccgtccggcccaacacagcccgccgtctccgttgcagtcccgtcccctcgccgccggacgcgacggcggccaccacagcatttttgatttccggattcctccccttctccgttccgtccatccatccatcccggaaatatccccaaaccctcgcctccccctcccccccgccgccgccggcgcggccgccagatctgcggccatggacgacgacggcggcgcgtccccgtcgtcctcgctctccccgtcccgctccccgtccccactccccgttgccgaccccgtcaccgtcgccgcggcgcccccgggccacctcgccctcgccatccccatccccaagcccggctcctcctctggaggtgggggagggggagggggaagggaggacgcctggagcgacggcgccacctccacgctgatcgacgcctggggggagcggttcgtcgcgctggggcgcggcagcctccgccacccgcagtggcaggaggtcgccgaggtcgtctcctcccgcgacggctactccaagcagcccaagtccgacgtccagtgcaagaaccgcatcgacacgctcaagaagaagtacaaggtcgagaaggccaagccggactcctcctggccctacttccaccgcctcgacaccctcctcgcccccgtgcacaagcccgcgggcgcctaccccgccgccgccgccgccggggccgcgggcgcgggcaattccggctccaactccgccgccgccgctaccgccgcccggagcaccgcgcccatggcgccgcgcgtcaacttcccgcagcgcacgcgcacgcagttcctcccctcttccggggtgaagcggaggatgccgtcgcctccccaggtatcagcgtcgtcggagtcgtccgacgggttcccgccggagccacctatggcggccgcgaatggcaagaggcggcgcgaggtggaggaggaggtgaacggtgcggacagcggccaccgcacgcagggcctgcgcgagctggcgcaggcgatccgccggttcggcgaggtgtatgagcgcgtggagttggcgaagcgggagcaggagctccggatggagcgcgaccgcctagaggccgcccgcgagctggaggaccagcgcgtccagttctttctcaagatgcagatggagctctccaaggccaacaatgctggcgcctctgctgccgctgccgcagtgggtgccgttgccaccgccattgctgctgccgatggcaatggcacgaggagaaccgctatggccactgatgtcggtaccagcagcaatcaccatgttcggtaccgcttccaggacagcaggcactgccatgctgccccgcagcagccacaacaccagtacaacgagaacaatgccgccgaagccgccagaggtaccgggaatggtagcgataccgacaacaaagaagacgaggatgaggcagaggacgaggaggacgagagccagtaatggcacccggtttacatcttgaaagattcaagaattcgatttgtatgattgtatcagttaattggcattgccctggtggttagaattacctcccatttaggctgttctgggagcaacaaatgacatctgagtactagttagcgtcggtattagcaacaaggggtagcatagttatatggttatgtgcctgtgcctgtgggtgttgtgtaacttgtagctgcttgttcatgcttgtgatgctgtggtctgagctatgatgcaactgccatgtcctggcgaatactgcatcgattgtaacctgattgttatgtgacaaaatgttagccttattctgtgtctgttcttggaaatcaggagcattgtcctgaaccttgatagtgtggagacgtgccccatcagtgttcgatttttcgcttgctgagtaattcagagtagcttctgttatgacttatggttcctgaattgtaccttgccgttaacttggcatggtgaattggtggaattttgttacgacttatatgaatcccgaattgtaccttactgttaacttgtcatggtggaatttgagctggttatgttgcctgtgctctcttcacagggtaagctttctgcagaaatgtgcaagattccttcagacttcgagcagctgagcctgacagaacaattgtgggcacccaagtatgctttacaggcgtcatggaatggatgtagtgtaaagcatgtaacacttgagatgcttatgctgggataaaccagtagatccagatgctaatctaatcctcgcgcacttgatgcagatcgtgctggtgacctggttacgacaacagacgagatcagaagggcaagtgatgcttttgttgtcgccatggcgaatggcgagcctgtggtaggagcagcatatgcgatctagcagcagactcagaaaggtgtatgcaaccgtttgtgctatgaacgaagagagagagagagagaatgcagatttgcagtcaaatggtagtttagattaatgcaagtaacagccaaagttggtatcattgtatgcaagtttgattgaaaaagcaaataacagagaataccacatcacctttctttgtccattctattccgatatatgaaaaagagtgacctaaacataataaggaatatgagcatcatttaagtataactagcatgatggcccgcgcagattgcgcggctagcatcattatattttctctcatataatagcatatatattttctcattatattattaaaatatattacaatgacaacataattttaaattttacaataactttacaaaactactaatgtgtaatattcatattgtattttatatacgtgttagttattaattatttttaatatcaaattttagttatttgtaaattatatatatttctatatggactctagacttgtcttttaatatttctttttttaattctgattttttattatttctaattgtatttctatgtggactctaaactcatctttcaatattctttaatttttaatttcaaatttcagttacttctaaattgtattcctatattgactttaaactcttcttcccatgtttttttaatttcaaattttagttatttgtaaattgtatttttatacggactctaaacactaccttttattttattatgtttattctgaattttacttagttttaaattcctatatggactctatactctacttctaatatttcttattttttaattacgaatttttattttcttttcttaattgtatttctatatggactctatactctacttctaatattccttattttttaattccgaatttcaactatttctaaattgtatttatatatggactctagtctcctcttctaatattccttatttttaaattctgaatttcagctatttctaaattgtatttatatatggactctagtctcctcttctaatattccttatttttaaattctgaatttcagctatttctaaattgtatttctatatagactctagtctcctcttctaatattccttattttttaatttcgaatttcagctatttctaaattgtatttctatatggactctgttttttctttttctccgattaatgtgagaatttctcggccatgagagcgaacgtagatgctcctttttctattcctattaatgatataatagatagatttgacctagcttgcatgcatgtatttctaataaccttttatattggcatagtacaaaaacattatgagtgtaactttaataatgacgtagtaccaaaacattatgaatgtgtgcatcatgtaagtgtaaaaaacagctagtaaatatgattaaaagtcggaatgaaagtggggaaaaaaatggagacgcggggaatcgaaccccgtgcctctcgcatgcgaagcgagcgctctaccatatgagctacgtccccatcgattgaaatcatctatgagaaactataaagtgcttcatccgtttcgtattatgttagtttgatcaaattcataaaaaaaattagcaatataaaaataccaaattagttttatcaaatctaacattgcatatattttgataatatgtttgttttgtgttgaaaatcctaatatatacttcctctattttttaatagatgacgtcgttgactttttctttcatgcttgaccattcgtcttattcaaaaattttatacaaatgtataagatataaatcacatttaaagtactatgaatgataaaacaactcataaaataaattataattacgtaaattttttgaataagacgaatagtcaaacatgtgagaaaaagtcaacggtgtcatttataaaaaacggaggtagcatattttttataaatttgatcaaatctaaagaagttggactgagaaaaggtccaacgacttacaatatgaaatagagggagttcatatgccatttgatccggaggggtatgatcctagtaatggtactgatcctggtaattgttgagttgtgatccaaattcatttgcacttaataaaggccagcttctgccatagtggagcagaggcccgtcgccggtaggcttgggcgagagcacgtggatgatcaggaaactgaaattgttgataatgatgttcatgatacagttcaacactcacctcctgttttgcagccacaagatgaacctattgcacatcacataacaaagaggagtcgtggagctcctgtccgtcttattgaggaatatgatatggtttattatgcttttagttgtgccgaacaagtggagaatactcttgagccggctacatacactgaagctggtgtttctggtgatcgtgagaagtggatctcagctatgcaggaggagatgcagtctcttgagaagaatggcacatgggagcttgtgcacttgccaaaatagaagaagcatgtccgttgtaaatggatcttcaaaagaaatgagggtttatctctaagcgagcatccaaggtttaaggcaaggttagtagcaaaaggtttcagccaaattgctggtgttgattataatgatgtgttctctccagttgtaaagcatagttcaattcgcacatttttcagtattgttgctatgcatgatcttgagctagagccgttagatgttaagataatatttttacatggagagcttgaagaggagatatacatggaccagtcagaagggttcatagtacctggtaaggaggattatgtttgcaagttgaaaggatccttatatggtttgaaacagtctcctcgtcaatggtataaaaagtttgattcatttatattgtcacatggctttaagaggtctgaatttgatagctgtgtgtatatattaaatttgttaatggatcacctatatacttgctgttatatgttgatgatatgctgattgttgccaagagctaggaagaaatcactacattgaagaaacagttgagcagtgagtttgatatgaaggatcttggtgctgctaagaaaattctaggaatggaaattactagagacaaaaattcaggtttgttatttcttagtcaacaaagttacattaaaaaggtttttcagcattttaacatgcatgatgcaaagcctgttagtactcctattgcaccttattttaaattatcagctttgcaatgtgctagtactgatgaggatgtagaatacatatctagagttctatattctagtgttgttggttctttgatgtatgccatggtttgctcccgtcggatttatctcatgctatgagtttggttagtagatacatggctaatcctggtaaagaagactggaaagctgttcagtggattttcaggtacctcagaggcacagctgatgcttgcttgaagtttgacaggactaataaggggcttgttggatatgtggattcagattttgctgctgatttggataagagaaggtcactcacaggttatgtgtttactattggtagttgtgctgtaagttggaaggcaacattgcagcatattgttgcccagtctaccactgaaataaaatacatggctattgctgaagcatataaagaatccatttagctgaaaggattgtttactgagctttgtggagttgattcttgcattaacttgttttgtaacagttaaagtgccatatacctcactaaagatcatatgtttcatga

SEQ ID NO: 66333 - DNA, 4184 bp, Oryza sativa
caagctagttggtatagtggttttacccaagaggctgtttggcgccgaaaatgttttttttttgtctttgttgtgttcagggtgaaggattgattcatgctacaagaaggaatttgtctcaaggtggagtttgttgagttgtgatccaaattcatttgcacttaataaaggccagcttctgtcgtagtggagcggaggctgaagctgacccattgggttgtgtacctggggacgcccgggggtgtaccttttagggttccactatacacacaccttttgtaagccgtcgtgcggcgttgtaacctcatcccgatatagtgaagatattttactggctggcaccagtggtattttctctcctgctttgagagggttttccacattaaatctcgtgtcttctgtgattgatctattgttttttatcgtttgtttgcctattatttcttaacagtaatacactgctagagtaataaaagtcttgtctaggtgcatctttctgccaatcctaaccgagattagtcagatttttgtgatctgaaaatggtcacacatccaagtcaagctttcgcagaaataactactgtttcaatataactacttgctctgttctttttttacatgagcggtccgcggaccacaggagtttcgaggtcagttcttcttttcgattctatagaacaacagtacaaaactactaatggtgctaaactctacatttaaccacctgttaattcagataccaataatcttctctatcatatttccctttcttccacatgtttctacgtaatactaacatcacactattatccatcgtctaaggagaccatcttcacatatcttctagctcctttctgtccaagagttcatatcagagattgtttgacttatcagcggaataagcaaaacggtatatttacaaataaaaagcaatttgtgaataaaacttttatgtatttgttcttagcgatgtaaaaacaaaggctgaaaaataaacttcgataaaaaaaaccttaaaatttacttcaaatttaaggttaaaaatttaaattttgactgataaatataagcataagcgaaaagataaatccattactctagagtttaaatatggacatacatgcagattcaaacctaaaagtgagttttttttatacggagggaatggttcgcagttgagggtgtgtaaatggtatatgcatgatgtcaaagctaatatgcactcttaaaaactcaggtaaaattcatcacgagaaatataaggtaatatcaacctgagaagtgaatttgttaataaaaaagccaaaaacgaagtattagactcaaatatatatatatacacgtgtaatatatcaatctttttcatttctttttcctaatcacatcacatgacttgaacaccaaagaattaacccccgtgtccggccggccatggaggaagactgcaagtgcattgaccgggcaaaggtggcccagccacacgccatcattaccaacggttaccatgcaggggcagtttggtcattcgccgcgcacgccgcgccttctccggactccggagcacacaagaaaaaagaatctacccttcagaataaaatcgttttcgggatcggcagccgcgctctagttatcgttatcttttccttcgttaaactattaaaacatgtacaatagtagattattagctggttataaatatattttaatataataaaagataagagagaagagcagcggactatagatttatagccagctgtaacacagacttcaagacacaatatgtgtatgacagatatgaccatatactaatagtatagtaagcaaatattgtataaattgactattaaattggctatagatgaattaaagctagtaattgcctacactattaaacttgctcttaacccgacgaatctgccctactgccgtactagctaattgcaatcggatttacgttaatccaactttcggctaaacctaattaaaaccgcatgcgcggatagagttaggcgacgctgatgctgctaatctcagaactggaaaaaaggttaaagtggttatgtcttatgtgtgacgtcgctgtctggagttcttgtgaaccttttctttgtgaatccctgctgtccagatgtgagagaatcaaacgatcaccagcttatcgaatcgcccgtatagaatcggtatacatctctcctttttagcggtagctatgcgtgtaataaaaaaaaagatctcccagaaatggacctattgggaacgaaaacaaaatgttacagtagttcagtgtaattggctaaagtaatactccatctgtcccgggttataggacatacttgttatttaactagatagtttttaactaataataccttttaagactaatctatacatgtagtcaccatatttaaaagataaaaacttttaaaataattcataataaaaaattctaaagtttgacctcacccttatctaaaacgacaagtagtatcagctcgaagggagtagtacggtttagcgtttattgtggctaagttaatcgataggattaggggtggatagcgaaccggctcggctcggctcgatctagctcgttaggataacgagctggctcggcttgactcattatcctaatgagctagaaacccagctcggctcggctcgtttgaaagctcgagctagctcgttaggctcgcgagccaaaccaacaagatagcaagggtgacagtggtctcgagcctgtgacgccttcttgcagctggcgctggttggggaagtgcggcggcggccctagcggctggcggcaccgagccacggcacatcggggaagtgcggcggcagtgacggcaatggccctagcggctggcgacgccgagccactgcacgtggctggggaagtgcggcggcgacggcggcggccctagcgactggcggcggcgcactgcggatgcggaacaacggaagggcatggtgaaggggatcgaggattggacgattcgctagagacagagagaaatgcggtgcgcctagggttttgttgttcagctgttgttttgggctgggcccttgctgttgtctattgcagtcctgactcgttaagactcgctcgtgagtcatctcgagctggctcgttatctctaacgagataaaatgctagcttggctcgttaggaaatcaaacgagccgagccgagctcgtcacgaggcgagcgagctaatgagccacgagcttactgtccaccatccactcctagataggataaatatgtgacgcataaaaaggcaaagaaaaggaaaaaagagaagcagatcgggtggtatcacctgatcgcttggttgcttcctcttggtccggatgagtatataatcaccaccaactcaccaaggccgcccagcgggacacttaactacttgttatctctgtttctcaatgacgtatgggtccagatgataaattattactaattgttatattaactctgttttttaatagatgacaccgttaacattttgccacacgtttgaccatttgtcttattgaaaaaactacgtaattataatttattttgttgtgagttgttttatcactcaaattactttaagcatgatttactcaatcagtcccagaatataaggatttttaaggtttaactagggtattaagaaagtatataaaaataaatgggagaatgttgtgataggttgagaagaaaatgttggtgaataagttttatattttgggataaaccttatgagctagaagttgttatattttaggatggagggagtatattttatacatttacataaaatttttaaataagatgaataaccaaacatatgtttagaagggtacgacagtcatttattaaaaaaagacaagtaaagggataaatagttaaagagtgaagtgcatgggcggtcattaaatttatagggatgtgtcatctaaatccctaaactcttaaaatacatatacaaatcctagaacttgtcatagtgtgttatctaggtcccaaatcaccacagtcctttcagaatcctacgtggtgctgatgtggcatgccacacggacatttaaaaaatttccttttcttttttcccctccttttcttctccttcttctccaagcagaagaaaggaagaaaaaaaaaaggacacgccacgttcacgtggcatgccaca

SEQ ID NO: 66334 - DNA, 5703 bp, Oryza sativa
cccttttcgccggctggggagctttgcccctgcgcacacttgtcacgctcacgcactgaacaagcgaagcagccacacccacccacgcacgcacaaacagacgcagacagacacacacggtcatcacacacgcgcgcagctacaaaaacgcaccaaccgcaaccggcgagcgcgcgacgcgagtcgagagacgggagagcagtgcagtgcagtgcagtgccgcctcgtcttccttccctccctcctcatactctctctcctcccggtcttctcctcccccgcccaaagcggagcgcggcggttatatatatatatatatatacagcacttcctcctccttcctcgccgcacgtcgccctccgacttcgcctcgtcagccgtcgtcaccgcccccacccggtgagctccatcgccaatctcatcctctctctctctctctctgcttccagttccttcattctgtgtgcctaattgggtggccggatccatgcggaattccgagctcactcggtgtgctgctgttcttgcatgtatcggtgtttggggattgatctgggtgcgggagctgtaggggagtgaattgcgtttttcggcagtttcttttcttctttttgggggagtccttactggtaggattgattagctcgtgttatttcggtgaaaatgttttttttccctttttcaaggatattcagaattagtccgttcttgttcctgatgaacatacggccgttttagttacaatgctgttgatcccaattggaacggggagattagtcaaatctatctggcctcgcttggattagaggtgtagatttcataatcagttttggcctggtctcttttattgctctgaatttttttcaggttcagaccaacaaaaaaaaaaggcattgcattatggttgcagtgttgtgtactgcctctttgacttgttttggattgatgcatttctttatatcagatgcaaattaacggtcgagttagacaatttttttatagtaaggagttcttggagattcttctccttccagggccatgatactaatacagtagtagtatcttccatatgactgcaatttgtcagaccagattacccggagaaagaaaaaaaaacaaagatgtagttctgtctgagtagaacaacttgctcaacactctcttaaacttgatcacctgtctgaccatgaatgaggccatgcataatgatctatacttaggagtaccacatggataaattatttattgcttctagcaatcattttcttttttaaaaaaacgttgttctatggatctcaaattcaattgtagtcaaccatgatccatccatttttaggcatcttgaaatgaccttcttctttgtgttcttcctctagtcactgaaaggagtttttttttaatatatatatatatatatatatatatatatatatatataattttttcgttcttgttttgttcagtggattgcaccggagatcggaatgggcggcttcgcctaccccttcacgccgtcgccggcgtggtcgcgggacgccgtgttcgctggctcgccgtgggccgcaggcggcgtctcctccctcgccgacgctttggtgagctacggtgccgtcgacgacgaggaggccgcgttcctcggcaagaccgccgcgtcgtctcccagtacggcgaggctgcacgagcagcagcagctgctgctggaggctgagctgctgcgccacggcgacggcctcggcttcgccgcgatggacgacgacggcggcgccgcgatgctcggcgcgctggagccgtgcgccatgccgctcaccgacagcggcggccccccggtcatctgcagcagcagctccaacgacagcagcgggagcgagcactccgccgccatgcctgcaggaggcggcttcctcgtcggagagcagcagcagcacgtgccgccggcggcctacgccgcgggaggtgtactcccgtccatggccgcgggagaagaaacgccgcagagcttcggctttggcagcctcttcaatggcgatctcctgcaggaggcgaccgtgagcaagtatcatcatcatcagcagcagcagcagctgggcgttgtgccttcgtcgcagccgcatcatctgaatgtgagtaacaagaaccctgaattgaatctgacatttacatgtaaaagcatcattcatcgccagtggtaacattttagggcttgtttagttggcaaaaatttttgcccatgcatatcacatcggatatacggatacacatttgaagtattaaacgtagtctaataacgaaacaaattacaaattccgcgaggaaacttttcccgtaagacgaatttattaagcctaattaatccgtcattagcaaatgtttactgtagcaccacattgtcaaatcatggtgcaattaggcttaaaagattagtctagcaatttctgtaattggttttgtttttttagtctacatttaatacttcatgtatgtgtccaaacattcgatgtgacagcgtgaaaaattttgtttgagaactaaacatgcccttaatgtcttggaattgcaggatgacatcgatttcaacactggaaaattgatgtcttttgcttctggacagcagcacgttacccccagcattgacagcctgcagatcgaccagaaggtgaggatgagctcaataaaatgttttgtcttttttgttttatgcgacatgcttgacctcaattcttctaagtagatctgcatgttaagtcaatatatagtgccgatttatcgctatctaaataaagcagcacagcacggtacagtattagttagctaaaggctgagatagaatcggaccctgatacttcagtttacctaacaacctgagctgcaatttttttcaggaattcagcagtggcctgcaccacctcaatctctcctcgctgatttctggaccactcgcatcattcaatgcaacacagagccatagacaggttcttgtccttccttgtccatcttgatttgccaatcttttagtaaatcagtcgaattcctctgcaatatctgatgtcctgaaaacctgagcaagaactgttgtgcatacagcctgctgaagcttgcggtggcaaaaatggcggcgccgctccatttgtgaacctatctgaggtgctaccaaagggcaatgggagtggtagtgctgggaatggagcacccaagcctcgtgtcagggctcgccgaggccaggccaccgatccccacagcatcgcagagagggtgagtgggttcatgtgattcttgttctgcttgaattccagtggttagttcagctagaagaactgtagaacaacggattacagcagactgtttgactctgtggtgatctcctgtttgtagctccggagggagaagatctctgacaggatgaaggatttacaggagcttgtcccaaactcaaacaaggtagtctacttactgccatgcttctttattaccagataatgctagattagtagtacctcgttgagatgcttgtgatctgagatgacaatttgtttttctgttgtgcagactaacaaggcatccatgctcgatgagatcatcgactatgtgaaatttctccaattacaagtcaaggtttgcgtgccaccacaaccgctcgttttcacagctatgtttgtttcaattgacaagctattttctgcttctgtactaatgccattgctgtcctttgaaggtccttagcatgagcaggcttggagcggccgaagccgttgtccctcttctgacagaaacacaaaccgaggtaaaccaacaaaatcaattcacaataacattctaacttgtttaccactgctgatgcaatcaggtcaaagaacaggaagcggttaatcctgttaatcacaatgcactcactgaaactgttgatgcagagccccgggtttctcctgtccccaagatcatcatcaggagaaaggcaggcaggagcaggagcagtaacaggagggctccccggcgatcagccggagctcctggacggcggcgccatgttcgagcaggaggtggtgaagctgatggaggacaacatgacgacggcgatgcagtacctgcagagcaaggggctctgcctcatgccggtggcgctggcgtcggcgatatcggcacagaaggggacgtcctcggccgccgtccgaccggagaagaagaagaacggtgatggcgatggcggcggcgacgaggaggacgtgaagggagagtttgacgcaccgaggaggcctcctgtcggccggccgaaggagatgaggtccagagtctaagctagaacctctgctttgttcaggagagatggagcttaatttagatcctaacactttgctacttatatgtttattattatgaaattttaattgcaagttgcaactggtgatctcgaactacattttgccggtgattagaaaattgttatatggaggttagttattaaatcatatataattatattttgtattgttgcggtccttgcggacaatgccattcagtaccttgatatttgatctatatagttcacaaatttttgtaaattatgtctttactcatgctggttatgatttgttccgagtttggtgagacatattggatgaagtgccaaaattatatatatttatgaaatcttcgtgaccaaccatcatgattcttttgtgcagtactccatttgttcctattataagatgtttcggcctttccatcttttgtctaacattcatatgaatttgggtatgtatatatgaaacataaatacatggacggtcaaatgtttaacgctacgtttcacaattttcacgcagttgaactcaatttcaggaagacggcatggttgtagctagtaaactgaactcgaactcaatttcatatcaactttgaggcacaacacaaggcataatcgtatcaactatcaaaagaatagtgtgatccgtttcaaacgatgttcagatcgctcgaattttggcaggattggttccttcatggatcgagaaattactcgaattacgatcagagattggttgcctagttcttcctcgacagcagccgcgcccggagctcggcggcgtcgacgtcgccgaagcgattctcggggacccagcagccggtcttgggatccctcatccagaagatctccttcgacgccgccgccgccgccgcaccgccggcgccaccctccgccgccgagatcctcgccgccatcgaggagccgcgctgctgcaactctgccgccgccgccgccgcgtagccccggcggctgcaacacacaataacagatcacgtcatcagtgacctcgcagaatgccttccagaatccaagaaaccaagcaagaacgaacgatccaagaacccatccaagatcatatacccagttacccacccgagcgagagcagttgtccggcggcgacggcggaacgcggcattgcgctgctcctcttctgtgtcggagagagagcgagagagagacgcggcggcgagaggtgtcaggagaagagtggttgtctctgcctccggcgcggcgcggcgcgaggtgcaggtccaatatataggaggcggatgcggcgctagggtttcctcggcgccgccagtgcgcgccgcgcgcgatgagaggcgagccgagcgcgcgccgccgccgccgccgcgggggcgcgccacgcgcctcccaattttttcgcgttgccagcaacgaa

SEQ ID NO: 66335 - DNA, 34873 bp, Oryza sativa
aagtcggcgccggaggagcagtccttcttcgacgacgtcacccgcaagtgcgccctcaccaccacgcaggcaagctccatccccaccccacccacccagcccggatcgatccgggttcctcgctcagatctggtcgacgcgagtagtgattgttctagcaaatgcggttgactgatcgtgctgaaatcctggtgcttgttttttggaatctcggtgcagaggctgtacggcttcgcgatatgcttggctgccggattgacgtgcaccttcttggtaagtttcacagtttgatgctgtacatatctgtttgtttccacttcagggtgattttttttttggtacaaagtaatgtagggagcaatgagattccatgctttctgacgattgacgatacttcatccttgcagtatgttaatgcagccgtagtttgattcatgttgttcgaattgtcgtaatgccgcgtttttggtcttggactctcagttcaatatatctgattgccgtagacatgcttcacacagttagcagtaaccatcctttttcaatagtaggacagggtgcataattgttccccatgctttttttaacataaagttctcaaaccattttctatggtactgtttttgcctttgggagcgcaaataaatacctcaaatgttggaagctgtgtaatttccgtgcagcgtacaacagttagtagtactaatacttgtatcacatgatatttctgatgatctagctgtggcagaacaagaaaaacacacaataatatatttttagataatgggaaacacacaataatatatacatgattgtacttcacattttacttgggtttcatctctagtctagttcctgcagcctactctagcttgtttgggactaaagggtatccttttttttgggcaactttactaagggctgttcttattatattgttggttattcttcagattttctctgtctaccaatttttgttgtgtttgattttcatttccctccagccactgtgggttatttgatatttttgatctccattgcagtcaatgcttgttttcttcaatcctgtgaaattcggggtaacattcacccttggcaatttgatggcacttggaaggtctgtttcaaagttccatttaatataccatcttactctattttcaagttattttattacttgcctttggacaccagtaaaatcagaatgatgtaaacttcaagaaatatgggtgttgttcacattcgcatatcaatgcaaacatacaaactctattgctcttcatataatcatattctcatcttggatgctcttttttttcttttcttatagatggggtttcaacttgttgaattatgtctacataaatgttaacctgtactttaactttgccatggtatgatattttccgttacaaaaatactatgtgtacatgcttacaagactgtaatattctgccatttctccgctaggtatttatctttgaagccaccaagtctttttttactcatgtcaactaatgatgggatcatttgtttggcagtacagcgtttcttataggtcccaaaaggcaatttgacatgatgcttgattctgtgcggatatatgcaactgctgtatacattgcaagcatcataattgctctgttctgtgctctctttgtaagacaattttaaatttaacaggtgtaaattagttttgtatcatgcttcaatttaattgtataatatgctaaatggctctattttttatttacaggtgcacagcaagctgctgactctacttgccattatcttggaatttggtgctcttgtttggtaagttgaatagcttccactggatggtttttagtcatctgtttaactaggataatggcataacttttgactccagctagccagccgctcaaacatgtttcgtactgtatttctaattttctgtacatgaataggtgatgctgtaaatcgccaaagtaatattgcctcattctttaacatgggctgaaacactttacgggctataaatgggatagcagcatataaacccaatatagggttaattataagtgtcgcacgatcacagggatagaactattctcaagctataaatgttggtatttgcaggtacagtctaagctatataccctttgcacgctcggttgtttcgaaggtgatgacgtcttgcttcgacactgaattctagaatgaccatcctgatctacatgttgttgctggacgcatagatgatatatctgtaatatactgtgtattttgatggagaagtggagtgggggtcatcttctccgattagcctgtgtagtcattctgatgttgtgaagacacacggatttgtgcgtcttatgctcagagatcatgtcatcttttcctcacttcccccccttcttccccacatttgtacatggtaaccacttacactccgcattcgaacgtttactgtgcagtttgtttggattgtcctaggttgctcctggattttcctgcttctcaagttcttccagagtgcaactttggaatttatctcgtttggcttagctctaccaggcagaccttaagcgttggtgataactgataactcttcaatttcttgtgttacgatcttaatgataacttgttagctacggagtatatatgtatgaccatatgcgtcatattgtttagagcaggtacaatagcagactattagccagctataaacatattttaatgagataaaagatgagagagaagagcagcgaactacagatctgtagtcagctgcagcacggactccaagacgcagtgtgtatatggtaagtgggaccatgtattaattgtatagtaagcaaccattgtatgaattagctattaaattagctatagataaattggagctagtagtgagctgtactgttaaacttgctcatagactagtctgtctggatcgagaaattgcagtataaagaactcagtaacatggatcgagaaacatgcaaaatataaaagtcatttccacaagatttgtatttcagtcctgtaaaattccagattttcctctgcctttccaaaatgggctccactatcacgtaaacactgaacaacaccaacattttgacaacagcattattggcatttccttccccctttcaatgcgtttcattgtttctaagttttttttttacatccatcagcagtcatcacaattcttggacattacattttcatgacaaccagggttgtctgtacgacacccataaatatcccctgagctatatactctttccaaaccctgctgcaaattaagtaaagagcgtgggggtgctgaacattgcgctggagcctttttaactagcaatagacactacacacaatattcctttacaaggctaatacttacattattacatctgggattagattttacagggttatacaggagatgtgagaaccaataaatcacatccccatggctcttgaagaggaaagctcggcttctccatccgcttcgcttcccgctgcatcccctgctacctgcagtattttccccaaggaatattatagttgcagattatatgcatatgcatccatcagtttgtagaattaagaatccttacctttatctgggagagataacgttcaaaagcaccatcgccataaaggatcttagctccgcagccaggttggtccactgctccgactgcgtcttcatctacaaccaccgcatcgattcgcttctcaccagattttgcatctggaatctgcaaggcacagcaaaacataaaaagaacggtgtcagcctcattgagtttatgtctacactgtaaagtcaatataaaggaagaaaatttgtcacataacaaacctcgtacatagcatccatgagaatattctcaaggatagtccttaaaccacgtgcacccgtatttttggacattgccttcttggcaattattctaagtgcagcatctgtaaaatgaagcttgacctgaaagccacagttggggttgagatgagataccaaggggacattaatttgcatggttctattacagatatactcacattattcatgctgaataatttcttgaattgtttacccagagcattttttggctccatgagaacctaacagaacatgattgtatcagtgctccatggtaaaatctataaatatcttacagcattctataagctttatcatggtaagatatcataaataaatcacaagatgatgctaggtagaaaaacagtacatgattggattacctgaacaagctggtcctcgtttagagctgccaagctaacaaggataggaaaccgtccaataaattccggaataagtccatatgctattaggtcgccactctcaacctaagaaatgaacagtttaaacacctagatttaaggttttacacagtaatttcactgaattcacacatgcattctccttaaacaaaggagatttccaaaaaatgttaaactcggaattttggtgcttactgattccaacaaggatgatgtcacttgagcacttgagatgccacctgccctcatgttagcacggacaggtgccccaaagccaatagaagaatcttgccgcctgatttttaaaaattaaagcaggtgcaaatacattagatgacgatttgagaaaacattggagacaattgttccaataggtaagtctcaaagatcaatatgcaatacctctctgatatagttttctccaagtcaataaaagcaccaccacaaataaaaagaatgtcctttgtatctatctgtatggcatgaagaccattatacaattgaagttaatccatgtgtgcataccacaagcactgaacgagtagaaaaacaaactcaaggttttactgggcagttggtaatctgaaattgcactagtttagaccaggcatttatggtataaaggaacaatagtatgttcatataaagcagcatttgggatgagacctatccaggggatggatatttcagacaaaggaattgttctctattactattgtcagtcatggaacacccaaaactcttatcttgccgtatttttcttggggctatcattcagcagaagataaaaatgatatggtgtaattattccggcacaaaaaggctaaatattttatttttgaagattgtaatatataaactgtgacagtacctgtatattatcaccgcgaggatgcttccttgctcctttctcagggacattgacaatctaaatatatcaacatttcacaaaagtatcaaaagacgtccatgtaagttctgatttgcttagaagtaaaatatcccagaaagatcatatgatatatatttcagccaaataagcaaaatgatttccctttaaataggtcactagatggattaccataatttttttttaacttgatgacttgtaccatatgtgttcaatatcacaagaaaaagctcaaactgaaatatttccagcataaagcaaaggatcatgcatcagtactactgaacaggcgcgcacactactaatactatgttgtttcatttgccgggggatgctacctatgatgtactaatctgtatccaaagcacagagatcctagaggagtagagggtaagcaatatctgcttattaaggtttcactttatatattgtgattcagtatgccaaaagacacataagctaaccaggccataaggagatcaatgcaaatcacttactgtgccttccagcattttcaacaaagcctgctggacaccttcaccggagacatctctactaatgttaaggctctcagcctgcatgttgaacacgtcagctgattaatgtcaccaaggaagacatactgattcagctaacaaagacaaaccttctttgtgatcttatcaacttcatcgatgtacaccatcccttgttgtgctgcttgcacgttaaaatctgccacctgattgaaaatagagtatccaaaatcactttcaaaggcatggtgtaaagagaataagcaggtccaatttgtaagctaagaaccataccgccagtaacttgtatagtatagattctacatcttctcctacataccctgcctgcaggaaagcgcaggagttaagctttacttttggaactaagatgatattaaaaaaaggggaaaacaaactgatgaagattgcaaatgctagcaaatagaaatgaatgatcattcacaatatcactctgaacttaatccaaatgggctggtggctgtatatgatacttcttgttgctgtttaatgtaagggaaattccattagttttcactgaataactgaatttaatgaactgccattgaataattgtgtgttccttccatggcatcaggattcaatttcttccttctatgaaatctctgtcctctcagtctgattgctctctgttaaggttgcaaggccatttagcacctatgagcatgagactaacagacatgccctgcatgctgttctctcattttctctattgctgccaagccagacctacattagtctggtccaactcccatcatcatgtttcaaagcggcagctcatacttataaaagtgatgtacccaatgcaaaggtaatggaggtggttttattgcagctgtatgcaactaaatgaagtttgggtataaactttgagccaatagttggtcggctgtggaatttgttcactcatgttcttcaccccagtcaagaggtgttcatggaaggaatatgcagtcatccagtgggcaaatgttgaactcacagttacgtggtggcatataatggatctttccatagtttaatggcttcaccattttaacttttgcaagtaatgagctcaaatcataaagatgtgtgcttggacattatgcatttaaaagttagtaaagacttgcctgtgtcaatgttgttgcatcagcaattacaaatggcacattcacaaagcgagctaatgtcttagcaagtagagttttacctgtgaaacaaacaaagtatccaaaaaaacagtgctgagtgccctctctgttatagttgatctagtgttgtagaagaaataattgacagttcccattacatcaacattcaactttgaatttgggggcaaatgcttacctgagccagtaggccccattaatagaacattgcttttctctagttcaacaccatcgtcatcatcagcttctccatcaaaaccacccaaatctgctccagacctaattgttttagcttatataccacataattagtcactgaaagatattcatcgatcctaattgttcttgtgcaagaatagacgagcttcatcattccaagaacaagaagaacaactaaggtggtagaaagaaactgaccctttttgtaatgatttatggtatattcgtttataatgattgtacactgcaacagatagcacctgtagatttaacaggctgtgagagatcagcatatcaaaagtatagaggcgttactgttgattaatgcaacactaagcaaaagacttgaagttgacttatcatctgagtttgatgaacaagaacatatatcgaggtgaagcttttcgcaactcatgacaaatatatattaaattgagaaagaaagtgatatttagaaaataccaacacttgatttatcactctcattaacactatatgtactaaaattatgtacggaatctgaagtgtattaggttggacaatgaagaccaaggataagtgtgtggaaataagggtttatttgaatgcgaacaccatcagcagtccaaatcaatgttctatatacattttgtacaaaactacgtgtttgttatcagctatcaagtagacatgtagaagtgattcatccattgcaaattagaacaaatttgactaaagaaataaatcaagttctgaatcattccttgatagtgtcaaaacagtagaagctcacttgagcccctgatttaaaaaccagtttgcaaagatatcaattttatgagatagcttaacaggccaataagtaaatattgttccttactgaaagcaaagccccaaagcatcatcacaatcaacacagctagctcaataactttgttgctaaatctcgccgccatcgcgactcgtaaacaaccaaatgcggcgtaggagtgtctcaagcgaagaactagatacgatgtaattcaacaaagacctcacgtttttaattacacgaactaaccgattttaatcaggatgtgtaataataaccgagataagtgcactggaacaaattcaacaaaattggaagaaaatttcctcaccttcttggctctgtcctgcccaatcacatacttatcgagcccctgacatatatacttgggcgtaggcaaatccttcccgaggttcgacccgccccacccgtccttccccgcaccctcctcaccaccaccgccaccacctgctcctcctcctcctccgccgccgccaccgccaccgcctccggcgacgcggacgacgttgaggttggggtggaacggcgggccgggcggcacgtgcacggccacgccgccgccgtccccgtcgtcccgcgacgacgagctcccacggatggcctcccagaaggaagcgcccctggccctgacggcgtcgtgggggagcaggtcggcgcggacgcggccgatctcgacgaaggtgccctggagcggcgcgaggaggtgggggcggaagaagtaggcgctgcggcagttggggcagaggttgagcgcctggtacccaccgccgcccgcgcccgcgcccgcggcggcggaggaggacggcggcgcgcggtgggagaagaggatgtccatgtgcttggagcagcgcgggcagtgcgcctccgcgcggatgcgccgcggctcgtgctcgtcggacgacgacgacgaggaggaggtggggccctcccacttgcgccgttcctgcacgcgccggtgcggcggcgccaccaccgccggggagcagcactccggcgcggtcagggtggacgccgcccgcgtggccacggcggcgaggcgcctccaccggaggaggccggacatggcggaggaggaggttgagctcgcgcggattgggggaagtggagtctagagagagagagagagaggagagagagagtgtgtgtgtgagagagtttttcgtggggatctttgtggggtgtggatagtgattttttcgagctgattttttctttttctttttatttttttgctctgtttggttggtttttttgggtgggattttttttttccgtggtgggaagggatacgtgggattccaggacggcgggggcagaggaatctcgggatcagataaggaggggttccgcgcggttggatcatggctccgtgctgcatcgggattcgtgaccttgtcttctcccacaggatttttcgttttcagaatcttgtaaattccatccggattccacaaggtattcagaaatgaagatctcagcatcacctcacaactattcgtcgtctgactaataatcatgtctgattaaacattttttaatactatgattatctctgattaaccaatgcttgaccagcaattccgccaacgtttcagcacttaatagaaaactgactcaaacatgcagaattgcagattaaccagagtatgtactgacaacaactccaacagacataataagacaactaggcactaggcactagaaataattgacataatagacataattgacttaatagagtaggcactaggcagcgacaactgacatagtaagactgtaatctgcacatggagactgtaaatcatgcaagcaatattccattcacaacagcaaaacataattcaggagttcacagaatgcgtcctgttagaagaagagccactcaactcaagacgtcaagaaactcagattctttctggtatttcagaaaagtgagagcttgagaatacagtttcgacttctgtgattgtaccctcaggcccgttctttctccaacaaaagttagatgaaaatttggatatttatgtcacatttttcaaactgctaaacaatatgcttcatgcaaaaaatttctttataaaagcagttgaatatcataaatatatttttcaagtttataataattacaacttaattaatcatacgttaatatcatctcgttttgcgtaaaacacttaacttaatcttcatcttcatctacggcataaaagaaagcctctccaatctcggcatcatgttcatttgactcgtccaattcaacctgcaaacggagaagaaaatggttgcaaatttcgaatttcactagtagcagcttgtatttcacattcactagtaccagagttgctttcagatctgaaagtggagttccaagtcgattatatggcagtccgggatcatcatccttgactctgctaaaaaacattctcctgcagatgcaaaaccgcgttaagagacagttctgtgattacctatggttatgtttagttcagcgtaaagtttagattttggttgaaattaaagatgatgtgactgaaaagttatgtgtgtatgacaggttgatgtgatgaaaaaagaccaaagtttagatccaaaatccaaactttggatctaaacatagccatagtaaaactagtatctatgaagaattcaaactccaaattcctattctgtctgtgattctgcatataactatgtccattgagatgctttattgcctagattacataagctatacatacgagaaatgcaaaattgtttccaaaggggaaattttttctgggtgagtagaaatagcttgtgtcacattaaggctgtgtttgatacttggggttgggaacccaactccaccgcacggaaaacggagcggtccattagcgtgtgattaattaagtattagttaattttttttgtcaaaaatggattaatttgtttttttaaagcaactttcgtatagaaactttttacaaaaaaacataccatttagcagtttgaaaagcgtgcacgtgaaaaacgagggaaaggggttgggaaacttgtggaaagaacagaggcctaagtcactcacattgatagaactaaaagatgggtactacagccaaccaccaccgcaccgcgttcagcgagtcatgatagatgctggaaactctgaagccaatccttcagagttcagaataggctgggtttagatcctaagtttggatccaaacttcattccttttccatcacatcaacatatcatacacacacaacttttcagtcacatcatctccaatttcaaccaaaatctaaattttacgctgaactaaacacagccataattatcagaatttggatggaacaccagcagagcctaacctggcttcaaactgtaaacaaccatacagtttggtggcatataatgattccaacagtaaacaaatgcacagatttatcacaccccagttgtggatcacgtatgcaatacgaacaaacgccaaaaacattactggcactactcaagccaactaacctgcagctaatcatcacagcttcaaaatgattaggttaacttgtactatgctttactcattccaatggtacactcgtacactatcataactaaacataaataggcaattctacaagcaaccattcttgaggagagaaacaaacaagcaccctaattttacaaaatttaagatatgccacccgtatcttaatgacatgtagcactcacatgagtcaatgacatatgggtcagggtggcatatcataaattttgcaaaatttgtatggcatggttcaaattttcccaacaaagacaaagccgaggtccacaagtatcgaattatacagatacgatccattaccaccaaagttctgcacttgctatcacgagagtactaggcagccaagatcaaccatgacggcccgtttagttcgcgaaaagaaaatttttggacatcggacgtttgaccggatgtcggaaggagttttcggacacaaatgaaaaaattaattttataactcgcatggaaaccgcgagacgaatcttttgagcctaattaatccgtcattagcaaatgtgggttactgtagcacttatggctaattatggactaattagactcgaaagattcgtctcgcgatttcccctctaattgtgcaattagttttttaatttatctatatttaatactctatgcatacgttcaaagattcaatgtgatgtttttgggaaaacgttcaaagattcaatgtgatgtttttgggaaaaagtttttggaaactaaacagggcaaaaaaaaaatggaggggaaaagaggctggtttttttttttttggtgagcggaaggctttcacctgctgcttgaggtcgtgacgcgcgcgcgtcagatagcaagcaaaaaaaaaataaaaaaaaatcctcccatttctctccctcctcctcagcctcaggtggtcgagaggactccacctctccgctgccgctatccccgcctcgcgccgcgccaccatgccgctcctcgccgccgccgcggcggtggcgccgccgttgtcttccttccactcgctctccctctcctcacgcggactccgggtcccctccccctgcgaggcccgcccgcgcgcgccgctccggcgcggggacctcgccatccgcatgggcggcggcccgcgcacgttccccggcggcgtctccaagtggcagtggaagcggatgcaggcgaggaaggccaagcagctgctcaaggcgcgcctcgcccgggagcgccagctctacgagatgcgcaagcgcgccgagctccgcgacgccgccgcgcacctcgagcgcccctgggaccccgacgcctccgactccgccgccgccgcggcggcggcgcccaacctgctctccgtcgcggcggacgaccagatgaaggcgctcgccgaccgcttccaccgccccggcggcgtcgacctctggaacgaccgcgacgggccgcgggtcttcgcggccccggacaccggcagggcctccgcgcgcttcttccccaagggatccgtccatagcgttcagccctacggtcttgtcaatggtggccttgagagcacactggctgctcgcggtaacccttccgatgcgacggaccggagtcaccgccaccgcctgcaaggtgttcgtgagaatgcggccaagaaggaaatgcgtggtgttggtggtgatcgtgagcctgcggttgagtacatcgaaaggggtggagtgtgggagccagtgagtaacttggatggtggcgacgacgacgattctagcgacggtggatggaacgatgacattgttacctcggacttggaggacatgggggatgtcgatttgcgacccgagcaaagagcaatggttgggagagatagaaggaaagataatgtggcaaggtgggaagctacaacatctgtagccatcggtagcgatggtgttagggatcagcgtggcaatggcttctctttggaaccagaaggcacaagtgaatatcatcttggtcaaagctggcaagagagaaatagtgggagtagagggaaacgtcccgcagggagaaggaaggccttgaacaccgatggcggtagcgccattgggaaggatcgagtggtgggtggcagttcattctccgactctgaggtaacacgcaatggttttgaaccaaaatggagatccacgactagagggcgcacaacgaatgatgttaggaggtggaatccccccaacgaaggcggtaggaatgttcctagaaagggttggacggatgatgagtttggttcaaattcagacagtggaatggatcacaagttgatgccaaaatggaaaactcagaacaggttgaaccgaagcgaaaatggcagagatagaccggagctgaaatatatggctaataccaacaatggggagaggactaggaggtacatgaggggcagcgatggtgagggaagaagagatcggtttgttaatcgcttcgcctcagatttggaggagccagaatggaagccaagaagaaagagtggagcaggcaacgatggtgatggaagaagagatcggtttgttaatcgcttcgcctcagacttggaggagccaaaatggaagccaggaagaaagagtggagctaggatgaacattggcaacagagagtacatcgatgacatgaatgggagattcaggaggggtagcgatggagatggcatgaatgggagattcaggaggggtagcaatggagccgcgagattgttggatgctatggacagcaacagagaaatcggcagtgaggatgatagctacaggatgagcagaaatggaggacagcgcaggggagacgggtactcgctacgcccaacgtcagaattgcacaactctcggaggctgagggaatcaaatgaaatgtagttctttttttcttcttctgatagaaagatgaaatgtagtactagtattttacaatgatgataaacaaataacacacgccctgtgcagactaacttctaggagtacaacccattcatctgttcaatagcagtgtacagcacacgccacttgcttttgttcagattatgcgacgcaacgcagaaatcatcgccttgctgacttccatataaaaaaggccaaaccaacaaggctgatcaatcaagcgcatcgcggatttggtagtttttatctgaaagttatcttggttgcactgatcaggtagtgcaggtcataattcaaacaagggcatggaagaattcacataacttcagaattataagtgtcacttccaatttccaaatgctggattataagcacagaacattgatataaaagtacatgattcatgtctccctggttgcaaattacatgatggtcatgggcctcatggcagaccttatgaactcaaactggaaaagatcaacaacattggtgcttggtaaagattgctccaaccacttcacctgcagcacataatacacctgttaggcaattaatcacggaaataccagggagtgcaatagacataggacaacaaacagcgcagaactttgctttagctcctccgccgatgtgcttgagcaatgttggagggaactaatcatgcatgcaaaacatataaaaaaaaatacataaaaagcttaatcacaaaagaatacatcttcagaaaaccagattttgaagtgacttccttaattgatataaactatagattccacgatttccattaaggagaggtataaaaaactgctctaaacaaacccaaaacccaactctttgtgaaaaacgggtatagagagactgaatcatatttctatctttcgatcccgttgcaacatgggcatctaactacttatcataaaatgtaactatgcctttgttagaagttgcccctttcaaattaaaacactaatccgtatgaaatgatcaaatgaatctgccagaggataatcgacttatggaagtctgggaagacagtggcgtgtgacagcaaacaatgctaaagttagagtaacttcggcaaggatgttggctctcatttcaccacaatgcacagaaaaaggacacctcctaactatgtaactcaagtatctaacacaatgcaacaaaaatagtggtgcactgacaagttcttaagttcacattagaaggtgaaaaacataagattctgacaatgatcatgcagaaaagggaagaaaaaaaaggtgatactaaattatgtgaaacaagcttatttgcatcttaaagtgaattcaaccaggactgagaaaagaataatgtttgctccaacatagatggcaacatgtcatatagtacagaaacatgcttcacatgatagtctagttagggttatagtaaaacatatctacctagattaaagatgcaattttcaagtatcacagcttaagatgcagctaaaggggaaaggcatccagccatccagtcagttatcttaccaagtgctatccacatgtgttgacttgatgaccaaatcaatatacatttcgttggcacaacatgcctcttcttagggcaggtatatacttatacggcagaacgaatgctaagactagaaccaatgatgttcagacttcattggcacctagtatatacatttctcaagaattttgttctccaccgatcgtacgtgctaaatacattcttagtattcctatggatgaaatatttcaccatgtaattagacacctaatcttttgaaaaaaaaaaaagcaaacatgaattgtcatgggaagcaaacgaacaactagccagtccaaccccgcgccacagtttcaatatgcaaattactaatctgtttcacatgaaaaagctctacataatctccaatagatagatcaaggtgagcacttccgaacaaccctaacgcctccaaatcgatcccaaatctaacgaaacgaacccatttcagccggaggaagagaacaaggggagcttttacaccgggggggcgctcacctcggggaggcggcgcgggtctccgcgcgtggccgccgacgcgatctagtggtggtggtggtcgccggaggggcggtagaggcggttgtaggcggcctcgccgacgaggtagatcccgaaggcgacgatggcgatgccgagccccggcgtggcgtggcgcagctggttccccaccatcgggtgcctcctccagtcgtcccgccgccggaagaactcccccgtcgcgttcaaccccttccccgccatcgccgccgccgctctcctcctcctcctcctctctctctctctctcctcgacgcgcacagccacacacacacaccaacacgaaagcccaagtggtagtagtatgcgatgcgtggttccagcccgttttgaatcgggccttacaaagcccaaggaaataacacacgcagagtcagagaggaacagagagggggaatttttagtattttttgaacctttttttatttttaaattttacaaacataaatattttcaaaacttattttcaaaatatgaatcttttggccacacgtgacaaaataaaattgtcatgccacccacagcgggtgcgatagttttgtcgtcacgtcattcagatgagtgtgactattgttttaccacagttcggctggtgtgatcaacaggttcaattttctaaaaagaatagggttgaaaatgtttgttttaaaaattagaaatataaaagttcataaaataaaaaaaatcaagagatagatagagagagagagctcaagccgcaatggagccaattacatcgcatgtatcgatcaaaacaccgtgccaattacaccctagtatgcaggatcaaatgcatgaatggtatagaatttcaattccttcaattcaaagggggcctaaagcactgatagaaagtaatggtttgtattgtatagtgtatttctttgttgttctgctcacacatataatctatctacaaatatacaatgtttctgcctctctgttttttcttttcctttcgaacctgcttgaagaaagacatgcacttgacgatgggttcctgaacttgtccaagaagctggtgttgtcaagtcttgaactgtcgaacatcagcaaccaaaagtcccacaaaaaaaaaaaacaaataaaggagccaagacagggtagaaacctcatgaaaggggaggcagttatcatagaatcatacacactaacccataacttaatcactactgaacaccgagagtatccaactctctcatagaggttcacatcacactacgaccacagcagttagcctgcctgcctgctaaatacaatagctacttaccatgtcgggtacaacacaatgactgaaactaatacaacaaccggcctgcacgccgggtctgctgctgcacggcagcaggttgcgggtgaagcggttctccgcctcttcaccaattcctaacgattctaaaacatgtcaaccgggagcctcccgtggtcattctcggctcctcttgctgctgcagccagggcacttgtactgcttgatgtgctctgccttcgcaggggtgatccgaacgcacttgccatggaaccacttctcgcagacgtcgcagcagatccagaactcaccgttcgcgtaagtctctccgcaagcgccacacatgtaagcctggtcctcatcctctgtgccttccgggccgctgtcttcctcatcttttggctgaggtggctttgcaggcttgctgttagaattggattgcttcgatggctggaaaagaagggaaacgaaaaggttaaacgttgtgttgatatgggcgctagataatgcatgttagacatgcatatgatcacatgtacatactttagggttggacttgttgcttttgctgctgccgttggagacttttgtttgcttcttggcaattcccgtcacaacttcatatacagtgggaagaccattaatcatggtgaagagccgtctcctgaaattcaaatgccagttatggactattgtcattttctaccaaacaatataatgttgattgttgagtgacaatgcactggataatattactcagataattacacaaaagatgaaaaatcctcttgtaaactttgacaaatggaatcagaatgcctcatcacagttgatttctgtaaataagaaatgcatcgacagctgcaacgaaaactatgcaaacctggcttccttatcaaatccaaagcgagccccaaagtaaaatgctacagacagtagccatgcatcgctatgaactgcaaccagcgacaaccaatctttttcgatcattccatcacgagcaaagtttatgcccagtgctggttctggaagttcaggaggtacttcctcagctggaagggtcacgtcccaggtctcattgggcaatccataaaggcacaggttctctttctctgaaaaaataggagatcactatgtcattactatgacataaacaagggaagataacttcattcaacagactacttgtgatgtaatgtaccattcatcattatttcaatggacagtacagcacaaaatggctacatacagttgaagattaacccacacacgcttgaagcacatactggggctatgcctagggagtcgacaaaccaatttactcaaaacaaattattctcacgtaacccctaaaacattaaacccgtcttcaaacatcaacaggacagtaagttttggagctactgttgtttttcacctttaattgtagtaatgatgcaattacagtatactagcatattgacttacattttgggaataattaattaccacatcttaaaagtggccaaaagttaaatgtcccaggatcatatgattacagtatacaattacaattaacttatattttggatcatgctagcagaagctgcttcaatggttccctagcaatgtaagtatgctgttgggcctgtagaatagggtgctttagtgttttaatgggccttgaaaattgtaatgattaatcagtcctgtatgatgtgggccaagcccatgaatacatgcctctacatgctaacataagttacagataggaccaggcgaccagcagtaactgaatttggatatacctttttgtccacttctgtcttcaattcatgaaatttctttactaaaaatatttacttcgaggaaatttcagaaaaccctgagttttgggtcatgggtctcacaaaacacagtttttaccatggaaaacaacttttgtttgctaataaaatgcagtgaggattacacaaggctggagaaagagtatggccaactagaataactcccatgaagccttttcctaaaaatgtgttaaaatttttcaaccagattcccaatcctacggtccaataaccagatcatagatttacatgatgatcgatctggaaaagagaatagttattagcacgatgtgatcaggatttgatttgcagcctctacactgagctgatacactagcttcaatcaaatgaaaatttaattatttaaagaccacatctgattgattgtggttcatatagagtattttgaatgcaatcatcatttaagcatgctctctgaggtcccagatgctgatagtgcaaaccgcaacaacaattgtactttaatttgctgaaacctgaaactaccccctaacaaactgacttaaatggacccaattacaccggcaagcgactgcaagataccagctaagaagaaaaagctttcaccgataaacactaaaaccgccataactaagacagattagttagggctacaactaaccaattattcgagcttttattcttttccccgaggaatcaattattccagctttaaggaactttaagaaacactggagcaaaccctaaaatcgcaaccatactaagctccgtccatccagaaaaagcaaaagcgactccagagcagccgcaaaaaagaccaaagcctcacatccccaaacacaaaaaatttagctcaaacacatgaacatcggggagctagcctcaccggggtcgcactgccggtagaacttctccacatctgcacaaccacacaaaaaaaagaacagcaaatccatcaaatcaatcaatcaatcaatcagcaaagagcatcccaaacaacaccgaagagagctacccaccggtggtgagcgccttgacgatgcccgcgcggcgcgcgcggaagtcgcggaagacgtcctccgcggaccgcgcgttgtggtgcaccgccgcccccgccgcgttcccggcggcggcagccgcagcaccagcgccgcctccctcgtccatccgccgggagctccttgctagggtttcaggcgagtgggagtggggggagcgagcgagagtggtggtggtggtggcctcgtagtggagagcgagagaggattagagaggaggggcaaaatcgcagccaggtccagacgaggacctaaacgcaaataaacaaaattacagggggctagcacgaaaacgaaatcccagtttccaccctgggtggggtggggcccacctgtcggggcggttgatgggctcttctagagttttgtctcgtggcccacggagaagagtcagagaccactcgtcttcttccttccgctcgctcgctcgctcgctgacgtgtacgcttcgcggcggaggcggcggcggcggcttccgatggcggaggcggcgggggcggcggtggcgccggcgaagctgggtctgtactcgtactggcggagctcgtgctcgcaccgcgtccgcatcgccctcaacctcaaaggtacgttgtgcccgcgccgcgcgattgccttcctctcgtcgtcatcttctatgcgtggttggctcatggccgggcagagtgagtgaacctggtgcgtgcgtgcgtgcgggtgattttgatgtctgtctcctgcaggattggagtacgagtacaaggcggtgaacctgctcaagggggagcactctgatccaggttaggtgctacgccacctgtctgtcaaactgctttcctccccctatctatacttgtgtacggttttgtgctgcgtctagagactgttcgtgcaattaccgccgcaaatttgtgcttggatgttgagaggtaagattctagcaggcgatcggcccgaaatccacaaggctaggctctgtgggggaagatgaataggaaggtgttcgatgaaatgcacaactgagaaaattgagatgaacatgagaggtttcggtgcagcatgtggaagcgcctcttttcgggattttcttgatgcaatataaagcaaagtgatatatgcagatcatggccttagtacccttgtaactggacgcatgatacgcacacgatgcgccatgatgtccacccattcgtggcacgcacccatgcacaactagctcagaatcgtaggggaggaaccaaaaaacaggaaactcaaaccgaaagatagaacacatgtgtggtagcctcaactattttcttttttgtttgtgggtggaagaattcatgaaggttaatcctatgaagttcgtcccggcattggtcgatggagatgctgtaattggtgattcttacgcgatagcattagtaagcattcagaattttgagatgcagtagtttatagcatcaaaattggccgcttcttgacttgtttctatgtgattgcagtatttggaggacaagtaccctgagcaccctcttttacctcaagaccttaaaatgaaggccttgaatctccaggtaatgatagattctgcactgctatgcgcaggatgatgacctcaattaaacattccatttgatatacaagtgctatttgtaatttgttgaggttgagcagcgttgatgttcagttagtgcctatttgagaaggtaagatcacatcagaacaataacaaaaagaggaaaggatcagcccacacatgtttcaggataataggaatactgagcacaaggatataagataggcttaggcataatccagaaaatatagcttactgtatgcactagattttttttcctcttaccgattgatcatgcctagtgtgacctttcatgacataatctaattttatggcagatagcaagcattgtatgctctggaattcaacctcttcacaatcttaccgtactggtaagaactgatttgcattcaatttcttactgccatgtaaggttctctgcctggtatttgattactcagtgcacctgtgttccatgtctatctggctgcattgtgcaaagatgcatttttgtgcctcagattaactctatattaaacagtttgtgcttctgtagtaaaattaatatagtacagctcaattagggaaaaaaatattgtataacagaataatttgcgggccacttgtttctttgcagaggttcattgagaagaaggttggtacaggggagagcatcccatggactcaacaacagatcgacagaggtttcgcaggttctcctcactgacgtatcctttattttattaatcaaatgactatattttgcagctttacttccaccatcaaatctgcttcaaaaaaaatgtgttatgcataactcagttgttttgcatgttgtgagaagctcactcatattcctccccttttcacattcctgcctatttagatttgcttttatgtcacaccatgctcacttcgttccccaatggtgtagctgctgagaacctagtaaaaggctgtgctgggaagtatgcaacaggagatgaagtccgattggtgtgtatgctgccctaacaattttatcctttcttgtatggagatcttctctaaggtttttttttttttcgtgtatcttgcttgcaaattgtgtcactttttccctaaaacagagtgaagttctcccatgtgaaaaaagaaaaaactgaagtgataaaataaaaatgcatcctcatattcactgtactcctcatgagaaccatagattgccatttactaactttccctttgtttatgtaatcatgtttgtgaacactccaaatattaacaagcactgttttggcttcagtaactgttgcatttccgttacacatgcaggcagacgtattcctcgcacctcagatttatgcagcagtgactcgttttcaaattaacatggtactgttcttgtgcttcttactctatccatgcatatgcctttatctattttgttaaatctaatgaaatatgttttcttggcagttaaattatcccactctcgcgaggctccatgaggagtatatgaaacatccagcatttcaagcagcactcccagacagacaaccagatgccccttcctctacctagaaaatacagtgtatgttcatctgaaaaatagattaaaagttgtacccaacttatcattggaagctgtaacaataagcacagaacttgttgcgaaaattgaaaataggtgtatatgtttttcaaagcttctgtccaaataaatgacccttaaaattgctagcctatggacaacttcatgttggcatcaatggtgccaacaacatgatacaacttgagagtgggaatacaagatgcacttgaaacgcattggtttgataatcttacagattatgtgtgatgcagcacgaagagaaagaatctcaataagggctcaacctgatgattatccttaaaaacaagtgtatttgattttttgcatacctgagttaaattatcacaagacactgcccattttagtttctgttgtacaagttaaaattttgaatagttttattgtgatcatagccttttctgacttttgcaacaaatttgagcaatgtccgatgggcaaatggcataaacaacaatgtccaaggtttgagaactaagaaccaattaggaaagacaggagggcttcctctcatgaaaccgccaaacttaatagagctacccaacgataaatagaaaaacaagagtcatcaagaatgttacttttcgagcaattgatagcttgaccacctatttatctttttgagcaccccatcctcgatgacatccaaacaagatgcctaacatatctaaaacctaaaccttttatatctcggctcgaaacataatcgagccaaaataaatatgaaactattgagttaagattgatagatggagtctcgaggtgtgtatttggctatgcttcatggattttcgggcaatgtgtgacgacattcaagaacttaaggctggtattagcaattgatgaaactttcttagtagagcaaggatgctcacttcctactattagccaatcttaatagagcaaagataataatagagctcacttcctactattagcccatcttaaagctaacacatataatagattagctacaaggttggctacaattttcttctcctctctctatctctcacttatacattaattgtatttgtattggagcttgtgttaagctagctcttgcatgagagccaacacccttaactttttattacatctctcctccatataagcttatagtaggcttatagcactattatacttgctcataggcaaattcaaagggtaccttgctcacaacaatagggaatagggattgatgccggattacaacttactcccttggcatttgttctggtagagaaggacaatacatccaagtaggagtagttcatcaatatgattacgttatgtttgattggccctaatagagaaatatgcataatatctgtttacacccaaatttggcacctaggaataaaataggaaaattgccaaagtttggaaatctgccgattttccgctgagaaggctggtctgaccgtcgtatgttggccggtcagaccgccgacagtgggccggtcaaaccggcggtgtgtggccggtctgaccgccaaagtctgaagccgagtctgtttcgtcgggtctcgaggtttccttgctcgggaaggcatgtttcgggtttcctttggattctatcccgagtcgaacgtggaggagggcctgtagagggcaagaccaacccctatataagggacaaggccggtttaattgtaatctatcaatcaactatcaatcaatcgaatcgttcttttacttttgcttctagttttagtttagtttgtccatctttgtcgatttgcgttgtaaatcgtccgccgccgttgcgagaatgcgacacctctttgtaggtttgttctgaaaaccttccgttttgcccacaagacgggtagttatctatcgttctatctatatctgctccgctagccggtttagtttattaaaacccatcttggtttagcttttgcttgattgaggtggttggcgactctagaatcaccgcaaagctttaggtgctgcgatcgtgcttgtcaacttgtcacaaaaagttgccaacacgatttttggcggctccgctggggaaatcagctcaacgtcgtctcaacttcgacgccgccatgacgaaaatgaccaagccagaggtggaaccatccaatatcatgccaatctcattggaggatcttgatggggaagcacacaagatcatggaggagcacatcaaggcggtcacgcaggagatgctgatgagatcgtgcaccaagacctgtggttctcaagcctagaccgttgcctaaatctacttttgattcggtaggtgctgaagaggtaccaattcctatccaaaatctcgtggcaatacaatagattcatccattgttgcttcaaataataaattagatgcatcttttgaatctcgttttgatgcgcgaattgaagattttatgaggaataaattcggttcttttttagccgattttcagactaaagcctctaccagtactagcaaagcccttgttgatcaaatatacaacaaaaccgatgggggcgaatatgcaaacaaccggtgagggataagctgtgcattcagccggtccgaccgggccagatggccggtccgaccgcgcgtttaccgccggtcagaccggccagatggccggttagaccgggttctttcccggtctgaccgcgcctctggatgctggtcagaccgggccttggaccggtcagaccggcgcaattatcccgatacaggggattgatccaatgacaaataatgggcttttataccatattccagcacatgattcccctatatctactgttagtcctcaagttcccccacatatccctaatatttataatgatcttactagaagatatcctcccaatactaggtatggccaatataattatattgtgccgcaaccacaacctcttatgccaccaaacccaccaccaaatcagcataggcctgagaatatagaggaattgattagtggtattattagggataaattcgggattgaagctaggaatcatgctaaggtttaccaaaagccgtaacctgattactatgataacatcccatatcctcatggctatagagttcccgaatttaccaaatttagtggtgatgatagtaggaccacataagagcatgtaggtcaattcttagcgcaatgggatgaggctagtgattctaatgataatggtaatcatgatatgtatgttgctgagtggttatggactaacaaaaataagccttttgtttgttctaatttaatgccgactcctcgtaaagatcggcaaggtgaggttaagtatagttttaatgtagccaaatgtgataagatttttgattatcttttgcaagaaaagcaaataaggttacctaaaggccatgtcatacaatctcaataggaattaaaacgttgagcttattgtaaatgtcatgattctcattctcattctactaatgattgcaatgtgtttcgacgacaagtttaatcggccatagatgaaggacgattgaaatttacgatggttttaagatgaagcttgatcatgatccttttccggtgaatacaattaattttaatgataagaatgtgttgattcggctggagcaagctgaatctactaaggggaaagaagtggtcattggagagcctaggccaaagatgatggtgccaaagaatccggaggttggtgtttggaaggagaataggagtgaagtttcaagttctaaagctccaaagaagactaaggtgaccttcgatatgcttttgaataagtatgagaagcaaggaggtgaggaagttcacaatgaagggaaaagaccaaaatcacctcctagggagcgatttggtcattcaccaagagacggtcagaatcacctacatatcatcgttcacaaatcatgtcatgggggccttatattatgggacagaaggagtaataagtagtcagggcgttaacaattgtccttctgattagaggagtcctataatgccacataggctaaattaagtgactctagcgccgtgtttagttccaaaatttttcttcaaacttctaactttttcatcacatcaaaactttcctacatacacaaactttcaactttttcgtcacattattccaatttcaactaaacttccaattttggtgtgaactaaacacaaccctagggaggtgactacggatcggacgtccgatgttttagctaaaaatcggacgctcacctccacctccgccaacacatgcagacacaccagcaccaggtgcagcccactgcaagcgtaggaagccatgcatctatactagaaaacaaaagttaggttggtttaagttttttttagcaaactttaaactattttttctcttaaattacttctccaattcatgattcgattgcaccactaaattcgttgcaattaaatctttaaaataagaccaaacatgactataatccgatgaaaaaaatatttagctttattcatgaatttttcaaatgttgcacctattatatttaaatgtttcagtcagtattcatatggtgtttcactatttaatttgcaaatgttgcacgtggtgttcctagaatgttttagcaagtattttataatgtttcaataattatagtttagtgttcatatgtgatataaaaatatttcaacaatatcgggtttttacaaatatattgtatctgtgatatgttttatttgtttcactcattaggactcagtgtttcatataagtggttgctagtgttgcagcctgtatttttaaatgttgcatttctctaaaacattttatagagtgaactgaaacaaacttttattatgggtgaaacatcgtttgattttttatcaaaatataatcgtgtgatatcttgttgttaagatttaattgtaaggaatacaatgatgtaatcatattatagattggataattattttaggagaaaaaacatttaaaggcggagaaaagggtggagatgagtaaaaaaaattacgtgtggacatgtatgaatagacatgacatgacatgtgcagcataactgtgaatgagaaaagaaaagatgtatagagaagctattgactggtacactctgtagttcgtataggctgaaatatacaagcaggtgtccgacgcgtccgattgtttatccgttgatcggacgtctgactttaagtattttctcaaccctaggtgtagctttaattttatatttcagtccctgacactttttatttcagttcttttttttttcaatttaggtggaggtccaaagtttccacttaacaccctgtaatccaaaacaaaaaataaaaatcacttttccggccttcctccccccgagttcacatcgtctgcctttggagcaaacggcaaacattgccgttgcactcatccatgccacacatttttgtatcaacggctgtatggagtgaccccaccacagtgattaattaattaggggcatctaatcaatagaattagttgtttctctcctggaaaaaatcaacgatagaattagttatttctctcctggaaaaattcaacgaatacgccgtggctttggaaataactaattaggcattttttgcatggtcaagtacattgttcattgagttattcactttcatgcaatttcgcaggctaattcatgagtttaaccataccattaagcattctctctctatccaatctgttccatttatgttaaccataggaaatccatttcattatttgacattttgactaaatgttttataaaatataacatgtaacaagatgctacacacaccaacagtaaaaattaacccttattgggtggcaggaccagcagctaccttgaataactctattgatacatgcaagaatgtacggtatatttaattaaaagcatgtcatgtccatgacttttgacaaactagagaatgttgtaggaagaatgtatttgttgtgcagtgttacatgaagttaatttgacctttgctattcatctggcataagctgaaagttctcttccgcaagaaataaagcatctaaattgccaatatactccaacgttccatattatgcttcctttggctaccatttagatgacctatcaattttctattgacttataagcgcgtaggttgttctgatggcattgtgcgagtttgctctggtcatgtctgaatacttttatatgattctttattttttttttcaattctcacggggaaaaccatttgttataagagaatttatagaaattgtgttgtttgctgcttggaacaactcccccttagactttgctgcaaagcaaagtgcttttttccactgagattatgtcacaccctaaaaattcaaaatttataaattgttgtttaaatggaatttttagaatttattttacaagtcttgaaaagaagatctaattttaataaataaattccaatataaaaaggggccagataaaatttcattaaatactttgcttaattctataattcctagatttttctgggatttatttgagctaaggaagtatttttaataaatggaattgcatttaagaaataatttaaattgaaaaaggttttaaaagtttcttttggctttgggctgaaagtcggcccaaaaccgctctctctctctcctcggcccaagtcggcccagtccgcagccgcagccgcccgcgcgcgagcgcgttgtcgctgacaggtgggtctcgcctgtcaggcccgtcgtcttcctcgggccgaaaccctagcgcgccgccgccgccgttcccttccaaatccggccgttcctttccttctccggccgaatcaatagaggggaaacgatctccgggatctcctccaccttttctcctttggaatcttcggctaaatcggtttggaaaccgatgggttcgaggtcgactcggatcggctttgagcccgatctttccttctcgtcgccggtcgccgtgggccttcgccgccgcctccgagcccctttaaaaggacccccgagctctcctctacccgtcgctcccttcgccttcgcctttcgtcgtcggaagagtcctagcgccgtgcgccctagctcagccgtcgccgccgtcgctccagccgtgcgccgccgtcgttccagccgtcgccgtcgctcgggaaggccaccgtcgggatcgccaagtcgccgccgtccttgtccgctgcttcgccgtcgtcggagactactggagcatcgtcgccgccgtcaacccgaagagctccgccgtttcttcttcgtcgccgtcaccgtccgttgggtttccgccgtcgttttggtcgccggtgagttcgccgtgtcgtccgcttcgtcctggtgccctccgtttgcgtcctcgtgccgccgttcgctggtgagcttgcgccgcccgagccgtccgagccgccgagccgccgccgccatagatgacgtcatcgctgacgttattggggccgtccgccgtgagccgccgtggacccgattgatctcggccgtccgttttagatggatcgatctcggccgtccgttcgcgtgaaccgccgcccgtgcgcccggtccaccgcaaaccctagccgctgacgcaataaatcctcttttccttttcaaaaacaattcattattgcgtcataattcaattaaaatcagtttaagtgttttaatccgatataatctttaaaaattcataactaattcatcttagctccgatttagttggttcaagtctctaatttttttctaaaattgagatctacatgttaaaaatatccacatgtactgttcatgcttgtttatgtgctgttttggtgattttgctcttttctgcttagattccgtcgtttccggagagtccgttttcgccggagaagagtttgaagagttccaaggccagcaaggcaagtcacacagatcccaaacaaccctttgagcatgttgatcctatttaaagctattgtttctattcaactattgcatttattttcgaatgtcattgggtggaatcaacctattctttgttatggccctattgttcttgtttaccttattccttgataccttgggttaatataatttgactggttgaaccttatatattggattggttcaactagatgttagatgtaattgcttagccctgcttagaaacactagttcacttttgggataacttatgaatcattataatttaataatggcttaatgatagttcacgatggttaatcgtgattggttaattaattacttgccaactaaaatttgataatggtgggttgtgagcacatggttttgagagtcgtgctcatgacaattaaggaccggttcacgagtttcggttgtgaaacattaatcgtgccaaccacaagccagcgtgggcaacggctttaccttttgtatagcatggttcattgcggagcaccagactgagaagtggcggagataagcccacgggggtcgctggggagtccattacctctggttttgagggggagattatgatccaggaacggtgcactgtagtggattgtgttgtgcgagaggtaatgtcacagctcctttccgaggtaccgtggtggtactaaggcacatggtgacatgatgtggggctgtgtcttgtgggtacagtggtacacctctgatcagagtaaaactattcgaatagccgtacccgcggttatgggcgggtcgagcaatgtctttcgtgattagtcccacacttctcaccatagtaaatgatgctttaattggtaataatttgtttaattcctggtttggagaatagatctgttcagccgggtgtggttgtcagaatggttgggcctatacaacagggtatgttgtatagtgttggtttaatattgtttaatacttaactgttttattaaattctccaatgtttgctaaatgctgcttttgcaaatgagcctatattatgccatcctttggtatccttgtgcacttgcatatttgctgcgtgacttgctgagtatgtcatatactcaccttgcaatcattcatcagaggaagagttcttcaatgaagctgatggtgtggaggattaggtgtagtcttggtcaagctgcctgtggagtggagccgtctgcgccgtttattttactttccgctgcttagatctttattgattgagaggaactatctacctctgtaataatattttattcgctattagagtaataattgtactctattatcaatttgttattgtgtgcctcggttgattcctggacgagggttcacacacatgtaagcgtttgaaattttggatagaaattccgggcgtgacaagttggtatcagagcctccttgaccctaggttatgccaaatggttacctatagaagccctctaaaaatattggaaaagtagaactgttctcctccctttctcttttaattaaaccaaactaatggcacatgcacttcttaatctcttttaatggttctcattaaaaatttattccagtgttattagtactgtacatctattactgtactaatggctcattttaccagcaaaagttttacaatattgttttatttaatcttgctgcaataaaataaatttagcatgatgattttataactttcttttatttcttttaaaacctgttgttcaaaagtacaaaacttgtggccttgtttccaactgtttcaacttatcttgcaagtttggtttactttatttaattaccttttaccttgatcttctaaactttattcaaattaatcccaaaacttgtgctattaattggataaatgtcttaactccctcctttcacttgtctttagatgccgcgctacaagcctgagtacttgtttggtgttgagggttttgtccaggagttgcgtacaatgtcctttgtcattggattcgggactgcccctttttatgcccagattcctcatgatcgtcatgaagagaagtgccgagtcaaagtcaccttgaacagtaatagtgaagatatcccctcagtgatgttcgaagctggaggaagaaactacatccatgcaagtcaggaggtggcaaggatcgccataggagagctccgcgatcgttatagtgatcagttggccgatactgagtatcgctatcatcctcgtcaaccccagggaagtgaccgtggcagttaccttgagactgaaggaattgagaatgatgctaccacaaggcatttggttgagatgctgtgggctatggatgaaagtcgtgcggagattgtgttggcagctcaagatcgtgaagaccggaatcgtggtaagatttgcaagctagaagacaaagtggatcgtttggagaaggaactagccgcattgaagggagaagcgccaccgcagaaggccagaattcgtcttaccgcaaggaagagagctctatttgtccctcgctatcaattggcgccaaaggttcgtgtggtggagaaagaagttgccctaactcaagcagatcctccggtcatcatcataagtgatgatgaagaagaagaatccaaacgcaaccattccaagattgagtgggtagcaactcaagatgatgaagacgagccgaaagaaccttcaatcgacctccgatgctcggaagaattagagtgacttgttaagtcgttgttttagatcgttgtgttagtttgcttactttaagttgcttgtgtgtgtctcgcatgtgatttacatcagtggtgggatgtaagtgcatgattagatgctatagatagagttgagcttagtgtatatcaaagctgtgacaacattgtacatttcatatcgttctctgctttgcattttttttatataaaaagtgtctacaaaagagttattaagatattgcaatttacactacaatatatgtaattcttgaacttagtttgtttgcatgttcagtgtaatatataatgtggaaagatgctataatctttgggtgattgaacatgattagtgtgatatgatgtgggaaacgtgcgttgcacgtgcatgtttactagtgatttattaaagcttttgctaatgttttcacatgcttaaccacggcgtattcgttgaatttttccaggagagaaataactaattctatcggtgatttttttccaggagagaaacaactaattctattgattagatgcccctaattaatcactgtggtggggtcactccatacagccgttgttaaaaaatgtgtggcatggatgagtgcaacggcaggaaccccctc

SEQ ID NO: 66336 - DNA, 2333 bp, Oryza sativa
gacgacggcgcaaggcggtgcaccatccctcctctcctcccacccccaccggcacggatcgggaggcggcgtggccggcgagcgccgtccgactcggatcgaggggcgactccctcccccttccggccggtagcgccacccccctccatctatcctcctcgtcggggcggcggctcgacgacggcgaggggagcgttgcttcgcttcggggcacggcctccccaaggcggtttggcccctctcccgcagaagccgagacggaaatagacgcaacagtccgattcggatcggagccggggggaacccggtgctatatatgccccaccaccgtcgaccgccgcagacccagggtcgtcaagtttgaaggcaacatgatgcagcaagacagcaagaggaagaggtccgtgctgccggagacggctacgttggccccgggaagcaagaggaggaggaggaaatctgtaccatcccgtcatgcggccgcgatgctacctgacgagttgctgacggaggtgtgcctgcggttgcccgtcaaatccatccttcgcttccgggctgcctgccgctcctgggacgcaatgctgtcttccgaggaatttggtcaactctacgcagcgagagccgaggagatgtcgtcagctcctaagctgctattcgtctcacctacggcaaatttcaactccaccgcggtgtacaagtgctcaccatcgaagcccaccgatgacctgctgctcacgcttgatgatgttcgcggaaactatgtggaggtgacacccgcaccatgccatggtctctccctcctgtatgatggtattgccccagcttactatgttatgaatgcaaccacacgggcagtcacacggttgccgcctttccgagatgtggcttttgccactgctggtcttgggtgcgatgcccggacgaagaagtacaaggtagtgaggctttttgaagggaacttgcttgagaaggaatttttgaagtgtgagatatacacacttgggggcgatgaaggggatatttggaggcctgccgctggtggagtacctttccggttctacagttttgctcgttctgctatttccaatgcggtgatgaacaaactgcagccacttttcttcaatggatatctgcactggttgatcaacccattgcatcacgttaaactaccaagagcttctattttatcattttctctcactgatgaaaccttcagatggatccgatcaccaccctttgtggcatctggagtgcatttggtggagcttgatggtaatctgtgtatggtccgagaccttcgtgataggtcaactgctgtttgcaagttggaaatttggaagcttaaggactataactctggtgattggtctttggatcatcgaattgatttaacagggcagttgcctagggatttacttgagccacagatagtgaaagttatcggttccgctggtagttgcagatcaggtacgaagataatcatcgccacatccaagcacaaagtttgttcctatgatcctgtttctagaactctggaaaccattacctcaatctcggagacctgcacatcctatcaaaatgagaaatctgatattagattcagtttatttaaagaatgccttaccccagtgcataaaacaagggaagagattgccttcgcaactcccttgtctaaggctactaaggagatcctactccgactcccggctgaatcagtcttgaagttcaaaccagtctgtaagcaatggcttgggctgataaagagtgaaagatttatccgtgcatactttgcacacaagaacatggacaagaggccaaaaatcatgcttgtgggtaagggctctggaaaatcacttttcaactttgttcccttaagtaaatggcttcaagaggcatccaatcaaggcacactgtttcttgacacaaaggtggtttgctccaagccttgccgtggattgaatttgatgagcttcgtggaggaggactatctgttcaacccgtgtacaggttaccacagggtctactggaacagagagtggcatcagcaccaaccatggaaaatgcctacgggttgccgtgaacaagaagacaatccttttgcagttggcaataagaatgttggtttggggttcagccaggtgattcaggatcatgttgttgtggggattttctatgaccggaaagactacaactctcgtgagtattctttaacatgttctctatggagctgtggttctggatacttcgagcaactcccgcagccacctctgcctgtgaatgacatgccacctgtctctgtggatggagtgctgtactggatgagcgaaccaagg

SEQ ID NO: 66337 - DNA, 18640 bp, Oryza sativa
tccatttgatcaaacaattgaaaacttgcttgcacttgatcaggtgtcacttgccacacctaaagtgcagcaacagcgcactggaggtcatcttaagtgccacattaccagatgcgaagatgttcctaggaagttttctccgtggaaactatctatggctccatgtgagaactttgctacacctccaagtgcctcatcagggaagaatctgttgtcctccagacaccaatatgtgaaggcactaaatagtgtgagcccaaaggttatgcctgtggttcctatgttgtatgaggagagcctaacttattatccctttgctgcccgagcgagagtgttgtttagttgaagtggtacctttgtcaaatctaccatttcatgtgtcagataggtcctccatgtttggccataccatgtcaccaagtttttataatgtaatattttgatgtttatgtcacgtagctgtcagaattatagttgtgttgcataatttatttgacttgtatttcaagcacaacttcttttgtagctttcagatcttaagcagaagggtgatgggtttgaaagcgcaactacggactcaaatgaatgttctttccttttcttttcccaatttctcacttatgtggcaacttttttctacactgatctagatcctctgactttgggttgtaaagtcacagacgtacagttctgctctatccgccgttcgttatcatccgacgatccaaaatcgtccttccaattcctttcttcttcctctgtttccttggccctgtttctgtgtagcttcacggctggccgccatggctgtcactcttggccaacaaagcacgcaatttctgccgctcaaaaggtgtaggcatgttgaaaattttcttttaaggctacagcttctgtcttaggcagattgctgttgcaacaagaaaaattgtatcccattattgttgaagcttctccctttgcacgatcttacccagggtataagaccaccgaatttgaacatcactttctcccgtatgggcatttattccatttgatggactctcatcggtacttcctccgtttcacaatataagttattctagcatttctcatattcatattgatgttaatgaatctaaataaatatatatgtctagattcattaacatcaatataaatgtgggaaatactagaatgacttagattgtgaaacggtgggaatacttaacaagctgacattttgacgacgcacctggtatcgtctccccatgtcatcagcaaactctactcgcgtggacggctatcgttccgtggatatgagatggatgatctctgttcacgcagtcacaccgctcgattcggaggccaataaggtggaggccggtgtagggacgtgggtcacgaggccgaaagattgccctgcagcgagcccctttccgttttctgcatcggccatgatgcgattgaagtttgctgcaagccgacaatggcagccggccatgaagctatgcaacgaagggagcaaggaacggaggaagaagaaagattttagaagaatgataatggacaacggagaggatccgctttctctctgtttctcctagattcctagttcctcgtttgctactactccctccatttcattatattattaaatcacttttttaagtaaaattttaatttaacttagaaaagtttaactaagtttatagaaaaatatagcaaagtttttaactcaaaagaaatatattattagaatatacttaatgttatatttaatgaaactagtttggtagtgtagatgttgttaaatttttcataaacttatcaaagccaaaagaaatttaattagaaaaaaaattaaaacgacttataatataaaatagagggactagcttttagttgcatgtatattacttttcatgtggtcacaaagttctcaaatttgtttccacgaatttgtgtgattcagtcgctaacgaaataatgtttgcagtagtgaagattaagattcgatacgcctgtctgctcactttatgcgaaaatcagggggatatgaagcaactcaaacgtacgacaatcgatttttaaaattcatatatgaactagtggtgcttcaatatctctactatctttacctatcttatcttaataataataataataataataatatataactaactaaaaaattactattttccaatagtcacatctttgcttcgttcgtcattgctttaggacgtgtcgtcgactcgtcgttcgtatcgctcacggaatccgatgtgctttgtgtatgtgtagcctgattctaccagactagtgtgtctccaagtttccagggtccaaagacttgtgttatctccaagctagtaagaaatatactactccccccgctcataatataaggattttaagtttttatttatattgtttgatcactcgtcttatttaaaatatttgtgtaaatataaaaatgaaaagttgtacttaaagtactttggataataaagtaagtcacaagaaaataaataataactccaaaattttttaaataagatgagtgatcaaacagtgcaagtaaaaactcaaaatcccttatattatgggatggagggagtactaatgtattctaccaaacttccgtacgtgagtatgtctccaaagtccaaagactaccacgtaagaaatctaatgtaatcaatcaaacagaaatattagtaattgatcacggtcttaatccgattttgtttccaagattcctacttttaatttttatatacactactacaaaatcgatttttcatacagccaaactccatttttgcaagcggttgggaagcctgcatgaaagaaaagaaaggtatgcaaaaatcggatttttcatatgagtagagcaatcacatgcgaaaatccgattttcgcatatggacgcttaagttatctgaccatgaaaatgaaaaatcacaaaaataaattctgaaaatcgattccccaaaccctaaacctaaaacactcatcgtcgtcgtcctcatcatcgccgtcgtcgttgtgcgcgtggggagcaacatccgcgctggagagggaggggcaccggatccacccctcccatcgttgccgctgccgccaccgtcgctggagcccgagccctcatccaccgccatccaagtctgagcccttccctgccgtcccccgtcggatcgtccaccaccgaaccccacgttgagctccccatcaatggatccacacccgtcgccctccccaccgccagcctcttccacccttccacccacatgccacagtcatcgtcgttgctaccgttaccgagccccaagccgccagatttgccgttattgagctccctgtcaccagatccgcaccttccggcattcccaccgctggcctctcccacccttccacctgcatgccgccgtttttgtcatcgatgttgtcgtcgagcatcacaccgccgagttccctatcgtaggatccacacctacggccctccctaccacggccattcccacctgtcgctcctgctctcatatactataagatttttagcaacaaaattatatccatatgaaagtaaatttaaatgccaatctaatggtatattttttaacaaataaattttatttcatattgtactaaatgttggttaaatgttgaatcttgaaatacgcgcgcgtcttatattatgggatggagggaatagtagttaacaacacattgaaataaaaaatgttgacaacaaaattagaacaatcgaattaaatatagtgacatcaattcaaaaatcaggcatcatataaataaacaacccccaaaaaaaaccacataagtaagagaaattttttttaaaaaaatacagatccaccgctgacctacgccttctttgagaaaggaggaaatggcacgggcgcctacaaaaggaggaggtagtgcccacgagcatcaggagtggaggctggagtagggaaggagacgacatcattgtcactggcttggagtagtagcggcggctggtggtggacgttgcagccctgttgttggcactggagtagaggaggcatcgagtggcggctggctacgacgcggccccgctgcggcggtgggtattgggcgccaacacgaacgatgacctcaaaaaagcaagacatgggagcgccacatcaaccaagaggtgtggatgggatgagagtggtagctacatgtttgacttgtcacttcgtgtggcctccatggtagtctagggtttacttcgcacccgggcctattgggctagatgaattagggtgtgtttagatcctaaaaacttttagctaaaaatatcacatcaaatatttagacacatgcatggagcattaaatatgaacgagaaaaaccaattatacagtttgcatgtaaattacgagatgaatcttttgagtctaattgcgccatgatttgataatgtgatgctacagtaaacatttgctaataacggattaattatgcttaataaatttgtctcgcagtttacagacagaatctataatttattttgttattagtctacgtttaatatttcaaatatttatccatacatataaaaaaaatttggccaagaactaaacacggccttaatgcttcttgttcttcgttgtgtccagtcatgactgcattaactaccattaattcatctacacaatttaaatatgactattaataaaaatacattgattatcaataataaaaccacttcggtagaaatataagtcggtattgagctcaacgtagctgtcgtgccaattgaaataatatgatatttcttgtatatgtataattaaatttttatttatccgatgcaatgtgcgggaatttagctagtctatttcctttcgtcacatggctctcttcggggctatttggatgacttccatagcttaccacaaaatatttggcaaagtgtggcatgccacacattatatgactaaaaatttgttggccacaattatgacaagctatggcaaaaaaaccacccaatgacaagtgggtcagcttgctaaaaaattatggcataactcacttgtggcatgaactaaatactagacttaattggtcaaacttaattgccacaactttagcaaatgttggtacccaactaaacagccctttcgtccggtgtccgatcgagtgtcccacttgtgcacgcgcccaccgcccacgcgtcagattgggagaacgttatggccgggcgcgcacaggaggccatgtctccagagcacagacccacgtagagcgattcgagattacggcgtacccgtgcagaagtaggaaggaaacgcgggatcgcatctgcgtcagttcagaccggtcacaaaccacagctttgctacccttgaatcaaacacgccaataaaatctccctgccttgcacgtatatctggaaaactcaattggatatcccctcatttttatacgtcgcttaaaaaatcataaaaacaatttgaaaacaattagtatgataaattaatatgtgatatgtcactttacaaacatgcaaattcaaattccacttatataagtagaaacaaaaacaataaattttactttgaatagaacacgtaattcacggtcaaatttgtttttttttcaaattgtgtaagttgaattttaattcgcatgtttgcaaaaaagatatatcatatattgttctattttgatattttttttaattttttttgataactttttgaacaacagagacacagcaacgaggggatgccctcctcgagggaaaaaaaatccacttccgatatatcggcctcctgggacaagattcttggagcatctccaggctcaagtgccaccctcgcagcgcgtacttctctttcccctccggtgctttgatcagcagctgccgtagcgccagtgtgccagcagcaaatcgcggcagcccggcccggtcggtcgtgcctcgtgaagttccctgctcttcaccatgccgccatgccggcagtgtttgagtcgagtcgaacctcggggacggaatactccagctcagagccctgcgtcgccccgcactagccgtcgcctcagcccgtcaacagtttgagctcgagcctcgaggctgtacccatggcgtctccgagactgggttgggggtggtgatcgaggtgagcagcgacgccgacgcaggggatcgggcgtgcaaacatggccgggtcggtggaagcctcggcctgcgatgtgaaggctaacgatgacatggtgtacagtggagggacactggaaggccaatgagcagaagcagaaagacgaggacacgaaagatcagaagcgagcgcatgttcttgaggttactcttgttaggtcagaccgtcagataaaaaatgtgttcttgattgtgtcgtggtttagatcgttgtttggattgtttgatagtacccaaccatagttggtgattcatatatattatatataccataggaaaacaaaacacatgaatgcacaagtataaaacagaagattagaaaatatgggaaactttatgtagatgagttgtttggaatacaagaattttatttaaactaacaagacaataagtttcagtttatggttttataaacttattgacctcattttccctttactttaatttgttttcctttcatttgtttggtactagaatataatagaatacagaaacacaggagttgttttcaaaggaattcgagggtccattcctttcttttgttttgtactagaatactaatagaatacagaaacatagaagttgcttccaaagaaattctagggtccattcctccattccgaacagccttataggaaaaaaaaaatatactatggtcctcagttctattgatttttctttggaaatcctccatcccaaacatgcccttaattattgatctgaaaatgttttgtcattgttttctttcctagctgtttcctcgatcaaattatttgatgtttattttgattttaaattttccccgttgcattgcatggacatcctttctagtatctctatctctatttttttaatctttacctattatataaaatttcaaggtgtttttgcctataaatttcgtacgtcgcccaactcattgcccacatataagcatatttttctgtccgatttcctttttcaccgcgcgtgtgtacgtcgtacctgttattttttcttcgtccgattctcttcccacgatttccaaatcgcgtggcgtctaggcccatgtcggcccttgtccagatccctcacaaaacctacgagtccgccgtctcctcgcttgcccgcctcatcggagcctccgtagaaaacaaattagagacctgttgaaacctctggattgtcgacgtgtggataaataactcttccaacggcttcccgatcggctccaggcgaacgtgttgttccgcttgaaccctgcctccctcgtcttgctcagctcctactctcctagggctcggagaagcgattccactctgcctgcgcttggttcgtcgcgttgcggctgatggagtgatggtgaacgagggttctattcactttgatgtcattttaaacaatactatttttttaagtaaatttgacaagaatatacatatgtttagtttcttaccaaattttggaaaatataccagaaatttggtaactacacagtaatgaccaaaatttagtagcatgtacgttggcaacaaagtaagcacatccaaaatagctatcttaccaaaatttgataatattgccaaccttactaaaattttggtattgccagaaattgataaggtttaaaatgacattaaagtgaacagggccgagaaggcggtgatgaagctcgccacccgccgttttcttcttcccaagactcaccagctgtcgatgctgatctagatactagcttcgtgaggttaattaatccattcaccgtcgtgggccgaccgagtctcccataacacgaattaagtttgcggcagcacccagcattccagcatgcactgcagagaatcagtcttagaggcaaaatgaatggcaaatagaaccaggagcacggcagccgctgataccctcatctctggtcgccatgaagcgtcattgatgctcttagcctcttaccatgcatgctcgtcctcggtggccagccacttgccgagccttccgatctcctccaccctcctccagtactgctctgcggatgttctatttagttcacatcaaaattaaaagtttgattgaaattggaatgttgtgatggaaagattagaaatttgtgtgtatagtaaagtttcgatgtgatgaaaaagttgtaagtttgaaaaaaaagttaggaactaaggatacattagtcccaggactaggactaaagtttagccccaagactaaaacattagtcctttttagtcatagcctgtttggttgaagggactaaatagtactaaaatggtagcccgcaccagatcctccatggcctgaggcagctagcgtggggtagcggcgtgagcttgcgcacggcggcggaggcggcggctgcgggagctcgcgcgcgacggcgtcggtgggagctcgagcgcgacggaggcggcaggccgcgtgagctcgcggcttaggtggcaggccgcgtgagctcgcggcgtcggcggcggccgcgggagctcgcgcgcggcggcgttggcagcggcgtgagcttgcgccttgcgccggatggggagagcggagtagtcgagtagtacaggagagagaatgaagtgagagagagagagagtgaagtgagagcgagagcaacaggatagggttgggatcgcttttctataggtttttagcctatgctgttttagtctgtttaagtccctcccgtttggtagtttagaggctaaaagggacttatcataagtccctccaaccaaacaccacctgatccaggcctagttgccgctgccgcatcctcctgtcccggccaccacaggtgcgtcatccacctttccgggcgcagctagcgaaggtgcgcgtggtggggtagagggagaggtaataggttatgagagagcgaagtatttggtagtggggcggcgctggctgcttgtcataatgtcatggcctgacactaggatcttgtcgatcggtgtggttcagtttgctgtaagagcaggtacaatagcgctattagccagctataaacatattttaataagataaatgataaaagcaagtataatagtaggttataagtcagctataaatatatttaatgagataaatgataagagcaagtataatagtaggctataagcttacgtggaggaaagagaatttgaaaaatgaagagggttgactctcatgcaagagctatctattcacatacttcaagataaatacattaaatgtatatgtgagagatagagagaggaggagaaaaaaaagataaccttacagctcatttactatacatgttaactctaatataagctataagctcatagttggctctattattaaacttactctaagagcacccgcaatgataaagtaaggtgctctctataaaacatgtacatctcagcaatagactagattaatagtaaaccacctcaatagtatgtctacatgggtatctatagctctctaatgcattgcctcgtttttctctatagactatctccaggttagtagatagctttgtgctctctctctctctctctcttcatttaatctcttccaagtaggaaaatatgctgacatggatatcttgtagagagcctatagataaccattgcgggtgccctaagagagaagagcagcgggctacagatctgtagccagctgcagcacggactctaagacacactgtgtgtatgataggtgggaccatatattaatagtttagtaagcaaccattgtatgatttggctattaaagcaagtttaatagtatagccaactactagctccaattcatatatagccaatctagtagctcatttatacaatagttacatactccctccatttcataatataaggcacgaccactttttttcagatattccataatataaggcatgcatgcatataggccattaactatgaccctttcttcattaaattattacttttttaaatcctccactcttatgttctctaattctattggatgcatgcattgtatttattaggatgattaactacaagatgataataattattttcttggtctttgggttagagttggttatgccttatattttggaatggagggagtactaaactattaatacctggtaccacatgtcatacacacactgcgtcttggagtccgtgctacagcttgtaaatctgtaggccgctgctcttctctctcctcatttatctccttaaaatatatttgcagttgacttgtctgctattgtatctgctcttagattttctatgatgacgctctctctcgtggcccgatcttctggtgaggggataactcttgctttgatcgagtgtgacgtttgcgacgtggctaccaaccagaacaagtccaggatgccgtgcaatcgctacaccacaaacgatgtcgtaccaaccgtgacgcgcggttgatgatccctgcaatgcaaacgagagaacactgcaagaacaagataagatgcaatctaaatattgcgaataggtaattaagcacaaaggaatagttgcgattgaggtggctctgaatcaacacaccaactattgggggctctgaatctatagtcgtcgactaatcgagcgaggactagagacaaggtgaatggcacttggcaaaattcaactaaacaaaacccaattgtttttgacgatgtacaaagctatttataggggaaaataaagctagggttaagtgctaattcatggaggtggagggagacacttccgagatgggcctagtctattacaaggcccaaggcctaagttcggtttcaacaacagcactgtcttattttggcaattcccgttgactcgagatgaatttggacatgacaccggatgcatttgaaaggtagcgagataaactttctatgaagtccaagaccacctaaatcggagttggcatgaaggcgctaggtccgtttgaagtaagtgctgtctccggaggatttgtttaatctgtttgtgcataatttttgttagttacagaccggtaggtgctatatgtatgtgtggatggatggatccaagctagcaagcaagccatttgacggaattgttgtgaaaaatactttcaccggtggacatctgattctggaacatcagaaaggcattattcccagtgtttagagtttagacctggtaattcgtttgagctgaattttcattttttttccctatacaaacattagtattgtacccgtgctttgctttgcaatctcaaaactcaaatatataatatatacaactattctgagttaaaaaaataactataatctactctaaattaggtcagaaggtattagtttgtgactagggttgtgtttagttccacaccaaaattaaaagtttgaagaagttgaaacgatgtggtggaaaagctggaagtttgtgtgtgtaggaaagttcgatgtgacggaaaagttagaagtttaaagaaaaaagatggaatctaaacagggcctaaattatagtgactgcaaacacacgcatggcctaaaatttgtgacgccatggtgatgcctgtttctggacgtgatgcaagaatgcgtggaaatcgaagttgatgaaaaaaccattgttgtggaagacggaatatgcttttcggacgaaaagggtaccgttcactgattaatcataatacaagattaataagaactatgtggaaattttatgttggcaaatatgacgttgccaagtacgtactttggacatttaaatggttacaacaatataaattgaatatattaatgttatcttttaattgaatacttataattaacatcaacttaaaatatagtttccaacagtcaattcaaacagcaaacaatggtatgtttggttatattcaataagtaaaacataacagaatataagaaatactaaacaaagtccaaaaacaactttggatcgtcatcaaatacacatgccacgaacaattaaacggaagatggtggattaattgctaaaattaaaattttaatgttcatgaaaaataaatgttgagcgtaccacgataataaacggttttgttactgcggacatatatatgtacatccgtttaatcggtcagtacgactgttctccacaaccctgccaaaaatatgtgctattcttcctaagattcgcatggactcgtaccactcttttaagttcctatcacatcgaatgtttggacactaattataaatattaaacatagagtattaataaaacccatctataattttagactgattcgcgagacgaatctatcgagcctaattaagccatgattagcctatgtgatgctacagtaaacattctctaattttggattaattaggcttaaaaaatttgtttcgcaaattagtttttatttatgtaattagttttgtaagtagtttatatttaatattctaaattagtgtctaaatacagagattaaaggtaagtccatagatccaaacaccacctcacactgtcacacaactactcaattaattttaacagctgcagctagaggcgacaagtgagggccctggcaggattcggtagaagtctgccaaagagaaatcagtggctcatgaaaagagagattgaagcagagctaagctagggcagttggtgtgaagtgagataaattaatccaatcatccctttaagatcaaaaggaacacgcgatttctcattgttcggcgaattattgttgggaaatggttatcagcggttttcaacctctctttctcacagcatgaacaaaacaacttaatagagcagaaaacccatacacaaatctatattcattttaaagactataattatgatggtgaatctaccatcacccgccacagatatagtatcatcgtccttcattcactttcacactgaccaatcaattgccacacctagctctttcacctagctcccgacgccctgatccgtgcagcttggaagatccaccgcgatgctgggaacataccaggacttgtcattgtcgatctgcgccattgcttgctactccatcaccatgggaaaatccacccatcaccctaggcagatctgccatcgaggctgcgctagagagcttgtcgatgtgccgcctcgatctacaccatgttgtctcaatgtgcacctatgctgccttgatccacaccatttggaggtccaccggtctacggtgccctgattctcactacccatagctctgtcggcccctatcacgctgatcagtgaggaggggagctcgagaccaccaccgtgaatgtctccgagtatgagcgccccacacgactagctagagtagcttctcttgctcgttcttggtggcgccgccagagagagggtgtttggagagaatttaaattcaaatctctccgcccagggaagtaaaataaaataatatgtgcggacgtgccagtgtactaagtaaaaaaaataaaatggacgaaggaaaatgcattttattataattctcaaagaattacaaaaaatacaaaatccttagtcaaatgcgctccatagcctataggcaaggtggatctgacttggcgattatgtggtcctagttttcggggtctcggaaaacacccggttagttactctcacgggttgaacccgcgagacacctccgattaagctgtgctagtcgtcgtcatcgatattagcttcatgttctcccatgcaaggtgcggatgtggtgagggtgtaagtgggcgccggcagtgttcgcggccttgtcggtccacgcgccattgtcggtgacgtcgtctcgatgtaaactccgcccacccatccatccaaccttgtcggtcatgatggcgttaacaccggtgatgccgccgaacacgtcagtggcagccgtgaaaagactatcggtaatgatgccggtggtagtgccgaactcgagagcatgaagaagtcatcagtatgtgtatgaatattgctaggagcaacaaagacaccagtggagatgccaagcttgtggtcactggcagttggggtagcatcgcccttctagtttccacggcaatggccgaccatcgtcatggtacaatggtcagtcgtctgatcactgcagtaaacacttagtattgagtagttttaggggatgttaggggcgtagcctagcctggaaacgatgagatgcgttccaggagtggggtggccctcttgtatatgcgccgacaatcggggccggactcaaatgatgttgagccacctccgatcgtaacggcttgactcgggagtgagccgatggttgccacaaagaagccgtcagtgtataggcgctgtggagtgacagagacaccggtagggatgccgagctcgtgatcactagacggtgaggtgaggattcatatgatgatgacgccgttggcggcgacgagttggaggacttcgccatcagcaaacaagcagtaaatggcgggtcatatatataaatataagggtttcgtcatcgaacggacgaggttggcgagcatgacgccgtcgtcgttggcatgaggatgactctagccgtgacgatgaacgcgaggttatcagcagccggcggcgacgccaagcacgttcttttttaacagccggcggctccaaacttgcacgttggcgacaaatgcatgattggcgctggcaacgacgacaaggccgggcttgccatcggcggagaaacaatcggcgtaggcgatgatgaccaagaacaggttcaccattggtgatatccgcgaggataaatgtatgctaatgattgatgacgaagacgagggttcttccggtttctggccgagatcgcatcacctcggcgtcaatgacaatcatgaaaacgccctggccgtgcaggtctgagagtatgaccggcgacggcgacgagtcatcaatcatcatcgatgacggtgtatatatataaatattttgtcatggagcggtcaaggccggcgagtatgacgccgtagctgttagtacgaggatgatcccgacgtgccgaagcgaaagcgtcgtggacggaaggcacgacgacctcggccagctgaagcgaagggatcatggctggactcggcaacggcgtgcgggcaccaagcaatagcgctccggcgttgtcctcgggccgctcgacaattgtaacatgaggaagattgtagcgccggcgacggtgaggtgttggccgcgtcgcgaggcagaggctgccgtcagcacagtaaggacgcctggcatctcgatgacgtcgcagcgccaggatgtgtcaccggcggccggagtttccgacgggatggagcagcacaacctcgggcgggatggtttgacagcttccacagcagcttgatatgacggcgatctccaccgaggtagcccatatttcattatcttggacggtgtctcaggaactcagacatgcagcaactgtgacacctcgtgtctctcgtcgccatctcgtgcatgcatgatgatctgaacagaaagagaagaaaaacaagaagaaaactaaggagctatacccatggtgatgactgagtacgggctccccagtgatcgtctcctccttagcgtgcctcctcagcgcacgcgcctcctcgccggacgccgaggtactgcggccaacatcaccggccgccgagctcacgcgttcccgccggacgccgagatactacggcaagcacatggatgaacgcagtgagccagtgtgatgagtcctcgcctccaacacaaagtcacaactcggtcacaacggacggaaaaaagaagattccggaatgacccatgggtgtctcatgcgccttggccttatctctcgtacgtgcttgggcccacatgagatactcacagccacagctgtgcccaagtttgaaaaaaatgtgaccccgtagttaatggctaccaagtttttaattatagatagataaataataatctgtacaattttttttagggaaacactgtaggggaagcccccacagttaatattaaattaaaaaaaggaatacaaataatttacaaaatatttatccactaagataaagcttgtctcttataaacttttaatctgtacaactttacagtgaaattaaaaccatatggcctgatcatcatcggcaattcggcgtacgtgtcacgtttcaaatacgatcaggccaggcggtgtactgctcgcctctgatctctctctcctttgcaaagcgatcgtatcagcgttttggctcatgcatgcatgtatacgttgcagcgcagagtgcgttcactactcgaaaagcaaaaggaaaaggcagccaaattttggtcatctctcggatccctcatctctatagtccaaaccggagttaagtgtgtgggaggtatagtagtacctgtgacgcctgtgtgattttaactgcgattaagttatgtattatgtggtagctcggtttttgtgatcagtaacctaggagtactaacctgtgagtagaaacagtttcgttaattagcacatgaatgtacctacatgcagcaaaatggagtagtaccctggaagaagagctgcacaggaggcggtcctcacacaaaaacacacacactctctctctctctgtgtgtaggggagaggttggtggtggactggtagtcaagcaaatgcatgcacacaccatatctgcctccgatgcgttgtgccgtagcggtttccgcgggaggaaggggaggggacagcggctggaggcagcagcgtacaccgcggcgaaaagcaaaagggagggatgggagcctgggaggtgatccgatcggccagggctggcactggcaaagtgacaagttgtgtgtgtgcgcgcgtgtgtgtgagagagagaggggttgtgacccaggcgtggcgctgcgtagtactccctccatcatataatatataagaatttttaagtttttcttaaacaaccactcgtcttatttaaaaaatttatactaatataaaaaacgaaaagttgtgcttaaaatactttgaataataaaataagtcaaaaaaataaataataatttcaaaattttttgaataagacgagtggtcaagcagtgcaagcaaaaactcaaaatctcttatattatgggacggaggaagtacccagatgccgcgcgagggccttgccagcgccgatcccgacccctgcgaccactaggccgaccgctgctgcgcccaagatggagaaggcggcgccgaccccagctactctgcggaggagccagaggacgactgctcagaaggccgcttctctagtgcatgccgccaccactcttgcgtctccgctagcctgccaccgctccgctcgccgcgggagagagggagggaggagggagaaggaggcgatgagggagaaaggacaggagggaggaggggagagaaagagagatgtaagggagagagaaggactcacatgttagtgggtcccatgatataatttttgaatgacaactggatccatgcatattttttaattccaatgtcacctaagcgccacgtcaatacctaagtgccattgtgctattggtggttcattaaaaatggatgcctccacattaatttaaatggaccttgacgctgagctataatgactcagcaaatccatgccaccttcgattagagtttagcatcaatgaagttggcgctaagacgttataggtcagcgccaaggtccttagcgttgagtcgacgacctatttttggttgaagttttttgcaaggaccagtttcaaaataagtttttgagaaagatcaatttgtccaaaaaaagggcacatttgaagtattgaacataggctaataataaaaaacatacatattccgcttgtaaattacgagacgaatttattaagcctaattaatttatcattagtaaatgtttactgtagcgccacattatcaaatcatagcgtaattaggctcaaaagatttgtctcacaatttaattacaaactatgcaattgatttttttcgcatttgatgtgatggaatttttgaaagtttgaatggaactcaaaacaacctatgctggaaagtagggctcccatcggatggcctattcagctaaagtaaaagccaaactttaaattttcaaacttaattttaacattgattttgagatattttcaacgtagtttctttttcaatatcagcttttaaatcatcaagaacacatatataaaagttatatctataaatttacttttattctctaatgagctaattacgaaaaaagccacacgatgagatgaggccctagctttccaatctcctcccttgttcagtcctggaggcctcgtcgatccattaatgaatggaggtgggccccatgggtagacctcgttgatccattaatgaatcgaggtgggccccatgggcaagggaagtatatgcatcgttgatccattaatgaaaggttcagattgaaagctaaagcagaggatgccgatccgtggggatagtattggaggagtactagtagaagatcaaaaaaagtactacctccgtcccaaaataagtgca

SEQ ID NO: 66338 - DNA, 2931 bp, Oryza sativa
ccccaataaaaattctaatcataaaaaattttcaaataagacggacggtcaaacgttgaacgtgaatagagtaaagactgcacttattttgggacggagggagtacttttgtgccgtgtggaaggctgggaaacagttcctggcatcctgtcctgattcctgtgccctgttcgaccgggccccacccccgcaaaccaaaccttgtcttgtctgcgtctggttccaccaagcgcgcgcctcgccggtcgcagtgaggtcctgacgataaacgagattactccatccccatctagcattttctttaaaccgttaaacagtagtgtgttttatagaaaaaaaaatttcatgcataaattatcttaaaatattagatagtaataaaactcaattaattataagttattggtttctggcttccttattactcgtagaaatcggatcatgtaatatagagcaatctatgttagacatctccaacgtcgctacgccactcgcattggacaaaagagaacaagcgcaactgatcgatcaattgacgccttcttggtccacaccaacaaattattaacccacgaaaatgtccgtgggctgattttgttggtgtgagtcgagaaggaacacatcggtatgatgtattggttcgcctccgtccgatgccaaacaagtagagtagcaacgctgagcgtccctctgacgatggctagtttggatcatggactaaattttagtccctgtcacaccagagatttagacactaatttagagtataaaacataaactaattacaaaactagctacaaagatgaaggctaatttgcgagacgaatctattaagtctaattagtctatgatttgataatatagtgctacagtaaatatatgttaatcttaaattaattagacttaatagattcgaatcgcaaattagtctccatccgtgtaattagtttgtaagtagtctatgtttaatactctaaattagtgttaaaatatcttatgtgataggtttagtccctgtatcaaaataccaccatagatactcctacagtatacccctctacagtacatgagtacagtacagtatgtaccagttgtacatggctgcacataatcagacttgaacaaatgctattactgagcgttgagagagattttttttttcttctcatcgttgcaactagtgaagtgtatgcattctgtactagtacatcacactattacgattacgaatttttactgatgaaacaaaattaaaattgggcgcattgcgcatcttttttttcttttttcttttttttttttgccgtgtgcgtgtggtacagctgggctgcgcctgcgcgtgacaagcacgcggctcgcagcggcaaatcctcctctgctacagtctacagagagaggctgaaaggcaaagcgaaccacgtactcagggctaattgcaaggacagggacgggcccactgcagtgcaaacggctcggaggtggtagtggaatccacggcaacttctttccccaatactccgtatacgtactcacgtacagtactgtatgcatgtatatacacgcgcggcgcgcctgagggtattagtagtagagtactgtacgtggtagtagtacagtattatacaagtagtgcccagtgcccaccaccagtagtatactgtacacgtagtagtagctggggttgttggagtcgtcgggtccagttgcagtggtactacaagtttcagagtcgggttcgggttgtttcacgcagagcacaacggatcgatcggaggactataaaagcagatattcttcgtcgtcccctctcaccttcatcccaagtccgcccaaccctcccacccatcacaaccattcccctctcctcaagaaaaaccctatcgatgggtacgccacatcatcctacgctttggatgttcatcgacagcgtcatgcagcggcgtggctcgccgtcgccaccacctgccgcgcagctgagcgggggcgtgcgccgcggagggagctcaccgccgtcggcgacggcctccggatgcaaggggtcgggatcccgatccggggcgaggccttcccggctgtcccgtgaggaggtcgccgtcctctcgtcgccgaggccgaggcgatcccgcccgacagctggggatgacgcggacggctccttcgtcgggtcgaagcaccgcgatgtcaggagggcgtaccccgccaaaaggaagcagcgcgccgcgacgtcctcctcgtcgtcctcgtcgtctcctcctacggctacggagcggctccgcaaccgcgggcgtctcgttccctcgaaccgcgtcgacaaaaagatgcgccgcttcgtgggaacggtgaacaagttcgacgcgctccgccacgacaccgactcccacgacggcgacgacggcgacgacgacgtcgcgcttggcgcggggccgctcgaagccggcgacatcgccgcggcgaggactactccaagcccaccaccatctcacgccttctctaaggcgccaggtgcgcgctccctggagactcgcgcccgatcgcccacactgagtccgaccgcatcgccgtacacccctgtctgctccagggtctcgcgctcgcccgtgcgagggccggcgaccgcgcccgccggtgttcgtcaccaggggttcccaacccagtggcccacgccatctgaatcttcacctcgttcgcatagttcgggcggcggccgtggcggagcaggcgcaggggcaggcggcggccgtggcggagcaggcgcaggcggcggccatggcggagcaggagcaggggcaggcggcgcccgtggcggcgcaggcgcaggcggcggccatggcggagcaggcgcaggggcaggcggcaggcggcggccgtggcggcgcatgcgcaggcggcggccatggcggagcaggcgcatgggcaggcggcgcccgtggc

SEQ ID NO: 66339 - DNA, 6009 bp, Oryza sativa
ggagcaggcgcaggcgcagggggcggcgcacaagaaccaggcggcggcggcgcacgccgtgtcgtgtatccgtggaacgcccctgtgccacaggcattcccactggcgaggtgctctatctgcggcgctgtagcgctccggtattcgttttgttgtagccgcattctttgcgggacatgcggctgcccatgtgacccacccgccgtcgtcgtcctaccgccgcctgagttctttggatcagtttatctcctagtgattcaccagccagtgagtgggttcccatcgcctccgatgatattcacagcagcttggagccaggtggatgtatggactcactggattacttacgcattctgcccggcgtcgaggcttgtggatggatcacatttggtgccggctaaattctactctatgagaatccaaaacagatggatttcttcgatgcatgtctttgatggatatttgcctaggagcatgattaggggttgatggtctgggttcctgacttcctgctggtttactctagtaatagtacttagttttctcttcctgtaatctgtaatatgtaatgtgaaaacttattatctactaattaagagcttgagcacatggaattgcattgtgttggtttctgcacaattgctgtgtcttcttgcacatttgtaatgtgaacacttattatctcaaaaaaaattgcattgtgttagtttctgcatttctgatagtattattctccaccacaatgctagcgtgagatgctgcagaaattgagcgtccgtgtgttgcatgatgaagaccttgcttctcctttttcctccgtgataattaagaaaaaaagaaagctgccgcagcagcagcatggttgcctggatttttttttaagtacctcaaaatgaatgtgagacgtccatttgattcgatctaatggattagattcaatcctactacacctggtagtagatgtagtataattcgtggaggggtaacgttggaaatgtaatagatggcattgtgatgaatttgcaattggcttaggggtaagttcgtaatctagtccaggggtcaatatgcacaatcggttcacagctgcacggaggcgaggcgagatgctgcagacatgcagtgctgctgtgcgcgacggaggccgccgcacttcacgcgtttggcagtgccgtcaatttgatactgatgatgagatcctgtcaaaggactctgctagtactctcgcaaaaaaaaaaaaaggactctgctagtacacctgtttcaaccgtagcgtcaaggtttagcaacacctgcctggaagtccgaggacctttagtaccgtaccgaaccaaaagtgggatgatccatatcagaatctaagacaaggccggaaggtgatcaaaccgatgaagggttcaagaccgtcgtagccatgctgatgttggtcaatttcttgtcaattgttgtttttgtcggtcaaattgcagattgaaatagctgattaagaagacactaacacagttttagctcatatctgattgtagttatttttgtcagtcaaattgtagattcggatagctgattagaatgacgctaatagagtgagagtgtgcttgcaaccgcgagtcgttgagctttcttttttagccttatttcagttcagtctagaactcagtacttagtccgtcaactcagttctgctgcagataaacgagcttcggtattagctcatttgcctgatgctaatgcgaaaatgactaaattatacatcatcagctaaacatcagtgattcagtaattagttttgcagtatagcaattgagtgattcaagaacacatttcgacaaagcgaccttccctagagcaggccggtacaccatcatatcccaagaatgaagcggtgctgcggtgcacagggccacagggggtggagggatggcgccgtcgtacgtggccgtgggttcacgcgactacgcaaggaggggcggcgggtggcggccgcgcattgaggtgaggggcggcgccgccgtggcagtgggttcgcgcgaaaagaacgggaggcctcgcgaaaggcgaaggcagacgtcgggcgcgcgaggacgggctgcggccgtcgtgcgcaacgaacgggaacgagcgaatcactagccttcgtggaagcacctgaaataacgaaaatacccttccacggtgtagaagtaaaattctaaagtacccatcaggatcaatggttagatttggttcctactacactactaccagctcaagtagagggtactgtaaaataaaatgaccccttgtttgggctttgctaaaagaatagtaccacaccctctctacatgccaatgtaggggatgtttggatggtcacatagactaattataaactcattctataatctagactaattcgtaagacaaatctattttgaacctaattaatccatgattaagctatgtgatattacagtaaacatttacaattaattttattgttagactatatttaatattttaaattagtgtctaaacatctgacctgacatttactaaagtttgatccctgtatatccaaacaccaccgcaatgcatgcatgtttgttcagtgttcacaatcccagtagcatttttttttgtcttcttcttgtgtcgttgctaccttcctttttcatctcagagagagagagagagagagagactatttggatgtttgactgcatgtgcatcattatctgctgcacgtaccgtacgcgatgcagccggtgctccaaggcgccctcgacgctctcgtcgaaggttgacgtcgagagggagatggttgccgtcgcatcgatcgtgcgccatgagcacgacgtgcatgtggatcatggctactatatatacaaactttatacgtatcgtatataaagtttgtacatatatacgtacgtatacaaactttgtatgcgtatgtacgcatataaactttgcatacgtgtgtatataatgtttgcatatatacgtatataaaatttgtatacgtgtatatattacgtggagggtcattaaacttctttaagtgtgtcatgtaggtcactctattttcaaaatgaacatttgagttactaatgtgatataagtgagtcatttacccatctaactatccacacgagtgtgtggatactctgtacaaatttcatgccatgtaggattgaaaaaaaatgccctgagtgtgtttgaaaagccattttatactcttctcactcggctatcatgatttggttgtaccaagaccttaggtccagcttggtaaaccattatgatccagctaatttgtccaataatttgtcaatgacaggtatagggtattttgttttgatagtaaacttttaacttttctatcacatcgtttcaattttttcaaacttctaattttaacgtggaactaaacatagcttaatagtagtattgttaaaaataaaataccaatattgtgagggttccactcgatgtcaacaagaacacaaagcaaatcacaagaatacacaaaacctataggtaacttagatattactaggtgctttaagatatttaattaatattacgcttcaatccgaattgagtccccaccgtaacttaccaccgagttgccatatgatgatcagttgcctgagctctcagattctatatcgatgggaaagtatattcatcctggagggaatatcccctcggttcatgcatgtcatctatgttaaatatgtgatctaaattttaggcttacaatatattcgaattagtttcctactacgactctaagtctttatccactaggactcttagatttctaatgtatcctctgcgtttgtatcaactcctttatagtaatcattgccgatcagcgtctgtattttttcccgcaaggatttttcatgtaaaatttatgtctccgttgtgcatctaatcctattttttcccgaaggatttttcatgtaaaatttgtgtctctgttgtgcatctaatttcataacaagtgtatctgagcctttgagatccatctatcaatcccggccaccggcgtgattccacgatcgaagaaatcgatctcatctgatcggcggcagcaggcgcgtgttcgtcgcgccgtctcgtcaattccgaatttccgagtcatcgccgtcctcctgaccgcgcgaccgcgtgagaaaacgctggagcagcagcgcacgtcacgaaggaaaaagcagcagccgatgcacagccatcgcagaaggaggagcgcaagaaaagtaggagaaaagcaggaggccatctatcgcgcacggttcccaggaagattaggtcaggaagcccaccgttcctgccctgttcatgcgaattactacctctgtcaaaaaaaataagtgcagccatagatatacgtgctcagcgttttgaccatccgtcttatttgaaaaatttataaaaaatattaaaaaaattagtcacacataaaatattattcatattttatcatctaataacaataaaaatactaatcataatcctttttcaaataagacgaacggtcaaacgttagacatgaacagtgctaaaactacacttattttgggacggagggagtaaatttcacgttggtttttgcttcgtgcacacgaagttctaccgggaaatcaagtcctgtgcattgcttgctatggttctatttggtgaatcgcccacacgccagtttaccaggagattttatccggagatccaaatacttctttttatgcatctagagtgtttcacgtttctgctagggttccacaatttataccagcagattcaggattttatttccaaggcgagtttaaaggttgatctaccgctcctgaattgagatgcaatatactcattatggcaagtgaagatgcaagttggtgcatatattgaggatgaaaaggaagtgttgtcgtgcactagtctatcagttgcgcatacatatttcaggacacaagcgaagtcatcgagagggagcctgaagggtcctgtccagatcacgtggaggattacataaattcatgccagcagattcaggattttattcccatggcgagtttgaagtttgtgcatcgatttcgcgtctctgctgggttccacaatgtcataccagcagattcaggatttattcccaatggcgagtttgaagtatggtgtacctcttctggatcaagggtgttatggattatagtccaagtgactatttggcgcacatttattttatcattacgaggttgtttggagattgaagatttttatgctataagggaaattcgtctcaagatgaagattgttaaatatgtgatccgaattttgggcccacaatatattcggattagtttcctagtatgactagtctttatccactaggacttctagatttcttatatatatctcttgtaagccgcacggggagggtgcgacagcccaatgtatccactgcgtttgtaatcaactcctctatagtgatcattgccggtcggcgcccgtggtttcgctgacgtggcgctgacgtggtggtattgaccgggtctcctttacacgtggcgtttaggtggcatttagaattaaaaatatatgtgggacccatttgtcattgacaccgaaaatagattgtgggacccacgtatcccttccctctaccctccctctctctcccacggcgggcagagacggcggcgagtggtggagacggtggtgagccgcggaggcgcggcggtggcgcccaggctgagctccactgcggcgaagacggaggagaccacagcggtggcggcgggaggcacacgcggtggggtacggcgagctcggccgccgccgaccaggtctttgacgctgtaaccggcggacaggagggcaggcgggtgagggcagcggctcatggcagtgggaggacgaggggagccggcggcggtgcgagcggcggctgagggacgggggccggcgggcaggagccgccgccggcggcggcttgtggcagtgggaggacgtggggagccggctgcggga

SEQ ID NO: 66340 - DNA, 6042 bp, Oryza sativa
cgcggacagccgtaggggagagggagaaagaaagagagaagggaggggaggaagaagaaagggagaagatggcatgtggggcccacatgtcagtgggcctcataattgtgtgtgtgaatgacaaacgggtcccacgtatagctttttaattgaaatgccacgtcagcccacagactaggtcaatacctccacgtcagcgaaaccaccctccaaaacggccgagggagtcaaattgcaccggttttcttagtttgggggtcaagatatccggttttgtggtttagggtcacggattagatttcaatcacttttgagggtcaccaagtgaacttattcctattagtttacatggatgagaattacacggtccattgaggcccatgatactgtggattaggttcgatgggccttgaggatcggcgtccctccagtaatccagcgaatggttcaaaattatgtaatgaaatttccgaaatttcgatcatatcggaccccttgatatgatattatttcggccgaagttttaaatttatattatttttgttgtgaatttggtaatattttgttcaaatgtaactaaaatttatttaaaattttggaaattttgaaccaaaattcggtatattgccaccgtccggtagaaactttcaaaccgaaagagtagggcctgtttggttgttgtccccgtgttcctgcagtggcctgacctgatagctagccgctttgattagcctgactcagagcatctccaacagcctctctaaattagactctccaaacacccatatagccaactctctaattgatttgtcaagccaaactcattcctcactccaacagcctctccatctaccctctctattatgagtctatgacattggaacccacacgtcagcctctactacaccttccacctctttctctcccttttcctctttctccccctcttcctcttctattgccattcttgagtgacgccgatgatggaagggctacgggcggccacatcggatgcggccaggcgcggggacggccgcggtggatacggccgggggcgcaggcggcggcgccggatgaggccgggcgcgggggcggccgtggcggatgcggctgggcggcgggggcagaggtggcggcgccagatgtggatgggaggttttcggagcccctcctcccaggcgccgacgagctcctcgtggtggccgacgtcgtccttgcgtcccagcgcctgctcgtggtgtccgataagctcctcgtagaaggagaggagaagcgcgagtagatggagcactgggaaggaggatagccagcctggtaggctagccaaatttggctagtggatgagctcggatggagagacagttcgcttggagagttgaatggagagtctgttggagtagtgtttttagttcatttgctaaatttttagcttggagagctgagtagagaggctgttggagttgctctcaagcgacgaaaatccaacgcccgtctctcatgcaagtgataagctactagtagcaagattaaggtgatgtgaaatctatgggtcccactattaattacattctttttcttgcttttcttttctttcttcccaccgattgatcatgtttgttgagttaatactatctgttaatattgtctattaaaagtaattattacagtatgacattgcattattcttctcaggcacatggttcaaaccaaacaactcatctcacaggctgcttggtcaggcaaatgtcttcaaactttcagcatagcttcatgtatgagttttcatcatgtcaccaaccaaacaggccaaacctggacacctggtccaccgtcttcctctggttccttggcgctgttgtcgggacgagagctacagcctacgccctacagcgccctcctccggttcagccagtacttccaccgcaacagcttcttcttcttcctatggatcatccttgtcaggtggtgacgacctgacagcacactgatcacggctaaacccgcacagcagcgcccgagtaaacgaacccgccaaaccccggcggcacggccacgccgcgccaccgcgccgcgccgccggcgtcctccatcacccacgccgcgtactgcttgccgtcctccaccttgccgaacacgaacacgaacatggcggcgccgtcgccgtcgcccgcgccgaccgccttcacgcacgccttcatgcctggcggcccgtccgccacgtccctccacgcgcccccgtcccactcccgcacgccgcccttcccggcgccgacggcccacaccttgccgccgaccgcggcaaggcacgtctccgcggtgttcggcgccatgtctccctcgctggaccaggcggttgcgtcgccggttgtggtggtggtgtagcgctcggcggtcttcttgaacgcgccctgggcgtcggtcgggtagccgctggcggcgagcacgcggcccgggtttgcgacgagctgcggctcgtcgcgctcctcggacatgtccgggagcgcgcgccatgcgtcggaggcgacgtcgtacgcgtaggcggagcggagcgcgttcttggactcgtcgtggccgccggcgacgtagacgacgccgccgctcccggtgcagccgaagaagccccgggagtccggcatcgccgcgccgcgccgccacacaccggcggggacgtccagcacgcggacgtcgcgtgtcaggcatagcgcggccggctcccacccgccgacgacggcgacgtgccgtccgtccccggccgccgcgcaccgcgcgaagaacggcacgcccccgccccacgcctcctcctccccctcccccgcgccctccacgcgccgccactcgcccgtggtgaggttcgccgcggccagcgcgcactccgtcgccgccgacggccccttcccgtcgtcaccgccgcgcgctggcgtggcctggacgaggaacacgacgtcctcggccgccccggccgccctccggcggcggcggaacgcctccgacgcggccgcgcggcgccacccgcggcacacgcggcgcaccgcccggtgcgaccggctcggcacgcgcgccaggcactccatggccacgtcgtccggcaaccccgggatgagctccgccgcctccggctccaccaacgccgccccgaggagcgcgccgtcgcgctcgatggcgccgcccatggcgagcagagcaagcagcagtgtggcgtgtctttgctttgtgacgtggaaagtggaagagagggtgtttgtgtgtgtggctcagtgaaggaaggagggcttaggagggtttaagtagagggagagtgagtgtgaggacaaatttgagctatgatttctctctctctttttttaaagtgtgctgaaaattagataatatgacgtccgtaaaaagaaattcacttttatatatgaatctggacataaatatggacctcacttttttttaactactttgtctagatttttgtattgaagtgaagtctttttttaagatggaggtagtggtattttagaaggatatagtgaaagcgaaaaaaaatacagttgtacacgtagtggaggaagatattcttgtatatggtggactataaaggtataagtttggtaaatttgatcagtgatattttcatataggagtggggtaatagagaagattattgaagcacagtaagtgaaaaataataatattgcttatcataagtctctccttacatataactgatcttaaactagggaagccaaattatgataatggactccgttccatttatcatcgaatttgatggattctccctcaaggagtgtaatggccgcacctacattatggtcactaacatcttaaccatctgaagttaacctctcttcggtttgtacattaggcatggataaattgtgtgccttatgatagaagctgaaaataaaaaccatttatattatttaaagttgtacattaggggtattgttaatggtttattagtatggcgtatacattagatcatgtttagccaaaaacaaaaattaattttctttgtggagcgtacacatccataaattttctctcgccctacttatagatcaattctatatattgagtgcaaacaaattttagcctttgtatgaacttggtaagcatacaaccgataggaaatataattcaaccactgaattactaaaaaaaaaatcttgaagcctaaatccgacgacacaggtagacttgacaagaatcataaaatatatttacaagagcaatttccagcgatagtgatgatttatcactacatatcgtacatatatatggtaagatttttgacaaataatgcatggagctagcataaagagctgttaattaaagatgtggtatcgatcatgcatgtgcacatagacatgtgtatcgatgtttcatttcgtgtttgaagaaaattaaagccactatagaagtaaatctatttttcacaacaaaaaaaattgttgcattaaaccaaaattcattgcaacggacactaattgcaaacaaaataaaaatgtgttgccaaccgttataacaagtgccatggtaatagtatattgcaacgaattttaaactattacattggtttgtgctattgcaacaatttttttttcatttattgccatagtatgtggctttgatatgtgtaaatattaccacaaaatatctgaataatgtatgaaccgaaagatgcatgtaaaaaaagaaagaaaatgacttgaaatctaccctctaacctttgtaatgccatatgcaaagttggatgctcttctgatccttgatgtgaaaaggatattacatcttgccgatcataatccaatgtatactttgcctgcaaccagtcaagaggttacccacttactctttttctcaatgacgaaaacatgttttaaaatatatagcatggtcttacacagattttgatcgctgctctctatttctgaaatactttcaaatctcaacaaaattacagtattataaaaaaaacatttgagacaaatctacgtgcgtagtacatacttttcatgcatccaatctaaatataacatatattgttgttttgaagcttaaaaagattgacttggaacatatctaatatttctgaacgctagaagttattgtattttaggaatactatatatatcaccttttaattattgccatcaaccctcaatcatagaatcttttggggaaatgaaaagtgattctcctataaacttgaggtcacaccagaaaaactaaagattagactctattattctacaaatgcatatgtaccattgtcccactcccaccactacatagcatgttggtgtgtatgtgattttgtatgtgattacgaaagggaatgtagcctagtggttacagtgacctgagtagtgctccaaggtcctgagttcaaatctcctatggagcgaatttcagattgggttgtttgcggggctaagttccctatcttaatggccgtatatatccggttggatatagaggccgggtagaaaatacccttctctaaaaaaaatgtgattttgtgggcgcgccaatatatatatgccacagagctaagcatgcatgcagcgtgaactgaagagatgcgtttccccgaccaaaaaaggaaaaacagagaggaggagatgattctctagagaggaaaaaaaaaagaatgaccttctagaaggtggtgagttgcaccgagggcccaccagcagaaaggtgcatgcagcttagtgttttcccttttcttttcagttttcactctgctgtgtccctgtgtcttttcgttcttttccccccgaaaggctatcaatgtgtgcttttttttttttttgccttggtcattccaaaaaagtaaaaggaaaaaaaatgatttgccttgataaggactagctaattgggagtatggaaaaatacatactactcatcaagattgctatgatattttcatactctctgtgttctgtgttttgcatacacggttatagtatggcaatgtggcatttggttgaggagaaaagctgtggtagataattaggccctgaaaat

SEQ ID NO: 66341 - DNA, 9960 bp, Oryza sativa
agcatcctctctctcaaagctagagagaggtcggcagcagcaacagatctagtacaaaaatatcagcagagcagaggagtacaaaaccaatgtgttgctcgaaagttgttcactttttgatcgcatattatggagtatcgatcaccttttgtgtttgcgcctttttgaaaatacaaaaccgatcgatcgagtattactagtaaggaatcaattcatgcaatcaatccgatatttccgatcgagatcgaggagggccggatttggttttggcggctgcgaatttcgagatgatgcggagggggcaaaaggcgtgtctccggtgtctggcacttgaacgtgtctaaccttctagaagctaacccattcatcatttagaaacgggtgcgctcggatttcggaaggagtggtaacttctccttcacatacagaaaacaatattaacatataattaattaagtattagttaaaaaatataaattttaaaaataaattattaaaaatataccagtttgaaaaaatacacgcgaaaaacgtcgagtagaagttagaaaaggataaatattgaacacaccctagcctaacatgagcatgaatcccatccctcttttcgtgtttgcttctcgtagaaaaaaagagtcgcgtcatatatttatcatatatttggttagatggacatcgaaggcccatttcaaattgcataattcatctatttcttgctggcagacccctctaaactttgggtcaagctagatctgacattatctattatcttacacgtgttaaatttaaaggaaaaacaaagatgacatatgtaaactagcatactccatccattaagatataaccccaacggtcagaattacacgtaaggcactaaatatcttacgtctccgctgacatttgctagttgaaaaaaagtggtcaccaccaagaaacgtccttagtcacctagcttgatgatgcccgctggctccgtcactgttatatatgcatggtgtcatttaaaatagacaaattaggtggtcatgcattacatatatatcccaaaagccacgaggtgtcatatgcaattccaatgttaatttgttctagctcgcagggatgagaatactagcgtgtacatgctcagagggctggtcctgatgtttcggtggtcagggcgaactaaacaaatggaggtccttaatattatatcttctactagataataactaaacatttgaaatgcatccaaaagcaaaagcaatatttattatgtaaaacattataaatgttgtcttaagattttcttcagatattcctacaggcaaagtaattgattatagtatcaatattaatctcatctagcaattttattttacaaaaatatctagcaatttcttctcaatacatgaagttgtcctaccgtttatccatttaatttttcgatgaagttgccagtggcagcagaaagtgtagtgtgccggcctcgtcatgatagacgtgtagcatatgagttataacatggttaattatagacaaaattttttttgttagaccttttaatggatggaacaatattttgtacatgtaagaagtttttgtaaacagatcgaattctattggcatagaaaactcacatggaattataaattgcaattctaaagattttctagtcaaataataggtaatgtgatttgacactattttgaataggaaacatggcactgcgaaaaacacactgacagaaagagagcggtcgtcattatattgatttttgtcatatgcagctagtctagaatcaatggagatcgccctcaattttaaacaccctcttatacgatctattttaaacaccctcttacacgtggtgaagacgaaacctatctaaagaaatcacgacttgacaagggtatatatgcattatgcgtacaagtgtatgattttacccactagaattcaaccccaattaatcttcaccggttccaccttttacacataatcttgcaagtagtgtctcagtgactactactccctccttcccaaactgatcatcatataagtttatacaccaagaccaagaataatttaaatcacatcaattaagacatcatatacacattctcccataacgcatatatcgattaaaacaccatgccaattacaccttagcatgcacacattttctcatactgcattaattgtattataaagaaatccgtgtccatacggttatatgatgatcaatttgagaaattttaaattccgttatatgatgattaatttggaaaggatgaagtagcaaaaactacacgcatttaattcttccaaagacaccccacaaaaaaaattcccctaaaaaaaattcttcttgtcgaaacatgaattcggcaataataaaagggggtagcgcacgagacctaaaagtggatggatgcggagacaaaggatttagacaggttcaggccctctcaatgagaggtaataccctactcctgtttggggatttgaatccgccgggtgtagtatagatctgacgatcaggttgtctcatgccccctagagggcttcctgcccaccttatataggatggggggcaggattacaagatagaaaccttaaccaacacggtatcggtttcctaaatctactttacaatattatcaaaccaggactttaggccgttccataatatacaaggaaacgtaatacccaagtcatgatctgttacatattccatacatatatgttatcccctattactagtcggataaccatgccgtgtggatatggggtacccataatctccacagtagcccctgagaccttcacagtcgaaaatataatcttctctcgaactagattactccaaagccgagtgcttcaattatcttcgccatggtctcccgagtacttttaccaaatctgaagactgtggagggctgaaaaataaagtcaggtgcatcgaatagatgcacctaataggtgtagcccccgactatgtggttaattgaaccaaccaaacatatagtcaaggaataaataatctaaccaaccgagtggttttgataattgtaatcaaccaagtgacttgatatcaatatatagcatatgcggtgtgaatccccgaataatatgatccaagtgatataccgactgcttggcaaaatatgatgcgtacaacctaaagttgacaacatctttgaaagttcacatagcaaaacagctataaagaagcttgtatgttgtgaataaagaaatttccaaagtattgggcatacgccatgcgcacactgctttaacagatgtgcttaagtccctagaagacacatggttccaccacacctggaaatatatggcatatgtggtataaaatccgagtaaataaactcataaaggatttaccaaccgcctggaaaaatgaccataatatataatcagcctaagccataatattggtcaataaaaatgcacacttacgtggcaaaaagcaatgatattgtatccaatcaattgcttgataaacccaaacagcacattgactatataaaaaaagtcagcggggcagctatataaagctttactgtttgacaccttttaagatgcattgtaccaactcctaaaaagtcgagtaactgcggtataaaaggattttaaggtattgggcacttgatcacgcgcactttggcctaagcgaaaagtgcctaagtccctaaaagaacgtgacaggccacacctgaaaatatgggctgcagacatattaggcctaggccaaaaaatatgccttcgacaccctttaaaggatgacgcatgtaacatgctcccgagtaataaatcttccgggtaatatagaccaaatgtagctcatatgaagagcttctgatctgagtggttatcccttatgagatactccaaaatagatgtaacaattgaatcccgactggcgcaagtattcagttgataacccttacggggaataataaatagtccagtctttgagcatagaaaatagacccatgatcacgaattcatattgcatatatccagagcaagtccaaattgaaggtatgatacttgtgtttgagctaataagcccctgagcatatagcttgtccttctgtcgtagtcacaattgtccattgatggtagctgacgcagttggcatagagacaagacgaccaacatagagataatattgcccaccagaggtggcaaaaatattggtggtagtgaagataatgataccaatcaaaagtgatgaagttgcacagccgtggaggcgaagaaaccagtcggcaacagtcaggtcagccatcaatgaagatgaaggtgcccagcgataaagttatgtagccatggcagcgaaataatcaatcggtgacagacgaggcagatcaaaggcgatgacgaaatccaccaatcatgaagatgaggaagatagtcggcgacgacaaacgtaaccgacagtaatgatgataagcatcaacagagatgatcaaatatgatgacgaagttgcctatcaatagcagtagagtaagctatgataaagaggtttgacaggatgttgatgaagatgacgatgtcggtgatccagtcaatagcggtgtaatagccgatgataatgacgaagacgctcatctgcgtttgcatagtaggtcaaccgtgaaggcggaatagcaagttggcgaagtcttagtcatccattagcaacggcggaatgtcagagccgatgaagcagatgtgctggtgacgatgtcagtgacaataatccatcaaactgttgtagatgcttcacttggaggaaagtatatgctgttgttcaactcattgaatctgatatgagttgattggttgatgactccaaactcccagacatgtaaatttaatcttgacctactgctctgaagcgaagacaaaattgatgactcccagagttgacttgttggctgattaattgattgcttcatcttgacataaagcttgtcaaattttgagccatgtatttgtgtagcccccgactctttgattagttgggaaacaactgaacatagagtcgagaattatagcttcttgttgtcgagtagtcatcacttgattgaagatatgtgttgaagatgtccaagtagaaatcctgaatattggagagccacttgttgtagtaaaataacacggcatcgcatgccgagatgtcgaggttcacaaagacgtcgtggttggtgaagtagcaaaacttgcgaagcagcagcaatagagtttgccggtgccgaagataataaatatgaagtcgctctaccatgatgacaaagttgcatcgccgtgatgaagtgaacacgagtcggcggcaacagaagcaaactggtagtgaagacgcgcagttgtgaagatgaaagcaccagtcggcggcggcataaccagtcggcgacggaagacgatgatgtccatcagtagtggtagctgtataaaccagatgtagaggcgagggcactagtcagcagcagacgagacgaccggcgatgaagatggtaaggccaatcaacactggcagaatcatgcagccatggaagtgaagaaaccagtcggcagccatggcaaacgtaggcagcttgtgttgaagatactgatgcctattagtagtgacagcgatgtagccagccgtgaagaagatagcatcagttggcgttataacaggccagccgtgcaggcggtgacaccagtcagcggcggatgcggcggccggtcggtgaagacgtagacgcccaacaacggcagcataataggccagccgtgcaggcggaaacaccagtcggcggcggtcgaggcggccggtcggtgaagacgtagacgcccaacaacggcggcataataagtcagccgtgcaggcggaagcaccagtcggcggcggacgaggcggccggtcggtgaagacgtagacgcccaacaacggcggcataaaggtcagccgtgcaggcggaaacaccagtcggcagcggcgaaggcaagccggtcgatgaagacgtagacgcccaacaacggcggcataaaggccagccgtgcaggcggaaacaccagtcggcagtggcgaaggcaagccggtcggtgaagacgtagacgcccaacaacgacggcataataggccagccgtgcaggcggaaacaccagtcggcggcggcgaaggcaagccggtcggtgaagacgtagacgcccaacaacggcggcataaaggccagccgtgcaggcggaaacaccagtcggcggcggcgaaggcaagccggtcggtgaagacgtagacgcccaacaacggcggcataataggccagccgtgacggcggcataataggccagccgtgcaggcggaaacaccagtcggcggcggcgaaagcaagccggtcggtgaagacgtagacgcccaacaatggcggcataataggccagccgtgcaggcggaaacaccagtcggcggcggtcgaggcgagccggtggtgatgttctgactgatccattcctggagcgtaagagataagcttaaagccatgaatcccttttatgcatatctggatctggatcctgcagaacaaacatataggatgagtagtatctgatataaatataatactcgagaaaaaatcaagcagtttataaatacgtatttcttctcttgttaattttgatttccccgagcagatgactcattacgtttaaacactctgcccgactagtcatagccaccaagcactgggagtcggcctaagcacttcccaaacatgcatatgagtgacatgagttcgtcattaatggaacaaagtttcacggatcggagtttactactcgggtacttttgcaattattaagagcagaaaataaattatcttatctctatgcttttgatttattccgaataatacttagcaccttgcgttactcggtccatccaacgagcccccgggtgctaggaatcggcctaaaggcaactatccattggcaaaccaaacggaaagcataggaagatggaactccataactcgataggcacttttgtactcagaatatgtcgcaagcaatcaagataaatattatgaaaattgtttaaaaaatatgatataacatctgtagcccccgactcactactcaatggaagaccaattggtgtagtgaggcagaggaaaaggcaaaatatcatataaagaataaaacaaatgatgacttagctttgtaatattccctcggtgacagcaaaagtagccgatgtgggaacgaagcagtccatcaatggtgacaaaaacatcagtcggcgccagtggaaccaagccagtggtgtagatgatgaagcccattaacagcggcggagtgaccaatcaaccatataggcgaagacaccagtcggcggcgacggaggcaggccggcggtgaagtcgtagacgcccaacagcggcggcataataggccagccgtgtaggcagaaacaccagtcggcggcggcgaaggccagccggtcggcgaagacgtggacacccatgaacggtggtgtgaccaaccaactgtataggcgaggacaccagtcggcggcgacggaggcaagccggcggtgaagtcgtagacgcccaacagcggcggcataataggccagccgtgtaggcggaggcaccactcggcggcgacggaggcaggccggcggtgaagtcgtagacgcccaacagcggcggcataataggccagccgtgtaggcggaggcaccaatcggcggcgacggaggcaggccggcggtgaagtcgtagacgcccaacagcggcggcataataggccagccgtgtaggcggaggcaccaatcggcggcgacggaggcaggccggcggtgaagtcgtagacgcccaacagcggcggcataataggccagccgtgtaggcggaggcaccactcggcggcgacggaggcaggccggcggtgaagatgacgatgcccatcaacggtggtgtgaccaaccgaccgtataggcgggggcaccaataggccagccatgcagacggaaacaccagtcggcaagagtagtgccgcggcgttacatgcaaacagcagaaaataccaagagagattaatctgacatttagagatcaatctaataaacaacaataagttgaaaaggaaaaaaacccggcgaagtcggagattaaaaggaaaaaactcgccgagattgatctcttcgactgactccgagacggagcggaggaggcggaggtcgcagtcgcgggcggcgttggtgtccatcagcatgacgcaggacggcaggaaggcatcggcgtggctgcagccgtctcctatgcatccgattagatcggttttggcatgcttcgtgtttgtagatccatcttgcaacaccatggcatcctcgttgggtagattggaccagtaggcttggtggtggacgaggacgaccatcaaatccgtcgaactgtcgttgccccgtcgttgccgtcgtgctgatgcgaacaagatcaggcagagaatagcagcgacgattcgtcttgttgaagtcgtcggcggcgaggaatcaaggagctcccaaagcgaagacgaagccggcgactcataaagttgattccatcgcactcgtcgtcaggaaactcggcgtttacctctacctggcgcgccaactgtcgaaacatgaattcggcaataataaaagggggtagcgcacgagacctaaaagtggatggatgcggatacaaaggatttagacaggttcaggccctctcaatgagaggtaataccctactcctgtttggggatttgaatccgccgggtgtagtatagatctgacgatcaggttgtctcatgccccctagagggcttcctgcccaccttatataggatggggggcaggattacaagatagaaaccttaaccaacacggtatcggtttcctaaatctactttacaatattatcaaaccaggactttaggccgttccataatatacaaggaaacgtaatacccaagtcatgatctgttacatattccatacatatatgttatcccctattactagtcggataaccatgccgtgtggatatggggtacccataatctccacacttctaaagaccacatttgaatctgagtgcatatagaaccatagacaatcggttgtgctagctactccctccgtttcaaaatgtttgacaccgttgactttttagcacatgtttaaccgttcgtcttattcaaaaacttttgtgaaatatgtaaagttatatgcctacataaaaatatatttaacaatgaattaaatgataggaaaagaattaataattacttaaattttttgaataagacgaacggtcaaacgtatgctaaaaagtcaacggcgtcaaacatttcgaaacgaagggagtattatctttgtcacaagataaaaactgaatctttttatttcttgcgggcataaaaataaatataaatctgagccttgaaggacgaagagaaacaaatgcatgccttcacgtatggaggcaaagatgcccaattgccccatcattcacggaaacaggtcaatgacagcgaaacggagagtcaagatcctcgagacttcaaagagatgtcttctagtactaatatatcaccatggacttgactcgaagagcatcattgccagcacgcactactgcgttatacatgtatcctgcattctctaacaggtaataagtactacatatatatcgtgcaagggtataatccgtttcaaaatattaaataaattctaaaactgaaaatggacattactaaaaaaaaagaagggagaatagctaatgtggtccctgaagtttcgcttcgggctcagtttagtccttgaggtttcaaaacgtccaaataggtcctccaaattaatcatttgggttaacatagtacttgaaaaaaaaaatgccacataaacatgccaagtcatccttgcatacaacaatgaccattctacccttaccatataaaaa

SEQ ID NO: 66342 - DNA, 4136 bp, Oryza sativa
  unsure (1)..(4136): unsure at all n locations
cagatagagtaatggtccggcctttttgttcgttcctccctgttgtttccttttttttcctttatttgtttcttttcttttttttatatggtaagggtagaatggtcatttcatttgtattgttgcatgcaagaatgacttggcatgcttatgtggtattttttgtgggtccaaggactatgttaatccaaataattaatttagaggacttgtttggacgttttgaaacctcaaggactaaacttagcccaaaacgaaacttcaaggacgcattataaaatatgaagaagagattgtaattggttgagaaaaataaaactgatagaaaaattaaatggagaatagatatatgaatggtttgagacgtgggagtaggtgaagaaataattgtattgtaaaataatatttaaataattagaaatagtttatttttagacgaaggggatcgtagatgcctatggtgttggtgccgaggacatggagacacacataaagaaaacgttcagaaaagataggagtagctactaggccgagatggatggcatagcccatcgtacaggacgccccggtagatgggacagtaagacgctttgaaagaaaacctcagctcaggcttgctctttttttaagttactcttttttttttcacagaacaacgcaacagaatgtcatccctataaacgcatgcacgcacgtaaatcgtacccctatgagcatctttaaagactgggctggtaaatccttgagattgacgaagtcaccacaggcgtctcgctgtcgacggttacgtcaactaccactgaaagcataacgccttgctgtcgacagatacgccacctaccactgaaagtataacgcccgaacccaggaccttatatgctacactaggttacaggccctttcgagtaagatatattttttaaaattgctaaatgatatgttctgtataaattaaatttgtgttataaaaactcggacaaccatgtctgagatacccaaccatcttttcagtcgtggaagtctcttttttgaatgaagttcttctgcatctttgcagaataaatgatcactcaagcagtttgtagatgattggttacaaactttatatcttttcttataaccttttataaatatttttcttaataaataaaaattacactgctgggcaaactggcagtaattccaggaaaaaaaaactcggacaattatgtattgattgctattttattttacgtgattttacttaatcgttgtcttcggcctaaattaagctagttgtacgtagtagcagttcgatactccagtttgatacattattcattgacttgactaagaaacatttttttatatatggcgtggcgttaaccgagagagacgcggtcgcgcacgcggtcgccgctgccgtgagcaccggtgccggcggtgcgtcgcatagccatataataagcgtacgtgtcttatgatagtatgacgtagagtaggtctagtttttgcttgactcttttggaagaacggccggagaccgccttgaccaccttgagccttgtggtcgtactattggaccagccactaccacgtcggaccgtcggtacgaccacatcatgtatccaagatttaaatgaagatattatctcttttttttatagcaagattaaattgtcgaccgatatccgagtatccattttaatactctgctttagagcaagattaaattaatacagtttgaattaacttttctttgtcttggtgataaaaaataatacgcgtaagggtgtgtaagagggtgaacttctcgagcaggggactgtgaggcccccctttgttagttcggccggaggccgcgagtgaaagttgaggagttggaaggatggaagtatacggcgatgtcgagggggtcagggccctcgatgaagatgagacaaaaagggtttatacagattcgggccactaaggagcgtaataccctactcctgtgtatgatgatttttctgagcttataaagtctctgaatctctggtgtacaagctagagctaagccttcgactctagatccccccttctcgctagacatgtacctccttttatacctcaaggggttattagatgggcccaaaggtctatttagggaagagggaaaatattctctacattaaatatgtgtcttgtgccttaacccggaagtcatctgcacgtcggctgctgtgcggggcttatcaaatcataccggctgacacgggggatgcccctgccactcaccatttaatggaggaggacttggggggcatgcatgcaccaggaacacaatctcgggcatgtctggagcagtcaagccgactccagactggtcgagaggtccaaagcctctcatcattatgatgggacgggcaataccttccacacgccgcctgacacacgatcagggtgtgagtgcattgccgccgtctcatctgtcatttggccggtcatagaccgatcgcaggcacacagcacgccgcatttaatgtgacgtggtgcgctcgctccgtccgcattaaatgctaacctcatacgcgtggcggccacgtgatgactgtcgctgggggcggcctcttccctctaagctatgtacccccgggcccatatcaccgatagggcacacgatgaaagattttagctaattagctggacggaaaagagaaatatcaagaaatatgattaacatattattagttgagtattaaatatttaaaaaattaaaaaatatttatttgaatttttaaagtaccttatatatatatatatatatatatatatatatatatatatatatatatatatatatatatatatatatatatatatatatatatatatataacaaatcgtttagtagcctgaaaaacatgttaacgaaaaatgagaagtagctaagcttaaatagcacttttggatggaaggaataccatacaatctgcatcggagtgcactagcaattaattaatggcaatcgtcaagctctttttctcttagaccctgtttatatgggactaaaacttttaagtacttgtcacatcggatgtttggacattaattataaatattaaacgtagactattaataaaacccatccataatcttggactaattcatgagacgaatctattgagcctaattaatccatgattagtctatatgatgttacataaacattctctaattatggattaaataagcttaaaaaatttgtctcgcaaattagctttcatttatgtaattagttttgtaagtagtctatatttaatactctaaattagtgtctaaatatagagactaaagttaaatccctagatacaaacaccaccttactatgatggctcgtcacaaacacgcctctcaagctcttaaacgatgcatttttttttataaaagttttctactacctcggttttgaaatatatattcattaatttcacctaattcattaattaatggcaatcgtcaatctacaaattaatttttgtgtgtgttttacaattctgtgatcatatatattcataccaaatatttgtatttttttctgttaatgagtttttgtcaatcctgcgttacgggtggacgtaaacattttactgtgtccgtccttttacttccagcataaaaaaaaacatcaaccttactgcggagcactaaaaaacgtacttaacctgggtgactacacagttgcatcgcataacagagctatatatatctttattattgggatgaagttcacgcaagctgtagtacttaacctgcaactacatcgttcacactggttacccagtagtatcaatacgatgacatatgctgcgtggttcgatgccgatcactgtagcaaacctgcacggcaatgggcagattctgaagaatggattctagcgttcagagtttcacgccttgcctgagccacctgcgcccttcagtacctcgtaaaccgctgagaaatccaggtcccctagtccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 66343 - DNA, 2671 bp, Oryza sativa
agtctgcgcatcagaaaataggttttaagtcaaaaaaaaatataatataatataataaaaataaataaataataaaaaaaataaaaataaaaatacctgtgcagcagatacatcaagtgctgcccaagaggacataagatcattttcttccaaaaactccttttcaagatcaggagtaatcagaacattctcgagttcatcaccaatcgaactcagggggtggcgatactttaggtcattcaaacacaagtttgggccatgatggctactttccccgagttcattgaaattaggaagacccataagccaatgtccatcttttgcacatcgttcgctaaaaccaccaagaacgttttgtatcagctctggggaaggggttgcgatgaacggcggtgacggaggtggagttgggttcgaactacctgtagttcgaacacctccatcagcagcactcttccctgcttcggacttttcggccgcattgacgggcgtttttgccttttttgcaaccaagtctctatcagctcgaagagagtttgttgtctcaacagtatcacccacttgggtcgaacaatcttcatcgacaaccgtgttggctggggcaacaacatacagtgaagctacttcttttgccgaaagggcaaaactagcatcagcttgaattggggtgacatggatggcagaaagatcaatacggatatcatcttcatccaactcttcatcactgtcaataacaaactgcactcgtttagaactcggttcaggcggaggactgctggcagttttcttccttttcaaatcagctaaaacagtaggaggaggaactgttttgctatcatcagattcagacgagtcgctcgagttgtcgctcgaactgttactcgagtcgctatcatcactcgagtcgttctcttcttcatcagctccttcctcttcttcttcttcttcagcattttcttcaccaatttcttcgtcaacatcttccacttcaacatcatcatcatcatcagaagaagaaggcttcacagatttctttttctttagtttggggacaatttcaggataaacccggacagggatatcggagcctagagaggcaaagacccgattttgccttttcccgttttgaagtgtcaaaaatttcaaatgctcatccttggtataagggccaagaaatttccgaactgggcggaccatatcctctggaatcacaactacaaggaagaagataacaaagggagaaaataaatcttcttaactaaatcactttttcaagaaaaacaaggttcgcaaaaaaaaatcaagttcgaaaaggaaacttacgatcagacgaaaccacaaatggaggaagactggaagggcaatcttctgggatttctccaagagtgatatcccagccgctcgaaagaggtctaattttgagaagaacaaactcttccaccaggtctcggcagctaaagttcgaaacaagttcttcgattcgaggttgtatggcagtgaactccggcgacaaagagactgatggctcggagacagcttttggtttcttcccagagaacgaaaaaggacaatccttatcattcagcaggctaacagggatttgatgataaaaccacttcgactgccacttgttcccccattttgctcgaatagcagacatagctggccatggacttccgcgcttcggatgaggagcaaagtttacacacccaaacttcgagttctgtttggtgtagtgccgagtacaatggaagtatgcaaagtcttcagcttggggggtctcaccgcagcttcgaaccatccattcgaaaagcccaattcgaactaaagcattcggagtcaattgaggaaactcaagtttgaacaatttcaggacctcgaccaaaaaagtgctgcacgggaatttaaacccggcgtagaagaaatcctcaaacacaagagtgtatcccagcttgggagaaggccttgattctcccactggtcaaattacaacgtttcgaccagatatccaaccaacatcaacaagatcgtttaagtttttgtccttaatcgaagaggcaccaataccacaagaagtattttcgtggttttttgatttcttggacttcgacttttccgcagttttcttgtttttccccatgttgtgtagtgagaaaggaagaaatcaagcaaagcaccaaaactcgaatggcgaaggaagaaagagatttagttcgagtcttttgtgatttcgagttgatggcagaaaaaacgagtggtggcgtaggtcgcgtgatagcgacccctcctggccttatatagcgcagggtggtaagggtcgcgggtttacgagcggacacaaacccgaagcgacgcgaccccttaagcgcaccaatgaaataccggcacgtggcataaaaaacatttaaaaaataataaataaataaataaaaatgaaaaataataagaataaaaataaaaataatgaatagtaaacgtggcatatatgcatatttgaatagtgtgtttcgaccgaataggaggacggcggttttccccctttttccataaactcaagcacggtttcggccgaaaacacacatcgcccttacccgtgaggggcttgttgtagcagggtacaaacaccttttcctccaatttggtcaaaacactacgaggttttgcaagacct

SEQ ID NO: 66344 - DNA, 2181 bp, Oryza sativa
agaacaccttttttagggacattccataatcgctaatgcaactacacatattttggacaagttacaatttcacaggtggtttccaaggatgaaagagaaggcaaaggggaattcgaattcccaggaggaagaagacggtccaggacggaaaatgcatttttcccaagagttcgaggaagagcactcctcgaacaagagaagatgccaagggaagattccgtggggtccaccttcaaccactctcgccagctagcacctaaaagactaaaagacccctggagatgtactagaatgcccccacagacgctgatgtggcaggggcattagagtaaacttacaaagacccacaggggtaaaaatgtaatctcacgtgtacgaccaccggttataaaagccagtcaaaaacctgtagcaggacaagacatctttaatacaaaagtaatcctcaaaagttgtgtttgctgttcgagctcgtttctaaggataggcgggaaaacacttctttccggcctatccccgatcttgttcgtgacctaaggtcacaacatcggtcattagcgtaggccaaaaatcttgatgaaaataatgccctgagatgctgagaaaaaaaaattgaagttggttgttgcagatgtaatttcctaagaatcgtatacatgttcatcaggtattttagttgatgcattgacacatggaacatctattactcccaagatatgcatatacggcctgaaaagtagtagagcaaaagattagtttaggattagattctcctatatatatggtttttctcttcaagaagttgggtattctccagggatcaagacaaatgttatatatttctcaataactactaacaagaacaataggatggcttcacagtgattagtggtaatcatctgtattacaagcaaaatttagagcctccagtgatctgaaaacatcacattacctccaaacaaagaaataataataatagaaccagacaaaattttcctttgtaaagttcagaagaaagaatggatgcaaatccattgataggggctgcacaggatcaactaagaatatggatagacgccttccaaagctgccatccttaaggctagcctattaatcgactttggctacctaattcctgaagagcttctcctgatccaagacatatatgatcacgcaaggaggagacaatatgttaaaatcttcaaactctatggccaatttctgattggcaattgtgaatgatcaagaaaacaaatggtgatccacaaattgacacatcacaaaaacatgtaaaataggagaaattggtattaccttagggtttagggggaatagggctggttggccggtggttgatgtctgacggtttcaggagcagagaacagggagggggcagcagatggagcagatgccggatcggctgggcttccctggtggcggcaacctcgacggcggaaccaaccggatcgtctcggactcagcaacaagcatgaggaactggcggcgcggtggagatggctgtaggagcggtggatggcaagatacaggcgaaacagtgatgggggcgcgatcggcagggcggtggtcgcagcggatgggtggagaaatcggtggcggcgggggaagggacgacctcgggggcagcggtggactgcagcggcgatggcggatggggaagatctcgtctccggctgtgcggcttcgttggcctgtcacgaggagggaggatgcgcgcgaatcgagtaggagcgaggagggcggcggggattcgcggggaggagtcagcgcggcggggatttatgcgaccgagtcatcgcgaggcagaggaatcggtggaatcgctcataaatggcgtagaggatagtggacggatgagattagatcagatggtggatagacggatgagattagaggggatgatttcacctgtaggattggaggggtacaactcctcctttttatattagtatagaagtatagattcttttcaaattcaagacttgaaggggaaactacacagttcaagggaaaactatacattatttggtgaaaagcaaggagaaatgcaatgctgaaatacatgagttatgcattgcagtaataagctaataatacataggtactccctccgtttcaggttataagactttctagtattgtccacattcatatagatgttag

SEQ ID NO: 66345 - DNA, 1879 bp, Oryza sativa
aggcatgacaaaaacaggggaacttacttctgagccaggactggaccagatttcatgcagccaatgtaagctcgaggtttcgaccaatgcttagcatgtttccaagagttgctgcaatatttgcaatattattagtacagtgtcgctaaagttgaggtaaaattttacagcctaagttttcagctttagcttcagaagcaacatctctgaagactatgtatatatgagatttcatgaacttagaatgtatagtttgcatcaaatacttagaagaaatttaatacaaatgaaatgtctgaataggtcaaatttaagcaggaaagaattaagacttaaagaaggaagatgatgttagatcatagggcagtagttcgtacacctatatttacatgtagatcaacatccactttaatgtagcactctgcagccaacctggacaaggatttcacaaaaaatgattgtctttgcaaccaactccagatattctttcaacatgatcctgagcaatcgacagatattccaagatatttcgctgttacagacaaataacagaccattaatactgtactctaccagttaaagtaagttctattgtactacagcctatggtaattaccaatctaaagaatccaccatgtttcctattttctgcatctatagctctatcgagtatcccaccagatgttgaactgtcaaataagataaaagatgaaaatttcagatacattgagcacaagatttttttacttgaaagtaaacccaagttattgtcagtttatattgctgaataataatactacctccgtttcatattataagactttctagcattgctcatattcatatatatgttaatgcatctagacatatatgtgtgcctagattcattaacatctatatgaatatgagcaatgctaggaagtcttataacctgaaatggaggaagtagtaaattggaaactgtttagtctagtaagactgtaagagaaactctccctttactatcgtccacaatagattgcccaaagtacgtgttttctattttcctctacaaaactatgaccgataagaaatgtaattattttttcttcctcaaatcctcttctcccacctgttgtaaacacagaaacaatgtcatgtaacatgaccttttttttctgtggcaacaaagatgtgcatgcaagacaatgcaaaccgtgaggaagcagcggcaataacgattcccttgaggccggctcctagcatctcctccctcgggagcttgcaactacagcggcttgagctcgctctatagctgctggggatgaagggcagagaaaaagaggcaacatcatagacgagatggcccaggtgagcgaggaaaagtggttgcttagacacctcatataatcatgtatacaagcacatatttgaggatatctaattaattaatgcattttacattttagacttatttgtatctttagttgggatccgttgcaacgcatcaaaacagggtgccagtgtccaaaaacacagtgaattcaaccatatgtaagcatgcataattccagatcacttgagtgaagtcttcaaagcaaacgatatggaatatcagaacagaacagctgagaacataataaacttactaaatatctaaaggaactgcgtagatggaaacatagctaattagatgtcgtatattgtcagagggtcagtttttccaatttaacatttgtattcaccatcgctatggtacaacattactgattgagctacacaagctattgccaaatctcaaagatgtaaactatgacaatccatgactcgatgagtgtttatgcaacttcatttgtctagaatgaactcagcatttaaaattaaggcgaggggtacaaat

SEQ ID NO: 66346 - DNA, 2070 bp, Oryza sativa
ttgttgcttgaggactccccaactccatctcccgaaggtattggcacatcatgagaccccactttgatggtaatcacctccgaagtccttgcctccaccttaacacgctttccttccctcttttcttcattaacctgattttttccataaaaccggctattatttggtgaagacaagcgctcatgaattggcctccttggtcctccccacctttggttgaattgcattggaggcatatgattgaacattggcggtgttgccccccatggcatgtagtaaagataaggataacccggcggcggcattgggtaaggcccccatgacatgtgttgtgaatgatgatatggaggtgattgcgaccgtcttggtgaatggccaaatcgctccctaggaggtgatcttggtctttttcctttgttgcgagctctctcatcaccttgcttctcatacttctccaaaagcatatccaaagtcgccttagtcttcctaggagctttagaagttgaagcctcactcccattctccttccacagaccaacctccggtttctttggcactatcatctttggcctaggctcaccaatgatcacttctttccccttagtagattcggcttgctccggccgaatcaacaccttcttatcattgaaattaattgtattcaccggaaaaggatcatgatcaagcttcatcttagaaccatcggtgaacttcaatcgcccttcatccatggccgattgaacctgtcgtcgaaacacattgcaatcattagtagaatgagaatgagaatcatgccatttacaataagctcgacgcttcaattcttcttgagaaggtatgatatggcctttaggtaatctaatttgtttttcttgcaaaagataatcaaagattttatcacatttggccacatcaaaactatatttaacctcactttgccgatcttacgaggagtcggcataaattaaaaggaacaaaaggcttattttttgtaatccatgaccacttgcaacatacatatcatgatcaccctcatcttcactatcactagcttcagagtaatcaattgcattaacattaggcttcttctcatatggtctaacaaattttttattatccttaacccggctttcctgagccaaagccttttgcatgagttgactaacatcaagaaattgttggccatcaaatctttctttaataggagcaattaaaccattaaaagcaagatcatccaaatctctatcagttatattcaagctataacatcggtttctaacatctctaaatctcttaacataatcaatgacagattcattatacttttgcttaaccgatgttaaatcagataacctaagctcagtttcaccagtatagaaacaatcatgaaatctttgttccaattgagcccaagtatgaatagaatttgccggtaaagaagtaaaccatgtaaaagcagtaccggacaaagataaagagaataagcgcaatttaaaagtatcactattagcctctccagattgcgctaaaaattgacctacatgctcccatgtggtcctactatcctcaccactaaatttggtaaattcgggaaccctatgaccacgaggatatggcacattatcataataatcaggatacgacttttggtaaaccttagcacaattcctagcttcaatcccaaatttatccctaataatcccactaatcaattcctccatattatcaagcctatgttggtttggtagtggatttggttgcctaataggttggtgttgcggcgcaatatgattatattggccttgcctagtatcaggaggataccccctagaaacatcattataagcattaggaatatgtgggggaacttggggattatttgcagcagtagatacaggaggatcaaaaattctaagatgatacaaataactagcattagtcattggatctaccccctgaatcggcactattgcgccggtctgaccggtccagggcccggtctgaccagcatccagaggagcggtcagaccggcctgagtcccggtctgaccgccggagtaatactcggtc

SEQ ID NO: 66347 - DNA, 15767 bp, Oryza sativa
ttgaatataaaatcggccacgagagggccgagtttatttctcataaaattttcacaattgttttcaaaagatgcttctaacttattctttaaaacaatcatagattcatctattgtatgagcaacttgttgttgaatagattgcgataaatcctcaaaagttaccttatcaatagtagatgaagacaccaaatctggcttgaagatcgtgccttgacgagtctttgtacatgtcttcaaaagctcgtcggcgtacttcttcatgtgttcatcgaaggccttgcgtgcttcctcatcaagactctccctcgtaaccggcatcacgttggatggatccacctccgacttggatggcggcgacttcgtcatggcaaagttgaagttgagttgacgttgaatagatttccccagcggagtcgccaaaaatcatgttggcaactttttataacaagttgacaagcacgatcgcagcaccttacgccttgcggtgatcttagagtcgccaaccacctcgatctagcaaaaactagaccaacatgggttttgataactaaacgggctagcggagccgatttctagataactacccgtctcgtgggaaaacggaaggttttcatgacaaacctacaaagagatgttgcactctcgcagcggcggtggacgatttacagcgcaaatcgacaaagatggacaaactaagagaaaactaaaagcaatatgaaaaacgattcgattggttgattgtagattgattagttacaattgaaccggccatgtcccttatataggggttggtcttgccctctacaggccctcctccacgtctaactcggggtagaaaccaaaggaaacccgaaacgtgccttcccgagcaaggaaaccttgagacccgacgaaacacattcggactcggacctgctggtcagaccggccacatgccgccggtctgaccggccctcaaccggcggtatgaccgctcaacacacagtggtcagaccggcccactcggagaaaaccggcagacttccaaactttggcaatttttcctattttatctctaggtgccaaatttgggtgtaaacacccttctctctcgcgctccgctattctcgtccgttcccctcacccatcactgccgcgattcttgcccctgcccctcgccaaccgtcgccgcacccaatccccaaaccctaccccgccgccggcacgcccctgcccctcgcctatcaccgccgcaccactccccaaaccctaccccgctccggcactgcgggttacggatgccattgcacctcctccattgagacgagccaccatggaggccgccatctttgctccccaccaggtcgccatcctagaactgctagcagtggaggcggaggcgaccgccgccactgcaccggggaggatggccgcgaacggcatgagctcgatatccaagggcggggctgtaatgaggaggtacacccatggaccatgacggaccggtgtgtggagcggatacgggcaaggagggaatcgtgcagctggtcagggcaagatcctatctctctctgttaatctcgatctcctcatgagattgctactaatttaatggtgatattttttctaaattttgtgccaattccaggagaactcggaacctatggagctccttgaggagagggagtacgtccctgtacttgattccctgcatcagttcatcccttctgttgaggctttgagtggcaggggcttttgatgctatgtgctcttggtttgattatatttttgctttgttttggtgcatgcagcaagatcatagagttgagcgggaatgggccagaagttgtggctcgctaactggcagattgcacaggcaaattcccatatgttggcagtaagttttcccctaaattttatcctagaaacttcaacgtttagttgccaattgaaatctgtgcaatgagttattattcgtttctcgcattttgctggtgaaacttgcttattgtctcttttttgttctgcaggagcgcaaccttgggagggatagagtcagatcatggctctctgatcattttgtaaatcttatggcatctttagcatgcagctgatttgtccccaattttttttccttgaagctaaaatcattgcaacatcagtttgcttgctcgagacctataataatagccaaaatatcataattggaggtttggagatgctcctatactggctggaaattcagctggtcacggctagtaagtttaattattttctattgtaatttgccatctccagattaccctgctccttgcaataaatcaatctccctatggtattagatttttttttctactcttccgtcaataaaaacgatggcacatgattggtggagctgtataggtgaacgacggcacacatgtgttcatacttcataccggcataggggcacattgcagaaaaaaaaaagagaagtagatctcaggttcaatcgccgctgcacccagggtctcacgcatcgatctgcatgcttatttgtagtcaaactaatgcagctccatggttctgatttgatttcatttgatttgctagtgtggagattatgggtaccccatacccacacggcatggttatccgactagttataggggataacttatatctatgtaatatgtaacagatcatgacttgggtgttacgtttccttgtatattacggaacggcctaaagtcctgatttaggaaaccgataccgtcttggttaaggtttctatcttgtaatcctgccccccatcctatataaggtgggcaggaggccctctagggggcatagatgacacaacctgatcgtcagatcaatacacacccggcggattcaaatccccaaacaggagtagggtattacctctcattgagagggcctgaacctgtctaaatcctttgtctctgcatccatccacttttaggtctcgtgcgctacccctttttattattgccgaaatcatgtttcgacagttggcgcgccaggtaggggctgcgttgagcttcctatcaacgagcgcgatggaatcaatttcatgagtcgccgacttcgtttttgctttgggagttttcacttcctttccgtcgaccacttcttcaagctcctcttctctgacttgatccaaatcagtcagggggcaaactcaatctgatttttatcattatttatcatattgatttttaatctcagattaatctcttgctattttttgttgttgttcgcatataattacgcggcactattgaggcgattgatgctggtcatggactcgaggcgtctcaactttccggtcgatcggccgcgagtccactctgccggcttgtcttcgccaccgccattgctgataacaacaacgacttcaccgccggcctgcctccgtcaccgccgagtggtgcctccgcctacacggctggcctattatgccgccgctgttgggcgtctacgacttcaccgccggcctgcctccgtcgccgccgattggtgcctccgcctacacggctggcctattatgccgccgctgttgggcgtctacgacttcaccgccggcctgcctccgtcgccgccgactggtgcctccgcctacacggctggcctattatgccgccgctgttgggcgtctacgacttcaccgccggcctgcctccgtcgccgccgactggtgcctccgcctacacggctggcctattatgccgccgctgttgggcgtctacgacttcaccgccggcctgcctccgtcgccgccaattggtgcctccgcctacacggctagcctattatgccgccgatgttgggcgtctacgacttcaccgccggcctgcctccgtcgccgccgactggtgtcctcgcctatacggttggttggtcacaccaccgttcatgggtgtccacgtcttcgccgaccggctggccttcgccctgccgactggtgtttttgcctatacgattggcggacttcgccgctgttaatgggcttcatcatctacaccattggcttggttccactggcgccgactggtgtttttgtcaccattgatggactgcttcgttcccacatcggctacttttgctgtcaccgagggaatattacaaagctaagtcatcatttattttattctttatatgatattttgtcttttccttcgcctcactacatcaactggttcgccgttgactagtgagtcgggggctatagatgttatattgtattttttaaacaattttcataatatttatcttgattgcttgcgacataatctgagtacaaaagtacctatcgagttatggagttctatcttcctatgctttccgtttggtttgccaatggatggttgcctttgggccgattcctagcacccgggggctcgttggatggaccgagtaacgcaaggtgctaagtattactcggaagaaatcaaaagcatagagataatataatttattttctgctcttaataattgcaaaagtacctgagtagtaaattctgatccgtgaaactttgttccattaatgacgaactcatgtcactcatatgcatgtttgggaaatgcctaggccgactcccgatgcttgggggctatgactagtcggacagagtgtttaaacgtacagagtcatctgctcggggaaatcaaaattgacaagaggagaaatacatatttataaatattttaaaatacttgattttttctcgagtattatatttatatcagatactactcatcctatatgtttgttctgcaggatccatatccagatatgcataaaagggattcatggctttaagcttatctcttacgctccaggaatggattagtcagaacaccaccaccggctcgcctcgaccgccgctgactggtgtttccgcctgcacggctggcctattatgccgccgttgttgggcgtctacgtcttcaccgaccggcttgccttcgccgccgccgactggtgtttccgcctgcacggctggcctttatgccgccgttgttgggcgtctacgtcttcaccgaccggcttgccttcgccgccgcctactggtgtttccgcctgcacggctggcctttatgccgccgttgttgggcatctacgtcttcaccgaccggccgcctcgtccgccgccgactggtgcttccgcctgcacggctgacttattatgccgccgttgttgggcgtctacatcttcaccgaccggccgcctcgtccgccgccgactggtgcttccgcctgcacggctgacttattatgccgccgttgttgggcgtctacatcttcaccgaccggccgcctcgaccgccgccgactggtgtttccgcctgcacggctggcctattatgctgccgttgttgggcgtctacgtcttcaccgaccggccgccgcatccgccgctaactggtgtcaccgcctgcacggctggcttgttataacgccaactgatgctatcttcttcacggctggctacatcgctgtcactactaataggcatcagtatcttcaacacaagctgcctacgtttgccatggctgccgactggtttcttcacttccatggctgcatgattctgccagtgttgattggccttaccatcttcatcgcctttcgtctcgtctgctgctgactagtgccctcgcctctacatttggtttatacagctaccactactgatggacatcatcgtcttccgccgccgactcgtgttatgccgccgccgactagtgcttttatcttcacaactgcgcgtcttcactaccggtttgcttctgttgccgacgactcgtgttcacttcatcacggcaatgcaactttgtcatcatggtagagcgacttcatctttattatcttcggtaccagcaaactctattgctgctacttcacaagttttgctacatcaccaaccatgatgttgttgtgatctcgacatctcggcatgcgatgccgtgttattttactacaacaagtggctctccaacattcatgatttctacttggacatcttcaacacatatcttcaatcaagcaataactattcgacgacaagaggctacagttctcgactctatgttcagttgtttcccaactaatcaaagagtcgggggctacacaaatacaaggctcaaaatttgacaaattttatgtcaagctgaagaaatcaattcatcaacccacgagtcaactccaggagtcattatcttcatctttgcttcggagcagacattctacttcaacaacttcaaatatttcggtttagacgagttgggcaacaacatcaactctcctccaagtgaagcatctacaacagttataacattaatttgatggattattgtcactgacatcatcaccagcacctctgcttcatcgaccctgacatctctgctgttgctaatggatgattatgttttcgccgacttattatttcaccttcacggttgacctactatgcaaatgctgatgagcgtctttgtcattatcattggttgctacactgctattggctggatcaccgacatcgtcatcttcatcatgtcggttgcgtttgtcgtcgtcaactacacaactttatcgctgagcgccttcatattcattgctggctgacctgactgccgccgactggtttcttcgcctccatggctatgcgacttcagtacttttgattggtatcactatcttcactaccaccaatatttttgccacctctggtgggcaatattctctctatattggttatcttgtctctatgccaactgcgtcagctaccatcaatgaacaattgtgactacgtgctcaggggcttactagctcaaatacaagtattatatcttcaatttggacttgctccggatacatgcaacatgaattcatgatcatgggtctattttatatactcaaagactggactatttattattccccgtaagggttatcaactgaatacttgcgccagtcgggattcgattgttacatctattttggagtatcccataagggataatcactaagatcagaagctattcatatgagctacgcttggtctatattacccggaagatttattactcgggagcatgttacatgcgtcatcctttaaagggtgtcgaaggcatattttttggcctaggcctaatatgtctgcaacccatattttcaggtgtggcatgtcacgttctttttgggacttaggcactttttgcttaggccaaagtgcgcgtgatcaagtgcccaataccttaaaatccttttataccgcagttacttaactttttaggagttggtacaatgcatcttaaaaggtgtcaaacagtaaagctttatatagctgtcccgctgacttttttatatataagtcaaggtgctgtttgggtttttaagcaattgattggatacaatatcattgcttttcgccacgtaagtgtgcatttttattgaccaatattatggcttaggctgattatatattgtggtcattttctaggcggttggtaaatcctttatgagtttatttactcggattttacaccacatatgccatatatttccaggtgtggtgaaaccatgtgtcttttagggactaaagcacgtctgttaaagcagtgtgcgcatggcgtatgcccaatactttggaaatttatttattcacaacatacaagcttctttatagctgttttgctatgtgaattttcaataatgtagccaactttaggttacattcatcatattttacaaaacagtcggtatatcacttggatcatattattcagggattcacgccgcatatgctacatattaatattaagtcgcttggttgactataattatcaaaaccactcggttggttggattatttattccttgactatatgtttggtttgttcgattaaccacatagtcgggggttacacctattaggtgcatctagtcgatgcacctgactatatttttcagccctccacagtcttcagatttggtaaaagtactcgggagaccatggcgaagatgattgaagcactcggctttggagtaatctagttcgagagaaggttatctttccgactgtgaaggtctcaggggctactgtggagattatgggtaccccatacccacacggcatggttatccgactagttataggggataacttatatctatgtaatatgtaacagatcatgacttgggtgttacgtttccttgtatattacggaacggcctaaagtcctgatttaggaaaccgataccgtattggttaaggtttctatcttgtaatcctgccccccatcctatataaggtgggcaggaggccctctagggggcatagatgacacaacctgatcgtcagatcaatacatacccggcggattcaaatccccaaacaggagtagggtattacctctcattgagagggcctgaacctgtctaaatcctttgtctctgcatccatccacttttaggtctcgtgcgctacccctttttattattgccgaaatcatgtttcgacagctagattttagaaatagcttaacaaattgttctattcaggtgtctcagcttctgcctttgtttcaaatgtgtttagctgttaaagaaaataggttaggcttcacttccgagattatgcacttgtttagaaaatttttacgatctgatagtcccagtttttctgcctttgttacaaattggcaccatagataaatttgcttgtgttaaaatgtattgccatcatagcgttgtaacttataccttgccttcatggaaaatagtagtttattttaaatggaagagagtaatgtgctttgtacaaattgatcttccagatgcataggtttataaaatgctatgatctagatgaataggtttcctgtctattgttgttcatttaaaatagaaccaaatatgctgaaactattcaacaaaaaaagtcaaacagaagaattctactgtcacactgcactttcaaaagttttggttgatactggattttattatatatcagaattaaatagtttacaagaatatgagtgagaattatattattattgatccgtttctgctgtttgccactgtaccacctatgcatgcttgcctattctcttaatgtacagtcaaagttatatgtagaggcaatgggctcgattgccattcatccaaattagaaattaaatggtgcatgctttctttggggtttgatcatatatttctgtattaagagatgctgctggctctatttggcctttgatctctcggtttgtttaacattgcagtatttatttttttctttccttgcatctgaacaaagatgactccgagctaatctctcagtttgtttaaaatggtatgaaatggtaaatggacccggttagctttgtcgaatcagtttattataaaaactgatataaaaattagtgtcttctacatcttaatgtgttatatatataacggttgtactcaaattcagggttttctaatatgggtcaatagggattgaggttctgtgagatggacctaactcatttacataaacaaaattgcagccatgtaaaagcctagcgctttcagttcaaataaataatttattatcatttgctattaaatgcttaatgcctatatatttgctttgctacatatttttgcctcagtagaaaccaggatattttaccaaatatgttgagagttaaattactaatactaagtgatgaatatgtctttataagcgtgtacctcgtggtagacgaacgcactgtcttcaatatggtgcttctcctgatatgtgttcgatatagacgttcatgtggcttcttgaggtgctctataaggaggaaggtgaccagtgaggagcagaagttgctgaatatttccaggcgatgcatgtattgcaaaaaatagcacatgtaaaactttcaggtgatatttgtatctgtatgtggtataaaaagttagatactatgagctattgtttgggtttggaaatgtttcactcagagtgatgaaaatattgcagaactccattcatggccaactttggaaagttattgacagtataataacattcatgagaacaatacaaatctctctatcgttattttattcgtgatcttaaatattaccttttggtttttgcattatcaattatcaccattgcgttagcacgggtatattacatgtataaaaaggagttcaccctctagcaatcttacatgtcaaatctatatactaatataaaaaggagaagttcacctctagtaatcctacatgccaaatcatcaggttaaatccctaccgtccattcgcacctcaggtgtagtccgtaccatccaccctctccgacgacgatttcaccctctccacgcacggtctctgcgcaaagaatacgcctcgtcaccctcttaacacgcgactcgctcctcctcctcactcctcctcgcgtcgtcgtcccattccgtcgccgccgccgccgccgccgccgtgcactccaccgcctccgccgcgcactgaaccgaggcgaggtcttccccaaccaccgccggagccgtggtcttccccatctgccgcgactggccgcagcaggagccgacgtcgtccccatccgccgccgccgccgccgcaatccaccgctaccctcgaggtcgtcgctttctttcaccgccacgcactgaaccggaggcgaggtcttccccagacccccacggagccgaggtattccccatctgccgccgccgccgtgcactccaccgcgatttctccgcccatccgctgctccatcgcgatttctccgccgctgcaacctctgccccgccgatcgcaccccatcgcgtcgccggtttctcacgcctgttgccgagtccaagttgatccgattggttcctccgtcgaggtcgcccctgccagagaggccaagccgatccagcatctgctccacctactggcccctccccgttctctgctcctgacaccgtcggaaatcaaccacaggccaccagcaactgcacctgcaccctgttgctcgcatgattgtgatgacacataatctcgatctgcaactcactgtctccattttctcaagccggaacattggggatattatggcaggagcagcgtggagtcaaagccctactccgtagagggctcgaggctgcgcggatcgcttcctctctttgaacacagctggggtgtgcgacatggctgtggtggaggatctgcccccacccaggtgaaccctcactttagactgtagattgcaacagctatatgtaaattacaataacgatttctctattaatgaacctgcagtttaatctgaaaatttaggcaaaatgtaaccgttgcagtcctttgttttctttctcaaacacaccattccagtcttttggaatgacccttagggcctgtttggcacagctacagctccagagctcagccaaacagtttcagctccaccaaaactgggagtggagatgggtggagctctctcacaaaagaactagagttgtggagcgttgtttaggaagctccacaactccacgccagacccaactcttgaagctaaatttaggagttggagctgtacgaaacaggccctaaagctgaccaatcacttgtgaaggaatcctctactttgcagaagcagaagcgttacttggcatatatactttgcagaagcagaaacacaacttggcggtggctggtttatttagcaatctctacttggctttgatggccagtgtggtaattaatttcagaaatctccgattcttgttgacaaaatttcttttgcaggttgaacatggtgatttcagacatttatcaatgatggattatctgcttgcctattctttctgttacatcagttgtgggatgtttttctgttaaattaatctaggttgctctcttgatctggtctagacagatcctaagcaaaggttgcaataaggaaaacaaaaggaaaaggtgagagaggggcttagtatacctgttgactgtagctgtgtcaattttagttcaaatgtttattggttttgtcatgtatactgcactgtggttcatgaagaacacgaagaatttgtatttggtctacttaattgatctaaattatgtagaacttcatgatttccttcagtgcaaaatatttattaaaaactgccaaatgtagttttttttcttttttttttatccctataaagaactgctagaaccttttttaccacgtgcaaaataacatttgcaatttttttaacaaagaagcagtcttacatcatgtgtgaggccaggtatcaacattttcttcagtgcaacagtcttttctattctaatctgctactagaagatcatgtgcctcacattttacaggatcattgatgatatgaatgcttaaggatgctattttgaattgttggttttctcagcaaacaaaagtttccatggttttatctgatttatttttattacctcacacttaggatatatagcacattgcattatgttatctgatttggacattcttgaactgtagccctttaaaattaacacttatattttagttaaagaatcaagttttatgacttggtttaagttatacatatctttcttcaaagtttaaaaataaaaattgtaaaatcgtatatgcctgccaccttatcttgcataagttgaggctgtttaccgtccttaggaaaaaattgtccttcaggtattggaagtataacatttgtatttgattttacaatgagggcatgaaactcgctttctgctggactcaaactgaaccattttggttgataccctaacattttgctctaccatataacttatttcactattacaactttatttagactgaaaaaaatttctggagtttggtgcatagctgcctgaagcctgaaggcttacaatttgtttagttgtgcttactatttgaatttattatgttcaaagtagtttcaaaatactaatgattcttagttattttttgggaaaaatcggttatgctcattcaagaatgtatgtctaacaacacatgtgatactcttttccaaaaattatacaaatacttattcagtttgagagtatttcaatgttcctggtttagttttcagttttttctccaagtagtgatattctttggttaattttgttttttttaatgcagctcaaaatatccatgtcaacttgaagatattgtggattgcagattgtgagggttacatttgaagttattgtggatgacacgaatcaattgtgtagatacttgtgttattttctcttacttagtggagttctcttgaatgcatctgaagacaactcttttgctttgagcctttcaagtgtttgttaagttgtggaaaattgtatccattttgtaatgttggctactttgcacctccacaacaagtgtccaagagggggtaaccaaaataggctagatcatgttagaacatattgttcttaaacttgtgtatttgtatgtttcatgcgacatttattggggaaaacacaataaactatcagggtattcacatgtttcttgctatttaccatatatggaaaacgtgcaaagtgcacgattactagttttggaaagtgtaagactgcagcagaatgtgatgtaagaagactttggtagtgcatcaccaaaaaacaacagctactgcaactaaccctttcgttttggctaccctggaagtaaacaggcataggtttcaccagagtaatccgggtatcaggcgcaaggcaggacaccaaactgctaatcttccatgaatgctatgcattccaactaaaacacacgtctgatgcacgactgcatgcaggactgcaactcaaacaaagccacaacagcctgcaccctgctggcgaaaagcaagaccaaagatcgttccatcaaatgcagcataactgaataaacctttgctcccctcattctgacagtgaggtgagcactggcaactgaaaataaagcatctgagcagaccaaaacagatactaatgtactagtatacataacagtagtgatcaggcggcatatgtctgcacattccatgatctggtatactattaagcttggcagtgaatgcatatacatggcattttcacctccatattcacaaagatagtgactagtaggctgaaaaatggacactggctaattcacttaatcagttgctgtaacagatgcagcttatacttcacataatcatttcccaccatagtaaccacttatttaactgttactagaacaacgccactaatatgacaatacacaaggacaagacccttcttgtgtctgttgttttacagaaacaggaattcgttgacaaaattagaaataacaatgtttaagtagttcagttattagatacatgacaagttatcaacttccaatgatatgaaaggaggtgtgctgctagcatcaacaacgatcacttgggtatctttgtattaagacttaagagaaatagcggatgataaccatcacttgtcccaaccattttccagcatagtaactacagatttaactgttagtgaaatgatgcccactaatacgatactaatatacaaggacaagaagaccattctagtgtttgttatttgacagaatcagaaatgtgtagataaagtttgagtagttcagttgtcagatacaagaaaagttatcaacttcaaatgatatgaagggggtgtactacctgcttgcatcaactactattgcattctgcagtgagacctaccaaacctatgtaaaccaaccaccaatcaggaaccaggaacatcagattaaataaagactttatggtcgaaaagaagcaccgtgcaatgactagcaagatcaagacatcacactatcggaactttataaatgactatcggaactttttgtgctatgccttagatacaatagtttcagttacacaatgatgtctgtatcccagtctggcatcataaaaatccacttgtaaaagtacatatatgtagtcacaataccattgctgacacggatcagatgaaagatgaactgaggcgtcaaattaatatgcacaattattataaaagtgcagcattattcctgacaatgttgtgttacttgaaagccaacagactcaggcagaaggagaaggaatcattatagactcacaggaggctatatcaggcaatactgttcagaaacttggattgaacgttgatataactgggacagtatgcaggggcactgatcgaaggcatgtaatatactcaattactcattgaaaaatattaaagtaggatgaagtaggatgtgcagttaaacctgcaagttgcaatgaagctgaagaatccccaccttcaaagagtttgttatcaaaatccattgtgtttgccaaacttatctagtatgacctttcttgcagttaaaacacatggaccaaagaaaagataactggatcaaggatttgatccagagaaatttatagacattcttgaagttaatcgcatggaaaatggtgactaaatgtttttggactggtataatcaacagagagcacagaaggatttgttaagactatatattttcattttaattcactcttatattttgttaagagtatatgtttgttaacagttaaaaattgcatacttttacatgcagcaatatgggtttttcacaaaaattgcacatttacccaatgatgattgaagaaataagtttttcacattgcctgagatgatccaatgctatatgcgcttatgcagcatgataaaagaatcaaaatcatagagacactaaa

SEQ ID NO: 66348 - DNA, 2060 bp, Oryza sativa
aaaatacagcaggattaaccaaattaagattattaaaagactaatccctccatcccaaaatataatagacggagggagtaactaataagcaggagtactctactagttagagtacataagtggggatgtagtgttcaccaaagctataacggcacgacctgtgcttgatgatgtgaagcttgtcgccgttgcagcgcaccacctccacaccggtgagcatggtgcaaaaccttctatccctgtcaaagtcgcaccaagattcgctgcaggtctcgcggcgcgcgaccatgaacagcttagcgatgcacaatttgccgtcgccgaggtgcacgacgtatgaggcgtatggcgtctctagcactgcaaagcccttgcacccgcggtgcgccaccactggctgctgctggacggtggaggacaggtcccaggcaccaaagacgtcatcgttggcggcggagagaccgaaccagaggccgtgctcggggacgtactcggcgcggccgcagaagggcagcgcccagtcgccagctttgctccacgcggtgttggccgtggcgaaggagtaggtgccatagctctgggtggagaccaagatgtgggcgtcgccgaccaccgcgtacccacggatctctccgctgctgcctctgtagccggcggcgtgcacgcacggaggcggcggcaggggccgccagtagcactcgtcctccagcctgcccccattgagggggcgtcggtcacggtggatgagcgcctcgaaagaatgccccgaccgtcgaccctgacggtcgtcacccttgtcaggccaaggtgtcatatccatgaggtagagatcgtcgccgatggcgagcgccttggtgttgaatttgggcgctagcatggagggcaagacgcggacggagtgctcggcggggtcgtagaggatggcgcggcgagtagtccggtcgacgccgacgatcttgtcgtcgctcctgcgcatgaactccgtcgacccgcagaaggtgatctccgtcggaggcagggggaggtcctccaccaccgtcgccgccgacgacgactggggcacgggcagcgcatccttggggaagaagagatgtgatgggttgatgcggcgtagcctgtagggttgagggccgtagccggctttgtcgaagatgtcgaccatgtagaggaagcgacggatcatcgtcgtccctaatttgctaatgcggcggcggcggcggcgggggaagcaaaagaccggcgatgggatctcaatctgcggtgcggacgggtggctgcctaggtttttgaggaatttttttcgtttttagatttttttttaatatttacagaaataatctatcgacaaaaaaaattgcagaaatagcccctgctgccataatggtgggcggcaagctgacgtggcagacggtgggtcgaccgcgccgtctgccgccgtcggccaaaattgcgattaggcccttgccgcccatacaggggctaattgcaattttggccgcccataaagagcttgcggccgtactttggggcggcaagggacccagatgaaaaaagtacggccaaaagatttttctatgttatgttaataataaataaagaagtatttattggtaaaacttgttaatattgttataaaaatgtattgaagttggttgttgcgcaatttcatatgttaagtgaggtattattttgtaccttattcgacgtattagtactcggataatttatataggcctatcgcagtctgggtcatagaaacattatatggcacttaaacaaggcacaattatgtaacatgcaagaaatagtagtacaatttgcaacatgatacgcactatcttgcattgccggttacatagcatgcatattagcattcgcaactaggcagggcaggtagtggcaatagcttgcaacaccaacgacgatgtagtaatgggcacaaggcaagtcatgcacagtagcaaattttcaatatgtccaagcttgctccgcataataccctaatccctctacgctgaggcatctcctctcccttctctcaataccgcgcctttagctaa

SEQ ID NO: 66349 - DNA, 4314 bp, Oryza sativa
cttgttaatattgttataaaaatgtattgaagttggttgttgcgcaatttcatatgttaagtgaggtattattttgtaccttattcgacgtattagtactcggataatttatataggcctatcgcagtctgggtcatagaaacattatatggacttaaacaaggagaattatgtaacatgaagaaatagtagtacaatttgaacatgatacgactatttgcattgcggttacatagatgatattagattcgaactaggagggaggtagtgcaatagttgaacacaacgacgatgtagtaatgggacaaggaagcatgacagtagaaatttcaatatgccaagttgtccgataatagctaacccctacgtgaggatccctctcctctctcaaaccgcgctttagtaaccctgtattgctctggtagttcaagctgcacaacacggctaggtggagttagaacccttctggtgtctatccattctctgtattgacatctccttggtggttcctgggaggaaagaatagatgtaaagcaagcaaagttagtaaatgttgtgagaaaataaggattcatgtaattaaaatattcttaccatgaaatcgtcgtcaagaatatttggacaaacaaagaaccttcgacccaatgttgtaggatttatggaacgaagaacctgacaacgatcaccacacctgcatcttggacgggcttcccatggagggagtgccgtagttagcacccgccagtcgctctgttgttcacaacattgtcgttcataagccgcttttctctataagtatttctcattactttccgatgcgaaataccagcgaccttcttgtaaacaagtggttaggtcaagaacgggattttctgtatcgacccactcgatgtatgcgcaagccgtagtgcgggtctgccgaatagagtagtgttacgaagaataaagcgattgcccatacggaatgaataagcatatgcagataataaaatacctcacggtcatagttagggcacctaaaaaagcatacagtactggaaagtgaagcaagtaaacaaagagaagactactctactggccctgccccgcgccgcgaccacgcttggtcctccgggcctgtgctcgcacgtggtcctgggagtaggtgaaacgatccggtggcacagcacgggtagcacgagtgtcccgcggaggagtggcctgtgcctggtcctgcgtctgcacctgcggtgcgcctcccagctgtgaggggccaatgacgtcctctgtcgagccctgaagcgaagtcgaagtcagtgatgtcgaagagcacggtggaaggcagcaagcggtccgacgaggtccaagcatggtccagtggtggaccctgactcgacgtgccggctgcctgtgacgctcaccctgcagcctgggagaagtgggcggcctgcgtcatagcgaactgggtgaaacctacacatcgacaacgggacccttgtaagctaagacataaaatgtatgtaaattgattgtggaagtaatgttgtttttttaagtacctgtggggggcacaacagaagacctagccgaggaaggcggggtgctgaacggtgcacgaaaccctgaagcaatcggcaagtgaaacggctcacttatatgtgcgaggcatgtacagaaatagtaataaaaatacttacctccgtgcggagggggagtcggcctaggaacgtgcgcagctggacggggaccagtcggtacgggtggccgctgtacagctgcgtctgcccgagcaacgtcgtctgcacgacaggtgagcactcggagaatcgagcgcatcgactccaccatccgcgtgtacgtcgtcaggtgctcctctacgggtactggaatccccgcgctaaacgttggatcgtcgttgaaccgtcagcgacgacccggttgatgtcgtcaacctgcatggttaatttgttcgtaaatattcgtaaaatttgacgaagagaaagacatgaaaacataaaggaatggtgcgatgcagggtactcacagcacgagcgaagtcctggtcgcggtgcctggcatagaggtctctagtgctcgcaacgtggggctgctgctccaagggagcgaaggtgaccctagtacgggtgtgtggctggtaccagcgtaggtaggcctggtacgactcctcagtgtgtggctctccctcgtggtccacgacctcctcggttgcgagtaactagtcctcaacaaaagtcgccaacttggcgggccagtcgccagctgactgctgacccttgcgcgagtacctacgaattaatgtgtaatattagtgtgaaacgacagatgttacaaattattgcaacaatggaaagcgtagtgcaagatcttaccggtgaacagcagctgggacggtggtcggaaacggtactggaaagggctgacggaagccgaactgccgcatcacgcggaaaggggcgtgaggctcaacgcagatgtcgaagaccatcggaaccgtagtcatccagtacgcctggtccctggtgcagagtgtggacagacccaatggcgcacgagcctgggtagccgcggcactgtagggctcccacacgacgtcagtcggcagaaggcggtcgaactccataacaaactcaggatacgaccgcctaatctggacgtgagcccatcggcgctgcaatacgagatgatcgatgtgatgtacaatgaacttagcaattaacttaacaatacgataagatcgatgcaacgtacctgacgacggcaccacagagtacccatcgtagggtagtcgacctctggtcgctcctcgtacagtgactcctcgtacgcgtgctggtccacctcagggcggccgatcgcaatcctctcagctgcctagatagaaagaaagagagggcacccaccaaaggtcgcgctgggatccgtcttcgtgcaagactcacaaagtgcatggtacagagccgccaacaacgcggaaccccagctccactgaggcacctcgcctaccgcggcgtcggcgatgctcctggcgtagtgcacgagtcccttgtcgaccgcgtgcccgtgacggccacagaacatcacccagccaaaaagccagagcaagtacgcctccaaacatcggctgtaggagtactcgtcggcctccgcctgtagctgctcaacctgcaagcagtcgataaaatgttaggcaccttaactgcggactaaagatgtaatacgattgtcatttcggtacaaaaacactcacggtgaactgaagcaaccacctcttcgtaggtccagtgttgcggtggtgtgccaacagcttgagcgggaagtgcggtgcgcgttgtactagtgcgaaacgtgccgtcagatcatcctgccagtccacagccgtggtcactggcccaacagcgtctcccgcgagcggtagccccaacaagtacgatacgtcctgtagggtaggggctacctcactgcacggcaagtgaaaagtgtgcgtctttggcctccatcgatcgaccaaagctgctaggagggacctgtccacagtccatcgtctagccgggttcgcgtcgccggccgcagcctccaccagccgacacatcggtaggaggccggcctcacgtagcctgcaataacaaattaatatgtcattataaaaaatattacagtgcaactaacttatagtaaaacactgttcgtacctctcgacaaaggagtcgtgaaccgtgagtagctcaccgcacgtccgtgcccagaacgtcccaagctgagccccctgcaccgcagtaaggtgagaccggtgtcggtgatctatcgccgggtccaacaactgaggtgtatcctgacgtgccatctctgaaaaatatagtgttttgtaacaccctaaaaaaaaaattcgaccgacaaaatcaaaactctaaaaatacggattttcaaaaacttttcaaactaattgcatcatgccgatcttattcgcctattttacctggatttgatctcgaagattattaatcgtgagtaaagaacagttaatcaggaataaaccttaaaaacaaattggtaaaataaatataaattaaaaataaagattaggtgtggatagtattaaataaaatattatcgcgaccatatttgaatcaattaaatttaatcgcgatggaataagaattaaccctaattaaaactcaaataaattatataaaaataaaatgtgagtaatattaatctagggtgaattcattagttaagataacacgaatattgagtaaaatgcatatatgtaaaattaggaattgtggaatcaaatttatatggaaattacactaa

SEQ ID NO: 66350 - DNA, 1368 bp, Oryza sativa
aatagccggctcgcggttattgagcaccgggacatgtattacacttggctagactctaaattctttaacttgtgtgggatgggatattgcatgatgatttttatgctgatggagccacttcctgagaggcgggaatatggacgtcctcagaaaaccataacgactcaatggcgggaagctatccttgggatcacaatggatggtggacagaaccgtcattgtttaatatgaacactggtattaaaacttgatcagtccatgctaggtcttaggcttgtgaaaagaattacaaaatttactttgcgcaaaagaaccatagccatcctttgaattcctctgtcatgtgcatcattgctgtggtggcttgctgagtacggttggtactcacccttgcaaatataaaattaatcagaagcgggagatgaagcctcggaggatccctatgcctactaccaggagggagatgaagacgatggtgctcagtaggtcttagtacggtcgttgcctgtggcaatggcatgccgctgcctgaattccgctgccttatctatttctgcttttggatgtattccggaccgcccggtccgatgatttaagactacgcctgcgggcttatgatgtaataattcgtattagacactcgtgtatgtgcacttggtatttcagctatgaattcgtgtgtaccagactacttgatccagggaaatggtattgtttacacgattgattcctgttataaaaacgggggtctacatgtttcgtgttagaacaattcaaaaaatagtaatgtaaaacaaaagataacttgcaaaattatgaaatagtaataaaatcatgagattaattatgtacaacaagagtacaggctatttaaatatagcaaacgttactaatggtacataacgatgacgtgcaatttaacatatatgtagagttcaataatataacataacattacgtgtcgaagtccgacatacatcagcatacctaaagacgttaggcgccttagtccgacgttacatcacgagacctaaagacatgacatgccgaagtctgacattacacgacgaaacataaacacatcgataagttcgaaacgaattacaagcaaatccacatgccgacatagaacataagaactacaccacgtagccagacgtggcacgacgacgcctaggacgtggtcgagtggaggtagtgccttcacccgtagggcgagctccatctgctgctgatcctgatagtcctgcctccgccgcacttggtttctccttgtctttaggacaatgcttgtaggtgtgcccatgttcatcgcatttgctgcaacgcttcaccctgccagcctccgactcgtccatatcgttgcgg

SEQ ID NO: 66351 - DNA, 7924 bp, Oryza sativa
  unsure (1)..(7924): unsure at all n locations
aaataccatctccacactcgagagttttgaactggcattagttcccaataaaaaccctcagttgcccgacttactataacattgattgttatgtcacttgtctgtggatcaactctcaagcccctcattaaccatccttttatagaaggtacactcctctcagctggtctatcaattcccctttctgatacaataaaatctgacagatctaccccagttggcccgtaacggacggaatatttgtttgttcgacatatctgtcaacgaaataactagatcatattactctttcatgcaataaacatctacaacgtaatatcttcttgtgtaagccaatgcaatggtaatgtattgattccaaactagcagatctacgtagttaccgatatctacaatacgcacttctagattagtacaactaaaaccctaaaaatataatgcatttattcaaacaaatttttaaagaatacacactatttaactcaatagtcacatataggatctatgaatattacctacaatcggcgtctgaatccggcagggcttcgccccttcttctcttctcctcccctctcttctttttttttcactggaattgaggagagaagaatgagggctgggggctgggcagcaggccttttataggcagcgaggcctgccgcccagtcagagggcggcaaggggccgcctgcaaaatagccggccccgactggcttttttgcattcgggccccttgccgccccaccagagggcggcaagggttttcctgcaaaaaaccctccctccgtcaccgcccgttcctcccccgtttgccacgtcagcttgccgccccagaggtgggcggcagggtctatttttgtaatttttttggccgatagattatatttctgtaaatatttttttaaaaaaaatctaaaaccgaaaaaaattcggtttttgagggcatcatttgtgggctgcggtggtcattgggctgtatggccatgtagtaagaataagtctactctgcatccctttactttacgtcgagtttgattacatccctaatcccaaatacaaggctctacactatacaaaaccgtgaacttataggtcttatggtagtacagagcccaattttctcttacgtggtagatgtttagcgaaaacaccagtgatcgggcgcccaatcagcggtagaaaaatcgggcgcccgcctccacccgcgcgctcccgcactgtccccccatactattacaacaaatcacccgcatatcacggaaacgctctagtaaggaaatccgtttcattttttattccatcaacaatgtttcagcaagtgtactcgtgatgtttcattatgtatggatcaaatgttatagttaattgaaacatcctttcactatttgctgaaacattatttttatatattatgaaacaacgcccgaaaatgttttcattgcaaatgtttttatatagtgtgaagccaatcttgctacgacttcgtatgggatgagaggaaattcgtcatgctcactggcatgaggtggcgcgctccgtactgttatagcttcggtaaacacacactgcatccccatttctctactataacaagtagagtactccctccgtcccaagataactcaatctaggataggatgacaggactcatgccacttcaactgggactcattttttttagataatggaatatgatatcccggcctttgctcaaaaagagctacaaccaattattacaaagttccactccaaaagagagtgtagttcaagacaagttgaacacaccgaaccgaaacacaccgaaccggaaaagagaggacccatactaagaaaagcaaaacaaaatgtgtagctagaaggcctcgtcaaaacctaggactgaagttcgaagccaatgcatagaccattaacaaaatccttgcacgaacaggtttctccaaagtggtgcccccaaggaggacacgacgtgccaccgctcgttcagaaccgaacaaggttttcacccggagaatatggtagggaaaagagaggggtttgctaaaacgacgcctctaaggaggggaacgacaccaaacggcgttgccgtcatcagccggccaaacggctcggcaaggctttcgcccgcgattccctgcccaaacccacaccaccaatccgcgcaagaaggatgtcaacaacattgtcccttcagcgaatcggccaaggccaccgcccatagttcttcccgccgtcgacggcgcgcccgcacccggactcctccttccccgccgccagactccttccccacctccacatgccgccgccgtcgacgacgcaccgtcagccccgggtaatggccttgccaacccgccatcgccacagccaccactgtcaccagccgccaccgccatcgccacagccaccaccgtcgccagccgccaccgtcagccaccaccgtccagccgccaccgtcgccagccagcgccgccaggcgccagtcatccagattcagccggggtggcacggatctggaggtgcagcgcgcagcgcgggtcaccggcgtcatggaggaagctcacgcttcaatttggtgaggagaaagtctcatttgacatgaggcatccaactcaccttcctcactgtcgtatgatttgagcctgggtggatactgtatcaatagactatactatgtcaggacgggatccacttttcctaatctgttaacgagactatacctttcctctgctccagtccccttacgaaactttcgttattgggttagccatacacttcacatgtttctagcgattcacatggcactaataaactgagtaaggtcaatgcactaccccatttctactacagctagctatatattattttataaggaagcactagcggaccgatcactaagtggttagtacctccagcaaaacctgaaatcgagttgagttgaatggggttcaagtcaactagatgaagggtttctttgtagcgagggaacgctttacctttttttaaagaaatgtatgtgctcctcctctttctggacaagacatataaagagacccgccgaagatttgtgcttgtgggctagggtgaatatagcgggcgagtgctatgatggttgtccaactctagaccttacgacaaagaaagagccagaaaccttacttgaatgatccccccctccaggggtatcatcccagtaagcttctatagataaggcggaacgtccttagttcagcattatagcacagggaagaacccttctgaaaaggaatggaggtatatctttactcggagtgcaacgcagagatagagatcgaagagccggtggttcgcgaagcatctggcttaccggtcatctcccattcccgtcgtcgagagactaaaagaactatagcatgccagaaacggagagttctagcacgcacggcctttttcatatagcaccaggatgattaagacttttcgaggttgtccacgagcggaggcccctcgaagaggcgagcccggaaacattcgccctttactagaaggtaaggcgcgcagctgctggtctttcacttggaatggaacaggtttcacgggcacggcgttcatggccggagcattaacgagggcgccacgcctccctcgtggcggcgaggttcttgacacggtcaccggcgtcgcggcacgcgccgcagtccgccgccgtcgtcgcgaacttcgtcgcagccacatccaccaccatcgccaccgccagccacccccctgccaggtgtgcggcagccggcaccggagaacgctcctcggccgagccttcgctgcggcactgcggcctcctcgtgcgccggcctccgcagcctcctcaccgtccgcggccagcacacacgccggcctccagccgcgtctccccgcgcgtcgacccccaccgcctccgccgccgtggccttgctcgccgctagccgccgccgcctccggccagatccggccaccccggagaggggcaaccggatctggcaactccgtcacccgtcgctggagccagagccggagccgaccgccgcggagagccccgccgccgtcgccgtgaagagccctaccgcagcgccgtcgccgcgccatccccgtcgccgcgacctcgtcgtcccgccgccatcgtcgccacgccctcaccgggcgagatggagccgaggagaatggccccgccgccgccatcccagcgcgtcacccggctttgccggcgacgagctccggcagcggcgaggcacggaggatggaggaggaggggcggcggcggctagggtttcgcccgtgccaccctgtgtagctaagccaccttgccacctgctacttcgccgcccgctgttgtgcctgcgaccacttcgacttctctttgttctacaaatagaaaatataaacagatgcttgcttggtgattggctggacacgttttatgatattgtggagtttgttcaccatttcctagtggtgatgtttagcaagcccatgaatgccctgatgctttgtatgacaatatgacggaccatttcttagcggtgatgtgtagcaagcccatgaatgcccatgatgttttgtatgacaatatgacagatcaattttggaatgttggttccagtatgctattagagatattttaaacaaactacatgatcatcatcttaagatgccttagaatttgaggaaatcaattccatcccaataattccaccccctttctcacacaatctcatatcaattcaaaagaaaaaaacatatcaaaaatatttaataaacatcaccaccccaaacttcttccatctcagcgccgccgtcggtgaaatggggagggcggcgaagttggcgagcatcctcgccgccgtggtgttggcccgtcggcggtgacttatttactacttaaattttccttacaagtttatatatagttagtgtctaagcggtgacttatttactaaaattttccttacaagtttatatatagttagtaaaaaaaatatctatgcattgcaacaggattgataaacactttgttaatttaaacaacaaactaaaataaaacaaaacaaaacaaaacaattgcaaacacaaagtcaaaaaatcatatatagcaatgaaccaggttacgcccactttatacgtatcatacaaaaatatcccttgtatacacgtttctatagcctcacaaattaattgggtgactttcataagttaacggcggtgcattttgctatatcttatagatcaaaaattaaaattttcattattcaattagcaaaagctttttttactgtagatggaaagcatttgcaatgtaacaaaattgttgcataaaaattatttgtgaagggagaaaaaaaagaatagagagaaaaggaggagaaaagaaaaggagattggtaggagagggagagtatcagaattatcgagagaaaagaaagaagaaaaagagaacgaaagaggggcgagtgaggcttgtgggatggtgtggatcggttgggttgggctgagaggaggggttgcgctaggatatgagcgtataatagttattctagactcaaattgaattggatgcgaacggcatataaacaactcaaaaccaactcaaatacgatgacgtaccaaaatttcgacgaagcatcttcagtatttataatagtagagaagtaatggactggtttactagagaaatatcttttacaattttcgtgggcatgctttgttcggtacgagccatttgttcctttggtttcatgcaaactcctaccttttagataaacaccacatatccatccacttgattaaatgcacagctcgacattgttaatcttataatccaaagtttaatgatcgattgattgcacggatttgatagatcatgcaaactttagatcatacaaattaaatttgataaacgcataatggattttaaaaaggaaaaggtacgaattaccccatgaaactatcgtagtcgatcgaataaccccctgaactcgaaaaagtacaaaatacccccttgatccaatcctaagtgattttgtcatagcccctctacctctcttcctctatctatctcttggccagccagtgggtggcgacgggaacatggatgacaacaagacagggcgaggttgggttggatagaaacgtccccgcccccgcacgctagcgggttcacccggccccggagggaagaacgggttgaaattagtccacgcccctgggcccctccgggccccgtactccggccgggttcccgcatccccagtgcaaacggcagctgccagcggctgccagccagaagaaaagaagaatgacgagagtcacctgtagccggaggaaagcacctggaaggagagaacatgggatccacatggaccccacatgtcagcgtaatccacgccatcaccctctttctcctcttctctctttctaagcaaggcaaagcggcgggaggccggcaggcgaggcgggagagaggagggcggcggcgccgcgacggtggccggcggcgcaacatcggctggctcccggcggcgacagctgcagctaggaaacacgacgacgcgggaggaggggagcacggcgacagcctcgattcgttccgactccctcccatcgccgccttttccttttcctccaaatccaaccccccttctccggcgcggcagcgacggcgacgacaccggaggcgccggcgctccctcagctcgacaaaaggtaaccccagccatccctctcttcctccctcctgcttccgttctgaatgaaaaaacacgatcaatctgcagccatggcaaacctaggcggcgccgccgaagcgcacgcgcgtcttctcgctcaccgacgacgtccttgtttagggtggaaaataaagtctaggaggtcggtgccgcgcagaagcaatcgatggagataaacttgatttgatttgttagttcgttttgtttctctgctgctgggccatagtccggtgacaagcgcatcgctagcgctcgcgccaagcaaccaactcgatcaagttgctacagataaaatcaattggtttgttgtttatctttttattcatctgattttatctctcttccgctaatcacctcactcataatcgagcaccatatatgtttgtgcattactatgcatgcatgcatgcacgtagttgcttcaccgtccaaataacatagcttgctcttgattctcccgggcgaccgacgcggcggagccggatcggacactcccccgtgcgcccctccctctacatgcgtgtatgcaggctctaggccctaccgtattctctgctcccacctgccattacaacaaaaaaatccacatattttggaaacctcctattaattaagagaattcgttttattttttgttctgtcagggtaggttacggataaggcataccctctatactacgacttatggaatataccgataaccttcacgtgcacggatcgtttccgtatatgctgttaggaatttatctcaaactatggaaaatatctctatgagttaagaaactaccggagtcctactcggaggggatagaatctctactatatcgtgccagattacatatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 66352 - DNA, 972 bp, Oryza sativa
aacaatccaaatcatccatctcccaaagagctaaatcggcactggcaacgttgactgacctgtcagctggtacaatctcaatcttgtcgccttgccactgaatcaagcattgatgcatggttgaaggaatataacaattagcatgaatccaatcccttccgagcaacatgctgtaagaacccttcccatcgatgacaaagaaagttgtacggatagttttgttgccgacggtcagctccacattcaaaactcctttggtttctgatggattgccaccaaaatccttaagcaccatatttgtcttgatgagatccttagcgtctctgcccaactttctgaatgtagcataagacatcaaattcactacagccccaccatcgaccatcatcttggacatcggcttcccattgatataaccatttatatacaacggcttgagatgccgattttctgtaccctctggcttctcgaagactgcctgttctggtgacaatgtcaatttagccgattcttcttcaacttcatcaacatcggcctgcttgaccccaaactctgcaggcaacgtgaaaaccatgttaaccgatgcaattacaacactttttcctttggccaatctttttgcttcatcagctgtggcttcatcggctgcaggaacctaattcataacacgccactcctgctttggctttgttttctttaaccgatgatcgatttcctgttcgacctcctgaaaatgctcccgactcctcaatctttgaacccttctcttttgattctttgtaaaaataccagaaggacaccattgagttttcctgttttcattgtcctcctggctacgatcttggtttactggacccaatctttgatgaacaggaactcttttctgcctcagccgattgcctctattacatgatcggcttgaactctttgttatatcactgcatccaggacagtcctcaatagatggcagcc

SEQ ID NO: 66353 - DNA, 4656 bp, Oryza sativa
aaccgaccctgtagcttgatactcagccattgaaccatcaaccatttttttcaccatattcgacaaaagtgttgactaatattccagattgattgatcagagcatggtgcacaacatagtcaacatgatcttggaagttgttaaactgtaactgtgctgcgttaccatcttggttaagattaccgccttgaactccctgggaaccatcaccttgaactccaacaccttggaccccttgagagccatcaccttgaattccttgaaaaccatctgcaacacctttatcacacggttgggttgtgccatctggaacttgctgtacttctccatccttagaagaacctgttccgggaatatcagcaactaccttcaccttatacttctgcaccactgtccccttgcgggtctgcatgaatgagtttaagaactggttccgtgcttgctgcatcattgagtcaaaatccttctgttgatcaggtgtcaacttgtctggagtaatggtcacgatgttgccttcattaatctcagataagcctagctgctggatcttttctttaagagaacctggactagccgaggacggcgatgctggcggcttctcggccatggagaaaactgctattgtgattctaacttcttaatgaatcccaccaggcgtgccaaaagcgtgttgatgtaaaacacgaggcctgggacatctgcttaactccagtgcaggttcaaaactcgccttcgggtatgctagcgtgccagttgatttgatcctgtaatcaacaagaaacaaagacaaagaaaccgcggttaaatccataaacgatagccgatcggctaggtgccgatgacatatcatttatatttgagccgatgtcatatatgcatcgatcgacggtcattaataaataagaaggaactaaatcttattcgatcggctgtagatattaacgatatatagtccttacatcgatatatacttaaatcaagtgattgggatagatcagtcgccatgccgagacagtataaatcacttagatcgaaatatatattaataataagactatatatgttcatagcatagccgatcagatagatctagcatgtatcggccaatactccgatactactctatattaagatattagagcaagtagaatatactaaacaaaagcctaatatacttaaatgaaacaagatcttaatataaatggcagattcaacatatcaatgaagcatataagggaaatatagttaaatcaggtaagatcggctgaaaccccgatgctaccctaatcgataaccaagaagcaggcaagagattgagattctaatcacgactcataagatcaaactcaactgatgcagctataaatatgaaaagaaggacaatatctaaacaatcaagccgttggatgtgtcatagagtggtggatatcttatataatctaagtcaacataggtatttaacctaatcggctgccttctatcgacagatgttagccgattgtaggttagatatcgatatcgccagagattatgtatggtatatgataactcgacgaattacataaacaagattagagtgtcataaagatggaagcactaatcccgagaacacaagccgccataacaagttttacctcttgttgaagatcgaaaccgatgcagctcaacccgaaagcaagaactcgtcgaaacaaaacgaaagtaaaagggtggcgatgcgccgagattgtattgaacgtgtgtttattcgattacatggggttcgggtctatttatacccgagaattacaagatatgtccataccagacacgactcttatctctaacaaactctaagataccataagtcttcgcggcagacttttgcccaaacttatctctaaggaaattacataaaatatcctaattaatagatacaattgacttctcaggactctatccatacgcggcaatcatcatgaagcacatcaacctaaaccgacaacgtttgctgcatcatattgtcggattcggctcaatcggctaacactgtccgactcgaactctgccggtcttagctgtagccgattcagacttcagccaattcttactctgttttcgcgacactcttcatctttgattctgcttcgatctaatcttcttttccgatgctgacattaccaaatttggccgttaacaaggtgacggctttttatagcatgaggaatgacggttgcgacggttggaaaggtctgtaataccctccaacgaccattgggagtgaatccccaccgtcagattgaaatctttcatccagcggcgcaaagggggttcggccgaaccaatggcccaaccggccccgctcttcagcaggccgtctcctcgtgggctcctcaatccagatcagtgaattatgggcctatttgatcgtgtcaattctgagtttctggcctatctctccacaagtctgattcttgacagcgtctgattgattgtccgagtgttttgctgtcggttctcctccattttgtacctctttctctaaggtagatagaattcatgtacaaatggaaatagattattctaaaacaaaatatacattgcaagcatagctagttctcctttattttagctatattgacagtcggaattggtcaataacgaccgtcaacaattttcaaaaatgactgtgaacccaaaaacgcttctggaaattttcggatttgtccgaaacattttcggaatctcctaaaaatcttcggttgacttcactgttttgctgttctggaaattttcggatatgtccgaaattaattttcagaattttcgaaaaatgcaattattgggcataacaggcaaatctggagttgtggctataaatagcccactccccttacttgtgagggctgctggtcacattggatattttcatgcccttggcttgttcatcttcagattcacttttgagtcttgctttcttgtttccctctcacttgtgtttgattcggattttggtctgtgtttgagagttgtggattcgagtttgtgtgtgtgcttgttgtaggcttcgtgaagatttgtgagcacttgcatcatctccgggagttcctttgattatttattactcttggaggttgaggactcctaggcggctaggtgtcagtctcgagtcaccgatctacgtgtggtaggccaggagaagtttgtgaagatcggatctcacctccgaaagggaagagataccactagtgaaaggaggagtgctttgtgcaacctcttgagcaaagggttagtggatacccgactctttgtgagctcgtcaacgtagagtagaatcccctcaaggatttgaactcagggaacaactcatcgtgcaacaactttggtgatattacttccccctctcctctagctttgcttgattgtgtcgctaaaggtctagttgcttttcgtgatagcatattcttgttgtaggcagctaaatctagaatttactttgttttgcgcatactctgctattttcggaaattccgaaaatccctacttccgtatttacttgagtttttgaattagcctattccccaggcctaattgaccctttcataaacctcagcgccattttagctagcgctaagtgcccagccagggaccccgcaacagggttgtttggcgagccgggcggcagcggctaagtgccgaatgtcagcgccaaggaaagtggcgctgagctgtagatgtcagcgccaagctccttggcgatgagacccctgccacgttggctgggccatgctggcagcgctcagcgccaaagcggttggcacggatatggccaagctccgcgccaggaggcttggcgctgagcccatggcctatttttggttaaagttctttgcgcgggctaatttcgtaataagtttttcaaaagggtcaatttgtaaaaaaaaagaatggcaaaaactgccatgtcggacgaaaccgcctcctaaaccacggaaggagatcatttacaccggttttcaaagatggaacagacgttatacccggttttgttttgtagttgagggatagattcgaagcaagagttgagggtggtaaaataaacttattcctgctaggctagggaaaggcgcattatgctggacttgggactgggccaccgcccaccgcagtccaataattacggcgttaaagacctagacgaaggagtggtggaaaggaagcagcctcccagattcccacccccccaccatctctccgtaaagctgacggctttgggaaggcgatgatccggcgattcctgtatatggtcgacatcttcgacaaatcacacggccctatctcccgcaggctacgccgcatcaacccatcacatctcttctaccccaatgatgcactgcccgtgccccaatcgtcgtcgtcggcgacggtggtggaggacgcccccctgcctccaatagacatgaccttctgcgggtcgactgagttcatgcgtaggagcgacgacaagatcgtcagcgtcgacaggactactcgccgcgccatcctctacgaccccgccgagcacaccgtccgcgtcttgccctccatggtggagtacaagttctggaccaagtcgttcgccgtcggcgacgatctctacgtcatggagacgataccgctgcctgacaaggtggatct

SEQ ID NO: 66354 - DNA, 2624 bp, Oryza sativa
cgccgccatggctgacgactgctgcgccaagttctcctcgagcagctcgccgcagttgtcgatgaggaagtggcgtcgaatccggcaacatctgacctgctgctgcgcctgcgccactgtcaacaatcgatttcacctgccatgaaaaaacaaaagaaaggtcagttattccggttccctgccttattcgagaggaaaaggaagtattggtgtaggcgtttagctacaaatatggtcatgcagcggcgagagcagagctgaggcatcaggcgtggtgcgcgtcgcttgatggtgcttgccggcactgtcagcaaacctggcaagaggaccactcgatgatcttgtgaacatttacagacggcttttgcatcattaagggaacttgttgcatcatggatgactaggatatcagaagagtgcaagttgtggacttcttctgctctatccaaacaaggaagacttcagatatcctaatatgcatattaatggaatttttagaaataaaattttcagctcctttaactttctgcttcaaatgcatatttcccattccaatgctcctaatggattgtattttgtctcaagcagttgttttagtaaaaaaattgtatgtaatacatgagatagcctgggacagtaatagctcaagaaacaaaactctctttgagcacaaagagaaaagtcctttcaagccgtgagaaacttttgggtacctttttggcctcctatcatatgagctcctttttcttctcccctgtaaatttgtcaagttctacctcactgtaagagagaggagatagagagagatgtactaactgatgaactgatcaatacaagtcctaactgatgaactgtacaaattatatgtgttgcgggagcgagaagttgtgcacagctgagttgggatcagatcatctaatgcttactggagttcaatgtggttattttctatccacgcgatctcaagactttgcttaggggctattacaaacacgagctaggtgggcgacggacctcatattatgacatcgaagtcacttctgactgaggtgtgttttgtcaaccttcagtactcatgtttcatatttaaggtcaatgtgtaatgtcttttacatggctgtttatatctcaggcaagatagtttttgcacttgtaccagcatttgccaccacttattcaattcataagatcccactagccatagtggcaatctcaaaaccactatacatcagtgaatttccatcttatatagctagcttgctggaagatgaggaggtgaacaaatccttcccagatctgtacagttggttctgaccctgagccgcttctagacactacggcgggagttctgcttccattgcctccagattcctgcaactccatatacggcacatattctgttggtgtattccaggtataagtttgttctttgctctggcctagatttgcagttgtttcagcttctgccttatcttagttattcgttttctttagtgtgattcaattctgtagctaccattcctaaagtttgcgttggctccccttttttttcaattggtacatgcagcaggctaggatatcaaggaaacaaggggttgatgaggtgatggacaacagtgcaggatcaacaatgagaacaggatggagcggagagatggatcagtagttcctccaatctacaagtgcatactataccgaacgccacacatgatctccgtttaggatcctcagtagtggtatgtctaacatgatgtggtgatctttgtggaacaggcataggtttgtgtcttaggtgaaaaatagcacatatattattctgatgagaatatatttgttggtgctattttcagcaacacctatgcatttggtggattaatgtttgccaagcagttctattcacctaaaagtcttgatgataccaaaagttggttaatggttatagtagtgtacatggacaacgttgcatagattatcttatctgtttttgcaaggggatattcataccaaattttcttatggatacttctctaacaagaaaaatagtgaattaatttgccctgacaatgatttatctggtatttcctgccatgcgtgtagctgtatatgcggttactctcaggaaaattgtctttgtttgggatgaaaatatgctatactccagatctaaggtgagaagagtagtcacattttttattctctgatttctcaagcagtatatttcactggcagaactagatcccaatacaatttcagtcctattcttttcttcctagactcagctcatttatatgttacttggaacagatatcagtacaatatcaatattttttcatttgattttcgttgtcccgtcaatgtttatatgttagcttatgggacaagcatatatatgaacaggtttaataaagcctcataaaggaaagttgcttcatgattttaagtcccaatggtatttttggggaaacgcttcacatcgagcgtccggagtgaaacaaaatatcgaaccaaaatgtctggtggggcctactattgatttaacccattctttacctccctcctctaatcctgcgaccaactaaccctaatcccatttcctcctcgatccaaatgccctccgtcggcga

SEQ ID NO: 66355 - DNA, 2691 bp, Oryza sativa
acgtgcttgccttgttcttgacctgttgatcacgcccctgcaattccttctctccaaacatagcaaactgaaacaactggttcacagtgttaaattccatataatcaactatgtcctgaatatcgcgcctcaatctcgagtaaaaacgacaaatagaatcttcggttccctccactatgctacatcgcatcaatcccttttgtagctcgccatagtaatcatgtacagatttatcctcttgttttaaacacataagtttcttgcttaaatctctaagataagatggaggaacaaatctatcacgcatagctaccttaagttctttccaagtagtaggtaaagctctcccacatctaacccagtccaccaaatataagaaaaatctttaaacttactagtagcttgtcgaactctatgctgctcaggcacaaggtgggcactaaacttttgctctactgtcatctcccaatcaaagtatttctcagcatcataataacccaaaacagatggtattttaaacttaaccttagaataaggatcatcaggcacgcgattattgttaccttgttggtatcgttgattttgagcaccactcatacttgtcattgcaaacacaaaaacaacagcaaacagtgaaggttatccctaataatctgctacgcggtgtagtggtgcctctcaacaactcagccaaatggagcaccttaccaagctcttacaagtgtcttaccagcactgctaaggacggtacaaccggtggctggttcgtgacaccttgaaggacgtgatgtggcgattgcaaggatcaaagtggtgctgaccagaagtatatatgtgaagcttaggaggcacaatatatagtagcaaaggaacgcaattgtgctaatcagaaaatgcaaagttgaataataattcaaagtactagtcaatgtgctggcctagcttagactcaactctagctcaaggaagcacccgacaacactaaggactagatatgaatcaatgcacaactctacactctgaaaacatactcaaaggatgaatgatttttttttctttcttggtgcggctttttttaagcacatttctgccttttttttctttttctaaggtgcagttttttctttccttttctttgcacctttctgccttttctttcttttttttattttttactatttttttcaacaagaactgaccattgacctcaaacagggtctcaaatgtaaatatgaatattacaggtacttaaatgctaagtgcaaaactaaaattagatcacctcaaaaatggaatgctcatgtcatgtaggttccgtttttataaaaatatctcaaatcggcaaccactaaaatacccaacaatgtgatgtaatgccctagaaaaaaagtagaataccgtagaggatatattggaagtccctaaggttttggtgtttgaaattagaagaaaaacaatagttatacgctagctgggctagctttcggccagcccaaggcccaggtgccccctccacaccccctcaaaaccctagaagatcccctcacctccccctagccgtcatttggtaccctgggcgcccacctccccctaggggtgggcagaaaaagaccgaaccgaactaaccgagaccgagaccgaaaaattcggtcacaaattcggtcatcagttgtaactaaccgaattttatacagtcttttcggtcatctcgctcggttaaccgaaataaccgaactggccgaatcactgtaaaggcccaataccagcccaatagcccattagctagagaaaaccctaaccttccttcccacatcacacgatccttcccagtccccacaaccccacatgcgcgtgcagatgcaccgcctcttactcgctctttctcctcctcctccccgcctcctctccgctttctcctcctcgcaccgctcctctccgccttcttctcgcgtcgcgccgccgccttcctcgcaccgtgcctctccgtcttctcctcgcgccgtgccgccttctcctcctcgcgccatgtcgccaccctctacccacacatctgcgcgcccacgacctgactcctgaggcctcgatgacggaaggctaatgggagacacaagatggatgggatctggaccgtggagtggttgagatcgacgggatcaatggctggattgatttgcttgatttgattttttttccatgaatcatgctctacttgctacttgttgtggcatcatcaaattttagtccttcatcccagttgctttttcattcatcatgtacagagttctttttttgcaattattttttgggctgagttcggtctttgaccgagaccaaaccgaattaaccgaagaccgaaatactctatcttgagttttcttgaagaccgatcagtcttgtgatcgtaaagaccgaatttttcaaaagactgaagaacctaaccgaaattttcggttagaccgaatgcccacccctacctccccctctggtcgacctcccccatgcctgccctactgcagacctgggaagaagaagaagggaaggagaagaaagggaaagaaggaagcggagggaatcgaggtgaagatggaaatgaagggtttgattaccgctgcccatggaggctttccccctgttttggttttctattagggtttagatcaagtgttggaagcgagtaagtttgggatccac

SEQ ID NO: 66356 - DNA, 976 bp, Oryza sativa
gggtgggttcccagcgtagaaagtgaatgtgtgattcttgaatgattatatgtgtgttgtttgaggctgagtcggtgtttattcaggtggtgccacttcggaacgcaactagagttcatctcgccatcggagaaggcaagtaacgtagcggtggtttgctataactttgacttgttatttgattttacctccacgttgaaattatatatcatcaaccaagattattatatgttatacataggatttacctatatgaatcatacttattgattccttcttgtagcataaatcaaaccttcaccctgaacacaagaaaacactttcggcgccaaatagcctcttgggctaaaccattataccaactaagcttgggcaaagctcaaccttagcaacgggaactggctttgtcatcatatcagcaggattatcatgagtgtttatcttgcatacctttagcttaccttgtgcgactacatcacgaccataatggtacttgatatcagtgtgttttgtcctctgatggaacatctgatctttagtgaggtattgttgatgcaaaaaacacacgctggcctggaagatctgcttagctccagtgcaggtccaaaggttggtaagatgcaggcgtgctagtcagtttgatcctgcaactgacaagatatgaaaatagcagatcaatgaaccgatcggctgacaagccgatggagcaattccagccgatgccgataccagccgatagcgatagggttttgagctatcggttgtatgtccaatgtagattctgatacttgatgtgaataacaatataaaggcaatcagctaataatgataaataacaataatataatccagtagaaaccaatcggctaacaatatgatataatagaacaagtattgatctgaaggttaaagcatacatcggctggaggtccgatgtcataaaatccacaagattagatagatcaatgaaaccttt

SEQ ID NO: 66357 - DNA, 1135 bp, Oryza sativa
tgcctcatctgttgcttcaacgggacgcacgcccaggattcagtgccaccgctgccatggatttgagcatgtgcagaaggtttgccctagtcaacgggcatacgctgctacggaagatggctacatcagcacctccgatgttgaagatgatgaggaggaagagaagaaagacgaagagcaaaaagacctatccatagctccatgcatgcttgaagaatgttcaattggccaagcacctataatttatgaagatgagaataaaggtaatggtgatggtgctacaactaatcaaggtatgcatatttatgatgtgccaactatgtccactacttgcgctacattagagcaacccatagtggaaacaattgttgaaatacctttgtcacaaaacaagttgcttaatgtttcttgtgataaagaagagttgtgcgatgcttcacttatatccatgccacaactagtgaataaacatgttagttatgttgttgaattgccatgtgttgagtttaaacatgttattcacattgctagcaagaatgaagagcataaatttctatcttctttaaatacttgagaatgtaatgtgcatcgagtatatatttgttcgaatttaactatacctccttttcatgatgaaatgtattgtctagaggaacacatgcgtataagtaattctctatctagttcctctagtggtttaaatgagttacatgttggtttgcaagaaggggaatgttgtggttttcgactataaagatttcaggatccaaccatatggccatcaataaatgttcctcaccggatgttgtgatagataaagataaattcaatacgctccatgacaaggtgaaaccgaggacggtttccaatcaagaaggggaggatgatgagaacacaactagctcggatataaccatgactagcttatgtattaatcaaccaaaggcgcatatgttctaccaaaggaggaagggttaaggatttacccggtgtgagatcacattattcgaggagccctagatgctgtctcagtaaagaatcgtcaacaagggcgttctagtgcgttgtagattcttatccaagacttgtatcatttgatgatgtcatgtgaatcactagaaacatgtgaagtgta

SEQ ID NO: 66358 - DNA, 2956 bp, Oryza sativa
cccccggaggtggcttgaatttgcatcgtattgataatgctcacaactatgaaactcttgtatctagttagtagctagaaattttcagataaatattcacacgataaacttgggagcacaatatttttgcccttgttatatatttccagttgtattataatacaaccgatccccccccccttctgcattgtacttgttttgggtaaatgctatgccggtgatctgtcaaaattatcaacagagtagtatagtgggtaaatctccaatctgtcattttattggaagcagtagcttgcacttcagtacaagcagtagggtttttcagcaagctccagtaaatctttatgtcctatcaagaggatcatcgattcgattcacaagggaatgtttgctacatggaatcaggaatgtttgcttcaaattagttttgtcatcttgagctgaaacaaagggttgatggaattttggccattaccaatctgcgcatgcttacagtctctgactgcctgtgctagtagaaatctgtcattgtttccactcatgactcatgtagcagtaattatttttttgccgggtcggtgaacaggaatcctactttactttattatgggaggaaaaaaatacagtaaaacaacaagcatggttattgccaacttgccacacagtgaaacctgtcattgtcttatctccactcatgtaactctaaacatagtacatacttgcggtgctgtactggttagagaatcagcgagtagaattatctctcgagcaccaatggaagttgcggtgtgagagattgctacagtctactggttcaagaaccagcgagcgagtagaattatctctcgaacaccaatggaagtcgcggtgtgagagattgctacgattttactgattcgagaaccagcgagtagaattatctctcgaacaccaatggaggcgctagagttggtttattacatgtgtatctcatgtggccagcatgacttacatacccaactcgtagcatatccggatgtctgtccgcgatcatgtcgggtgatcaagccgacattgttcgtgagcaattatccgttaacaaccttttctcgagtagtccagccatggccggtgtatgagataggtcgtcggtcttcgttggttggttgggcgcgacgactctgcatttgtcaagaacgttcttgataatgcagtgtactcgaccacatcctactcaagtgctcaattgttcctgaaaaatactttctagaaggcaagatatatagcagagaatatcgagtaggtactcaaagaactacatggatcttctagtattatcaggatgctacgagcagatgtaaatatcaggcattacgtaaaccgtaaacaagcatgattcatacagaagagaacagagcaagcccccagcgttagaccgtagtcggtttaacgtcggaaatactcgtgcaatagatattgtataaaagacatgctctaggtaaacataataaattatagatctgacaattctgtatgatctgaataggtatgataaattgcatataaaatattgcgtacctttgtagatacatgccggatgtatctacgaaattagtagattaatttaaaaaaccaatctaccaattactcttaccgcgtacttgtttgacatcatatgatctgacgtcttttggtacgccgcgtatcttgaggtttggtcgatctcgagagatcgagttgttgatgacgatggttccgatctcgtcgggagacatacttcggtcgggttggatcttcccacagcgaagtcgtcgaatagcttgttgtcagagaatccatcttttgaacccatctcgtcgaaaccttgaagtaccaaactccccctacctagcgcgccattgtcgacgtttgatgtcgcgattccggtatttgcatggtacggggatcgttggtactaggatatacgcgagactgagataaaagagatggagacggggatttttatacaagttcgggccccttatctgacaagtaatagccctacatcctgttggccaaagccggttattgatcttattcatcataaccacaccagtacaatgtttggagtagcctatctaactgttgtcgacatggcggtctgaagatctgactcgtagtcgacaacagagtagcctttctcctcgaatccgtgcccggcgagatcagagatagcgctttcgtctctcctgacagtatccgaagacaccgtaggggactagccgtgcttatcgctgaagtcgatatccggcggcttgtcttggcgtatgtaggcttgtggttttatggcgtctatgttgtccgtgtatgttgattgtctctatatcccctctcctcctagggggtcttgtatttatactcataggtgtcaccttgtccaagtagaactaaggaaaccaatatgaatacaatccgagtagtccttgtcgtttccatgtagaactctggttgtcttttcttatccggaacttcatccatatccgaggtcagattccgtataagacatggtatgtgacgggtcctgtcgagatttagtcaactattattagatatatggtatccataaccctgacaagattaatatgatttttttcaaacaactttcgtatagcaaactttttgaaaaaaaacacaccgtttaacagtttgaaaagcatgcgcgcggaacacgagagagagatgttggtaactaagggtaccgaacacagcctgagtaaagtttgaggcagcaaaaacgtcggataggaatagttggatttatactgtttgcttgttgccgtgggatgcgttagttggttcggcatacgatgcgatgagaaggacggcgatttttttttacggaagaaggtagagcgcgctccaccttataatcatttcattaatagatcatttcattaatagaaatgaggttttcaggttacaagttagaggttatagt

SEQ ID NO: 66359 - DNA, 2507 bp, Oryza sativa
acagttggggtcatcagcccttggttgaacaaaaaggcattaatggcactagaccagaagtaagaggcagctgccattaggggctcatccttagctgaattggctatagtgagggcgagtacctggccgattccaatttcatcccaatgaacctgcttgctagccgatacgcgcttataccatgtggtccagcttttctcaggggaggttttctcgagggatggccaagacttgaaggtgttcttccaatcgctcagattagggttcgctaatctaaaggggattctgttggttttggcaatgatgaattcagtagggtcggaatcaccaattggaccaaggaaatagtggttgtcatgcgacagacttggaattgcaacaagattggacagatgctacggatgcaatcaggaatagagaagaagaaaacaatataaggcaggagaaaactaatctgttgcaaaagagagagatctagccgatgagaacttacctcagtgtactcggctaatggcgcggcagatgggctggcggaacaagacatcgccgcaggcggagatctggccggagatgaagtcgcctgggaatcgccttgtgtgtcggagaaatcgccggagagagagaaagcatagttggtttcggcggtgaaaacgggagaagacggtgtgatttctcgggggtaacggttagtatttaaagcgctggaataacggtcgggaaaaggcaagagcggatcctctctcggaatcgacatatggcaaatccgaaacattaccaaatattccggacttgggggtcatgtgttaatgatcaaatttggtaattcaaagtatcggagattaagataaaatcgaagcggaatccaagagatagatcgttccggaaatagagcaagaatcggctgaagtccgaatcggctgcgaccaggtcagtagagtttgagtcggacaaggtagccgattgagccgatttcgacaatgtgactcgatacacatcgtcgggttgagctaatgtgcttcatatggattgccacacatggattgagtcctaaaaatggcaattgtatctattaattaggatattttatgtaatttccttagagataagtttgggcaaaagtctgccgtaaagacttatggtatcttagagtttattagagataagagtcatgtccgacaaggacatatcttgtatctcgggtataaatatgacccgaacccatgtaatcaaataacacacgttctatacaatctcggcgcatcgccaccctttttactttcgtttcatctcgacgatttcttactttcgagttgagctgcatcgtttcgatcttcaactagaggtaaacttgtcatggcggcttgcgttctcgggattagtgcttacatctttatgacattctaatcttgtttatgcaagttgtcgatttatcatatatcctatataatctctggcaatattgctatttaaccctcagtcggctaacgtctatcactggagggcagccgattaagttaaatatcaacgttgacttagattatatagggtatccaccaccctatgaaatatccaacggcatgattgtctagatattgttattcttttcatacttatagctgcatcagttgagtttgaccatataagtcgtgattagaatctcaatctctagcctgcttttggctgccgattagggtttcatcagggtttcagccaatcttacctgatttaactactttatatcccatatgcttgattgatatgttaaatcttatgttaagatctcatcacatttaggtatattaagcttcttgtttggtatattttgcttgccttaatatcttaatatagagtggtatcggagtattagccgatacatgctagatctatcttatcggctatgctatgaatgcttataatctccttgttaatgtatatttcgatctaagtgatttatactgtctcggcatggcgaccgatctatcccaatcacttgatttaagtatatatcgacagaagtattatataccgttaatatctacagccgatcgagtagatttagttctttcttgtttatttatgactgccgatcgattcaaatatgacatcggctcagagataaatgatatgtcatcggcgactggccgatcggctatcatttatggatttaatcgcggtttctttgtatttatttcttgttgattgcaggatcaaatcaactggcacgctcacgaacctaaaggaaagatttttggacctgcactaaagttaagcagatcttccaggccactgtgtgtttttcgcatcaacaagtacaagtggcctaacttatagaattaattgctgtacccaatgctaatttaatctatggacttcaaagtactagacacactatttatatggactcatttttcgaatttactaaaattatgtgatggttctgcgttttgttttgttaacaaaattggtgatatttttgaattcaatgttcacctacagagattattgca

SEQ ID NO: 66360 - DNA, 1628 bp, Oryza sativa
gtttctcattcagccttgcttcttccagatatttagccatagtttcctcctttgcttcaaaggatttggaaaagtgacctgctaccaactttgagtcagttttgactattaaccgccgagcccctagcgctcttgcctttctcatagccaataaaacgccttcatactctgctgtgttgtttgttgaaggaaaagctaattgaacagaatacttcaacgtttgcttcattggtgttttcacaattgcagcggctcctgctccggcggcattgcatgctccatcggagaatactatccatggtttttcgacttcttcctgttgttctacctcattgggagtccattctgccacaaaatctgctagtacttgtgactttatggctgttcttaatatgtatttcaggtcaaaaggtaagagttccattgcccattttgctattctccccgcgacttccttgtttgttaacacttctcctatcgggtatgccgatggtattgttatgtcatgcgacagaaaataatgcctcaactttcttgaagccatcacaattgcataaatcaacttttctacttctgagtatcgtgtttttggtccttgtaatgcttctgagacaaagtataccggcacttgcctattttcttcttcttgtaccaaaactgcgctaactgtcgctggagttgctgccacatacattaacagaggttgaccttttggcggacttgctaatgttggcatttcatgcaagtatttcttcaagtcatcgaaagcttgttggcattcagcagtccactcgaaggtgtttgcccccctcaaagtcttgaagaagggtaatcccttttctgctgatttagatagaaatctactcaaagatgccattcggcctgtcaacctctgcacttctcttgtgttttttggcggctccatttgatggattgctgcgattttgtcaggatttgcctctattcctcttttggacaccaagaaaccaagtaactttcctgctctaacgccaaaaacacacttttctggattaagcttaactgagcattttctcaggttttcaaatatttcttgcaaatctttgccatgggtaaatgcttgtttactctttaccacaatgtcatctacgtatgcctcgacattccgtcctaactgcttagccaaaacttttcctatcagcctggcaaaagtcgctcctacattcttcaaaccaaatggcattctgataaaacaataagttccaaatggtgttataaatgatgtcttttcctcatcctccttcaccataaaaacttggtgatagccagagtatgcgtctaagaaactcattagttcgcatccagctgtggcatctaccaactggtctatccgtggcaaaggaaaatcatcttttgggcatgccttgttgaggtctgtaaagtcaatgcacattctccacttgccatttgccttctttactaacactggatttgccagccattctgggtgcatcacttctcttatgactttcgccttcaacaacttttcaagttcaatttttgcagcttgttgtctgtctgtagacattcttctcaatttttgttttttgggcttgtatcctgacttaatcgctaggttgtgctcaatt

SEQ ID NO: 66361 - DNA, 891 bp, Oryza sativa
ttacctgtctgacatatgcttttctttgcctttttgactcaactcctaatgaagagcccccagttatggcatttatcactctctttggcacttcttcaattgcctctatcttcataacttgcggtgcttctatggcgttttgtcctcgttgatcacgagctccttcatacttgttctcatatcgatttacgtgtttttccaacaagtgagtcatttgcctgcattcttctgtggaatggcctcccggaccatgtatatgacaaaacttactgtaacattcttctgtggaatgacctcctggtccatgtgtttgacaaaatttggtttggtcaggtttattttctcttccttttcctctttcattgttccaccatcgtcctctacctctgcctgaattccaccattgtcctcgaccttttccagattgcccccaattgtcctcgaccttttccgatcctccccatcaaatccggtggagctcgcacggtcacgtgaccatacgatgacagagccaatcctcccccatcaaatccggtctaatctttctcgatctccaaaggtctaatctttctcgatctccaaaatttgttgatagcttttgatccactcgatctcctctttccgttttctagtcaaaatcgaagcaatcagagataaaaacaacgacgttaaatggtgggcgttggcaataaagaaaaccagaacaacatgaacaggtcgggcaacgacgtagtcctgatagagagaaacaacaacaacgagctttgttgatgaacacgaccagatgagtgcatcaaaacatgtttccggatgagaggattccgttttccttaaatgcgcaggaagaacaaaagatgaagaaaaaacgaataatattgttcattgtcttcc

SEQ ID NO: 66362 - DNA, 982 bp, Oryza sativa
cctttgggtaaacccttctcggctacttataccaaatgttgaacaatgcatcggccaaaatagctatcggctcagtggttggagcaggaggaccatggtggttattgcaatcttggctaaatctggtagttatgaaagccgttaatcggccatctgtgacagaagctgaatttccaagactagagccgattgcagatgatgatggagaagaacgcacccaccgcaggtgtatgtcctatggggaatatgcatccacaccagccaatgcaggagcaaagttatcggctgagctgctcaaggactggttctgcagcttttatgaaagctttcaaaaagatgcacgtgtttggttcttctatgagaattcagccgacttggatctcccatcggactttagattcgaagacatcaatcatgagagataccaaaaatctatagaagttttctcaacttcaatcagcccatgtatccttcctgttggcattcatcaaggaagaaatatacaagtttcttatgaattctactatccgatgagctctgccagacagttcggaatgggacagctaccgggagaactccatcggtttctcctaagcaaactcctccaactccttctgctctagcccatttttcaagggtaagcaaccgcctctgattctttttgcaactttctcacttatagccgattgctcacagattttatagttgcaaaaaaagaaaaccgctgtaaagaagaaatcggcagcaccatttcccaaatcggctccaccagtgagatattcttaattcttttagtagttgatcccagctgatttttcctaatacttatctttttgcagcctcctcctcctccttctcctcctgttcagcaactatcaagcgatcaaaccccatcggctgcagggagtcaccatgttgaagaagaagtacaaccaaccactcctgtcatcccagtaagtcttgtctataaaaatcttgaatc

SEQ ID NO: 66363 - DNA, 4265 bp, Oryza sativa
tctcaagtccctagttgagatcattgagcatggtcttagtgacgagaaccagaaagtgcggacaatcactgccctttctcttgctgcacttgctgaggctgctgcaccatatggtatagaaagttttgatactgttttgaagcctctgtggaagggtatcagatctcaccgtggaaaggttcttgctgccttcttgaaagctattggtttcatcatccctcttatggatgcgctgtatgccagttactacacgaaggaggtcatgcaaatcctgattagggagttccagtcaccagatgaagagatgaagaagattgtcctgaaggttgttaaacagtgtgtcagtacagagggtgtagaggctgattatatccggaatgacatccttcctgagtttttccgtcacttctgggttaggagaatggctctggaccgcaggaactataagcagcttgtggaaacaacggtagagatggcaaataaggttggagttgctgatattgttgggaggattgttgaggatctgaaagatgaaagcgagccttacaggagaatggtgatggaaacaattgagaaggttgtggctaatttgggtgcttcagatattgatgctcgtttggaggagctgcttattgatggcatcctgtatgctttccaagagcagacaagtgatgatgcaaatgtcatgcttaatggttttggagctgttgtcaatgcactgggacagagggtcaagccttaccttcctcagatttgtggtaccattaagtggcggttgaacaacaagagtgcaaaagttaggcaacaagctgctgatctgatctcgaggatagctattgtgatgaaacagtgtcaggaggagcagcttatgggtcatttgggtgttgtgctgtatgagtatttgggagaagagtaccctgaggtgttgggttcgattcttggagcattgaaagctattgtgaatgtcattggtatgactaagatgacaccgccaatcaaggatcttcttcctcggctgactcctatcttgaagaataggcatgagaaggtccaggagaactgcattgatctagttggtaggattgctgatcgtggagcagaatttgtgcctgctagggagtggatgaggatttgttttgagcttcttgaaatgttgaaggctcacaagaagggtattagaagagccaccgtgaacacatttggttatattgcgaaggctattgggccgcaggatgtgttggctactctgttgaataacttgaaggtgcaggaacggcaaaaccgtgtctgcacaactgtcgcaattgccattgttgctgaaacctgctcaccttttacggttctgcctgccctgatgaatgagtaccgagtcccagaactcaatgttcagaatggtgtcctgaagtctctctctttcctctttgagtatattggtgagatgggcaaggattacatatatgctgttactcccttgcttgaagatgctctaatggacagagatcttgttcaccggcaaactgctgcctctgctgtgaagcacatggctcttggtgttgctggcttgggctgtgaggatgctcttgtccatttgcttaactatgtctggccaaacatatttgagacatctccccatgtcatcaatgctgtcatggaggcgattgaggggatgagagttgctcttggtccagctgtgatcttgaattactgccttcaaggccttttccatccagcaaggaaagtacgtgaagtatattggaaaatctacaactcactatatattggtgcacaagatgcgcttgttgctgcttatcctgcactggatgacgatggggataatatctacagccgtccagagctggcgatgtttgtctgatcaatgtaagtgttgtttctttcctattattttgcttaaattttgtggcatatattattgaaacttctgctgttagttacgaagtaagttgtgatattgtatcatgggttcatatttgttcattcaggtgctttctttttctaaagagcaaccattgcattactcgtatgtatgattccttttggtttactgctgtccttgcaagtgttttatcagtttgtactgttcctcaacaaatgggcatccttagcctgggctactgtatgttattaggccttaggcagtttgacctgttggaataatgttaacttgaaacaacttagaaaaatagagctcagctttttataactcactttacatttacattgatatgttagaattctatggtcttcttggttacttggtttcagtgaacatctatcacgagctgcctatattgaatggactaggttgcaccaacagctattttgttcggtttgctccttttcagtggtgccaaagccttggttattgttatcatatgacccatagtgtgcaggcactagttcgtttttcctttcatgtttctttctgcaaatttgctttatgttctgcctttttcttccctctatgcaaagaacacatctgatgtgagaacgcattggcaggcaggatgtacatttccatgtaccgtcatccaatatatgcgtgtgaactgtgaagcttgaactcggtggtatttgagttagctgatattcaatttatggtgtttacttgtgatggatgcattttcattgaagttgcatttcttttttctttatttgcaggcttgttgcttctgaagggggtgcaatgtttaggatatatttccccctggtttacttgtgtaatgtaatgataaattgctacctgttctgatgtactgacgtttttgttactggttttgtgttcagggtattttgacccggtttgctgaggagttcccttagattaaagatcccaaggagatgatatctgtcctgaatgtttactttgttgccgttgcatgatcccctccgctctgaagagaaaatgatcaacatagtattactgctgtcccaataactgtattattagcaaaaaaatgttataagctactatcgagattgtgaacttgtcttattattagagtctgtattattaatgttattactatgcctggaacgtcacttatgtatgtctggaacgtggtattagtattactaccctgctctgagttgatggatcaatggatggatggttagatcgtatagtgtctgttttcttcccggactgttagttgttactttagaaaatgttttaaattgtattgcgtatgttgtggtttgtgatccatcagacaagctcctcatcagtcactatttacctaaagttgctttaaattctgtacctatctgagaacatgagttgtggatgtcgaacttatatttgatagtacagaacacgaattttgcttgaacattgcaacacttgtgaattttgcctggagaggtggtacaaaatgctcaggaatcattccatattcccatccaacccaacgcccatcagtagacgacgacgtcgacgcaaacgcccacagatacgaggcacaaaatcgtttctctccgcgtcgcgcacacgccacgcaagaggaccaggtcggtccggtgcgcgtgcacggtgcaccacacccacacccgtgtcggacgcgacggctcaaccgctttgacccacctgtcagtcagagccaccaaggcccgacccaggctacagagcccacctctcctcctccgtccggttcgcgccgcgctcccttcgttcgtgcgcttcctcggtcgccggcgatggcgatggcgatggcgccggcggtggtctcgggcgagaggctcgtcgtgttcctcttcgtcgcccgcgtcgcgctcgcggcgccggcccagctcgccgccccgctcgcggtcctcgccgcggccgccctcgccgtcgagctcgccgtggatggctccgcctccgcgtcctcatcgccgctccgccggttcaggaccaggtgcgacgttatatcctcccccccgctcttatccgtatcttcttccgccgcatctccacggagctgggctgctagttcgcgcgatttggttagctcgggggattgcgcgatcttgataccagtgttcgagtttcaaactccacgaattaagtgttcgaggagctccctgtgatgtcagggaacctgcgaggtgcagtgttttgcaaaattcgttggcgcagccgtagaatctgaggcgaattgatccatttgttggttcagtgctggctgcctccctgtgaggatcatgcaattggggaaacgacatcagtcggattcagcattccgcaggaatgcgattaaaggggatcc

SEQ ID NO: 66364 - DNA, 2438 bp, Oryza sativa
aaaagattgttaagtgcttgatgatgatatatgtatatgctacagaccgggtgacttcatcaggcataattcatggtgccactactctgcctagtgtcatgctttcacggttaattcaactttatagggtcttactagcagatcctaatggacgtgaaggtatccatttttctattttgtcaaatttatcagatccactgctaaatggaaatttccctaaatcttcatcaacatttcaaatcttgtttgacactaagattttcggtgacgcatctggtttactaactacatatgtgttcattgtcagaatatgcataccttgaaatgcagtactgggcagtatctgttagctgccttggcatgttatcattttttgtttggcatctacggcagtctcccagcaatggaaattctatagcttcgaaatacggcttgttgctcatcattttatatcccctggcatacttgttccaccttttactgaagactgatggaggtacatgcatattttatctgcatgcaaacataatctcaccctttctttccaaaatctggtggaagttcatcagaagcaaggaattacaaactaatctaggttgtcttaacaggtctgctggtgatgagtaatttggtgtatttgctgtgtcatggagtggctgctgtgatcttaatccagcatattctagagaagttcccttcatgttcatcttttggtttgtacctgaagtctaagatgtagttagatctttatttttttgtttatatctgactgcatatgtttagactttagagctatccatacgattgctagttatcctaccagttttccatgcaggcatagtgcattatatctacactgttcattttttaaaatttaaattcagcttatttgtgtggttcctattggcggatgcaatgtatatgtctcctgttcatcatgacttgaagctattgctttttttagcttatctttacattttctgtgaacttaggggaggccattttggtctcaagtggtcttgttctttactgtggtgatatgctggctcatactctttcaaaggtgtgatttattcctcgaactatgttttaccagcaaaatggtagcaaatctgatacttattttgttgcctgcacatttgcaaccgtgctgctggcagatggagttctccgtatcatcagaagcatttattcgcgcacctggaactcgaagcgagataggcacagttattcaggtagaagctattgcgttctctggcttcagtttcttagtgcataatacccttcccttttttttcttttctgcagggggttttgcttggtctttttcttctccccttgttatacaaaagctcccttcaagttttggcttactgtagaaaactggagagtcaaagaacacaaacagttgaggaatgcacacagaagagaattgactgtggtgtattttatgtttcattgttggtagcactattgttgttagtgccatcatggacgcgtcttattcaaggttttgaagtgcatccatttgtttggtgagcatataagtttgcatttcattggaagggcataaaagcatgcactctgttagtcaaatattgaaaaatttcttcctgtgttgcttctaaaccttgtgcatttttgtacgtattgaattttggttcacttaatggtttatattcacagggtttttaactatattttcaccgattcacgtgaacggcttgctttatgcgcatactggatatttgtgatatatgtatcaattagaaggttctacagtatatcaaaacaaagcaaaacggagaggattcttttgcgcaagtattaccatctcgttgctgtcctaattttctctcctgcagtaatatttcaggtaatatatgttttcgatattcgatccccatcagattgtttgaaacacactctcaataaattgtttctctttgcagcctgatttcttggacttagcatttggtgcagcatttgccgttttcttaatattggagatggttcgagtaagcattttctttatttgtgtccctttcttttcccccctctttctgttttttggcagtttgtatgcccacatgtgctaatttctccgacgaaatgtttcactctgacctcaggtttgggaaatataccctcttgggcatattgtgcatcagttcatgagtgccttcactgatcatcgcgattcggaaattctaattgttaggtaggtctggattaatggtcgttgttttccagattttaactcatttacatgttcagtgcttggataggcctaatactatatttgttttgttcagtcatttctcactcttgctgggatgtgcacttcctaaatggatgtcatcaggattcaatgaccgacctcttacaccatttgctggaattctcagcttgggtattggtgataccatggtaggttc

SEQ ID NO: 66365 - DNA, 979 bp, Oryza sativa
caacgccattcgcaaccggacgccgccgcctcgactcgacgtccttcttcggatcttgctcgcccgccgcgccttcatcctccgcgaccagctcgtcgctgccctcgtcaggagctcgcctatgaagttctcgtggagctcgccgggccagacggggtgtggcctgagcttgcagcacatctcccatcagatatacttacacgcttgtggggacgctgacgacgccgaagcggtacgagcgtcgcaacatcgtgcatctcgatagcgtacgcgctgcagccggcgatgcccgcgcatgtggacgtccgcttcgtgttctgctccgtgacggatgtttgacgatattttgtcattttacgttaagcaaacaagattactatttataaaagaagctagctcgctggtttttatgagatgcatgggccatgcaaactctcgctggcggcggcgctggacgcaatggtgggacgaggtgggggaggtggctggggctcgtgacggctgtgtgggtgcagtgcatctacggcaagaactacaccatcttcaactaatcccactccatcaagacgctcatgggcctcacccaacagctgctcaaaacagcctctccgtcgccaaggaagcgtcgggccgtcgctgaggccggccagctctgcgccctccccgacaccgtcgcccagttcttccgccaccgccgccttccagtttcttccccgttggccgccggccgcgccaagctcctcccccgccgccgccgtcagttcttccccgtaagccgccggccacgccaagcgtcgtcgccgcgtcacgtcctcgtcagcctccgcgcccaacggccgtggcacccgcccgcgcgggaccgcttctccgccggcggtgacgcagcgtcaccgacgccattcgcgaccggcctccgcctcgccccgacggcctcctccccagccgccgacgggcttgccaaaagaagagtgagagagag

SEQ ID NO: 66366 - DNA, 1619 bp, Oryza sativa
acacatgagcctcgtcccaacacatgagacgcgtcacggcaaagcttttcgataacctcgcattggcagtacccgctccatgaacttaaatcctcatgcactctaggcgtccatgtttctagcagtgagtggagttctggcgctcccgggaaagagaagtctcacacgcatattaaattatggttcaagttaagttccctctctcacacactcatggcagtcctaccaatggcgacaccgatgtagggcacgcctctcggccctacctcaacagctgtcccaccgtagcgcacctgcctcactcaggggtgaaccatctatgcagggatactgcctctgctcggctatctaatccgctagttctatacccatacgagaagtgcggatgtacgggggtcgtttcatgcttaacttcatggctcggtccttaattgaccggggacggtactagccttttccagataccacccaaatcctccgtccgccccagtcgaaaacagttgtttaattttatttttcctttcacaaatcatgtcatcaacatcatggcaatgtggcgctcatgtctccacatgccgcatctcaattaccttcccaaaggtaattgcccaagcatatagcatttgataaatatgattatgcataattctagaatagcatttctaagcaattgtcatagttgactagggactcatacgtaaacatggttacaaagatttaagggtaaacaataatcaaggcatggcataatcacaagtgggatgttcatcattgcatgcaattttatttgtaaacaaaacaatttcgcaattgggatcaacatgttcaaggaatagtgatgacttgccttgctcaaagtcttgcgggtcttggccttcgcttggatccgcaactccctcgggctctatagttacgtgcgaaaattgatttgaattcggttagaattcaaataagaatccgaataaatccaaatgacagtcgaatgcgaaagtcgtttcctttttattaacttcactatccgcgaactacggcaaacccaatttcgatttaaactattttgcgggtataaatattttgttgtcataagttttcaatttaatctacccgagcattatatccatataataggttagaaatttctatcgcgagctaaatgtcggacggaatcctaaaattatcttataatattatacgttttaatttagtctatgactaaacgattaaatataatatacgtctaaaattcctagcgattaagtccgaatttctaccgtgaatcgattacttatagagattatccaaaaatgatctatagtagtctataaagattcatctaattgttaattatatctaaattactactgcgaattgatttcttttagaaattaccaagaataattaaattttgcaattctgggaccatgattattctataattaaattttaattattttaaattttctaaactattaaccttcctaattttcttccaaatttttctatttatttttccttttcctttttccccctttcctttttcttttctttttctctttttctctcttttccttttcttttctttcctctctttctttttctctcttcctctcggctctatc

SEQ ID NO: 66367 - DNA, 996 bp, Oryza sativa
gcagggggatgtatcaaatgtccatgaatgaaaacacacaaccacaaggaccaagctttctcgaaatgttaggccatggagattggttgttcaatcaaccacctatcatgcaaccacaaacaacaggtacaacttataatttactagaaaataatttattttcagtatgtgtgcacgctacaactttgcattcaatgttttgtaggaatgtacaaccctgaacaaatgatgggatatgccggcagcatacagtcatacggagaaccatgtagctacggtgggggctcgtcaacagcacaacacgacataggaccattgcaacatgatgaaccaccaccaataactcagccagcccaagactacgacgatgttgatctccgcggtgttgaagtcgtccgtaggtctgtccgcgagcgatattcacctgaaagattatctttgtcagggcgcagacctccaactggtgctagaagaaagggaaagaaaaaggaaactggcacgtcccgaaatttcgatgatgaggcttaggaatagaacgattttatattgggctcattcgaactaatttgtaattttttgtgttcaaactttctaatatctcagctacatttctaaataaataaatttgaaatacttacctgccttaccatcacgaacacttacaaatatttacacttcagtgggtttgaacactttgcgaattcatggcattatcttatggtaagcccctaatatgcaccataaattatcgcgtactcagttcataccacaggatagggcctgcgaattcgcaaagtgcactaacctactgaagcttacacaagtgatacgctatacttgagtccgcatctttcgtttcgcaacgttccttttataggcactcaacaagtaacctctctaaccagacgacaacaaactttcggcggacagcacgcgaaaaaaatctagcatcactctctctttgtttgtggcgagcatgtgacatagagaagacaa

SEQ ID NO: 66368 - DNA, 911 bp, Oryza sativa
tcctcctcattcagcaatgttgcaaagtactggtaatcctctggcttcatgaggggcaacccaccaggcaactccttgggcacatcaaactgctgcccacgattctcctcaggaatagcatacaatggtgtgcccaatggtgttggtgtagcgagcagctttcttgctggtgtgcgtatgggttggtatgaagctggaggttcaagaatcttgtacccttcctgcgggaacatagtatcaagctcctcatccgtaagaggcctgttccgctcctcaatgtcccgctcccaccgcaagagctggtactgctctggagtcattggaccacgagaagcaatctggccgggtgttggcgtcgcaaggttgtcaccaccaaatggcgtcggaccaggagtgtaacctgcaggcgtcgcagcaccagtgcctccaggtgtagcactacccatacttgcaggagtctcatcccatctcgatctctgcttcttgggtgttggcgtgacaagcccaccaggcagcttaggagtagcatcccaagctccagaaggtgtggcacctggagtaatgccaccagctgcaggtgttgcatccgcatcggccatcctcccaggagttggtgtctcatcccaacgattccttctcaccgacggtgtcgcatccccgacacgaccaggggtggcatcccagcgcccaatcccaggagttgcatcaggagcatcccaatcggaggaggtcttcgccttcttggatccagcagcagcagaagcatcaccatcctgcgactgatcccatctattgcggcgcttcggcgctgccactggctgctgctcgggcacggccttcttctccttggccttctcctcctcttccttcttcttctgagctatgtcacgcagcagctgctccttctgctt

SEQ ID NO: 66369 - DNA, 1661 bp, Oryza sativa
gggtggagagattggacgatgcgagaatgggggaggaagagtaaaaattcgtgacacgttgtcacgttcatgtcaatctggcacgttacgaatagagtctcgggtccacgttacacgtttgatacatgggacccaccaaggaataataattaactaatttaccaaagtaactaagaatttaccacggggtccacatgtcatagacatgtaatgacccacatgtcatagatagccaaatcttcaaagtggcaaaaaaattaaatacccaaaacccccctccgttaaacccgaagaaaaaaaaccgcaccaccagcgtggcgccgatcggagccaccggataaatgtggaaggtcgccgccgacgcggcagaggggtggggcggctggatctgcgcgtcaatcctgctgccgaagacggcgtccgtcgtcgccaacctcgtgcgtcatcttcgaggtccaaagtcggcgacgccgccgacactcgcggcacctagaatgctcaacctcgttgtcgacgcggtgacggcgcagttggcttcgcgctccgccgacggcgtgccccactctcaccgcgaggccagtttcccctcctcctcagctgtcgtggaggacgtcgcctaaaaccctcaccttcaacgcgttggcggtgtggcgtcactggctgtcgacggaaaccctcgcctccgatgccgtagaggtggaggatcgagcgccactaacaaatccatggattccaccaacgaaggcaatggcctctatcgcggcgcctcctctgccagcgtcgcggactacacccgcaggcccggctaaggggcctcgggctgctacttggtcggcatcgacaactttctcacgtggctactcgacaaatcaattcatgaaggtccaccaacgatgacaagagtcacaagatagattctcaagtcctttttaggccctgtttagttcacaccaaacttcccccaaactccaaactttccatcacatcacatcacattacatccaaaactttcctactcacataaactcctaacttttttttttccaaactaccaaacttctccccaaacttcggaactaaacacagccttagtcaaatactagtacaatcttaggcctagctccattaggcaatttatcttatgttttcggtggcatgtcaaacaagcggagcgattagcaaatgactaatcgagtgttaattactattcctatcaatttaagaattaaattcatttaactatttgataaagatatttttatatagaaaatttttagacgaaatacactatttaatagtatggaaagcgtgatcacattaaacgagtgatttcttttagccaaaactccgttaagaactcaatgttgggctagattcgaaagtgagtttggattggaccactttttcattaaggcgttaaccatgagcacgtttacaaactatttaaacaatgtgtttttaagtacaagtttctaaaaaaaaatcaaacacatttttaagttctaaatcttaattaattgtgtgttaatgactacttttgttttgttttacgtgaattggaaatctcaatcaaatagtagtagagcacttcagaacttagcctaatattttttttggagtgcttcctatttttgaagtttaattttatacgagagatttaa

SEQ ID NO: 66370 - DNA, 8354 bp, Oryza sativa
  unsure (1)..(8354): unsure at all n locations
aaaagaatatatattcaaatttaattcgataaaccacatgcatacaccagcaggcaggggcggagcccaatgggcctaggggggttcataggcacccggcccaattttcagttttagtaggtaataagttcaccggaggtccctcaacttaacagcgagattttttaaggtcccttaactacaaaaccagaaatgtgtacccttaaacttacacaaactgtgcacacaaggtcctatagcagtatatatgggtggtttcactgatatggtatcctagtcagcaaaaaaaattaaaaaaagtacgtgggacccatctgttagctacacatattttttttcttctccttctcctcttttctctcttctctcttcccttcttcgggccggtggtgggcggaatcggcgagcgcggcagcagagtggcggcaggctgcggacgactggcgagcgtgcggcgggctgcggcgcggagcggatggcgggcgagtgcaacggtggacctccgccattgctgccccttcctccgctcgccgctcatcgcgtgacggcaccaacgcggctggctgcggcgggagggaggtggaccgcgcgcttcttagttgatggcgatgccccggagcttcatgtgtgtacgccgatgggttcgtcgggctccagaccatgtcggtgtaggagagaggatggtgcccgcgtcgaacggcggccgtgcttagcaagaagacatcgaactactacttaaccgatagcttcgaatagagctgggttgggtcggctggctgaccccgccacggccaaggccagcgtcgccggccgctgtaatgatcaaatttgcacaagtctttcattgtcgatctgatcatcatccaccaagctcatgtacccagtttagcaaaagtaagcacaaggcttcacacatgtttcacagcaacttctgccgctgcgacctcctcccatgctgcgcccacgacaggaatggtggtaacgtgagcccagtcaggtcccaaggccgcccaccaacttcctcccgcgcaccacctgcatctcctctgcaattcatccaaccatgcattggagccactgagccagcattcacctccaccttctaatcaccaccgattgactccgcctcgccgttgcgcgatgctgattgcgctttactaggtttggacgcggcggcagctctcccgcagcccagagggtacctccgcacggcggaggcgaggcgcacgagcaccacctcggtagcagcgggtacctagctcgattccggccaccaacccattcccctcgccgcgattgggcccctcggtcgcgaccacgaggaatggctgccttgccagtttgggggatttcgtcaccgcgcgcgccgatgcgttcggaggtggtcggaggaggttggcgcgccgtccgcagcccgccgccgctctgctgccgcgctcgcccactgttgattgttatttcagctatggccccaaggtgatccaggtgatggcagttgcaacggctggatgaataattcagttttgagtttgttatgcatgcacgagagatgtggcgagctgcaggagtagacgaccgcgtcaggcgtgcgttgtgggcgtgagttttgcacggcattgtatccaggagttccggatcgtgggatggcgcgattgtaggcttggattcgttttttcttttattagagtataagtagcagtagctaaaatttccatttgtaagtttatcaattcagttgaatgaaagaacccagaaaattgtcccacaaattccttctctctcgtgattctctgaaactctgaaatactctgcttctctgttctgaatttcttcctgtgttcttcagtttttttttgtctgttgccgtgccggacgtgtgcagtgtgcgcacaaagtgttcgattgggtgattagcagctaacaagtggtatcagagcttctcaggttgagggcggatctggcactatggcgttggttccggcgacggcagacccggcgaggggggagctcaggaagtgctttcctttacccacagctcacgtcaaccaactacactagttgggtaatacgtgtgcaggctatgatggaggatcaaggcgtatgggaagcaatcgagccggcggccggggcggccgtcgacccgaggaaggacaagaaggcaaagtctcatcttctccagtcgctgccggaggatctcttgatgcaggttgcaaagaaatgctcggcaaaggaggtttgggattgcctcaagacgagattcgtcggggcggatcgggtgcgcgatgcgcgcctgcagacactcaagggagagttcaccaacatggtgatggaggccggggagacgctggaccagtacgccggccggatcaccacgatgggggtccggtactctgctctcggcgcgacgttgaatgacgccgccatggtgaagaagctgttcgacactgtcccggagaagttcatcagcctcgtcgcagggatcgagcaattttacgacgtcgacaccatgccgttcgaagaagtggtaggtcgcctcaaggcgtatgaagagcggatgcggaagaagaaggcgaccaccggcggagtgaccgcggacaggcaagttctcctcactcaggccgagtgggaggcgcgcttcaagaaaggcgggggagaaacctcgtcaccatagaagaacaagccctctggtgagggggcgaaccgcggccaggccgggcgtggtcgtggcaggggtcgcggacgcggcgggacgcagagcagcggtggcggctctggtggtggcggcggtggccgcgacaagagccacataaaatgtttcaactgtgaggagtttggccactactccacgcagtgtccacatcccaagaagaagaaggttgaagctcatcttgcgcaaacggaggatgctggcccagctttgttgctcgctgtgacagaggcggtgcagaacgcgccgcgccaggatgcgctctgcgggctggtcgtgcacgaggagcgtgtgtggcctcgcctgatgctggcagagaagggagcagctgctggtgatctgtggtacctggacaatggtgccagcaatcatatgtcaggagatcgtcggaaattccgggaactggacaagaccgtgacggggcaggtcaggttcggcgacgcctcgtcagtgcagataatggggaagggatccatccttttctcatgcaagaacggtgaccagtggttgcttgacgatgtctactacatccccagcctccgctgcaacatggtgagtttggggcagctaactgaaactggccaccgtgtcgtgatggatggagatgacctcgaggtgttcgacaaaaatccttggcgattggtgatgaaggtgcggcgatcctcaaatcggctgtaccgcatcgagctacagctggcgtcaccggtgtgcctgttggctagtctcgatgacccggcgtggctgtggcatgcctgactcggacacgtgaatttccatgcattgaagctattggtggacaaggagatggcggcaggagtgcccgcagtccaccacccaaaccagctgtgtcaagcatgtctggtggcgaaacaagtccggcagccgttcccaggaatggcaaactatcgagcagaggcgccgctcgagctgctccacatggatctgtgtgggccgatcactccatcgacgttcgccggtaatcgatactttatgtttatcgttgatgatttttctcgttggatgtgggtgtttgtgatcaagtcgaaggaccaagcgctcgcggccttcgagaagttcaagccgttggcggagaacacggcaggacgaacgatcaagacactccggacagaccgcggcggcgagttcttgtccggcgagttcgcgcgcgtctgcgatgcagccggcatcgagcgccacctgacggcaccgtattcaccgcagcagaatggcgtcgtggagcgtcgcaataggatggtgatggcaatggcgcggtctctcctcaaggggatgtccgtgcccggcaggatgtggggcgaggcagttcgtcacgccgtattcctcctaaatcggctgccgaccaaggcgatgggaaatcgcactccgttcgaggcatggacggggaagaaacctcacctgggcccctgcgggtgttcgggtgtacggcgcacgcgaaggtgactgcaccgcacttgaagaagctggacgaccggagcaatccggtcgtgtacctgggcgttgaagaagggagcaaggcccatcggctgtttgatccgcgtcgtcggcaaatcattgtaagtcgtgacgttgtttttgatgaaaacacaccttggcagtggagtgttgctgcaggagaggtgacttccactgagttcgaggtagaagaacccgtcggcgcagagcagccggcgccggcagagcaggcaggctcggtaccgtggtaccgggcgccgccggcaggaaggcgagccggcaaggagccagaagtggcagaacagcggggaacacctccggcaagcccggcgaggttctcaccaaccttgcctagcacgcctacactcggctcatcctcaacgcactctgccgaggtgcaggcgtcaccgcgcacggccgacagtgacgacgggccggtgtggtacagaagcttggcggagatcatgattgaagcacctcgggtggacctggtggaggatgatgatgacacagaagcgctgctcgcagagatggaggagccgacatcctatcgtgaagcagccggcgagccggcgtgggtgaacgcaatgaacaaggaactggaggctattgagaagaacaagacgtggtcgctgtgcatgctgccagccggtcacaaggcaatagggctcaagtgggtgttcaagctaaagaaaaacactgccggtgaagtgatcaaacacaaggcgcggctggtggcgaaggggtacttccagcggcaaggtgtggattttgatgaagtgtttgcgccggttgcaaggttggacatggtgcgagctatacttgcagttgcagctgatcgaaggtggcaggtgcatcaccttgacgtcaagtcggcattccttaatggtgatcttgaggaagaagtatatgtctctcagccagaaggttttgttgagaagggaaaggaacatcttgtgtacaaactgagcaaagctctctacgggctgagacaggcgccatgggcgtggaatacacagcttgatcggagcatgaaggagcttggtttcagccggtgtgcacaagaacaagcagtctacactagaggtacagggagtgccgggataattgttggagtatatgttgatgatctgatcgtgacaggagaaagcccaagcgagatcactgcattcaaacaacagatgatgggggagtttgagatgagtgatcttggactgctcacctattacttgggaattgaagtgttgcaagagcactgacgggatcgccatcaagcaggttgcttatgcaaggaagattctgacccagtttaggatgctagattgcaattctacctcaattcctattgaacatcgttcacagttgcacaaagatgctcaaggaagcacagttgatcccacggagtacaggcgagtgataggttgcttcgttacttgttgcatactcggccggatttgtcctacacagtaggcgtggtgagcagattcatggaacgaccgacagtgatgcatttcaaggcggtgaagcaaattctcagatatctcaaggggacaatcaactgtggactcatgttttctggaggcaatggtgcagtggagattactggtttcacagattgtgatctggccggcgacagtgatgatcgtcggagtactagcggcatggcgttttacttcaacggcagtttggtctcatggagttcacaaaagcagaaaacagtggcactttcgtcctgtgaggctgagttcatggcagccactgcagcagcgtgtcacgctttgtggctgaggggattgttgattgagatgattggtgcagaagccaggccggtgaagctgtatgttgataacaaatcagcaattgcactcatgaagaaccctgtgtttcatgggagaagtaagcacatcgatacccggtatcattttattcgtgagtgtgttgaaagtgggaagattcagattgaattcgtccggactgaggagcagcgggcggatgcgttaacaaaagggttgccagcagcgagattggcgacagcacgacacctgctaggtgttcgtgattttgggccgtagcagaattaagggggagtttgttgactgttatttcagctatggccccaaggtgatccaggcgatggcagttgcaacggctggatgaataattcagttttgagtttgttatgcatgcacgagagatgtggcgagctgcaggagtagacgaccgcgtcaggcgtgcgttgtgggcgtgagttttgcacgacattggatccaggagttccggatcgtgggatggcgcgattgtaggcttggattcgttttttctgttattagagtataagtagccgtagctaaaatttccatttgtaagtttttcaattcagttgaatgaaagaacccagaaaattgtcccacaaattccttctctctcgtgattctctgaaactctgaaatactctgcttctctgttctgaatttcttcctgtgttcttcagtttttttttgtctgttgccgtgccggacgtgtgcagtgtgcgcacaaagtgttcgatcgggtgattagcagctaacacccactgccgcgctcgcggatccggcccgccgccggcccgaagaacggaagaaggaaagaaagaagagagaaaaagaggaggagaagaaaaaatatgtgtagctgacaagtgggccccatgtacttttttaatttattttgctgactaggatgccaagtcagcaaaaacacccatatatactgccataggaacttatgtgtacggtttgtgtaagtttaaggatacacatttctgattttgtggttaaaggatcttaaaaaatctcgctgttaagttgagggacctcctataaacttattccttttagtagttacccctcattttcacctggaaaaagtacactcaaagtcccttaacttgtcatcgagttacaaaatcgtcctccaaccgcaaaatcagatatccgacgtcccttaactaatcaaaactggtcacaatagatcattcggtggttttgataccggttttgtcctacgtgacagctgagtcagcgtgggacccatgtgggccccacctgtcagcatgccacgtgtatagatggccttttggcccgcccggcacggcccggcccaggcacggcccaccagacatcgggaccggcacggcctgattggcacttcgtgccgggccgtgccggcccatgggctacgctcccgccaggcacggcccaccagcgtcgggcgtgcgggcggcccgaaggcgcgggtggtccatcgtgcctttttatataagtctatattccatccctcctctttgggccgtgaaatatatatagcgaaaataagtctattttccgtccctcttctttgggctgtggcatatatatagtgaaaataagtctattttctgtccctcctctttgggttgacatatatatagctaaaataagcctattttacgtccctattctttcgaccatggcatataatatgtctatttttactccctgttgtttatgtgtcgggcctagcctgaggcccatcgtgccgtgccggcccggccgtgcccaacccctgcgggcggtgccgtgcttgggccgggccaaannacgccgtnngccaatgggccgggccnnatcgggccctcgggcccttttggccatctatagccacgtgagcaccctttcttttcccctcttcacctatagttggccataaggcccgaggcccgaaggcccggcccacggcacgccttttggcccggcccaagcacggcacggcccgacttgggtcgggcccgtgctggcccggcccgaccgtcgggccgtgcctgggcctccccaccggcacgctgggctggcccggcacggtcgggccggcccggcacgatgggccggcaggccaggcccggtacataaagtatagggactaaaaatagacatataaatgtaactgtctaaagaatagggaccttaaatagacttattttagctatttatataccccagcccaaagaagagggaggtaaaatagactttttgtagctgtacatatgtcacagcccaataggagggaggaaatttagacttattctgaggaaaagcacgacggcccatcgtgccttcgggccggcccggcacggcccgaggcgtgttgggccgtgcctggg

SEQ ID NO: 66371 - DNA, 7967 bp, Oryza sativa
gcctcgagtatcacagccgcgcctcgtctccttttttttttttttcttttcccccaccgcgagtccaccgataccgcgtcgtctgttcgtcttcgtcatccgtcgcaccagcaggctgcagtctgcatcgctggcccgcgggctcgtcgagtcgccgtcctgccgctggtcgccctagccggccgccggtagtaaagcagcagtagctgccagctgaacgcctggactaggactacagaggcaaagggcgcagaacagtagggcaaccgagcagtgcacaggcaaactgaagagaggtattcatctaatgatctaattatctctctctaattctcttgattagtttcagattttcaatttatactcctctcttctcttctagttcactcttctttttaatccaattagtttgatttgtaacttgattctactttttcaattatccagatttatataagctagggttcaaagtttgaagaactgaaaggaagtttccattaaacatctctgcttgaagggactcctgttgtccttcatccattagtccatcagaccatcattagtaaaattgtaagcacactgtgacactttaagatggatggaaaattaagatgtcttcatcggatataaatttttagttcaaaattaaaatgtttctgacttttgttctagatttattgtgggctattaactatcgatgatgttgagattaacagctttgagcccgaggatgaattttgcatagattaatcgtcttctatgtattttttgatgttccatttcgcggtttcttttcgtcttatatttcggtaagcacttttgcttgctactcaatgattttgtctcaatagttatccataaatgaacgaatagcattatttatagtaattgccgctctctatatagcaaagtagtgcaccacccttaggtggtgtttagatccagggacttaactttagtccctgtctttagacactaatttagagtattaaatatagactacttacaaaactaattacataaataaaagctaattcacgagacaaattttttaagcctaattaatctataattagagaatgtttactgtagcatcacataggctaatcatggattaattaggctcattagattcgtctcgcaaattagtccaagattatggatgggttttattaatagtctacgtttaatatttataattaattttcaaacatccgatgtgatagggacttagaagttttagtcccatctaaacagggccactgccagcaggcacgagcagtagcggtagctaacgctacaacgagtacctggcaacaaaatagatgaaaccggatcgccccatgcctgtgcgaacatccgccaatcccctcgaataaaggaaaatatttggagcagaacaatgcatgaaccggtacgaatggaaagtaaacctgaccatttcaataagcagttaagtacacaccatgcctgtcaatgactgcccacaagagctattaattaagactatcgctgaagaaataatcggaggtagaactgggggtgtgtgtcggcactgatccccaccttcccatacatgacgctgaacgtagctggaatcggacgtgctcggtcgctgtttctgctgctgcttgcatcccacaaatcctggaaggaaaacagaagcagatcaacataatggctcataacgtcacagaaattcctcaacaaaaccatcgtctttgccctgtcctgcaggaacccaccctgaaaaggccgtccagctccaccggcaacacgaccgtgtgtactgttctagcaccgccagcccagagataccggtgactcctccatggccgagctcaaacaaggagggaatgcacaacattcatcagcacaaacggtggaagaacagaaagaaactgccgtttacctctggcacacagacatggaaggatatgcgggcgtcggcggcagcaaggtcggcgaacggtggctcccatccaaggaagaagcaatcgtcgccgcagccacttcaacgaccgctaccgacatcccagctagatagcaccacattacaaaacaaagagataagtatgcttgtcacattttgacaaataacagattgatcagggaacttcctgctacctaaccaaccaaccttcacttatctgacattctgaactgataatcgtggagcacaacaaaccaaatcaaggcaagccgcactgccactgccacattctggaatcgctggatgaacaggtgaatgtatagaaataggtggcaattagggccagtcacaaagttaaaaaagaaagccattcactcaccgtccatccagacaagatacttcatggagtcaccggccgctgttggtgtgaggaccacccgcagccatggtcaacaaatgcacacgccctcgaaaccctcatagagtccaacccaaccctgcataattgaaggcagcacaacaacccaccaatgtccatcttggtgaagaagatgaagttgatggcgtccgcctgtgccagcaaccgcatcagcgtgtagtcgctgttccgcctaaacaaaaatcaccagaaatctccgtagagaggaagaagctaactcacatatcgttggcaaggttgaccctggtgttggcgaagaagccgcagcctgggctgtcatcgagggtagcggatttgagaatgaactcgtaacacaccaagcttctccacctccaaatcacgttgtgatcgagggcggcggccggtggcgtggatctgctgcaggggagggcagcgacggttgtggccgatggacgtcttgcggcatggatctgctgcgtgggagggcggcggcggcgcggtggcggcgcgtcggccgacgatggcaaggggagggatgacgtcgacggagtcgggcggcgcgaggggtcggctgttaggggaatcgatgacccacgatggtgaggggagggacgaagtcggcgtcggctgcagccaccacaggtgctcgaacagcaacgcgtccacggcgaacgccaccgcgggtccgccgcccggccgccgcgaggaggcgccgcaccggcccggcctcgagcacggccaggtcgacgggggaacaagttcctctctcccttcgtcgtccccacctccaccctgaccacatgcgccgccgcggacgcggaggcggaggagtcgaggcgccagtgcccgccgcggcgagacgcggagcggaggaaggtgtagcagccggcggaggacggacgcggcgacggggcctcctcctcctcctcgccgtcgccatcggcgggcgcagcggcgtggctcccgatgccaggatctgggccgtcagctctttgcgccgcctgtggcgtggtcgtcggagctacgacctcgtcgctgatgaaggctgcgcccgccttcaccgttgctcggcggagacggctgcgctcggcgacggcgcgaggcggaggcggacgagctccgacctccgagacggcgatgcgacggcggtggcggaggaggtggaggaggcggcggtggcacgatggcgacggcggagggagagggtgagacgaaggggaggaggggagaatgacaggaattttttttacaaataatacgattttaatggagcaaaaatattggtcggttaaatgaaatcgcaagtctagcacctatagaacagccgttgttcgcctatcgataggtacttgttgaactgccagttcgacgagtgataaaatatcttaaaaaaaaaagaaaaacactgtagtgacactgtaacagcgcagcctatcaaactttgcccgtttaataaatctggactattcgatatgtccatgtgggggcactgtagcaaagtactatttttttttcttagaccaactaccctgtggtacctgttgaatttgttcgataggtacccctaaacgtaaaattttgcctatatttttgcgatttttcattaaatcgtattatttgtaaaaaaaaagctagggctggggtgggtgggttagtgtgagtcatttttcgaaaaagcccctcttcttttaatttttacaacacagtcctaattcacgatttttcttttctttgcacggaatatctgggcctccatgaaaataaacacctcataggcacggttctcaagggaccttgatcgaattacccggaaatcaaagggttttttcacaaaaataccaccccatgcactgttcatactgtatcaaaatcctgacgtgacacacctcctcgcccgcccaacctgcgccccttcaggctatgttcggttactagggatttaatccccaaggagaatcaatccagggaggaattaagtgaatccctctcatatcacttaatccctgttggggatgaatcccttgcttttcctaatccctctctagaaaccctgtgtttggttttggctgggattttggctagaaaaatctaaaaactgctgaccaacgtgaatatatgaatgctgatgctcaataataaccgaatactccctccgccccaaagaaaattccaatcctgggtttgaacctggacaccctccgtccaaaaaaacccaatcctgggtttgaacctatctaggaaaaaaaaacccaatcctgataggttcaaacacaagattgggttttttttgggacggagggtgtacatattagtccattgtcaataaactgaaaaacagttatgactgaaagtatgaaccaatgaaaatggaaacatcacaaattaaacaagtccaagatgagtggagagctgacgagcagcaggagacgacctgacaaattaaataaattaaacaagtctgaacatttgttctattcaaaggttgcatcaacaatatacatattcaaaggttcagggatcaacatttgctgatgccgcaaaaaagcagtatccttgcagacttccttcttcccaaagcctgcagagaaaaaagttccctttagtttctgactgaaactgcataatttaaggaacacttctgtgcaatgagcaattgtttcgaattggtggttgtgatctcaatctatgatgtagaaaagagaaatttttatgtgcatttttcataattttggctgtgtttagttcacgccaaaattagaaatttggttgaaattggaacgatgtgacggaaaagttgaaagtttgtgtgtgtagaaaagttttgatgtgatagaaaagtttgaagtttgaagaaaaactttgaaactaaacacggcctttaactaccaaaaatgaaatttaaaataatggacggccctctgtaggttgttgcttgctgcttgcacatctcaaccaagaatctatctttcagcaaaatataacaggtgtgtgtgattgatgataaaaaatcagaaaaaaatatacttgcttaattgctgatggccaagaacattgatgcatatatcaaatcaatactatactattgaaaagttcacatgtaggaaatagaataacattaagacaaaaaaatgacataggaaatatttgctgactgtaagttggatggctaacaaaaataaaacagtgacttgccttttcttttcctgctcctaaagttctaatacaagagcatgcatatgaataggacaatatcaagtacttctgaattgggggaaagaatcatatgtgcctgtaatcgtcctcctaactagtatatcaagaaacaatgagagtacatatggatatggagcgtgcacatatataggtctaaaaaccagtaatagttagagcagtatatagtactactaaagtttccagttcatatagttgtaccaattttaaagcaaattactagcaggtcaattagggctgtgtttagttcctgaaattggggagaagtttggggaaagttggtagtttggaaaaaaagttaggagtttatgtgtgtaggaaagttttggatgtgatgtgatgttatggaaagttgggagttgagaggaagtttgagtggaactaaacacggtctatatgagcatatggttggctcctagattacctgtacatgtacaaagaaatttttatgtgcattttttatattgcgtggcttttcaaattctgacactagcaataatataagttctgtaggagtctagagaaatcaaatgcaagggtctaacataatatcagtgcacacattttgcatatattatcttaataaaaaaaacatcaggacttcctcccattccccacaaagtcagcaatgcattgcatttcctttatttcaccccatacgcagcaacaatagatctagcattcctgaagatgaactatagaaaaataaccaaggaaagtactataataaaacaaataatgcatattccatttatattataaattgaagtaatatggtaattagtccaagggaccttcatttgtggtttttaccaaagaaaaaagcattggaagtattattggtgatttgtcaatagagttttatggcacacaaaataatcattggtgattcatcaaaatagaagaacatatgcacaatagagttctactgagccgtcacagaatcacctccctaataacaacatcagcatgctgagaaacatacaagtagaaatggtgattcttgaagattggaaccaactatactagttgacattaaagagaatctgtggattcctgattcatacgcataacaagcagaattaagcagcgaaagatgaaaaggaattttgcgaaaaaacaaaaaagaacaggcatcagccgcggagttcgaggggacggcggatatgacggcgacctccaagacggcgaggacggcgacggaggcggcgacagaatcctaggtaggagacggtccggtgagaaccaagaaccctaggcttcaagaaccaagatccaaagttccaaaccctaggtagtacagggagaagagaggggaatgaagagatactcaccggtgggaaggtggccagcggaggggagagcgccgccgccggggagagcgcagtgttgccgtcgcgccgtcacgcggttgacactcgcactcgcgcttgcgtcgccgccgctgccttctcgtctcctccatgcgagatgtatttttccacgcctccacagtagatgattttttcccgggcctggacaatagggaaccccgtgatgggccggattaaaatcagcgacagggcttaaccgaacgcaattttttgcgtgggccgggattattttcacaccgggatgacccccgtgggttgggccacattcccggccaaccccgggctaaccgaacaggcccttatatattacccggaaatcgaagggtttttttcacaaaaaataccaccccgcgcaccgtgcatactatagcaaaattctgacgtggcacacctcctcgcccgcccaacccgcgcccctttatatattccgatgggagaaggcaggtggcgtagaaacgattccctgactcgagccgagcgccacgccgtctcgtctccatgatgcgtagcagagcggtgcctcgtcgtcaacttgccggtccagcggagggagtagccacaacctcaactcaatgtcattccccaattaaatttgaaaatatactgttcatttaattttttctcagaaatattcgtgattcaaaagtttttgtggaaatataccgtcgatatcgcataacctttgtgcaaaaatgatgtggacatgacgtcacggacggtatcacgtgataaaagtgcgagaccgcgcggtctcacgtagcaacggtgcgagaccgcgcggtatcgcggaatgaaagggcgacaccattcagtctcgctagagcaaagagcgataccgctgccgtgatgatttaattagtgattataattaattgctaatcaggataattaattactaattattattagttaatttttatttgagtaattaattacaaatcaagtggagatattgcacggtgtcgctgtttggtttcgcgagagcgttcgctctccctctttcattctgcgagaccgcgctttcaccgcg

SEQ ID NO: 66372 - DNA, 1543 bp, Oryza sativa
tgattctgctgactcactccagaatcccctatcacatgctgatcctgattctccccttgctgctcccaatctccccaaccaccagcatgattatcaagatgctcctcctgaaccggcccattgctatgattattttcaagatcaggatctagggcacccattggtggtaaatcttcatccggagcctgaatgccggcaaaatcattgttgaggacaaaaacagagaaagtccaagactccccctgaccaccctgattgggtatttgcttgatcactattgttctaggaaccatatcaacatcatcataaaaagctcgcagcataactcttcccgggactacatccatctactgccaataatcaagcctcccaaaaagactaataacacggctgacatagctttgggtacgaaaatccaaagggaacccaagaaacataatccaacccactctagcataagcgaagtggaggcctgtcgccggtatggaaattactagagaccgaaattctggtttgttttttcttagtcagcaaagttacattaagaaggttcttcatcatttcaacatgcatgatgcaaagtctgttagtacttagattgcacctcattttaaattatcagctttacaatgtgctagtactgatgaggaggttgaattcatgtcaagggttccatattcctgtgctgttggttctttgatgtatgccatggtttgctctcatccggatttatctcatgctatgagtttggtcagtagatacatggctaatcctgtcaaagaacattggaaggctgttcagtggattttctgatacctttgaggcacaacatatgcttgtttgaaatttggcagggctgctaagggacttattggctatgtggattcagattttattgctgatttagataagcgaaggtcactcataggttatgtgtttactattggtagttgtgctgtaagttggaaggcaacattgcagcctgttgttgcccagtctaccactgaagcaggatacatggctattgctgaagcatgtaaggaatcagtttggctgaaaggattgtttgctgagatttgtggagttgattcttgcattaacctattttgtgacaatcaaagtgccatatacctgttaacgccaaaattaggtaagcccaaaatcatcatcggcctagagtcaatatcggcttcagagtctcggaatcggtcgatgtgagttgtcaagtcaccagcagttgtgttcttggtggagtcggatcaattaaaggaagcttatctagaagagtccaacagttgtgttcttggtggagtcggatcaattaaaggaagcttatctagaagagtccaagttcaagaaggatacaacatggcagtttatctattaattaggcagggtttagtttccttttatttttaggaaagtgtgtttagtgtccggtaaggactttatgttttccttttatttttaggaaagtttctttctagtcctacaaggactagtatctacccatgggtataaatatgtacacccggggtcattg

SEQ ID NO: 66373 - DNA, 732 bp, Oryza sativa
tgataggttataagtatggtgtcctaagatggagcaagacaggaagtgagtttaatttccattattatttattccatgattgataattgatctcttatgcacatacttttgaaatgttagagaaaacaattgagggcacagcagcaggcataacttctgtattagcagcctgctcaatcctgctgtcactcttagcttcaagtggatacatactttcacaggttttacttccccccctggcattaaaccatttgaagcttttattctacaatatactaagcaagcataaatcctgaccatctcttttatattaacacagcattggatatcacttttggtagctgtgacattgagcggtttattggaagcatatacagcccaactcgacaacgctttcataccccttgtcttctatagcctcctatgtctataggagcaaccaattgtacatcaaactaccttgaggccctattcttaccattactaatatctagtgactagtgcagtacagtataggtatagcccttcgaattttttttttaaatcctcttattggtcgcattctctgtattcctggaccgagaaatgtgtccattactaaaaagttgagtttaggtttaggaaataaagatgaaaatatgaaaggttgtttagtgaatccttcagtagagagcatctttggtatgatagacttctgagcctatctggaggcatcaatgtatcatggaaggt

SEQ ID NO: 66374 - DNA, 1548 bp, Oryza sativa
gcaaaccctaccccccgtcttactcatactccacactccacagtagcagccggcccgtagaacggaacggaacgggaagggggagacgagacgaggagaagagaagagagaagaggtcgagccgcgctccgcctccgtcgggtcccctttataacctctctctctctttctctctctctcctcccaaaccctcaatcgtcgcatcgcctcctcctcctctcgccgctcgcagcgaaaaagccagcgcctcccagcgcccacgcgatcccgacgaatcgaatcgagtccgagacgccgatctcggattcgagaccgttgatttcaaccaacacaagccctcctccggatcgatccgctcctcttcaggtaacaatgaacgatgggatgggatgggatcccgctgaggatgcttttttttttctgttttgtttgtgctcgatctggattcgggttggtccggcttggcgctggctcgatctgggtgtcgccgggtggtgggggcgtggatctgggttggttcgatgtgattttggcgagtctgtgagagagaggggtttgggtgggagatgcgtgactttgattgctttaatgatgtttagattgttatatctccgttggcatgtttgttatccttttgagcagctatagaagtggtatgtggtgcttgacaatagtaattgatgttttgggtgtcctagtgtttgcaaatctaaaatttgtaacatgctagtatatgtacttttttttaatgactgcgttagattatttgtcctgctaagcacttcgatgtcctgctttgtactttgatgactgttagattattatcctttgtatgccaaggacagtggaggaaccataggaagtcgaaggtctttatggaccaaacgaaggtcttttttgggccaactagtttggtctgttcgcttattgagtatgctgtgttaggaggattccttagattaagctccacatgcagtatccattgtatactgagcttgatctctaacctgttaggtcgattaagtaaattctggactgttgcgagtttgtgtttcccggttcgaagatttcatgttgtgtgttgtgcataaaccctgttcgaagagatcatgttgtgtcgtgcatagacttcaactatgggtgctatgttccttgtgtgcagcagaaagctataaatgtactaacatttattgtgcgggtcaagactgcttttacaactgagtttactactactttgtgtccttcaaacattattgccattcatcctttgtaacctgctcttttttttcccttgaatacagccatggcaggaatggcacccgaaggctcccagtttgatgctaagcactatgacagcaagatgcaggaactactgtaagccatcgttctattctaccgtatttgtaatcttagtagcagctaatggatgtttgatttctcatttgcaccactcgttatgctatatgggtttcattatggactttgtgtctctcgcaacatgcaggcaccaaggtgacaatgaggaattcttcacttcatatgatgaag

SEQ ID NO: 66375 - DNA, 3312 bp, Oryza sativa
ctggatgaagctgatgagatgctctcccgtggtttcaaggatcaggtttgcttctgaccagcccattattctgctataatacctccaacagtttgtatggctgatcttttacattatgtcttctgtagtgttcatgtttgtgtaattgtgttttaagagtgtttcaagcatcaaaatctgatataagtacaacatatttatggaattgttatctgagtgcgcgctatgcttatgtttatgacttaatgttactattcttgaagaaatcataggtgattactagtttgtaaagctggtagttcatttttaggactcttttaggacttacagtttctctctctctttttttttacttgctgaccttcacctgcttcattggctatctgttaacgcaacaatatgactgcatatttttaatacatgtactatgtgtgtctaatggttgatgagctattatggaagttgtatttcatttctttatgctgtagtgttgcatggtctgaacttacatatggtgttcccttttcagatctatgatatcttccagctccttccaccaaagatccaggtcggagtgttctctgctaccatgcctcctgaggcccttgagatcacccgcaagttcatgaacaagcccgtgaggattcttgtgaagagagatgagcttacccttgagggtatcaagcaattctacgtcaatgtggagaaggaagattggaagctcgacactctttgtgacttgtatgagacactggccatcacccagagtgtcatctttgtgaacacccgccgcaaggtggactggctcaccgacaagatgaggagcagggaccacactgtctctgccacacatggagacatggaccagaacactagggacatcatcatgagggagttccgatctggttcttcccgtgtgcttatcaccactgatctgcttgctcgtggtatcgatgtccagcaagtctcccttgtcatcaactacgacctgcccacccagcctgagaactacctccatcgcattggtcgtagtggtcggtttggcaggaagggagttgccattaactttgtcacccgcgatgatgagaggatgctgttcgacatccagaggttctacaatgtgaccatcgaggagctgccggccaacgtcgctgaccttctctagattatgtcttaggaagtaaggttctggataaaagtttgtttttgtttttgttttaatatgaccaactttctcgtttgggaggagtggtaaggacggggtctatttgaattgtggttaaggacggcttccatgtttttctcttttccgtatgcaactatgtttggaaatttttgtagctgttaggctgtgctgcttcctgggctagctgggagagggagacactactggaatatttactttctttattaagctatgcttgccttgtgttattattccaatctgctcttacattcttcagctgtttgcaatccgtacaaattttgttcttattggtaatgtgaaatctaacttgtttcgagaaaaagtttatgttcaacttatcaagaattctgctttatcagcatttggtggtgagaagatcttgtgcagttacacgttgtggatcaacctggtaaacattattgcagtactggttggctgtgtttttttggctgtctggtccaaccacagcaagatcacaatagcaaagcaagaccacagcaagatcacaatagcaaagcaaagcttgtgcatcagtaatggacgtttggtgagtactattacaaagcgaaagcgatgggcgttgattatgattttattgtgcttgctatccgattcagagcctcatcagcatcatcctgtcttttgcgccttttcctctctggactggagtcactggagtgatggcatggggcatcttattcctccacttgctacacaaaagagctagtactatctttgatagggacactggactggagaacaactctatgtgcctggagaacaactctcctataggctgtgtttagttcagcgcgcaaagtttggatttttattgaaattggaaataatgtgactgaagagctgtgtgtgtatgacatgttgatgtgatggaaaaggactgaagtttggatccaaacttaactttagatctaaacacaacctgtaaattactacactgataggagcactatatcatacagcccttgacgccaacaaaataaagtactgtccatatatatatatatatatatatatatatatatatatatatatatatatatatattccaatttgtgttctctgacctcctcgatcaaaaagctttctataacaccgaaaggtgaactttcaattgtcatttttgcttttataaccctgaaaagtagaacattcaaggtcatcttttggctaatttgttagacaatggaagctttttaattgaactccccaattacattgaaacgatacaattgtactaacactttcgatctctacatagcaaggatatacatggccaaagcactctcacaccctctcgtttgaattcgatacatgaagttttaaaacttatcaatccgtagactagatcatcctgggtaaaaagttctctaactacattcttcaaaggcagacatgtcgcaagttccaaatcatgtgtacctggcttgagaagtactccctccgtcccacgatataagggattttcagtttttacttgtaacgtttgaccactcgtcttattcaaattatttttacaaatataaaaaacgaaaaattgtgcttaaagtactgtagataataaaataagtcacaaataaaataattaataatttcaaatttttttaataagacgagtggtcaaacgttgcaagcaaaaactcaaaatcacttatattatgggacagagggagtacaacgttttgataagtataaacagtagccttttgtccttttgtgggaaaagtattccccacatttttcgctaatacaagaagatgcacccacgtttgctatcacatcgtgcgttacgcacacataaatctccttgttgtttcagctagaaatttcaaccttcctattttattaatactactaagatagtattctgatttagtttttgtaatttgtaaaatcttcaacaaaaagttcttttgatttgaaaacttgaacttttgagttcagtttataatactaaaaccttgaggtagaaatgtgcagctttctatgtattagcactaggagacaatactaatgatttagtttgtgtaaccagtgatatattcaaactaaaaagctttcaactgaaaattgtcaactcctgagtt

SEQ ID NO: 66376 - DNA, 2838 bp, Oryza sativa
tttgggccactcgccacagaatgagcccatcaaagccgaagccttccctttcttggcccaccaggcccggcccacccgttcgcgaaaaaaatccaaggcccacagatccattcttggaggagggggcaaatcgagtcgaaacgaagccccccgtcgcctccgtcgcaagcaaaccggagatcccctttcccttctttgctcccaccaccgcctccacctcgcacacccagcggcggcggcggcgcccgcggatttctcgctcgcgcctccgaaaccctagctctcgcccgtagtagccatggcgccgcccgagaaccccaacggcgcgggccccgcggcgccgtccgaccccgcgcagccgcagccgcagccgccggccaagtccaagtggaagaagaaggacgagaagaaggatgacgatctggtgagtgtccccccgcgtccgttccccggcgcgcaacggccgatgggagggagatcgagattcggaacctcggtttttcgtttgctggattcgatccgtggttttgtgttgactgttttttttggtgggcagtcggaggaggatttggcgctcaaggagcagctcgagctctacgtggttcgggcgcaggacgcggatcccggcgtgcagaagctcgcgcttgagagtatgaggtgctgttcgcttgctgaaattaattaaccgattcttttttttagggtagggtagcgtcgcgtcgtttcctgaatcccagtaggaaatctaggtttagatttctggtctccaggcaaattttgtaaatgcagtggttcatagggtttattttgatccaccatagttagatttacttggttaagaccaaattttgttgctttgatttccatcttctgtcactaaaatatcatcctccctaaaaggcaggagattcgttccgccacaagctcaatgacatctgtaccaaagccactgaaattcctccggccacactatggaacactcaagtcttactttgaaaccatgccagaatcttctgatttgaaggtatattgtctgttgatttcccagttgtgcagtagcctaactttctctttgtcacagcgatgaatgctgatagtaatttcttactgtttttagaggtacatggccgacattttatcagtgttagctttgacaatgtccgctgaaggagaaagagtatgttcctgccacaataaaagctttttgtatctaatctgaacaagatatttctttgtttgaaacttcagtacttttcctaatgtttttttgcctattacttgtttcaggaaagccttaagtaccgtttgttgggctctgaaggtgatatcggttcatggggtcatgaatacgtaaggtaagggcaattttacatgtttttgacattcatattttgccttctaaagtggtatgatatgcttgtgccattattctaaagtgataatagtgttagttagctgtaacttgcatttgtgtcatgaactgtcacttcctactccacttatatttgaaaagtttttgttttttcattcttgattcttacttctgtccaagcatatgtttgaactccagagtccagacaatgtttctgtccgtgcttttattgggaatgtcaaagcgtgcctagtttatattttgaggtgccaaataattgagattgaactaaacagctttgtcaattattgttaactaatattcctgcgaccaatatactgagtaacttgtagaatcatgggacagaactaactttatgatagtcatagcactgtattgagttctaaactatacagttttgtttatgattaggaatgttttttttgaatcaatatgtcgattgtgactgaggttgtatcgttggaaccttttaattagtgtctttgacattttattttgcagtgacttatccctgatttatgtccaaattacctgaattttagctatatttgatattttaacagtgtattcaaactcaatatattatactaatgttttttttttgttttcattacatatttgggttctaatgaaatagctgtctcttgtacagaaatttggcaggcgaaattgcacaagaattccaaaagcgtcaggtaccactctcactttcatgttaatagaagctctgaaacttttacattttttttgttaccttgtatttatcttcccttcatgactttgttctgaagttgtgataaattgtttcttttgttatttggtgacttaattcactacttcctatcatggtccctttctgattccagctatttcaatagctacgtatttgttccttcttgtttttttgttaaagcttgttgacttttgaataacatgcccagagacttgcattgatgactgttggatagctgaaataagttatgaggttaccatgttaagaaaccgtcgtttattctttcttgccccctatgtgattctctcgccatgcatactatttgtccattttaattccatgatgcctgtaactaggacaacgtttctttaaatgttttgtttgagtggttggaacctttgattcaataattaattgtttcacaggatgatgacatgccgattgacgctcttatggaactagtgcagcaaattgtttcattccatatgaaggttggttgacttgattcttatcagagattttggttttggtatttaatttgatgctctgattgatgccacttagtagctgtagctgttgttatttgtttgacataattaatgcattaatggtgctttattgtaatttgtaatgcagcataatgctgaacctgaagcagttgatcttctgatggaggtattttcatatagtgtactaattaactcagatttta

SEQ ID NO: 66377 - DNA, 2410 bp, Oryza sativa
tctataacaaagtctatagaaaagttatttttaaaaaacaaattaatttatttttaaagtttgttaagctaatacttagttatcatatactaatgagccattccgttttgtgtgcagtatgagcatatcctaagagcaagtttaatagtatagccaaatgttagctccaaatcatctatagctaatttaatagcccattcatacaatagttatctataaatctataacccgttttttcctctctcttctctttacttctcgatatgtagttatagctgacttatagcctgctattgtacttgctctaacatgatcatcggaaaacacccttaaaaattgtgtaaaaggcccaaaaattgaaaacgtcgacagttgaaaacacgacggcattgtcggccatcctgtcaattaacgtactggcgttttgtgtggccgttgatggtaacatcctaacatgcatatgctttgctctccatcacgtatacagtacagatgagagcaaaagaagatggtaacatcataacatgcgtgcctgctccccatcacgtacagaagaaggcggcatagtctagtccacacgcacattgctaaacaataataacgactataacaataacggcaacaacaataataacaacaataacaaccagcgcgaaaaggtcaccgttgttgcgaactttcttatttttaaacggttcatttctttcgccagaacaaaacgacacgtgcaaataaccgtaaccgtagtgtaacatatagcgggcaagtactaactctgtcgtatagccaaaaaattctttatattacgagacggatgtagcagtagacaactagtgcactggcagcctgcagtcctgcaccaatggccggtcaattcctcttcccttttccacacaggcagccacttgatctcatctaccgtacggttgcaaattaacccaatctatatagaaattaaagtgtccgatcaatcagcatcgtcgttatttggcacgaaaagaaatagctagcttccacatcttctgggctggaggtcatactcgcgcgaggacaaacgtaacggtgtgaacaccataattcttctgatttcgattggcttttaatgtgtgtgttcaagcgatcgagcagtagtaatgactaatcacatggtataatgatactcagaatgtgtcatgtacgcagcacaaaaattcgattagattgattcagagtttcagacacagtagtacatgcgctgatggcggtgtatcgatgggtagctagcggtcggtcggttgtctggaggaaaacaactcgatccaaaaccgccaaaacaacaataattaagctcacagaaaaacacatgaaaagaacaaagaggaaatgaaacaagaggagatcagcaaagctagatcaagagatacacacatatgacgacgatcatcgatgaaacagctgggacgactctactgcatcaaggattaattaacttaaccacatgtcatatggctcatgaggagagatgagatcaagctggctactacaaataataaattacttaattacttaattaggcagccggccctagctagctagctaatgcccctactgaactgaagtgaagtagtagtagtagtaccgatcatcaagccagctgcatgccttaatcatcatcatcatcagtagtacaccgagatgagtagattttctactgagctagatcagatctaggcatatgcatatcatgtactgtatgcatgtatacatatgtgtatatttatacgtagctacagggcacgagctgcattcatatcatccttcatgtacgtagaataacacgagatcgatcgatcatcgaggaggaagaacagatgagaagagatgagctagcggaggaggctgcggatgatctcggcgcctgggctgttgtgatccatgccggccatgaggtcggagagcctgtcgctgaggtcgtccacctcccggtgcaggctcttgatgtagctgcacgtctccttcagcagcttcgtcgtcgacgcctgcattttattttgcatccgccattaacaacaataattaattagagagttttaaatagcgggctaacacatttaacggcagaccctctatagtggttaaatagctagacccttctcaaacagctgtagccgaagatttagaaccccgacaaatctacacatcgtcgatcactcatgtagctagcttgttcatgccgctagtgtgcatggtggttatgtgaacttgtggtgatgagaacggtgaaatgtagtacctggttggcgccgcggcggcgggagctggggaggagggactggagcttggagatgagctcgttgatctcctcctccgacacggaggagcgcgacgacctccggctcgacatcgtcggcggcggcgagggcgaatgcgg

SEQ ID NO: 66378 - DNA, 2110 bp, Oryza sativa
aatgcacaattggttctgggaactgggactgaatgacattcagtggatgcatgatgcatcaaagtacaaatcctgaagtcagatacatggaaagctttatcctcaacccagataagccggcaacctgggaagtagaggtgtaactctgtaagaccacatgtgatcctagattttgccaggtaccacaagtgcaaatactataattggtggtaaacgttatgctaacctgatgagtatgtggtcgtgaacaacagattgttctagcatcgataatttttatcatagaatggattttcgccccatgattctctttcagccctggccatgtgttcagattctacctcctccaagatagattgctttgtgcttcttttggaggttgaaggcctcgtagactgcaacaagagtgaataagcataggttaagaaagaggagcaacgtaaagatgagataaaccaacatgcctaacgaaagtaaaaagtatgatatctgtagcaattatacagtgatggaggaacacctaaaaagcattcctggaaaatactaaggaaagcactcagaagaaaggaaaattgacagcctatgttacaccaaataataattgcttgatgttaccaatgatcagattagaatgttgacaagcagcaagcactagaaaatgagaccatacatagaagtacagctgccttgcattgattagaggtaccgtttagaaatatattgctgcataaaagataatatatgcaccatccctgtacatttgttttccttgaggttgatgcaaactttcaaattcaaatcaacatctcatgttatatttattttaaagtcctcgcatagacctcaaacactttggagggatggaataaagcatgaacatccatatactagagttgcatttccctaatagttgtgatgattttagttttgaacaagaataccttgctgatgagtttctcaaatgcttctggtccattctgttcaatatatctctccgcagctgatagcacatcatcaggtttactcaggttttcttttcttggaacataccagacatttactatttgacgattcacaaacattggccgcacaaagtgatcataaacataagcagcaccatggaagcaaggtaagaccaaccagcagttgaagaacaactttgcataggaccaaaaaggaagcctgcaagcaaccgtcagaagtaagcatatctaatcctttgttatcctcttgatgtgtgaacatgtttatctccagcatcaatagtaaaaaaaaaatcacaaatattaccacaaaaaacaaggaaaacactagaccagggccaatcctgttttattggtcttctatattatgaactccctgctgcaagggactcacaggctatgttgctaaatctgaactttttgagggaaatcaaatgctaaacaaaaggaaatgagtaagacaaaaaaaaaatctcctgacccaggaaaatggtcattaccattcaattactggagcaaaagtaagctcaaacaaagtgataaacgagtacagcacccagtaagtgagccattgctgatcatcaacaggagattttgtttctattgctctcacagaggcatatctgcagaagtgcgaaaagtaaatatatatatatataataacagaaataatcaaacaatcaaaatggcaaaatattgaattacaacaaaataatacttacaatggataagcaagtgaaactaatggcctgcaaaggtaaaacaacagaattgcctcagaaccaatagcttcaaatatataattaacaaaaacaatatgttttaagttttttcataataaagaccacctgctctcgaagttttttcataatctctagataatgcatgtcatgatcactgatcacattgcactatagttaaccaagaggcattttttctattactttctcaaaacaacaaattacaatgcacataaagaccccagcttaccatgataataaaaaaaataacagacaatattgtagttcacatgacagcagagcagatagttcaatgaagctgcttgtgcagaaaaataggaattcaaatttcatcttgtctgctacccaacatcaactaatatcact

SEQ ID NO: 66379 - DNA, 17583 bp, Oryza sativa
taggcctattttctagcgccagaaagatccctaaatgagtcaagcgcgtcctcgatcctcccacgacgacccaaaaaccgcccaaagattctccccccaactttccccacatcccccctcgttcttctcccaaatccccacacatcatcaaccaagaaccaccaccaaatcgacatcgacgagccacagccaacgaatcggcggcgaacgaaatcaagaagaggaaggaagaagaaaccccgcccgtacccggcgaggacgtcgaagttgttggccagcagcttgaggaaagatccagaccccatcctctccccttccgccgcctcctcgacctctctccctccccgatggatcgaccagctcaagaaatggcagagattcttgggagctgtgggctagtagtggagagccgttgctcgggagactcactcccccctttcctctttactacttttctcctcctttctctccgctgttcatggccatggctggtcggtcaggtcagctactctgccgctggtggtgtcagtgacagtgagattcgctgggccaaccatggaaggttccaggctgcttcttcttcttcgggaccagatttctcggcccatctaagaagtgggctagttgggccttaggcgacgtgaagcgggtggtccaaaggcccaacgatgatgtgctggacctgcaaatgctagcacaacgctcctcggcttccctccgtgtggcggcggcggcggtggcgccgtggcggtggtggcggcgaagcaccggaagccggcgactagcggagacggcgggcgcggacgatcaagcggcggcggcggcgtcggccggagaaccatggcgcaggtagatgagcgctcttgaattttttatctatatgcttgagtatttttttccctttttcgtgttagtatttttaggtcggcctgttgaatgtttgaatattgatttctacgagctagatcagatgtcgtcatctcgatcagattgttcatttggttgatggctgcggcactgccttccaaggcagaggttatctgtatctgacaatctgctacaagtctgaatattatcgagttttcagacgtgaacagtgacaccccttttgaatttcagagaaactacatatcggctgtgtttagatccaaagtggatccaaacttcagtccttttttatcgcatcaacctgtcatatacacacaaattttcagtcacatcatctccaatttcaaccaaaatccaaactttgcggtgaactaaacacagccgataatgcattggcttggctggttgccgtccaaaaagttgatgacgaccaaaataggcaagaataagttcagaattcagaagcctcaggccagccaattcagccgcaaatctcaacgaacgaactaggaaattaaaccaaacaatgtgaagagcgagaagatgaacaagagccgaagattgtatatatgtcataagtttaattaatttggaagtcttagttagtgctatcaacaacgtgaaagagcgagagacgatgatcattactgaaacttgatggactctcagtaaactaatcgaagacagcctctcttctcactagtcacaagctgcgatgattagcatagcaccagtcgcagctgtgcttaggagatttgataagatatctccccctatccgtaccagaagaaaagggcacaagtcatcatgcacactcattagggcatgcagtatttacctatttaaatcctgcacaaactaagtacctttttcccatcagaacagctgatgcatcattaagttgttgtgctagctagtttttcaatcatttgaatgccatatgctcttgctttaacttacaatattcttgcttggcattttattggggaatatgaattatattccgccctgttgttatatacatcaggattaattacttttcaagctttgagatcatgccatgcatctcaatattatttttagatatatataatcatcactaggaacttaatgctagatcattaaaaatagtaatgctctaatgcacctaattcattagcttgtgcatcagtgctgataattaagcaacttgctgagccgattaaggaagctggtttccgtacatatgtgttggtttagtgagctagctgcagactgtttgcagcaatcatgctgttcaaactttgatagtaatattgttgtcgcacccagcaatattatgctgcaagtggcctttcggggacctaatttaagagagattccttctgaatttctgataatttgtacaggtcaaagatgtgcgggtgaacacttcttacaagtcaaagatggtccacccactcacccacaattcaggtacatgtccaaacctaaaataatgtggcactcagcttacaatattgctgccatttgcttgtagactatgtttttcctttttggaggctttggcaacttgtcttcctaattaagttttttaagcaatgtaatggagtatcaactatgctgctgctgctgctgctgctgctgctactattacagactgatggggtatcaaaagctgagaaactgtacatgtgtagattgcttccctcatcttttcctctttaccacccttttccacaaaagtgatatggaattcaaccctttaaaggctttaaaaattggtggccatgcatcaaatcttcaccccaaaaaaagtggaaaccatgcagtgctgctataagtacaccaaggcttgcacatgttaactattaattgtttacaatgctgagagctctttaatttgtcttaatttgtgactttcttgtttctatgggattaattactgtgatagttccttaattatatgtatctacactcaagctgtttggtttgcattaaacatgtgaagacgataggcagtctgcatgtatgatagattgagcactagtagtgggagaaatagctctgcctacctgtgaggctgtgacaactaacagcttttgctttttatcattcctctccatgttaggtcctatacattcacattaactaatcgatcagtattcatggcaattcaggcatggctaccttgtgtttgtctagttagtttactctccctgcatgtggggccggccattgattagacaagtgaactcccccggttaattttgataagaaatgtcctctcatgcatcaattagtcattgctaacaacttaatcaaactgatattattatacgtagtgtagtgagcaaacaattgattgtccagacaagggtgaagagacaaattgcaaatatatattatgaatgcttgttccagaaggatacatggtctatctatgaagtcatccatatatgaatacatatgcctcaacctaattaatctcatcacaaacaaaatgcagagctttcaagttaattaatctcatcacaaacaaaattcagagctattcaagtggttaaccttcttagtgatactgaaattctagtaatacacaaagatgtgacaagactgatgttttttataaatattcacatgtggcatctgctgatccattagaaattaatatggattatcaccataagcgttatagtgaatgtgaaacaatcacaatatagtaactctggaacatatttgtattactagtgttgtagatcagatgtcggaaattgtttccattatccaaaaggagtgctagctcattaaaggctagaatgtggttagggggcttccttaaatttactctaataagtaagaaaggaacatgtaggaggtttatatatctaacacgatggagactcatggaccacacagcaattcctgtggttcacaggaaacaccagaatcacatggcaccgcctgtttaaaagacagaagtgatttcatatgtctttcatcgtgtcctttttctcctatcgatcaattcttgttccaatttaccacccctctccttggtcctgactcacacggtcacaccttctccttaatttaattaattattttagcggcaatacttttcaatccaatattttggaagagtaatattttctgttaactaactggattttgtacggtcttcaggaggtaccaagaaattacgctttgattaatcaacaatatatatctatatccaggtatgtcaaaggattaacactaattagcgctactagttacaagtgattgtgaaaaatctatgtttgaaaagtatgtttatggcatgagtacacatatatagcatatctatttgccactcctcttgggcgcctaaaaatgtgcattggcccctggttcttgcttttggtggacatgtagttaaattgtttggcctcttcccctccatatatatagctactcctagatgtgtacaaggccaagaaaacatgtgaggattcacatagctactactccataaatcagcaaagacatcatggatcgatttgatggccggtaacacgagacacgcaaagaggatatactgacgctgcacacatgaaaagcttaccagttgggctcacggcatcgaccgaccagctttcttacaggtaaaggcaaatctacaattagctactatacgaggaaatatatatcggaaacaaaaacttgggtgcaaacttgaaaatcatcgcatacaagtttttaattttttttaaagagtctcatgtatagctaaggttgtattagacaaccatataaaatgtgcctttgattaatggggattttgaaccacctcatggacttgtgcctagtacgtagtcttatgatacattttaatctatttctatttactagcaatccatatccttgataaagagagagaaaactagaaaaaaataacttatctatagtaaaacagtgggatctttgtagtagaatactcgtttttttttagaaaatgggataaacccggcctctacatccgatcggatgtacacagccaagaatactcgtttttatacgccgacatgccaccacgacatcatagaaactgactatggaaggatccttctagtcttccctaaccattcaaaccaatctaaggttggagatcccgcacatggcacacctatcaggtaggctatcatccttgtgctacgttagattcggaagtcgattagcattgattctcgttcgccctaactccacatccatcctcgccttggtgcctatgagagagctgagctatactataagtctagccattatccacactgacttatggtaagtacaataatttctcacaagagttttcgtgaattgtggtaagtgagatagtatctcaaggccattccctatgagtcttaggtagcccggcgttgcctccccctcaatggatgccataaatcccctttaatgcacaataattcgatttagggttttttgtttataataaaaaaatagtgaatattctaaaaatcatgactaaattcatatgaactccagtaaattctaaaaatgccaaaagtccaactaattataaattggtttcatgtgttgtttcattatattctaacgtttccgaagcgccattgtacttcgagatcatcgcaaaggtccaagtgtagagcaaggcaagttatactattgttcttgactctattctacgtgaattaagcaaatgttttgcttacttgaagtaagcattcattgtttcacaatttcacatgggatgtcaatgacctatatgtagttgtaagctatagttcgaatactatcatttcctcgatgacttgggtaacatgtgactagatgtttgcctaggatggttagatcaactagctcactattgggataattacctctctattttatacctaggaattaattaatggtgacactttgcacatggttcatgaggatgactaatccaactaaaagatgactaaatggtgagttttcggtgcatggttttgttgacgcatctatagcaattaaggactaattcgtcagaaacccttgtaaaatattattgtacttagcacgccagcgtgatcaatggttgggcttataatacagctcgctcctctcccaggcaccaaggtgagggtgggcatgatggagttgcgttggaccagggaacaagtcctgtcaatttctatgttcggcaatataatttatagggtgcacaagatcaaagagagatggtgacacagatttatactggttcaggccctcgagtgaggtaataccctagtgcagttggtgtagattggatctatgtcgagaggtgcggagatcagcaatggagtggctgatggcacgtgtaatggagtgtgtgagtaactcttcagggttcttgccgaagccctttatataacgttagggcttccggcggcatgcatgtcacaatatcccttataatctgggtacgtgcaatctatttacatgggattggataatatttcttatctcttatcccttcctatacatttttttttgtggggacccttcctatacattaaggatagccgcatggacctggctactcggcctgctctatgtgacacggcacaaaggccttccgtgaggtacccgggtatcgtgccctccacaggtgttgatcgacttttaagtccacagtggtgcaagggatatttcatttactttgagtcgttatatgcatgtggtagcttgatagctacttagttaaagcagtttttatccatatcatctcggaacctccggagaattgactgaaacctaaggttccaaacaattgaccggagactttgagaaataatttaatccgctacaaaagtttgtttaaatttcagttttcgcctattcactcctctctaggctttacaagggactttcagcatccacacaataaaaggtagagttgagcctatcggttatatggagaaaacattaaaaaattgaggatgatgtagagaatataaacaaaagacaaggtagaaactaactgcaagtttatatgcaaatatagcatgtctaattccctcctcatatgtgcaccacacattataatcaacatccaacttggtatgatcatccaatcttggttcgcaaacaccagaagagattgtgcatacatgagcgttttataagtttgtacactaaattacatccaactaacaaattcatatgccatcaatgcaatttgctaacaatgagtttaatagcaaaatgctatactttctatgggtaaattgacactcattttgatgtttgtccattgacaatacaggaaactattctaaactctcgagagaatatcctctcattgtttgcatgtcatccaaatgattataattttctttttaaaaaataagcaagataaattaatatgtgataaatcactccacaagcatgcaaggttaaatttaacttcaacatgttgcaatgagaaaaaaaacaaatttgactatgaatatatgttaactagcttttttttttgcagattgtggaagttaaaatttaacttacatgtttatgcagtgatatatcatatattaatcaattttcttaatttttcataactatttgtatgacatgcaaacaataatgggatatcctttggagagtttaaaatccactccattgacgatatattgtaatactagcataatgctcatgctttgctccatgtaaaggaatatatattatgacagtattatagataaaacatattttttatcgaaaatatatcagtatcacttgtttgcttattatttacatatatggtattcacttatttaaaacgagaaccctagccctagcaaaaccgggccgggctgggccgggcttcactgctttacaagagccagcttagtgaacctaataattctgctcctgtcctccttatcctgatcagtcctcggtcggcttttcctctctctctctctctctctcataaaacagagacctttaatgcgtcgtgatctctcccctccaatcccgacaaagtacacacaccatcgtctccccctcctgcctcgatgctagctctcccattcccatctctccactctccctcctatcatatgctcctcccttctccactcttcttctcaaatcctctctcttcctcttcgtcctcctcctcttgcaaccaaaaaacaccataaaatagtaatcccaatccacaagctcacctctctcttgcacacacacacacctgacacaacacttacacatcataccagaagaaaaaccaattcgattttgccaaattacctagctatagcatataggtaggtagctaggtagcttggttttccctaatagctctagcttgatctctttctagctctaccggcggcgtggcggcggcggcggcggccgcaccactctacatcatcacgtacacctgaccagcttagcgggaagccccacaagaagagtttgtaggtcaccaatcagatcatcagttcatctttgtggttgtgtgggtgtgtgtgtatatatataccatggcgtgagagtagccatggatgtcaccggagacggcggaggaggagggcaacggcccaatttccccctgcagctcctcgggaagaaggaggagcagacgtgctcgacgtcgcagactgccggggcgggcggcggcggcgtcgtgggcgcgaatgggtcggcggcggcggcgccgccgaagcggacgtcgacgaaggaccggcacacgaaggtggacgggcgggggcggcgcatccggatgccggcgatctgcgccgcgcgggtgttccagctgacgcgggagctcgggcacaagaccgacggcgagaccatcgagtggctgctgcagcaggcggagccggcggtgatcgcggcgaccgggacgggcaccatcccggccaacttcacctccctcaacatctccctccgctcctccggctcgtcgctctccatcccttctcacctccgccttgccggcttggctggccctcgcttcggcggcggcgcgcgggcggcggacgcgtgggaccgcgtcgtcggcctcgggttcggcggtgcggccgacgccccgtcctccgccacctcctcctcctcgtcgccgcttctgctgagcttccactccggtagcgtcggccttgacgtgtcgccgccgtcggcgtcgacctccccggccgccgccgacctctcccggaagcggcggtgggagcaagaaatgcagcagcagcagcagtaccagcagcagatggccgggtacacgcagagccaaattcctgcgggcacggtgtggatggtgccgagcagcaacgcgcaggccgccggtggcggcgctccgccgggaggcggcggcgagtcgatttggacgttcccgcagtcagggagcggcggcggcggcggcgcggcgacagtgtaccgtggcgtgccaagcggactacatttcatgaacttcccggcgacaccaatggcgctgctccccggcgggcagcagctcggcctcgccggcgccggcgggggtggcgaggggcacccggggatcctcgccgcgctcaatgcctaccgcgcacaggccgcgcagccggacgccggcgcggcggcgcagaatggagcgcaaggctcaagtcagcatcgtcagcatcagcatcacggcggcggcggcggcggcggcgacgagcggcatgagagcatgagcgccagcgactcgtagggcttccgttccgtccggtgtgtgccccgcattttctctggttttgatctgttcttctttaattttctccgtttttgtttgagttgttgtctactaatgtctatggctttcttcctcgacccatcatatattcatgcaaggatcatacagttgcattccatgccatctgcataaaaatatcttattgtgtgctcttaagaatggatcaccaatttcaccatgataaagctcttgcaagttgcaagtggtagggtttggttagaatgctagagaaccttttttttaaaaaaaatgaaaatgagaatgctagagaacctagaatcattaatcaataaatcattgctttggtatattgatcgatcgatgaggattatccaccaactaatcctcatccaatgcatgcatgcaagctagctagcatccattcgatctgccactctaaataatttcttgttggttatctattgcgtacacatttcatacatcttttctctgtcaccgtatatagcttttgcaagacaaaagtttttcattcgaattgtactaccggcatgcatgcatataacctcgacaaagttcctttcatttgaatgcatatgcagtgcacggttctactagctagctagcggttggccgggcggcaaaggttgccaaaaaccaagacaaggtagcacggtagcaatcagggattgcattgggttaatccgagggtaagcatcgacgacgaacttcatcaatcaaatataatttttaaaatagtttaacagtgaagaaaaatagatctactttctacaatccagctactaccagtggcccactcctttacagtcgtgggaacacacgttttcaaatgtgggggcactcttactaatttgcagaatatgcttatatttatagtcacgtgtcaaagttccagtgggcataacactattagtatcataggagttagatagtgattttatgaagaaaaacatagccttaagttaaatagtactacctctactagcggtgacaattagtcaattagtcatccgctggtcagaggatgggttaatccatcgagagctaggaatatccttgacttgtttttaatcacctgtcaaacttgatacaaatagttaaaaaagttcaaaaacaacattgaaatatagacttcagcaaaattcaagtttacacttaatctacctacacatcaagaaaaatttgaacaaatttctgtgtgaatagcagctaggtattgttcatatatatgatgtatttgtttttttccttcctcggtgtgtcatcagtctagtttagacttgatatttttgttgctagcatgcatgtatatcttttccgaaagggcgccaaccctttttttaattttttggggaggggcgcccccatttttctccacttctgtcatgtacaatagagtttgaaccgggggtaaattaatgccccccacgggctttccgtgccacaccaggggtcgcccccaccataaggaaatatggtgtgtttcctccgccgtcacacaatgtaagtcattataattttttctacatttatattgatgccaataaatttagatagatatatatatatgtctagatttattagcatcaatataaatatggaaaatgctagaatgacttacatttgtaaacggaggggagtaccaaatatttcaaaaacatgtggaaattgtccgcgcgtcgtatctttggagtggaggaacgtacgtaggtgggtggggattttgtaatatggagagctagcttaggttatatatccagtacccccgatcgaggcaccaaccaccaacaccaagccatccatccgactatccgtgagcacaccgaggcccccaacgccgactgatccccaccccccaccgcgaggcggcgcgcgtacgtctcaccgatcgagcgaaacgaaacgaaacgctgcctgccacggtgcatgcgcgcccggcggcccgtgcgcccgcgggatggatgggtagatgcgggcggccccgcgcgtacgtacgggacgggaggaagagatcgtacatcgcgcgagcgagcgcgaccggcccacgcgcgcctactggcgctggctggctgcaaaccgatctcgcgatcgatagcgcgcggggagatggagcgggaagcgcgtggtccacgcctttctccgccagcgcgcaagcgcaaacggagcccctgtgcccgcccgcctgcaggtgcaggggggcactgtcgcgccggtctcccccgcggctagctagcttcatcaatacaatcgcccgcctgcgcggacgtacactgcaggtggagggccggagcatgtaccccgcatcgcatcgcgcatgcatgctatgctatgctccaccaaagggtacgttacgtatatatatcagccgggcgagacacgtacgtttgcatatattttgcggacaattattacccctttggatcgatggaatttaattagtactgttttcatctcagaataaattaatatatttatagaagattggagatagattagcaacacacacacaaatgatcacaatgaacctatttaataaccacactgcattttctataatatatatacgtaaacttcttttattaggcgatgggaacggaaagatggtgggtaggagggagtatatcttcatctaattaatttgttgggttccacactttattaaaaaaataacttttttttataaattcgaatggtagaattcaattattccgggatggagctagtagggaatatgaaggaattgaatctgttggtaaaaaaaattctttgagaggcttttggatggtagggttccctcatagaaaattttgagaaactattactatatacatatatacgactcaaaccgtccaactggatttgatcaatggttgcagtgtatataaacatatgtttctttgttatttgcatatccctaattgtacatgagttatacaactaggttgtacatatagcagtactcgaaattttatatgttaggaaaaattctttcacattttgtataaattcttctagcaaattaattgctttgaaagtttcaatatacctatctctcccttctctctctctgataaatgaacacataatcttatattttctccacttttcgatcgtacgaggcatccaaataactattttgtgtaatacttgcggttttgtttcctgctacaagaaacaagttataacattttaatcatatatctttttatactaattcctgtattttaaggaacccggtttcttcgactagtgtggttggcactagcttgaccagctaattgaattggtgacacgtttgtgcatggatgcggtcattgatgaacatgaagacgatcgatcgagagactacgcgtcgttgcctcgttggggttggccacataatgagctacaatgtggtgactgcacaagtgcacagtttatgtgcgtgcaggtgggagggaggaaagaggggagagaggtgagaggatgaggccaataacgtgcgtgctggagctgtcggttgttctctgcgccaaattggagccgtcacatgtccggctgattggccgcattgagtggccttgcctagctagtggccgcagcacgtagcagcagcagctgctgcagcgccctaaacacaccagtgaagcacatgtgtcgtgcctcgccttgtctccctaatactgccactcgtttcgagctagcagcttagagctaacacatctctggaaaagtattagttcaaaaaaaaactctagaaaagtgattatgatcccatcaattaaccaagagttggttataaatcaaaacgggtggacggtgatggcaacacacccagggacatctaggaaaggagtccacactactaccctaatgttcctacttcctagtgacatgggagatctagaaaaaaaaacaaagggtatttcagctcaacgaactctcaatgctatccctctctgtgaagataaaagaagaggctagcccagatcatcccttagagcatctctagcagggacactaaatatagcccctaaacagattttgggtgttgaggctaaaaaactcaatccagcagagcccctatcaaggatcctaaattaggtaggcacccaaataacctttcctagcccctagtctcaggggctctactgcacagcccccatccacggttggaaaagcgcgggagccgcccgacgtggtcttggtccaccggcacctcccctgcccagtgctcatccccggccggtgcggctcctccctgcctaccatgtcatccctcaggtgcattcctctacccaacgctccttcccggccgacgcgtctgctgtacctggagtctcctctagcctgcaccctctacctgaactcgatgaaaaacatggcccagtggccgagtcatgcgatggcgtcgaggcactggatgattcaagtgttgttgcaggctgcgaaattgagaaagtagtagcagggtagcactagcagctgcgattgtgggacttagaagaatggggaaagtgatacatgcgatgtgctatgcagcttttttgttgctttgcttggttgttgcttcgtgagagaagtagctggtctattggtggatgagaagacgggaaaaatcaacacatgtgagaaaatgcatggaagcgccacagcagcagaagctcgtttcacccgagctatgaatacatgctactaggatttgtatttccattttattttttttaaaagaatcgaatttgaattgtaaatttaaatatggttggattattatggttttatactaggagtagcgtagagtatagaactatagatttgtactttaaagtatatgttaaaatagaagatgaaatgaaataaggggcgagaaaagggactgctgctggagttaaaggtattttttaggtacttagaaaatggggaaagcccccattaaatttttaggggctataaaataggagctattgctggagatgctcttagtcttctccatgtgaatttacaattctttactttcgtacggttccttttcttccgctatgtttaatatgaaatatgcacattcgggtgccgatttgttaaaaataaataaatcaatacggtgtgtttacgatataaaataatttgtgagtaaaatatttacatatatactcttacccacctaacagtccaaattaattttataattaaattttaaaatttaaattttgactgcggttgatttctttaaggtaaacgacgagtcacatagcttagacgagatgagtgcactgtttgacgcaaattaatgcgcatgcaatcgtacacccgtacgagagggagagcatgtcatgtgatttcgagaggcctaggaacatgttggttcatcagtcatgccggggcgcatgcagaattagtactgctcggtaatttgtgcgactttatggtaatttagagagcagcagtactgcagtagtagtacgacattactacacttatttaatcgtctgactaattaaactagtgtcagtttattcagtatcagtatgatactaatgatagtatctgatctcaaggtcggcattactatgttgggagcatactccctccgtactcgtaaagaaaatcgtttagaacagcgacacggtctccaaaacacaactttgacttcttgtttctataaaaatatttattaaaaagtgatatatgtatacttttatgaaagtatttttcaagacaaatctattcatatattttttacattttcaaactcaataacttgagagttattcatgatttatatttccaaggtttgacttaaacattgtcctaaatgactttctttacgagtacagagggagtatatactttctccatcccatatactatatctatatatcctaaaaaagttatttctaacatgacagtttgtttcaaaataaaactatttctccatagcctctcctttcacccaactataaccattatttacttaatttcttcatctactttttttcttaacgaatcacaatgtttattcattattttaacttctttttaatatccgtgtttatctttaaaaaaaatacgtatattttaaaacagagttgtatatatatttttggagttcttcctaggacgtaagcatttctaaagtttgtcatggtacatgactaacgaggagagatgtgaagttaaattaagatcaatattgtagttagttaaaataggagatacagggagaaataaatgaaaaatgattgtgatcgattaaaatgagaaattaagttgatgaatatattacatagtactatatatttttttgataaaatttaaacgctagccgtagctatattttggaacgggcgagagtatttcactcactctgaatttgacctcctcatgttgcactaggtggcttttgtcaggactagctgtggcgcgcattcctcttttgaaaagataggcagggtcgacgcaggcaggcaggcgcatgtgtgcgtctctaccgaggtgacaacaaaatcacagggaaaattctcccctttcatagggatcaatgagcttaagcacacagctctcatgccgttgctgcgtccagtccttttcctctcctctgcatcatttcctttctctctgtctgcgtgagtgtgtgtgtgtgtgagagagagaggggaatctgcagagaggccacggttgggtttgcaaaacgcagacacggctgcttgctccctgatctctactgcatgcagtagctagcactgcactgcatgctggaggaacaggatgggagtaggaggagctagctagccgaggaggagggagagagaggagggcacagctttccctctactcccgtcgcttttgtggccagctgatcgatgagctgagctgagctgagcttaagccgggaagaagaacagctttatgtgcgtggtgaaatacggagcattcacacacacacacagtgtacatgtgcatgtcagtgtgagatactgagggcatgtttagatcagtttgttgtggaaaaattattttggtaaaagttttggtggtaaaagatttggtattgaagtttttctagttggtgtttagatgcatggtaaagttttatcattttactagtaaagagagatagcacggctcccaacatattttttggtaaaatttactactctagacacccaaataacaaatgttaaattgctaaattttctactagtgtttagatccattttaacaaaaagtactccaaaacagtaaaacttttgccattttagaggaactaaacaagacctaagggttgtgtgtattgtgttattgcgtggtggcagtagtacaacttctactcttacctcccctttccagtgcgtgagagagagtagagatggatactaccccacccattcatattataagttgttttgttttttctaattagaatttctaaagtttgattaagcttatagaaaaatatataatcatttttaacataaaacaaacatattatccaaatatattaaatattagttttaacaaaactaatttgatattataaatattgctaatttttatatatatatatagactaattaaaataacttataatgtaaaaaattataacggaggtggtactacactagtactcctatgttgcttgctcctgagctagctttcgacttgtcggccgctctgatcgatgctgccctttatccctctcctttctgcctcgatccgggccatcgcatgatttgcgtttgatgcaccggtgatgaccgtccaacagcaaattctggcgggcatgcatcacaccaatcgtccatggatcacttcccccctcttgcatgtcttgactgctgttcgccggtcacaagagctcccatgctggccctgttttagggaactttaaatagctacagttacttcgagaatctctaactccgtaaacaatctaagaacctgtttggtacagcttcaactcctgaatttagctccatgagttgagtctggagtggagt

SEQ ID NO: 66380 - DNA, 5679 bp, Oryza sativa
cgcttcgttctctccacaatgcaccaaatttatccccaacctaccctctcctcgagcgcttcttctccacgcacggatgcatcacacacccctcgccttcgctctctccacagcgcagcgcaccagcccgccggaggaggtcggtcaccagccacatcgggctcgccagcgtgcgggagggggggtagggcgtcggtgttcgtggtgacagcctggtgctcgcgcggactcggtgtccgtggcaacgacgcgatgcatccctccttctccccgaggagatgctggtgctcgacgcggtccgaagcagggcagactacgttggtggcggctggcgcgctggcgtagtggcgggaggcgtccccggcgtcggcggctggcacggtgtggcggcgagcaaccggagcgtggggctgcggttccggcgccgccacaaccggatccggcggctcagcgttggatctggccggggtcgacgggagtggacggcacaacgccgacgagcagcgggagcggacagcttctccacctcgccgatttccccttccttttctctaccaaattactcaagaattttgttggtttggtctgcatctgtggtgggttttttccttttctctaccaaattacttgagaaattttgttggtttggtctgcatctgtggtggttttgtggggggggggggattcgctgtgcgtttggagggatttcagttcgtcgatgattccgttggagggtgatttggggttttgtataggtgcagcgcgcttgcctcgcttttccccgtccgctcgcgccctcgccgcaacaaagttttgcgccgcttaggtaggggataagaaacctagctgaggtgcgggcatggtcgcctcgttgacccgaatctgagctggcgcaacaagatcacgtaccagctcagtgcactgtgaaaggcctaatttaagttttcaccagctggatacttacaggcaccaatgttttagaatcttcagcccctaaacatggcatgttcccttttgttcaaacttttcgtagtggtgatgatattattgaagcaattttcaataagaaaagaaaatctagcaaacatatgcagtttcagttctgcatgtttatcccatttcgccgtgcgtgcgcgtactctttttggccggtggagtacacgggtcgcagagaatcgttgctgggcgctcctgcgaaaaatacaaaataaagtgccatggattttagtgcgtttttggtcgcgtctaaaaggaatcaaagtcataatatatgctactgtgaccatcatgtatagtactactataatcaccatattgtatatgtatcgattgatttattcatagtctatagtgctattgttgctgctaccggtagtgtctagtgtgtggtgctaattaatattcctaggcactataattggattagaaggctctaatcgtttttaattagatttggatggtccatgccgttttgatgcttagcgctcaggatatggtcattgggacctaaattatctggagaaagtgaactatctgattaaaaattataggtgtgccatttgtgcttacgtacgcagtctcacccaaaaacagaaacttcattgtttaaagtaccatgcacagagggaatggtaatttggcacactaaattattactctctccgttttagagtcattttgactttagtcaaaatcaaatcactttatatatgatcaagtttgtagataatttataacaccaaactagtttcgttaaatctataattaaacatgttttcataatatattattcttgggataaaaacgtaactagttttcctacaaagttgattaaatttggagcaatttgactttgaccaaagtcaaaataactttaatccgtataagatgtgcacggtgagaagaatatgatataatagaagggaacaaagtcgaccatagtggtctacaagagcaccttcaatagtctcctaataatccatcttcaataaagtgatattgaactatcccaatatcactttttattattaggaagctacttttgcagctccccaatactttattttcactgtacatcatgacatataggctctatccattagatggccaacaccatcttctttatctctccttgacggtcaaattcattgtctccgcccttcctccgcatcccatgttggcaatggggcctcatttcccatttatgtgcgggaaattctctttaggacgggaaaggttagaattggttccgcataagaagtcgaacgagataaattatgtcacgtcaggtttcatgggggcaaagatgatcccccattcgatcattccccgtcccctgcggagacccacataggtttcaatctttgttaagggggtatttgaatctcctgaagatgaaaatgaagattaagtgtttcacgcaaaatgagatggtaataacgtgtgattaattgagttttaattattgcaaacttgaaaaaggattaatctgatattttagaacaattttcatataaaaagttttcgtatgaaatgcgccgtttaccagtttgaaaagcgtgccacgaatatccaaaacttaatccatttttgtaagtggaaacgaacgggggcaaatattaatattatttttttatcatgtgaattagtagatatatgttgatatattaatataaagtgtgaatatgcgttttacgttcgcatatataatttgatatgtacgtattgttttaagcaggaacagagagattaattcccatgcggaggtggggatgggaataaagtttcccccattatttttcgctgagacgaggacacataaaggtttgactcatgtggatcgataaaaatggggatgcattctccggcgaggaattccccgttgtcatatctactgcggtgtcttgcgagaaagccgaacaaggtagaggcaagcctaggttggagacgcattggatgagtcaacgacgagtgtgcgctcgaatttagcgagcaacgccctcttcggctagctagagctcggggcggtggagctccttcgggcagcgctagctaggcagtggtggcagagctccttgggcaccaaaatttggaaaactttgatggggtatttattgtcaaaattaaatgtgctaaccgcataaaaaatgccacttgttcgtgactgaaggagggatttgagtactatcattttgagatcccaccacggaagacacaattttacccatcacacccatgcacaccacatcctcaattacaaaatatagaaaattatattttaaaaaatatgtatctttattttctttttttttaaaaaaagaacaaaactccaagtacttacgaagggcagccaagcccacccgagaatacatgtgcatgcatccatccatactcctttcgtttaaaataaataaatttagtacgaaatgtgatatattttggattatttagtcccatatactatttggatccagggactaaaaattgctaaaggcacgtggaccaagggagatgctgccactttagtccctataagtacctccaagagggactaatagattttagtcccaatatgcacttttagtttcttttagtcacacctgtttgaatttctagggactaaaagagattaatgtggtgtttgaatctcctgaagatgaagatgaaaatgaggtatttcacgtaaaacgaagtggtaataacatgtgtttaattgagttttaattattacaaacttgaaaaataaattaatctgatattttagaacaactttcatattaaaagttttcgcacgaatcacaccgtttagcagtttgaagagcgtgccacgaaaatccaaaactttatccagtgttagcgatggaaacaaacagagcctagaatagagggactaatagattagtcctatgaaccaaacagggtctaagattataaatctggacaagcttcctatagccctatatatacaatacaatatgttacatcccatatactttatccgtttcacaatgtaagtcattctagcatttcccacatttatattgatggtaatgaatctagacataatgttagaataacttacattgtggaacggaggaagtaaaattattttatttgaacggaagtagtacttaccaaaactgaaactgagcaaattaatcaaagttggtggttatgcctggtggttgacagaaaaatccaggagctagcttacctgtatatatcatcccaaccctatcagctggcgcatgtgtgtgtgtgtccttgcagcagaaacaaatgaagggataaagctctctagcctaagcgatatcgatcaagaggtggctgcggggaaaggggaggaaagcggcgttgggccgggcgacacggcggacggcgacgttggccatggctgtcgccccacgtaaacgaaggaacactgcccccgcgtctcgatcgacgtacacacgaacgaacgcacgcagcgcggccgcgtcgccgtcggctgatcgatcacgtcgagacgtcgccctccggtcgggtcggctgccggcatccgtcgtcaccaacaagtgcagcacggtgagaggaggagagcaagcgaatcactcctaattaagcagcagcagctgtctgatcgcctgatgtttgtgtaattgtgtcctgatgattaccagcagagtccgaaccacaaattgggctgaaaaccttagtgggccgaaatggggccagaggcggcagtttttatcttgaggggccgaggcctggtttgggaggggaataagttcattctaggtccctcaatttgtcgccgagtttgaaattcattccttaagtgcaaaaccaggtacaacacatcctttaacttacaaaaccgtgcaaaagaggtccctcggcagtattatgcccagttttggctgacgtggcgcttatatggcaatttaattttaaaaaataaaaaacatgggacccacatgtcagctacatacaaaataataataaatggtgggacccatttggccccacatgtcatccctcttctctccatcctctctctctctcacctgggcggagcaggtctgagcggagtggctggccggtggagctaagcggcggcggctggagcaagctggcacaagcgacgggcaaggggcggcggcaccgcggcgccgagaggtggcgggcacagcagaggggcggcgggcagagagggggcgagtggcaggcgagctcctggagatggcgacgggatgaggctaaaaggacgccgccgtcgtcgtcggtgtcctcgaaccagtacggcttatccacacccttgaggagggggaaaccgttgaacagcaccgggattgcgtcaatggtggtgtagatatgggtattggccgtcttcgggtgcttctcctcgcgccacggcaccgcctcacggccgtcgccattgtcgtcgtcatctcaatccccgccgccgtcgatgaagaggtgggggacgatgttagctaaactccggcaactgcagtgaaacctgcaacacacacacgcttggacgcgagaagaacaaaccaattgggaaagtctttttggcgctgcatattacttgcttgcgacattttctgtttctttcccttttatccatacgcgattacagaacgtgggcacgatgacccaacttacgcggacacgatcctttctcagcagatgcca

SEQ ID NO: 66381 - DNA, 5209 bp, Oryza sativa
  unsure (1)..(5209): unsure at all n locations
catgtgtggcaacttgcaagcaacggaagaacttgatgggtaattttaaattcttcccgagaaaacagcatgatctgcactgtgtaattaactaaaacggattnnnnnnnnnnnnnnnnnnnnnnnnnntgccatcctgaccaagcaatagaagggaaaaaaaaaaagcaagagcacacagatgcaagacagtctaagtcagaactcagaaataacaatacaggcccatttcaatatacaaatgccatccctcttcaaggtaaagtctttatactgaagattatatcattcagtgtgctgctagctctgactcagtttggagcacttgctttctgtgggcattgctgttttgagccacttcagtcaagctggcattgcacatccgacagcctggtccatgagcacagctcactgctccttttagaatacaatgacagccaaagcatcaccattagctagagtacgtgacagaaaaaataaagctttgagaatgtgatggccaactcactgctgcatgtaatgctgttttcagctcactttgtccatcagcatggagaagcaacaggcacaattcagaggaaactaaatctgactagatatttctttttaacacaatgctttatttgctataccttggtacaagatggcatcccccacaaaagggtttgtgtatatgaacatgaaaaagacttctactgactaccaacacaaatgtagttagaaaaatcaggcaatactacaacatgacatgagctttgtgcactggcaggaagaacactgcttaattggccttactctgctctgctagattgagcttaatcggtcttgctctgctctgccacattgagcttaatcgggcgcgcctcgaatccacctcccttgcggttctcaagagtgtaaggcatgtatgttccgaggatcttgtcccacatgacaaagaagggctgcgagaagttgtacttgttgccatagagctggtggtgaatgtcatggtaggcgctgttgttgctgaagaagacatggaggatgttgcccgggagccacaggccgcagtggtcatcgacggtcttgatggtcgcaaacgagaagaagaatatggccgtcttaggagtcatgccggcgatgaggaaggagagggcgccgccgatggtgtccaggatgaggccctcaaggggatggttgtagagagctccaaaggcatacgggactacaagagtgtggtgcttggagtggacatgcttgtacaagaacttgttgacatgcatatatctgtgcatgaagtattgccatgtgtccataacaaacatcgcaatgatgaattgcaatgctatcacaagggccggaggctgcttcctcacagtaccactttcatcaccaatgatctacattttggggaaattgcaagattgtaagtacaataatcacataagaagtttcatcaagtagaacgaaagtaggttcaaagagaaacttctattagtagtgggaaccgttgcatactatttcaaactttattgttttctagatcttcatatattagcttgcgcaaaatgtttgaaatccaatataataaatttccccatgttaaagaaaccaaccaaaccctgtttacttaacaggttagcttcagagttaactacagtttaaggcatgttcaacagtgagacaaaactcaagctcatatgctcccaaaatcaacatgcaaccccaccaattctgtttgctatcaccaggctaatttttccccacattacaaatgctacaaaaaactgtccaatttcgcattcacagttatcaagaaagctattgtttcagactagttcatgacatattctcaaatccatccccaaactgaattttcttttccctatgacaagaactaacagcagcgctaagacaaatgtgaggagagggattgttaccgtgaagaggaggagggagacggcgatctggaaggactgctggacgaggacgcccttgacgacggtccacttggagacgacgttcttggtggcctcctcccccttggggtggagcctgtagtcgtccatccccatggcgtccagcacgatgtacagccccgagtagagccagtacaccgcgatcgggacgaacgtgccgagcagctcgtcggacaccgcgaacgccatcctctcaagacactccaaatctccttcaaatcctctacacactgccatcgaaaaaaggcgcaaatctgaatgagcaatctgaatcgcaatacgcaggcattggcgggcaccgagcacaaaaccctcaaagaaaccaaaaaaagaaaaacaaaaagcagggaatcgattcggatcttaccaggaggaggaagcaaagaacgcaagaaggctctcctttgtttgattcttgtgctgctgctccgaggtgagtggatatggtgcagggcggccactccggcgagtacttatagcgaagcaatgcggagggggggcaatggccaaggcggtggcggtgcgggcgggcggggtctgagaagggcggcgagaccggcgactcgtacaaagatttgttctttttttggacggaggcgagacgcactcgaggaaggaaggaagaccggctcggagaggagaggagagaaggcgagccgtccactcctcctatctgttgctgtcttgacttcactggaatctgtgtggaaggagaggagggctcttctcaagctggacaaagggttggttgctgcttctccggtttaggttgtgttttggggttttttttttttttgaaatttttgaatatttagtattaaaagtaaactcttgtaaaagttgttttccaagatgtgaatcttttggccacgcaaaataatactgtcatgtcggtctggttggcgtggtagaataaaactgtcaagcctactacacgccagctcgttcggattttggaaataagttttagaagggtttatttttaaaattaaaaattaggaaggtatgaaaaaaaaatccactttactatcttctacgcactttttttcacatgcacgctttctgagttgctaaacggtatatatttctaaaaaaaagtctatagaaaagtttctttaaaaaatcatttaaatctatttttaaatttttttaagataatacttaattaattatatgttaataagctatctcattttttatgtgggaaggaaaagtccccaactcctacttccaaatacatctggcattctaggatttaaattatatagaaaagtttcctgtagaaaatatttagaacaaataactgattccctacaaagttctttgaaattttagtggactaggctactatagaggagttgtggagaaaaataatcatgtcttcatctttctataatttcaagctcatgtgtttttcccatgtataattgaaactgtagttttgaggcttttctaagtttttagttttcataggaatttaattagcacaatattctatttattattattattttttttagagaagggtatttttttactcggcctctatatccaactggatatatgcagcttttttttaataggaacttagcctatcgaacagggaactaactctcaaataacccaatctgaaattcgctcctatggagatttgaactcaggatattgggtgctactcaggttactgcaaacacgatattctattatatgtttctttttcatttttgtattttcacaattccacgttttaaaagaagacctataatctagataactaaccctagtggtaagtggcgaatgtgattactgttatacaattgtcaaacagaaaattatgccggctagcacacaggattacaggagattggaatggattctcagatgcattaactgttttgaaggagatagcacgtgctgggatgttttgaccaggccattattttttttactcgagttgttttatgccagcctgtaccgtccaaaagaaattatttgtacaatttaaaattttaaaacttagttttgtaactaaaattagatgtttttagttgtttttacttagttttggctttatgaaaactaaaaatagaagtgtacaagttttatcgtaaaattattttatattagtaatgtatttttagttaataagtcgcagctaaaaatatatcttcaagtggacaataacagtatcacttggcaggtttgtaggttgacacaaattagggtatttttatgttgaaaaggcacttaattatggtgagcacgtcacattttttgcttggtattttttggtcaaacttggagaaaccaggataacagaccacaggatcatcatatatactatcatgattctacatatcattccacgtgagattttgagattgacctctcgtcgcaggatgtcacattatcacatcccatcacaccaaagcactatactactcttaacgagtaattttgccccaaatcttctacggtgattcaaatcaatgatcattttgatggatgaattggacaacttggaattgacaaatggcatatgccttcctctacgcctttccattaaggcaggcgttacaaaattatttgcccggacagaataaagctgcaaatttaattactccctcagtttcacaatgttagtcattctagcatttttcacattcatattgatgttaatgaatttagatagatatcaatatgaacgtgaaaaatgttagaatgacttacattatgaaacggaggaagtagttttttaatgagttacttcgagccgcctagccatgttgtcagtgtgataaaaaatacgagccttttgttgtaaaaaagtgtacattttcgctttcaatagtgcgtgatagagcccacgtgtgcgcgtatggaatgcacatttataagcgtatggagtgggcatgtatgcatatacatctttgtgtaattagaataaaatcattttattaaaattaagtaagcgcaacttaactgattagattctttatagtggaatcaactcattcggataaattctaaaacacgggtgttcgtatttacggttaattattctttccgtgatagataacgtatatgtcaatagagagactcacatgtaaatatcaagatatgtgcgcgtgctatgagcgtatacgtctgtactgtgattctaagattaccttttatttaaaaaacaaggtagtgtttgagaaccatagtgttccacgctagggagaagtactaccgtaccgaacgag

SEQ ID NO: 66382 - DNA, 2614 bp, Oryza sativa
cgtcgacttgagaacggtttgataaacctggttgctagtgcatgtcaccattccataatagacttgttggccttttgcttcctaccatggcagatggcacaactgcttcacactgattacgttaagttttggacgactgatccaccactcatcaacgtgcctaatctattaattagatgctactgataaatgataatacacatatccgcacccacttttcttggctctagaaaggctagatagcatcatgccatgaatctacttctccggtctctgcacggtaggggccaaagttgaatcatagaatataagagcgtttttttggaacgcgggattctcaaaacgcagagagagattaaagtgtcatgacatctcaaatcccatggattgaaaaaacacatgaaaacatatgaatagccatttggatagaacacaggaaaaatatagaaataaggccctgtttagaggtcggctgcggctcccgatgaggaggagctctgcagcgagtgagcgaggtcggccgcagcggtggtgttaggacttgggcggcgaaacggtgaggacagccggcgatgtgagaggacgaggaggatggaaagagtgacggggtgaatgaaaagagtgacggagtggtatggttctaattttaaaaattttcagtgtcatccagtcgataacgcgaatagtagtgttatttttttgatttgccacatttgcagtggcatgggtctaattaacccaagtttttttccaaacttcacatcaaacctttcttacacacataacttttctatcacatcgtaccaattttaaccaaacttccaaacttcagtgtgacctaaacacagcctaagaagagagaccctaaggatttttctccaagaggttgaagtccatgttaaaattcctccagaattcctatgatttgagccaatccaaaggaatttcataggaatttttttaatagttattcctatgaaccaaatgaccattgaggaaaattttccataggattgaaaatttataatggtctagaatcagctactaagctctacttgaccaccatcaaaaactaggtcagaatgggactgctgtaactgctaaccgcacggcacggccatacgtccatacgtacgtcacctcggacaaaactgatgaagcacacaagggcacaagtaataaaaataattgaagaatacaatccccagcgaattagcaagggttataatatttataggaaggcaaaatgcatcaccttccacaacaatgcgattgagaactcgaaaaaaaattctcagctttcatgatgcaatcagcccaaggatatcacatatatagccttcttcttggatagggatgaaatcagattggaatcaggaggacaatatttgtaccagatcctgggtttgtattatatacactatccaatacactttcatccctagtcttggatcaagagtttataatcatccaaggttcaaagaacacaaacgaaaccacccagcctcatagccctacttgagccttgttgccttggcggaatgccaaggccaaaagaatgcggcaacacgcaaacaaaaagatgagcttaagattcatggatataactttgcagcacaattcaacagcatgggtgaacaaggttggaccaggacatcatttgtgcagggagcagatcaacgaggacagaaaatacaggtaaagcaaaccacagtgacaggaactgtgacaaccatccaggtttcctaaggtttggacaacttctaaatggcaccgatgcatctagcagtataaccggctcagggtaaaaacatggtaaattcagagtaccaatcatcgatacgctggcgcgccaggaaaggaatagagagacgaaaccgatgcaccaggtgcattaagccttgtagaggcatacctttgactgatatcagaatatgcgggattggggacctcataatgagctgttggatagggtgcgtggagagggaggtccacagcatgagtgatgcgttggtcagaacggtaaagatcctctacacgaacagcacgagcagaaatttctccaggacggtacagatcctccacacgagcaccacggataggaatttctcctggacgatacagatcctccatgcgagcactgtgagcagcaacctctcgtggacgatagagctcctccacacgagaaccacgagcaacaatctctcctggacggtagagctcctccacacgagaaccgcgagcagcaagctctcctggacggtagagctcctccacccgagcaccaagtgaagcaatatcccctatccgcctgagttcctcaacacgggcagcaccatcagatcttgtggctgggactgctgtataatctcttgaaagaaatggatcagccacagttctggcagcaacactgaagttcaaggaatttgttagccaaaagcatggtattgttctaagtaagaaaattgaagcctataataaccaaaataggatgtaatagttagtttgggttagtattcaagtgtacacctacagcaaacaaaacatgcttaatatagatgatacgctgatagaaatttattaatactatagtgcataaaacatttgtccaatt

SEQ ID NO: 66383 - DNA, 7288 bp, Oryza sativa
tcccatcctaggttgttttattttgggacggagggagtattgtagcacttttccggtggtatgttgggaaaaaaaaacatgaactacaacatgtttttagaacatatttttccgtcaggaataaactaacaagactaagtttccacaaggaattaggtcaaatttaaggatgggcgtgggtcactgactggtgcatttagttaattttgttgaactagacaaattcatgacgatcaagcaaccaatggaacttctcttgcaaagttgcaaacggaacttttctctttttcacaccttagagagctatatctccaagggaacagttaagatgaactataaatgggccatcatgtacataacacacgttaacctttcttttgctcagaactgctttgtgttacattggtctattgacaatctgacacgcttcttccatggattccttttctacatttcctaatatataaactatatggttgttaaggcgggtaaggcgacccacccacgccttactagttaccactatagtgtaaaaccgctaaggtatggcgacaccataacctaagtgattagcagcatcagaagagagagagaaagaaaactcaggccagcccaacaaagcccaataacgttcataccagcccaaagtcaaagaaataaccctaacacccacaccaggtacacactctctcctctcaaagcgctgcctccaatgtcacttcttcctcacgcctgtatcgcttcttccttgtgctagctctgtcctctatctgtgctccttactcccctgattcagaatgaatccagtgcttctctttgtatgtgctccttcccttggatggatctaatgctgctcccttgagtcaagatgaatctggtgcaggggagagaagaagagaggaaaccagagctaagggggagcaagatggcgaggcatggagcagagaaatgggaaaatggtgtagttgctgcttccttcacctcttctccctctccctctctgggttatggcattaagcccttaaggtggagggatgccttaacaccctcagggagccctagagctatagcgacgccttaacaaccatgatataaactagagatggcattattatcaagtatcagaattctgttgaacaattctaaagaaatgctaataaaaaatcgtaatatatttcttaaacctcaagattgtaccatagaaatatttgtggattagataagttatgagcacttcagtttaattgataacataaaattgcacttgcagagctgaatgataagagaggtgaaggcatttgggctcggttcaattatctaagaaagtgtttcacgggatatatactctattttaaaaccaggatactggccatgttcattcgtataaaagacaataaaaatgttctaggttgctaatgcatgcattgatagtaacaagtccaaacatttctcacacggtatctttacatttcggaaaaaacacagcttcaagcgttaatctacaaaaaataactagttaatcaattttatgtcagttttcaaatatttaactaaccaatggaaagatcaacttaatttgctgaattagtaagtattttcccgtctccaaacactatgcgtttccaaatgttttactacctttgtcccaaaaagagttcacttttagaaacgaatctgggcatgcctcttgtccagattcatgtataaaagtgcagtctttttgggacagaggtagtatttattaaccacaatgacagaccaacatgcaagagagagaagctctcgcaaaatttctacaagacatgttacgaataataaatatggaccacaacttaggaagctttgtgcattaacgtaccgatcaggcagtggatccacttgagaacgataatatggaacatcagatggagccaaatggcggtagtatgcatgtggaacatgctgaatctctgggatagaagggccatgacgaggctctagggcatgcggcacaagacgaggctctatgtcaagaggaacacgctgagactcgcgtgcaacaagtgtttgctgataatgtatgtggggaccatcatgagcattagacaaagaatgatcaatcctataatccactggatgtggatcaaagcgtgttgccctgtataagtctttagggggaggaacatgcatgacaggcaaagaagatcgtctttcttcatattgatgtggctgtgtttttccttcatagtggtgcatctcttcaagaggcttctgtggagctggttgaggtacactcacagactcaaatagagctattagcctatggacctgcacaatatcatgtaatacataagataaagtaaatactaacatctatgatttgttcttttaaaactttctgttttgaacaaaattcaaatgacactcacttgtctagagttgagctcgggattgaacttgctctttgcactatagttctctctgattgcatccttaaatctgctctcaggaagtggaaggcaatctttatctatcttaaatttcacctgtggcgagctcaagcacaaaaaatagttttgagtacaacgaaaatatcaaatcttcaacactaactactctagatgaagcccattttcaaacagaaggttgtgtggaatcttgtgcccatgaattcgtgcttgatcattgaaagtagataacagtccaaatatgcaattgtgaggtcttaaaagttgtgcacggaattggcaatggtggtcctaatatacatgctgtacagtcttatgtaagaaccacttgtacaaactttcgtgactttccatcatatggtttcccagatatggtaaattccaactaaccaatggaagtgcagtaaaaacaaatcgaccctcacagagttacagttatatctgaaatgacaacttgaatataaaccaagcatcaaagaactctatggacataaatggtcacaagcaaatcctgttattaagaaacaggggcaatgaatgttctcttagcagtctatcaaatcattcagtcacattacttacagcaccacctgttttcttaattaaagcaaagatgaatatagctagctagtatatctacatctgtttcaacagataaccaatgcaaatgcacaattcaagttacagctgatgatgatgtctaatgcatatgcatcaatcttccgaaaatggaaatgcaatatgtatcgacaacagggttattttgttctcagaaacagtgtgaaccagaaagataccatttctactatcgccaatcataggtttgtgtacaaaaatcattggtgcaccatagtatcaatcaatccccaaaatagtatgtacacccttaagtataaaaacataaaccccaaaaaaccatattcacttcctctttaaaaaaaacattcacagcatatgagtttgtctacagcgatggaataccagaattacctgtgcagggaattttccactgaatgcatctcgaacaagatcaagcccaccctttgatactgccttgtacaccccataaagtagcttcaagtcaaaatcatagaggaacaacctcatccctggtcggatcttctcaactattccgattttccctctgggatacccaaacaagcggctctgaaagcattctggtttagtctgcgcattacacatgaatataagccctcctcccttactgtcaagcctctcttccttcttgcttccctcctcctccttcctcctttccttcacattgctagtcctctccccagcaatctctctttttctcttcttgatggcatcaccatcgttgttatcagcacctacaccattcttggtggcaactacagcattagcattagcattagcctcagccagctttggttttagctttagccttcgctttggcgttgatgcttcagccgtagctgccgctggcgtcgatatcacccgagctgctgatccatcggccacagtagctgatcgcggagccggggctgcaggcgatgcatcagcattgccaccagcagcaccaacggatggggaccctgaagcggcagcagctgctgcagccttcgccttcgccttcaccttattcaacctagatgtcttcttgaccgatgcaggggtggaagggctccccttggatgccccgtccgcatcagccaccgcggccggtcgcaaagccggagccgcaggcgatgcatcagcattgccaccagcatcacccagggacgcggcctctttaccagccgcagcggctggcgcagcagccttctcccggctagccttcgccttcaccttcgccttccccttgaccaacttagtcaccctgagcgatgcaggggtggaagggctccccttggacgaccccccatccgccccaccggcggcggccgccttgaccttggcggcgacgttgggcttcttcatcgtggttgacctagcgtggaccaaatggggggcaaacaaacgaacgaaaacctatcatcaaaagctacaccacgcgcgcatcaaacgaaccaaatcgggaaggaagaacaaatcgaatcgatcccaactccggattggatctccgacgagggagggctacgagagagatagagatgaaaaataccttcgattcgattcgattcgcacctgctcgcgggcagcaggggagaaggcgcacgggcggggaggagaggagcaggccgaccgaccaccggtttgcccccggcccctcgtcgccggcgacgtgcgccggagcgaggcgaggcggcggaagttttccggccgtgcctccgccgggaacggcgtttctcttcgcaaacaagggttacgatagcgcaaacggagaatcgaagataaagcgagacggagagaggggtggaggtgtggaaggggaaatgctttatgggcctttatttccaaattagtaaatttagcacattttagaaaactttttttcttcaactgtcaatttccttgaacttttcgtttgccttgctagtaatgggtatatatatgccacaagtaggatgactcatctaaggccatgttttttcagcttgggattattataatccagattattaggagtaagttgaaagaaacggataacttattgaagtagcttattataatctagagcccagcttattataatctgataaactcatttaggtgagctttttctagattattgagtgaaaaattactcaccatgccaccccactccctttttagacttgcaaactcaataatctaggctctaataatctggaaagaaacaactaaccgcttattctactacagattataacaatctagcttatagtaatctaactcaataatctagattataataatcccaagctgaaagaaacagggcctaagactcttatatctacatatgtacttcctctgttccattctaaaattgcacggtgaatattaaaggtaaagtgtttttcaagcaatatagtttttctttaatatgtcaagctacaatttttgccaaatgctaatcttgataaaataggtatagcttcgtgacatttattccgattaatggatatcactattaggaacactcactaagaacctgcataaatagtaataagtggtttttaatggagtatccgccaataaatttcccgccaaagtctacctcctcactagctaaaacctcatgcctatgttatgcaaatccgatcaataatattttttttacctatctgaattacaacaccttaacatcataatgtcttgctcatattgatgttgttaaaagagaaaaatgtaattgatgtttgtagaatttgaagggtattcctgaagatcaatgtcaaacataataagagaggtgacttgtttggacccctaagaccgccaaagagagatgccattcattctatcctaagaactaaaatcctagtgtgcgatgacatagtgacgattatcatgttgcttaagagcataggaaattatacgaatgagtttgaatatatggttagatgttttctctttgctatcacttgttggtaaaccggaggaatgtgaggaatccaatggtataaaagccctacaatttaaagcttgcggcacacgccaaactaactgatgaataaagtacctatttggtgacattcaaaaaattttaacattcatgaggatattttcaccttcgcatgaattcacaatctgttaaccaccatcatcattatgtcaatgacatgagtgtgttgcacaacttattttgggcaaactaagatttaagcatcaatacatcgacaattatctcaactgaaattatgaaagaaatagcaatttcgtaacaaaggaatttgtcatgtacataaacatacataaggcaggagatggagcggagcttgaacaataaaatgaaggggccaatatgtaagtttctttgaagtataggctactatactaacataacatgtgacataacatgtgacagattatagtggacaaacttcccaagccccaagctaacaaaaaaaatttcttcatcagtatttctcagaatatcctttaaattaattaatttttcaactttcaaatatttaactactttatttgtgcgttcctataattgtcataacctcagttttattcctcaaccatcaatactctacaagcatggcctttaacttcaagcagtcatgggcatcaggttgacatcataaccaatcactttggtagaatccttttacagtcccatactcccatcctgattcagcactgcagaaaaaggggaaaattagaacaacattgcatcatctagctgaccagctctaatccatcaccgcacataggcaatccatgcgaacatgtgatgcagctttccatattttcttcgtattactcaaaatattgactagccacttcttggcaaaagaatcacagcatgatcaaatacatatttctcatggacagacggcagctggtgagtccactaagggtgagtttgaggaggaggagattgagaagattgggaagatacaaaaaacgaggtgagccattagcgcatgattaattgagtattaactattttaaatttgaaaaatagattaatatgaatttttaaagcaactttcctatagaaaatttttgcaaaaaatacaccgtttagtaatttggaaagcgtacgcgcggaaatagaaacaaactcactcactttcttcagctgccgaacgcagcctaaagattgagatggcagcagctgataagagctagcagaacagaaagctgcttcatgtgtcatactccctccgccgcaatatatccaaacttatagtactaaactg

SEQ ID NO: 66384 - DNA, 2476 bp, Oryza sativa
attcctgcagccctgaataaaatactccaactattagtgcagtggagaaagatatgggaaacattgacaaaataaaatgtcactggatatataactctttctcctttttggatagatacaattgggagataagtttgctataaataatacaggagcattcagctatagtttccttccaatagactgccacatactctattactctacaccatgatggtccagtacagtttagctaatgaaacaatactatcataaaccagcaagaaaaatctacaagtttctgcccagcacagttgtaagaaaatgctacaaaggaaaattttgttacagataacaaagaacgctcacgtaaaattctcctggccagtaaaacaacagcatatcagtggtttcctcattattgggagtattttttttaacttccttcatagaccaaagttgcatagtgtcaggaattccatttcagtgtcaacatacttggtccagagagctttgtactggttcaacgcaacatcaagccacggtttcatattcccattaaaatgtatcacagcagcaccagcgataacctcaggactgatgcttggattatacccaaggcccattacatgccatgatttgtcaagcggctttgtattgccatagaatgtcatcagcccagcaggtagaacagatgtgggatcccaaagcacaccatcctcattctgccatgaaaataatgggtcatacattcatacacatatcagtgccttggtgagtgcaaacgcatgctagtaagatgcaaaaatagacaactatgagatcatttgcataactgcatatgtatatagtatattacacaggacaggacaaagtaggtcaagataacatgcaaacataaattgtatatcggggctgttattgttttaattactacacaatggccaatgaacacaaaaagcttagggctcagcaaaaaagtatcacatatgcatggcaatagaaacctagtgatgaattcatcttgtgttttgtggaacactagttgagaagtcaagatcatgaagcgctcaatcaggcgactattatacactaactgacatgattggttagatccttgtttacaagatttagccacactgtggttgaatcggctaaactagaaccagtaggtttgatgacttggttcacaattatagccatacgtttcaacatgaaaaaccagcagtgtataccttcatgtctatatctctatttttttacttctctcccttcatatctctacatctctcaatcttcaacatttagtggactaagcaacacaatacttaggggctcaagaaatatctataaccacatcgtgcaatcgcatgggaaattcgctagttgataaacttttacaaatgtgatacatttctgattatccatacacatcattgatagtagctaattggaatagtcacccaagagactacataattcttcgtatgtcacagaaggaatgtattgccctataatttcctataccaaatgcccactcaggttatttaaaaattgcaggaaacatcaagatacctgaatcgcatgatgatcaatcacaaaatatcttaagaacttccatcgagctagtgaaactgcaaactaaatgcatatgcacaaccaaatggcacgaatcgaggagattgggcattgagcataactataagcggcagtcgcgtatcaaaccaaacgcactccaatgctactcatatatgttatatataaccggataaaacagaagcttaccatttccatgtactgatggaacagctccgtgcagccatcccttcgccatgcctcaagatcatacacattgaccccatatgcccaagcacatgcgccaggatcgaaccgctcctgcacgatggcctgcgtgaagttgagatacttgctatatctcctgaatccaccgaagcacatctcgacggcaccattcaccttcccatccaagtcgagatgccagagcccagccaaatccttctgcaccaccacatcatcctccaggagcaccaccctctgcagtgccgggaacatgtctgggaggtagaacctcaggtaatcgagcaatgccacgtccctcttgccggcctcgatctgcctgagcaccggcgaggaggtctcgttgaggaacgggaagtcggagtaggcgaggagctggacgtgcacgccgagcggcggcgggcggcgggcgaaccagacgcggaatgccggcaggtacatgggcgcggtgaccacgtggaagacgtggcgcgaggggtcggccgcggcgcgcgcggcggaggccaccacgacggagacggcgagcacattgtcggagaacacggcgtagtggtacagcgaagggtcgtcgaactccggggacgggtcggggtcgtcggcgaaggcggagggcttggcgaggcgggcctcgaggaggcgcatggcgaggcagtggagggacttgggggtggagcccgcg

SEQ ID NO: 66385 - DNA, 2001 bp, Oryza sativa
taggaggaacgagagagtcgccagcaggagcagcgtcaggagcgccgcgaacgccgcgcggcgcggcgccgacggccggaacgcgcggccgccggccatcggagcagtggaggggagggggactggagtgggaagcgcgtcgcggatctgagactgatgaaggagacgggtgggcccgcggtgtcagtgggcgcggggtcgggtatcccggcgtaaacagtgggtgggcttgtcggtgaggttagatttactaggttatttgtttataggatgttattattggtggattaagtcgtgggtttaattaaggtggggacattattaatcatttgattaactgactgactggtgggggcaccgttggattcatgagaaggtgattcgtgtcaatgacatgtggggctcgttacattgggtccacttgtcagtgaggtattaagattgggagtagttggtttaggtgggagtatgcatgggagcaagatccggccaggctggatagatatcgggagtcaagacagacattctaatcgcaattttagaatagatcaaattcgatcataagattagttctaaactacgtaccgtgtcgacgacactcgacagtggatagtcaacgcggttcccctgctctactccactgaattttgctccattttgttctattgaaacataaataaacattaacaattctttgacaatggctagctgaacaattgatctaagggtgatcgaaggccgaaaacatagccaacctatacataaatgttgttacgatctgaccgttaattagttttgcttactctaatacaattgtaacgtattcggtactccctctatcccaaaatatagcaacttttggatggatatgacatatcatagtaatatgaatttggacaggcctcttatccatattcgtagtattagaatatgtcgcatccaaccaaaagttgctatattttaggacggagggagtatatacatagaaaacatccttctttgaccaagacatcgatacacttatctaatacgagagggtggaccagaatacgacatgtgtactcggtcccccagcgatgtaacttgcaatgtaggttggcgaggctgactgataggatagatccacgtgtagagatcgcaaatgtgccacccttgcagaggttttggccagttgcgatgcccctagggtgcagggataggctgagactagccgatgaagggatgtctttacattgacgatacagtggaagctccatgaaagcaatgaggctagggtgacaattttgagtgcaatgatccctctagacggcgttgtcaaggtggctcgctctcccttccaccggtcatttcagggtgaaaaccatatgttcagttttccttttacgggcgatggtggtgctatggtgttgtatctttattgaaggcgttgtcttggaggatctgtttttgccttccgttttcagacagttgagcctatgtttttggatgacgacggtccgttctttctcacactctccctctgcaacccctctcggttgtctggtagactttggtatttatcgtcttttggcgtgttgggttgttcagttttggatctgccatggctctagtgatgtctgatctggcttaattgtagtcagtgtggtgctagtcctttggttcgtatagacattatcgatgtgtgatggtgattttgttttacttttcttgattaaagtcttatgttttctttttatctcctatatcaatataaaacatcacaatatctcctaatgttaaaaaacaagtaaattgtacattggatcacctagtccacctcttaacccatcttttcacttcagacaacccctttcttgccttttgtttcactagcatattagagtaagtttaatagtatagctcactactagctccaattaatctatagccaatctaatagtcaattcatacaatagttgctcactatactattaatatatggtcccacatgtcatacacaca

SEQ ID NO: 66386 - DNA, 1033 bp, Oryza sativa
tgcgttgcaataggattttaatcaatgaaaattaccattaacctcgttattaccattattctttgtctacatctcttaaaaagttagggagttggtactggtggaggttgtagattcagctctcaccaccaccactattcctttttaaaggagtatagattttggacccttactgtcctctagctctcctatctatttcttggcatagagctagatataagctgctaatctcctcacaagttagttataagttatcagcaaaccaggacatgttgaagttggagaagaagaatgaggttgaagatgaaacaaacggtaagaaatgatagtctaaagggaaaaatacaggttaagagatagtccaaatgatggtctagaatgaaattcactttttagaaaaggaaaagtacgaattaccccctaaactcttgtgacagtacgaattacccccctgaaccacaaaatcagacatattacaccttgaactattgataccggatgaattaccccccggactcaatcctgagcggtttttctcctacgtggcatacacgtggcgccgatgtggaaatccaatcagcaaaaagaaataaaataaaataaagggcccacctgccattacctctcttccccctcccccctctctctctatctctctctctcgggtatgcgtgaacgggcagtgggcggcgtcggcggcgcgtggatgggcggtcggcgtgcaggggccggcgggacatgtggcacgccgggcggcgggcggcgcggaggaggcgaggcggtggcggaggaggcgaggtgaggaggtggcgaggtggccggctcgtcaagctcactattagggcctcgtcctcttgcgattaggggagtgacggctagcaccggacttgcgacaggggtgagggggcggtgcgagcggcgaccgtggaggcgagggcggagacctgggcgactgcgatgaatggtgccgccgcagcatcccgtccccgtccaccgtctgtccccgcacgccccggcgcaccctcccgcccac

SEQ ID NO: 66387 - DNA, 10610 bp, Oryza sativa
ttaaaaataactagtattggagttcagggttaaaaatcgaatgacgtaattgttgagggggtaattcgtggaaaaagatcttgtaggcttatcaaacagaccagcttatactcgatgcatgaatattttaggatcggataccaactccactactcgactagagtaatcaacaaattaaaacattttcttgccgaacaagcacagccacgtcgaaagatttccattctaacaccatacacgtgcctcccttatagcattccaatttcaattgcaaaaaccaaatccatttcttaatccgcaagaagatcagcatccgcaagaatatatattcatcgatgaatttatcatccatggacaagtagaagaaactcacagcaactcaccagcacagtagacgaagatcacaagcatggcgatgacgacggcggcggtggcggcggcggcgcagcccaaggaggtgaagctgtacggcgcgtggggcagcgcgcacgccgccatggccaggaacgcgctggagctcaagggcgtgcgctacgagtacgtcgaggaggacctcgagcgcaagagcgagacgctgctgctgcgcctcaaccccgcccacgccgggaaggtcccggtgctggtcgtcgtcgacgacgacggcggcggcggcggctgccccctcgccgagtcgctcgtcatcctcgagtacgtcgacgaggtgtggccacaggcgccgcggctgcttccgccgccgtcgtccccgcgcgctcgcgccgcggccaggttctgggcgaggttcttccacggcgaggtgtcgccgctgtcgcgcgcggcggcggtgctcgcgccgacgccggaggagcgggcggaggcggtgcgggagatgaaggcgcggatggccgtgatggaggccgggtttgagagggacttcccgtcgtcggtcgtcggcggcccgttcgtgcacggcgcgacgccggggctgctcgacgtgatactgggctcctgcgccgccgggacgagggcgatctccgccatggccggcgaggaggtcgtggagccggacgcgctgccgcacgtgcacgccagcatggccgcgttcgacgagcgcgtcgcagggttcgggaccagcgtgccgcacgagctcctcctcgcgcggctgctcgagagggaggagaggcggcgcgccgccgcgtcggcgtcggcgtgaaaacgtcttcgtgtaccgacatgaggatgaacgcacacgcatgctttgtaccccttccgccataaattattcgtcattttgatttgttttagttataacgttggattatccgtcttatttaaaaattagtataaatataaaaaagataaatcatagttaatatacttttaataataaagcaagtcacaaataaaataaactagctgggtggcccgtgcaattacgcggctagcacctaaacaaaatcatatatttttcagtatgattttacttcaaatttattaaatagctatgtcgttgtcttaaaattttgaaagaccaaaccttaccatccctgtatttctaattatatagttttcaaaagtcacgccagctgctaccccttacttctgtcatatccttctttatttgcttgctcgatctaccactatttctattcattcaccttgaaacctctaaaaattaaatcttatagtttttagagtttattgtttcgttgggtttcgtttttataatttctataagtcccgtcaaacgctgtcattatacttctctacgacccgttcactgtcttttctctttattgttattgggattttaaaaatcaaacataattattgtttgggttcattttttactttatagaagtccagccaaaccatcagcggctttgccattgtactccttttgtggctcgcccgctacctccctattttattgtcacagagtttaaaatcgaacatgattatcattgggttttttttactttttagaagttccgaacatataaaaattttctccttgtagtttttagagtttattgtcttgttgggtttcattttttataatttttagaagtcccgtcaaacgatgcctgtatactcctctacagcccatccgccgcctactctttattatcattgagattctaaaaatcgaacatatctatcattggaattcattttttattttctagaagtcttgccaaccattagtggctctgcaactacactcctatacaccccacgctctgtttctcctttttattgtcattaagaatttaaaaatcaattataattatcaatgggatttatttttttactttctagaagttccagcaaccgccttgcccgtcagctttacggcctgcctgtcgttcctcattttaatcgtcattaggattctatttgatgttttattaacagtttttatatgttgtatcaaccgccaccacactactcctttataggtctgttacttattttatctcatcatgtgttttagatggtcttttttttcaatagtctattttttatcaccaattttagttatttataaattgtattcctaatcgaaatcttttttatttttctaatttcagaatttattttttatttttgaatttaagttgtttcaaaattgtattcctacttgaactctcttttaatttttttactttctagaagttcaagcaaccgtcttgcccgtcagctttacagcctgcctgtcgttcctcattttaatcgtcattaggattctatttggtgttttattaacagtttttatatgttgtatcaaccgccaccacactactcctttataggcctgttactagggatggcaattctgcccgtttgcccgtttacccgtgggtaaaaactctattagggttgggtttgttctccattttatacccatgggtatcttattgggtcaaaagctatgcccgataggtaaatgggtatgtgtatgggtaatcactacccatgcccgttttgcccgtttacccgtaaagtctaacttacatgtaggcgaggagcaaaatccactagaatacataagccatgttctttgttttctacggtttcccttttattttccttattatttctcttccccttactctatcgccgccagaggagagacaccacattgagacggagaatatttgatgttttaagttcgattcgaacttagaagcttgtagacttgttgttccactgcttttgttgtgtcgggtaaacggacacgcccgtgggcacaaggcgcccgctggcaatgggcatgggcaatcatccttacccgtcatgtagtaatgggtatacccacgggcacaaataatctcatgggcacaggtatgggtaggcactacccgtgcccgtcgcgcccgattgctatccctatctgttacttattttatctcatcatgtgttttatatggtcttttttttttcaatagtctattttttatcaccaattttagttatttataaattgtattcctaattgaaatcttttttatttttctaatttcataatttatttttttatttttgaatttaagttgtttcaaaattgtacctacttgaaccctcttataatttttctaattttggatattattttaattttcattctcaattttaattaatctcgtagtgggctcttatatggattcttctttcaatattgcttatttttaattccgaattttagttaattttaaattgtattcctacttgaactcttgttttcttttttccaattttggattttatttttatttttattccgaatattaattagtctcgtgttgtgttcttatatcgactcttctctcaatattccttatttttaattccgaatttcagtaattttaaaattgtattcctacttggactctcattttcttttctaatttcggattttattttatttttatttcgaatttagattaatcttgtattgggttcttatatggactcttctctcaatattgcttatttttaattctgaatttcagctatttttaaattttatttctacttggactctcattttctttttctccgattaatgtgagaatttctagcccccacaacgaacgtggtacctcctttcaaagccattttaataatataatagataacaattttataatcttttgaataagacgaatagtttaaatgtttaaaaaaactcaaaatgaacgatggatatctatccaccaaataaagtttattccggtttcgatgaatatccatccagggtttcccaaaccgccggagccggggttaccgcgccccggcggtaagcacggttactgcgcggtaaccgcggtaaccgtgaaaaccgtatgaaactgcgcaaaatttatcaaaaaaataaattattttttaaatttatttgaatttaaggaggttaccgcggtatttatattaccgtacccccgcggtaagcccggtaaccacggtaaccgcgcggttaccggcggtaagtcgatccctaatccatccatccgacttgcctccagatcagcgttccaaggtgatctaatatctcagtttcaaacaataaaatttattattctagtttcgatgattatccatccgatttgttgcatatttggaagagtttctagctgctgtagcttctcgtaaaatcagaagctacatcaaataattcagcatttggtctaaattcgaagaatccatagttatagaatctagaaaatgaactagaacccagacccagaagctggaaaacccaacctttttatattctctgaaactggctaccaaccagttcttgcttagaattttaagttttccaaacatgcccttgatttcagtataagctcatagtgctagcgcaaccaagctgtcaaatagttttccattcggttttgatcgtcacatttgttatgggcagcgagactacgaaaataacgcgggcgtgatcaaacttcataactctgcatcgatattcagtcctggagtcgctttggtaattggtcttcccgctccatgttcttcgatcctacatgcactcccacagctgtccaatacaggatttgctggcccagtcttcgaaaatgtttataggggtaggatttacgcgcgtgcattcataggggtgagtgtgcgtgcgttgtgagtgtctgtattgttcagtgtaattctaaaaaaaaatacatgcagccatgcaagaaacaaataagatatcaatggggtagttgagagaaatatgctgctgatcacattttattataatataattgcatttgaaagttttttaaccaaataaattgcagaatgttgcatacctatacaccctaaattgatcatgaatcagatgcaaataaattttaaataagtggtgggcttagaagacggcctttgtttcccatagagccggcccaaagcagccagtcgccactctcgtgtttaatattgggccaaaaatagtgagttcctgttggacgtcgggccctttcggccgatgcatgtggtgatatgggccaattgcttcagataagatgacggcctgggcagtctgggtatcaactagccatcagccatgcagcaaggccgaaagttaacatttctgatttctgtgtggtaaactagcccaaaacacacacacacaaccttttctatcatttgtctactattttgaaaacggagtcatcctcttgcacccctttcccaccgtaagtgtcatccggtacttttcttaggtaaccacaaaccgagccaatcccgaaatatatatctgacccgtgcagtgttttattcttaattcacccacccagtcaatcttcaattgtatgagcttgatccattacaatgtatatgtgcaaatcatattcttttttccgattacatggaacaagaacacgaacaagcgccatttatagaatttgcaattaatcaaaccgtgaaactaagcagtatcctgcccactaggaaattggctcgaatcaaattggctcgagtcaatcgtagaacttttttttccgattatattatatggaaaacgcatacataaacacatgcgcatccaaatcaatcatagaatttgtaaacaaagtgcgtagaaactgaatagtatcctcattacaagtaccaacacacatggatagggactgtcttgcagtactgtctatacagtggttgtcgctgacatccaagtcccagcatgatggcttgaattattatatgggtttgcatatcatccgagtcatttgcagatgttttctttatgaaatggaaggcttatgtgcactcaaatcaataggacaatttgcaactgaaatgtgtagaaactaaaaagtatgctcaccaaaagaccattgacttgaaagcttttcagatcctcaaagctcttgcccttcttaaaaaaaaaaccattgacttgaatcatatcatatcatattaaatctttagtttttgtgacccactaccaacagtgaatcgacgattctcagcccagaaagcctgctacagtactacaggacctcacccttgatgcaccgtccgggacgatgtccacgggttcatcgatccatccgtctacgcctcatagccgcatcaccccgatcccctccgtcatcgctcctaaccaatcagcgcacccatcgtcccaaaatccccaaatcttcatcgcctcctcgtgaggttcgtcggcgccgacaccgccttcttgcggagcctgcggccagcgtcgccgctttcttgtcgagccagcgagggaaatcgcggcgccatcttcgccgccctcgccggaccagcgtcgccacggagctagccggcggcatctgccttctcacggagccatcgggcaagcgccgcagccgaccgccgccctcgtctcttcggcgatccagcagctgccgccgcctttcgtctggtacgcactccttctcctcacggacagggaatgcatgcaggttactgctgtctccaaatccacatactctacttaattttcttactgaaccggcccatttcactcagctagctgctaacggttgtccaactagctcgatccctgtccgtgctgctccgtatcctctttcattcgtcaatttcaggtatatatccatataaagtaatcttaacgaaagataatcttataaagagaaattggaggggaaacaagcaatgttgttttttaatacataagagaccatccaacattttttttttgactgtcatgttgcacattttgcttggcgatgtgtcttctttgccttcaacatccccctccccacaatgtaaaagatatttttggtgaccagttaaggggagtgcctagacaaaaaaaaaaacgattttgtttggagctagtgctttatgttggtcaatttggcgttgccgtaatgatatagtttttaaccataaaaaaatgcctaacatcatgcaagttatcttcatgtgttccaattggctccactcttggtgtatgatgctttcacaggaataacaggatactatgcgcaatggtgctacacgcttggaattagtagttaaggaacttttattccagtttggatggcgtagtacctacagaatttcgtgatagtatctatgtgattttgaaaaaaatattattttagtagatcatatcatcggcataagttgggggtttgtcccatctggctagttatatatgtatgcatgcatccaagtcaattattgattttttttcgattacatagggctccaccgtttggcctaataagctaaaaccaaaatcaaaatttgatttttaaacttaattttgaagttaattttaagatatttcaacatagtttttttatattagcttttaaatcactaaaaacatatatacaaaagttttacatacaaattaattttttatttcctaataagctattttggcttattagggaacatgtgtaacaggtgaggctaatagaaaacacaaacgtacatgcatcaatcatagaatttacaaccaaagtgcgtagaaactaaatagtatcctcgccaccagtggaatggcttgaattatactatctgttttttaatagatgacgtcattgactttttatcacacgtttgacaatttgtgttattaaaaaaattatgtaattataatttattccgttgtgagttgttttagcactcaaaatactttaaacatgatatatatcttatacatttatataaattttttgaataaaacgaatggttaaacatatattcgaaagacggcatcatctatcaactaaggaagtatgtgcttgcacatctatcctgagtcaatcatatatgttttttttacgattacacgaaaggcacatacgtatccaaatcggtcgtagaatttgctaccaaactacgtagaaactaaatagtatatatcctgatcactaccagtggattgaaaggcttgaattatatgtgtttgcacatccatactgagtcaatcatatatgtttttcttttacgattacacgaatggcacatacgcacccaaatcgatcatagaatttgctaccaaagtgcgtagaaactaaacagtatcctcaccactagcaaagaaattggctaatttctttgaacaaagtttatatatatgtacgtggtttctcaaaacgaacaaactccacggttagtttgctgttggcctgctaagaccaacaccaggagagaagaaaatggtaatggggattgctttcagaaaatggcaacaacaatggagatgcaggtcagtatcatggagatacatccatatatactagctgcgtgtcgaataagatgacagcttctgattcgagctaagtgggctttaccgaagtataaatcacctacacacaaacgcatgacaagctaaagtagtggcttagaattaatcagtctccatctgtggaccagagagtgtatcaagtaccaggtaatttagcccatcaatggttaatctatattaaattttttactttctttggaaaagagaggcgcacttatagttccttgctgttggaaccgggaacatttggatctgtggacgagatcatatcctacctacaaaaaataaatagagagcaaagctagactaacagccagttcaattaaaatattatggtagcacctttagagacaaagtttacgcatatgagaaatcattaagtttgtgtttcaaaagttcatgtcattttcttaattgtgggaaaacactgcaacaatcttctttttatatatagtacatattgacatgttcttctagaagtctccgcattaatctttgaaagataaaaggctggaaatttctatgaaaaggtgaaaaaaagaaactcacgcattgatcaaataaagaaaattaaaaagtatacctgaaccgttacatgtgacatcctaactaaaaaaacagagcatctttcgcttgtgaggtgcacaccatttcgtacagctaaaaagcttacctacaaaaatcctggtaaaaaaactttatgagattcttagtctggaaacaaaacggccagtatgaactagaggctaataataaacgggctaaatgtatatgcttgcctccatatgaattggagaagcaaaacatgaggcccaaaatgcatattccaatctttttgttccatctaattataaagctagacgcactaacccatgccctatcaaatccagcagagttgtactggacttgccatgccaccctctttcctcctactttcatttggcttaatcagctaattaatctcacttaattatcttgggttgattagtaacataaatattattacttatgtcaaaccatgtctgaactctgaaccctgactttccaaagtcaccttaattgtggtgaaggaaaatgacagaaggaagctgcgtgtgctccctgcttttcacattattttttaccagcagtaataaacctatcaatgataaaaaaatttccaagattccagacaccacttcaggagacctccattggaacacacatcacaaaggtgatcccatgagtaaacaagcactatatatacatgagacatccctaatagaaaatgacccgatggagacctgagtttgtagtagtgcgcttgtgatccatgcatcaatcattaatttggactttacatcctaaggtccgaaatagcacaaggccaaaattttctggatatatacgatctgttatagtaaccattctacatggataaacaattaacctgcattttcttaatgcgtctcattgacatgtaggtccaaccaaccaatatatgctgcaattagcacatagattaaccagtgattccatgacattccatggaacgcaagttaagtttatgcgaaattaaaggagtacaaatttgagtaacatcattgtataagaattttagtatattaaatttaaaaataaatttaatttatgatatttttatatgaaatgctataaagtgtgaataggggaaagtcttaattagggcacatgcctagtatagttaaagataaaacaaccacttcaatgacatcattctccgtaaattcttattcttactctggccgtatttagttcaccctcaactaccctaaacttctaactttccatcacatcacatcacatccaaaacttttctacatatataaacttctaattttcctca

SEQ ID NO: 66388 - DNA, 22427 bp, Oryza sativa
  unsure (1)..(22427): unsure at all n locations
tttccttcataccaattcataaattaacatacactcatttgttgtgggggtcatcccctgccaataagctgggacccattgtaaacctttcaatatggcattccaccacagtacacaatactaccacaatcatccatccatccggcagcacacgcacacacgcacatcaacagtacacctctcatccgatcgagagtctcaatctgcagttgagagtgcatgggtccagccccggccggtgatcgatcacacatcaacagtgcagacacaaacgcgacacacgaacacctgaacaggacaccgatcgacgaagagcccacataattctttccaagtgcaacacacacatcgtgaccactattagagcaggtacaatagcatactattagccagctataaacatattttaatgatataaaagatgaaaaagaaaagcagcgggctacaaatctgtagctagctgcagcacgaactccaagagacagtgtgtgtatgacatgtgagaccatatattaatagtatagtaagcaactattgtatgaattggctatagatgaattggagctagtagtgggctatactgttaaacttgctcttagagcaggtacaatagcaggctataagctagctgcaaacatattttaatgagataaataaggagagagaagagcagcgggctacagatttgcagccagctgtagcacggattctaagacgcaatgtgtgtatgataggtgagactaggtattaatagtatagtatgcaactattgtgtgaatgagctattaaattgactatagataaattggagctagcagttggctatactattaaacttggtcttagcggggctctcatcgatcagctcgatcgatcgatcatggtggtggacggggttgcactagctatagctctagctagttcgatgcggcgcggccggcgggtagacgacggcgacggatcatatcatcgcctgcgtgtgcatgccggccggcgagcgtgacggtgactgtacatgcatcgatcgatgtgtgtgtgtgttttttccatgtgggtttctttagtttttgggcgcagtgcgtgtgcttgcgttgctagtgatgcgcgagaggcctactgctatagcttttattagctatagatctccatggtggcatgtagctttcgggggacgaatatatgtatgtaatcgatttgatcgagtttatggtgaagactatacatgcgtggcgtggcgtgccgaagtgatcatatggatgtgcctttcaagatgattcatgtattttaggctcagcttgaaagctcatttagctattgcaatacaactttttctcgtttatcatgagcacgcttctaactgctaatataaatgatgtatttttgcacaaaactttttatatagaagtttttttaataaaaaatcaaacaaacccattttccataattgtaatacttaatacttaattaagtatacactaatgatatttcttgtttcgcgtaccaaaaaaaaagctaagccaaacagttctttcaaacggagccttactccgttaagatacagtagtacaatgaaaagtgctctcaatggatgtgtaccaaaatttagaaaaaaaaatgtacaatgtgtaacacaaataaaggccctctaggagtacgaccacattcatggagtctttttggtacggtccttgcctattgatcactacttgagattcttttagggctatgatgatccgtggcgtgcggtttttgctggctggagaggtattggatggtagaatatggatctttggtgggtcaaagaagtggtctacaagtgcaatgtgttcgatggttcgaaggggtgtttgatatggtttgaacgagtctttgattgttctgaagtacacttttgttgattgaaggcatagaaccctctaaaatagtaggcttatctctatcatgcggtcattttgattctttccgcaatgagtcaaagactaaaaaactattgagtaaagtgcattggcggtctttaaacttgtagggttgtgtcatataggtcccaaaacgacacagcccctcgaggaacctacatgacgctgatgtggcatgccacatggacgtgacgtgtccttttttttctttttcttcttttatttttctttttcgttttcttctcattcttctttttttctctttcttttgctcgggtcatagaaaaaggagaagaaagaaaaaaaatagaagaaggagaaaaaaagagaagaaaagaagaaaaatgaaaattttaaatgggttccatttgtaagtcaaaatgatgtcacgtcatattcgtgtgccatgtcacatcagcgacatgtacgatccttaggggttgtggtgatttggaacctagatggcacactatgacaagttctcggaattggatatgcattttgagagtttagggacctaaataacacacctctacaagtttaaggaccgcccgtgtactttactcaaaactatttatagtctacaatactgcaagcacctcagatccacatactagcgacgtcttattatttagcattgcggttgtggctactagataagtatttatggaaaggcggtggccagagataatagcttggttgaggaagttccaatggttaggatgccacaataaggacacatgctagtactactctttaatattgggaagttgaagatggtgtggtaggaaagcagctccttcataggtggggcctgtactcatgggcgcacaagtgaaagacacatgtctctcttacttatgttagaggagcctcatccgtgatatggatttagagatggagacgtgaagaaagtgtgctacggaaaattgcggtggtggatgtgacggaggatgtaggagaaggatgactgtgtgtcaaaggtgcatggatgtgttttattaggatcatgaaaggttagagcttgtttcgaccattgaatccacgtcggatgattaggaaattaaccatcactccctccaccctaaaatacatttaacttctagcgttcagaatgtctcaaaataacaatgtctctacctactttctcatctaaaccaataacaaccatctttattttaatttcttcatctactattttatctgaatcgataacaatcattcctcatttggtttcatttctctcctaattaaatctccatgaacaactcgtagtaattatatttttgggggcagagagagtatatgagagaaaaataagtttattttaaccactcgaactattttactggatcggttaacctttcaattcgcctctgaccatcaatttaaatgtgaataacccgtcctcctctctttgaaacaaggggtgcttccggttctgtgcgtgctttgttcattttaccccaaaactattgaaaatattcactttactccttaataattttttttatttcttatgattgtattttaagttgaaatattttagagccatatgtgactattatcaaatttaaaaatattttaagctaaaatctcgatgttaaatcaatctgaggtgtttccaacctatgcaaacactaataaaaattctaaaaagaaataccacgacataagttgtaatgtgtcttttcattctaccgaatttcagtgcaaaacatcaattttatgcgcgcacagagagagagaagagaaataccatttagaagtaaaacgaacctggtgtacctacaatgaacttaaaagtaatttagtgggttgggtaagtgctctgctaaaatagtacgaggcagtaaaatataatttttttgagaaaataacaagctactctcctgtttacagaattaaatttgaaaatatattgttcattcattttttttagaaatattcgggatttaaattttctttgcacaaatatactggttgtgcgaaaataacgtggcgtgacgtcgtgggcggtatcgcgcggggaaagtgcgagaccatgtgctctcgtggaatggaagagcgaggtcttgctgaaccaatcagcgataccggatttcaaaatagttaattagtgattaattatcataattagccattattatttaaccggtaatcatgataattaatcactaattattattagttactccatcggtcccaaaatataaacatttttagcatagtgacaagtcaaatattttaaattttgactattaataacaaaaatataaaaaagagcaatcatgtaaaattaatgttactagatttatcattaaacaaactatcataatatgcaactattttttatttaaaacatcttacttttatagatattgttggtcaaagcagcatctcggagaccgtgtcagttcaaaaataattatattttaggacgcatggagtaatagttaactaggtcattagtcactgtttcggcgttcgctgttttagcgttgggacggtgtcgctgtctctttcagcgggaccacgcggtctcacactttcatctcgcgataccgcctgcaacgtcactctcatgtcattttcacacaacggttgggcgagaccgacggtatatttctgaaaaaaatttacatcccgaatattctaaaaagaaattgaatgaacaatatcttttcaaatttaattccctgtttacatgtacgaatacatgtatacggcttacacgagttggatggaatagtgtatttgtgagtcaaatagactcttaaaagattaggtgcacgtgggtaggttcatgatcaaagagtttatcatggtggggggtgtgcgagctagccttttctttcagatagaaacaaagaaggaaagagaaagaaattaagaaactaaagatcgaagagtgctagctaattttgtgtacacacacatttagatatgttttctcaaaatgaacagtgaacggatagattaaaattatacaagtagacaagcttaacatccagtagtctcgtcatcttttggcgttgcaatatactagacgcaagagaaagaaagtgtgtgtgcattgcactttgcctacaagatgcgatattatgtgtgtgcaactttgggtacatacacatttctgaccaatcgacaaggcaaactagacatttaacaggacaactctgcaccgtatcacaaagacagccagcagctggcagagtatttatttcctgcggtgagatagatatgcattgtactttttcatagctcagcgtgattcattttgtgcaatgcatgattgagcactaagtactctgttgcatgaaagttcaaaggggtaattgcactgaattatagctcattgcattcagatatgaccatacctgaatgatggaaaatttgcaagagatatgatggccagttgatcctgatctgaaatgcgttgcctacaagcaatgaaagaaaaaaagtgtacgtctccatttatattcacgttgcaggacagggctattttgatttgctttggcaaatgcgacataacaaatcacagtgaagcatatatagtggggtttgatccccctcaacgggagagacaatcgagggtcatatcagatgaaaccccgccaatatatatatatatatattgcccaacaagaatgcaagacaaaaatgttaatatatgatttgcaaagcggattaacttttacagtcagacagttttactttatgcgctttatacattttcgcacccgtaaatgcgtaatccatcatacaaaggtaaaagtaattgagatgatttgacctcataacaaaagagaatgcaatacgaagtgagtattgatttgacttcataacgaaagagggaatgccacgcgaagtgagctgcatggtttgtttatcatacatatgaacctatccattcgagtccaaatcctaagcctatcatatgtactcgtaattaatttctatactagttgatatccacatcgatagtgcggcaactatagaacttttaaaatatattgatccagtctcttggaggttatcatatggggtgaatatacgcgagcgtgtgtataggtgcttgcgtttatcccgtgtttcttaaaaaagagagagtgtaaaaattgcttaggtaatttgtcttcataattggacagataattgctaacattttacattaaaaattcttagggctcctgtaaaacaggggtattttatgattaaattaaattcattaaaaatcttgaaaaattcttctattccagaaaaagccacggagagagagagagagagagagagagagagagagtactttttaattttctagcaacatttgctatagggattctaaatttcgttatatgctctaagacactacaattttgtatctttgttcaaggaaactttagttttatggttctttgctaaagaaaaaacactcttaccattattaattataatatatcttcttctattagatagataaaactttataaaagatgaatttacccttaggccaccatgtaagatttaaattaaacaaatatttgttgaatttcaacatatttttttttaaattcaaaaaatgtttaaattatgaaaataaacatattttaaaaatatttaaattgagctaatatgtttaattaaatttggagtgtcttttgggaaaaaacatagtgccctagaggaactagattaagttgacgtattctcaaaaaatattgaggaaacacatagacaccggtaagtccacggagtcgaacacacgacacttccattgaaattaaatccaagcacccctactactgccctagcaagtgcttctcacatgagtatgtatacttcatccgtcctataagaaatacacctagtgcaaattgtgatatatcagtattagaatatgtcaaatctcgtattagatttattctttttggaagagagtaacactcatgtttcttctatagacatatatatacttgaatatagtcaatgtcaacatgactacttttcaaaatataacaagaaagaaaaaaaataaaaaaacgtggggaatctaaagtctatagaccaattttctccgagggaataatgatggtttgctgggaagagaaaattaaaccccgatcgatcatgaccagtcagtcgtacatgcatgcaccagctaaggatcgatatatatcgatcgatcgtcagaatcagaacagggattaattagtggcacacacactactgttaattattccaaactcgtagtaccacacgcccgactagctaataatggacggcactgcatgcgtcccaaaagactaggcactactgttctacacaacaatggccactgtgcagcattgcattttatcgcactactaaaaaagaatttctttctggataagactccttttatattgtaaacggatcatagctgattgtgtctgaatcgagttccgtacataaacttccgatttttacatacgggtgcgtcacctgcatgaaaaaataatcactgtttttgcagatcttttcggacagacgagaggcccaacggtttggaaaaatgagttttctccgtttggaaaatcgttttgtagaagtgtcatctagctagatcgattaatcctaatccgatatgcatgcaccatctccctgtcatggcgactgttggtatttggtctgtcgatccgaccgccggtcggtcgaccaccattggcggcgacgacgcgatcgaccatatgcaaatggcgccccgcgcgccaccgtgacctcaaatctgagggcgacgaccacgacgacgacggacggtggatatattggcagttgcatatatatgcgttagttatgggctcatggccgcggacccccctcctgccggccggcagcgcatgggacggccggggatacccgatgtgagactcaatcaaacaacaacgtgcacaaatattttagatactatatggatatatgtagtgattaattgcatgggcattagcatattcctctatcatctatctgcattatcagggaagcaatatagtgtgagagtggagtagtgggtgtacgggtgcatggctctactattcaaaccgtaatgttcatcggaatataaagggcttgtttggggtagcttctcgctgcaacagtttcttccagaatcagaagctctccaaataattcagcttttgatcaaaatttactagattctcagaagctggctaccaactagctgcttctcagaatcttaaacttccccaaacaggccaaagaaagatacgtacgtaagaatgtgttcacaaatagagatgtatggatccttagttggcatagaggtcaaaagttgtgctttctctataaatatatgcattattgtgatctctttctctatgtgtgtgtattatatgtgctagttgaagggtaggatggaagtgcgtgttggtacaaggaaaatgggttgtcatatcaacttaggctaatgccagtggcgaatctacaactaaagttattgggtgtctaagcatattaatacatttttatacaatgaaagaatttcactaaaatgaaattataacctacctctgtattatctaccatgaatgtacacaaactagaaaggaaaaggggaaaaaaaactaagataaacacaaacatatcatattgtcttacatcaattcactcataaaactaagacaaaacataaaaaatactaactagacgtttactatagaacaacactttaaagaatgacccaacacttgtctgctactatcctctaacagtggactagctttccatccaaagtacgagatgtcaccttcaacaaaggagccgactagaaaagcattgacattatcaaatatgctagatgaactatatcagtgttttcaccctagagccatcgtctagtactccatgctaccgtccagctacttaaagctagcaagtcagaaaaaacaaatgtccatatatatcgattgttgcccgccaaaactatctcgaaaaaggtttacatggacacgatcgatcttagccgctgaaacaacttcggctgtcactaaccaatcttcctgattaaaagggaagtcatcatcccttatctaatcaccaataacaaacacaaatcagtaacaatgtgcaaagaccatggataaaacaccagtcttctctatttgtctccatttgggcaaataggataaccttgtcatataggacaaggtcctattttttttgatttaggaaaggcaaactcctagttttggagaatcaaagaaagtcattcattgatttatgaggagcattctccatcattgaccaggctaaccaacctcgtttggattatggtgaagcgcctccgcaccacaacaccagtctacaaaattgtgcattcctcccactagtttaatttgtccctcttccaatagctgccttggtcaataggtgtgacatcccagcctagggcttaataggattaatagaatactcatatcaacatgcaacttttttttccggaagccgatctctaaagaactccagggttaagcgtgcttggcctggaacaatttagggatgggtgacagatcgggaaattcttcccgggtgctcacgagtgaggacaaagtgtgtagaaaagacttgtgttggtctatgagggcagcctatgacctatgaaagctatcatatgtaagcgggcccgcctgggagaggtgggacgttacaaagtggtatcagagcatggcacatgcgctggcactggacacacggacgtggctaagaggggacgttcctggcctggggttgatcgacgaggacgtcggacgtggctaagaggggacgttcctggcctggggttgatcgacgaggacgtcgatcttctaagggggtgaggatgtgacatcccagcctagggcttaataggattaatagaatactcatatcaacaagttgcaacttttttccggaagccgatctccaaagaactccagggttaagcgtgcttggcttggagcaatttagggatgggtgaccgatcgggaaattcttcccgggtgcgcacgagtgaggacaaagtgtgcacaaaagacttgtgttggtctgtgagggcaacctatgacttatgaaagctatcaatgtaagcgggcccgcctgggagaggcgggaggcgagacgttacaataggcatggtcataccaggcgatgaaggcaaagcactgatctaccacttggtgatgagaacctacaaccaatgacggcagtgtctagaacaactagtgcaatctccccatcgtaactcctccctcccctccccgtgtcccacagtcgcaggaaggcgacccaagaggcaattattaaaataaaaatatgggttaatggttaaattgcgactgtaagagattttttgaggagtcagcttggaccatagaatgtgctatatgtggttgacgaggctgatggacatctataaactatactgcatgggcatatgccctatgttcttttttttcatcaaggtgatgagcaaggacaatagaatattggggtctgaaagagcccactaatccacgaaaaaaagatagtggagatcgacataacactctccctatgtgcgatggaaatataatcgatcaagcgtcagaatgccagataatacatgatagttctaagctacaagatggaggcaataactatatttctcgccattactagtttgaaattcaatggttctttgtacttttttatataatagtgttgctttgtacttatagcatgatcattagtctacagctgataagttgtaaaacgacatataagcaactaaataagaatttgtggttaaaaaactatcatatttgtatcatgcactaattaaaacactattatgatgaaaaaagcctcaaaatcaattctaaaattaagttttggcaacaacttataaggtaaaagatcctcaattgtaactctgttctatacctgatgagaatactaggtcctgatattccgataggtattgataactctcgatttggtggaaacttgacacacatgatccagcttccgatcaaccccgattcgaaccctgcaatcgcagcaccacgtttcctctggttatcaaccatgccgaaacccggttgacctcaccgataaggctaatcactgcatgcaaatcaaagaacacaagcaataacaagatagatagcaacacaattgcaaatgaacgattaagcactcgaatttgggcttccacaaaccgatctagcggcgaaactgcaatggcaaaaataatctaagcaaaacccaactctaaatgatgacgacttctgaataaatatgattagagacgtcctagggttgccttagggcgcacacccctttgggcttatcccacgacacaattacaaggctcaagacccaaatcagattcagactggatgaggtacgtggcttatttttcatattcccaacagctcggtaggaatttagatgtggaccaaaaccatctaaaagtatactccataagctttccaacaaatactcatgggctccgaaattcattctagatcagcagttagatccgttcgaagttaatgttgttaggaggcctgaatccgaatccaaaacgtgtaggactttatctcttgttttctatggaccaaaagtgacgtggtgaggtagaagtggatttggagaaggtcttgatttggtccccaatcaacttctttgatcatccatgcattctttatgcttggtctctttttcatcacccaagcatgtaccgctgcaaagaaaacataggaaactcattgtgtagcaacggttgttcaaatatataacaagtgaatctaatataaaacatatgcacctttggttgatgaatacatgaggtagtcatggtcatatctgagctagttgtgtcctcatcatactcatacttagtagaatgaggaaaaagaatcttaacgtttatcaatccatcttaacgtgactatggttcatattaacagaagagtttaaattcaatatcacttgggtactttttaactctgaatatcaaaaataagtaaataatagaaatactaaactaagactccaaaatatagtaactttgcatctattctacattatttattaaatcaataaaaaaactaaaattaagaccatatatttgcattttatttaatcaactttctgagattgttaaaccaagaaaacaaaaaataataagaatgtgtcatagtggactatatgtacaatgttgtaaaaactactatcgaattcatctaactcttaataaaataattgttttagactggtaaaatttagaccaaaatatgtagaacaaacactacgtgataacggaaccccaatgatgcctctcacaatattccctccccctaaccgttgccaatgccattctcatagacacggcaactcttgtccaccaacttgcaagatccaaatagatggaaaaagaactggacatagatcgacaaggtgattggaagtttgggttggatcacacaatgaccgaccaccacccccccggggggggggctgtctagctatggtatgtgacctagagacgcactcatcgacaattgaggattggagatttggcgatgcgctcatgtcatcacgtggactgtgcacatatctacatcaagtggttgcgatggcgctcctatcatagtctcaacatggtttgcaagcctagattgatggatcgtgcatgcatcatcctgctacagtggtgcttctgtcatatgaacgagagttcaagtggtgtaggagaattaatgcatatgcactctttgtgtgtgactagcgagcgataaaccatcgtctagcttccgtttttcaagagaaaattgcgagtgtggatcatagactccatgacgtcgatagctctgtaacttcaaagagagggccttctctaggattgtgatttcaagatgggtggcgatggtatatatgctccgtacatacatgacaacaaggctttcgccatccatccacatggtggaggcatatcgaagaggtcaactattcgtccgatgatgatggtgtctctggtcccgctagggtttcaactaatggtgatcagactgaggatgctacatgggtagtgacctttgttatggtcaggaaaattgtttagcgacaattcaaggtgtcttggtggtgctaaaataatcatgcattggttattttggatgtttgcttcttggtcgatggcaaccgctggtggtattactaccacttatgtttatggttgtggccgttagcatggtgttctattggtaactttgatccagttagttggatctgacaatatcatatcgatgttcatttgtcatttctttatttaatgtgttgccacatagaaatctatggatgaaaatctagtggtgaccgttaagttggttctgacgattatgacttgggtcattgatgtcggacccgaaaccggcacctatgagggtctccgaacacctatgaccttttctgcagtagtccgtattgtttagtgtcatagacattatgttatagttctggatgtaggagcataagtcaacatgatatattcacgttgtatttattactcccttcatttcaaattgatctacatatttcataagtacatcaagaccaagaaaagttaataactccctcatactatatttactctatcaacaaactctatgcattcaccatccccaatatttcctagccaatagcaaatcaagatattgcatgtggattataaatagttgtgtgcatggatgcatgcatcaatgtccatttactctaatacacaaataacgaatagacttaataaatgaacacaaatatatagatcatttaggaataacctaaaaaaactatatgtagatcaatttggaatagagggagtattttttttccaagtcgtgtgcatcccttaccattaatgtgcaaaggccagaagtaatttcatttcttattgtactaaatattattaaaaaaaatcatgtgccgaccgttttcatgcaaatcctgaaatcgaaaatgtggatattattgggcggacatttcgacatccccgtcactgtaaccccgaccagaaaccctgtatccctcctgcgacgtaacccggtgatgttggcagccggccgggggcaaaggaatgatgtgcgctagctcgcaggtcgctcgctcgctcgatcgatccagctgcttcttctgtccattcgtgcgtgcgcgcgcgcatgattgaattgaccccccccccccccccctccggcggcgtggggacggcgcgcgcgcgcgcgatcggtgacagcgagtgtttcgggcgggtcggcgcccagccgggcgcacttcggttgatcgatcgctcgcgctcgcgcgcgcggcatggcggtgtgtgacgcctcggcgcactcagctcagctcagtcagctataggctatagctagctcctttgtctgggacgatgaatggttggctacgcatggggccatccagtactgcaggtgcaggtgcaggtgcaggtgggagctatttgtgacttgtgagggagcctagctgtgttcgttgggacactttctcaatttctactcacttgttttctgcacgtactcctttcataaaaaaaaaatacaccatgtgtttccgtgttcaacgtttgaccgtccgtcttatttgaaaaaaatataaaaaaattaaaaagacaagtcatgcataaagtattaatcatgttttatcatctaacaacaatgaaaatactaattataaaaaaatttcatataagacggacatcaaacgttatctttttttggacggagggactatctttcttgtatctttcttaaacggttgaacaatatgtttttctaaaataatatagaaaaattgctttagaaaattgtattgatttatttttaaaaattttaattaaccatacgttgtcatttcgttttacatatcgagagaggaagggtttttagtcctatcaaaaaggaacccagcttaggtggagggcaagatttcctgtgtctttttttttagataatgagatttcctgtgtcttggtgtccctttgcctcatgtggacctgcagatatgtgcgacctgcatatgcatgtgtgtttactattggactgcactagccggtcaactctggaacaggaaatacttcaattcgatgatgttgatcaccatatggatgccctttttcttgtgaggacatatttatggttgaatttcccacacataatcgtgtgaggtttcctgaaaaagaattataccatctctagctatttcaaaatataataacctaatactaaatgagatatatattagaactataaatttgtacagtctctgtctaaatttgtagtactgtgatatatcatatttgatattaggttactaaattttataacgatggtaatatttggtatttagcatgctatatatgcagttgtgattttttatcgttattttggcttgtgagaggaagttagaatttcgttatgttttctttaaacttttaacatagaatcattggttgcatgcttgaagtcaaaggctagagatgtaactatgttaatttttgctacttaaaaaaatcaatgttatactgctataattaatttgattcagctatgatggactgtttggagttttctcctttttttccacttataattgtggtatttcttcctactagatcattaggaaccattttctggcgccttattgaaaaatgatatagtacatgcacgcacgtctcgaagtgaaggttgtgttatatctgactattagagtttggtgtatatcaaactagcgttaattgtgcctaatttaaacataagtcataacaaacatatttttttaaaacaatgatatttaattatactttcagtagtttattttctgcatctatctcgatcttattcggttaaaagattgagcgctgtgctttcaaagtacactacacaattcctcatatattttattcagcagctttgggtcaacctcagtaggggaaaaaatgctttgggtgtacccactaataaaccttggctggatgagacaatatttagtccctgtcaaattggatgtttgacactaattagaagtattaaacgtagactattgacaaaacatggactaattcgtaagacgaatctattgagcctaattaatctatgattagcctatgtgattctacagtaaacatacgctaattatagattaattaggctaaacatgtgctaattatggattaattagatttaaaaaacttgtcacgcgaattagctttcatttatttaattagttttataagtagtctatgcttaatactccaaattattatccaaacatccgatgtgacatggacacgtatagtccctcgatccaagcaccccaagttcagaaccctcattcccgatacgtaaaacggagcaacgattagtgcatgatttattaagtattagctaaaataaacttaaaaaatagattaatataattttttaaagcaactttcatatataattttttttaaaaaaatatacgccgtttagtagtttgggaagcgtgcgcgtggaaaaccagaggtgagttgggaaaggtgaggaaagaacatggccaagactacttgttgccactgcagtgttagcaacaagccgtgctctttaattgggtggacttgatcacaaatgccgtacacgtgtggtggtggcattgtcatgcgctttcgttttcctctccaacttataacgcctaccactgtgtcttccagaaatatttcctctccgttcgcccagtgtttcaattttgcgagtatatatatgtgtgtgtgatttgtgtcgatcatatataggattgtcagctgataaaagcatgcacgattatattgcatctaggggaggggataagcacgtgcgcgcgagttggacgacggaacaaggttccagtatttttaaattttaatccatgctaatgcgttcaaacgtgcttaaaggcctctcgttctaattttaaaaagtttcactctcttacttaccgatttggttaaaacaagcttcttttcttcacctttgataagtgttcaatggtaatatatatggctacctaaaaagaactgtagctcataatgatgatatgaacgtgcattcaaaatactaaaaatactaaagaactaacatggtcgcatggtggcccgcacaaattgcgcggttagcatcattatattttctctcatataatagcatatatgttttctcaacgtattattcaaatatattaaaatgacaacataattttaaattttgtactaactttatgaaactactaatgcgtaatattcatattgtattttatatacttcctccgtttcacaatgtaagactttttagcattgcacacattcatacagatgctaatgaatctaaatagcatctgtatgagtgtgggcaatactaaaaagtcttataatatgaaacggaggaagtacgtcttagttactaattatttttaatatcaaattttagttatttataaattatattcctatatggactctagactcgtctttcaatattatttgtaaattatattcctatatggactctatgctcttcttccaatattatttatttttaattctgaatttttattatttctaattgtatttctatgtagactctaaactaatctttcaatattctttaattttaattttaaatttcagtaacttctaaattgtattcatgtattatgtattgactttagattcttcttcccatgtttttttaaatttttaattttagttatttgtaaattgtatttttatacaaactctaaactctacttttaattttattatatttattactaattttagttagttttaaattcctatatagactctatactctacttctaatattccttatttttaattttgaatttctattatttcttaattgtatttctacatggactctataccctacttctaatattccttatttttaattccgaatttctattatttcttaattgtattactacatggacactgtaccctacttctaatattccttatttttaattcagaatttctattatttattaattgtatttctatatggactctatactctacttctaatattccttatttttaattccgaatttctattgtttctcaattgtatttctgtatggactctagtctcctattctaatattccttatttttttaattccgaatttcaactatttctaaattgtatttctacatgtactctgtttttctttttctccgattaatgtgcgaatttctaggccgtgagagcgaacgtggaggctcctttttctattcctttaataagttaatagattcctttttctagttaaaaataataaatcattacgtcaggacatatataattcttcttggcgagtctggcatgatctattgtgcaactttggtgaacatatataatatagtagcccgaaataaaatttactcttctatctcgtattttttaactacaagtctattttgcaccggggcccaaaattttaagatacaaccctgcttgcaactctggttgtaacatatgtgtgtatgtgtgtaatggtgttttatgataaaagaaaatataacctttggactatgcactaaataatcaaggatacacataatcaatgtgcatgtggtgatttcttctatgtaaaacatagttgtatagttgcataaggatttttctggaattttttccttcataccagcttatatattaacgatgataaaaaagatatagaggatagcttaattagattatgccaaaacatttactaggaaggatttgtataaagaaatcccatgactttgtttgagttaaaattttctgttcgttattaattccaaacacgttagaactgatcatccacctctgcaaattaattagttacattttatccctcaacctattaaacctttggttttggctaacgcggagttgaatttaagtttgcagtgaagggcacttgttacaataggagagaaacttatgactctctccattgccatccagcctgattgtcattaaaatcaaaaggacgacgaaattggtggagatgctatagtcttatccaattttttgtgttttaggtagaaacaaaaagaaaaaaagtacgaattaactccccccctaaaaaaaactatcgtgacagtacgaattaacccctgaactataaaaccgaatattccataccccaaactttctaaaccggataagttaccccctaacatagattggagtggtttaagatctcagtagcgtacacatggcacccgatcaacaaaaaaataataaaaatatttaatgggcccatgtgtcatatctcttcatagtatctctacctctctctctaatgctcaatgggagagacggatgaggaggaggaggtggactctccgtcgtcggtgaggactggaggaggcggcctctccgtcagcggcggcaatggggacgagggggaggagctcgagatccccttgaggaaggtactggagacggcgggtagctctcggttggggacgacgctggcggaggagcttgagcccatcttgatgccacgggacatcgtcgtcgcaccaccgggaaggggtgggaggcaaagtggagaggaggagtcggcggcagtcgcaactctgatgaagaggcgtggagggaggagcggaggcgtccgtcgatgacccgggcatccctactcgagtttgggatggaggagctagagcaacgtcgttggtgtcctagggaggtggtggtggagatgctgcctaggctcgggcgagggaggccagcggtagagaaggagtcggaggagggtgcggcgcaccggcggggtcaaatattgtgtagggcggccgacgacggtggcccggtggaggtggaagcaaaatggagagaaggcgttggcgatgggagattcggtgggggacgggtgaagtgtctcttaaatccgcccgccgtgccctcgccactcccacagtagcttnccagccaccgcctgcctctccgccatgcccccgccatgcccaaggagtagagtggaagcaatggcgccggtgaggcttctcgtcggattttgcatcacctcatgggaaaagaggaagaagggcggacgctgccgttagccatcaaccggagccacntagctacgnccgtctctcctgccgccggtgggagccacccagccgtgccngccgccgctcaccacctaggtccggcctttgcccccgcgtctcacgctgtctccctttgcccgcccccgcgcgcccgcgagagagcgaggggggggggaagaggggcacgacaccttgcgcccgagagagaggaagaggaggtacgataggtgggtcccaccgttattttaaaagaaaatcctgaccggattaccacgcgtacgctaaataggataaaaccgctctggattgggtcaagagggtaattcgtccagtattgaaagttcagtgtgagtaatatctgcttttcgggttgaggagggtaattcggtcaaccgcgatagttaagagtggtaattcatactttttccaaacaaaaatgttttaaccaagtcaatgagttgaggggcagatactactacagaactagtcatctctacaacgaatcatctgtataaagtacatgcaacttttctcatttgtacattaacgacaagaaacttaggtgccatggaagtcaaaatagagagaaaagactaggggtctttcggctagctatacaaggtggtgggctagtcgacctgggtttgaaaactcaccccttctatctattaacttattagtatagtaatagaaaaaggagtcaccacgttcgctctcattggtctagaaattctcatattaatcggagaaaaaaagaaaagatagagttcatatagaagtacaatttaaaaattactgaaattcagaattttaaaataaggaatattataaaaagagactacagtccataaggtatacaatttagagctaattaaaatttataattaaaaaataagaaaatttaaagtacaggtgagagtccacatataaatacaatttagaaataactacaattccaaattaaaaaaaaggaatgttgaaagaggagtctatagtccatatagaatataatttagaaaaaaactgaaaattagaataaaaaataaggaatattgaaaaatgaatttagagtccatataaaaatataatttaaaaataactaaaattcgaaattgaaaaaaaaggaagattgggggaagagtttagagtccatataggaatacatttgataaataacagtaattcatttttttaaaaaaagaaatattaggaaaaaaaaagtctagagtccatatagcaatacaatttgtacataactaaaattctgaataaaaaaaaggaatattgagaaaatatatagagttcatatagtaatacaatttacaaattatgaaaattagaatttttttaaaaaataaggaatattaaaagaagatttagagttcatatataaatacaattcacaaataacaaaattcggaattaagaaaaaggattattggaagaggagtctagagtccacataggaataaaaattataaataatggaaaatagaaattaaaaaaataaggaatattgaaagagaagtctagagtccatatagaatttcaatttaaaagtaactaaaatttaaaattaaaaaatacataataaatattttatatatatatatatatatatatatatagttcaatatgaatgtcacgcatgggttagtttgatcgagttactacataactagcatggtggcccgcgcagattgcgcggctagcattgttatattttctctcatataatagcatatatgttttctcattatattattcaaatatattaaaactttatatttaaacataattttaaattttgcaataactttacaaaactactaatgtgtcatattcatattgtattttatatacgtgttagttattaattatttttaatatcaaattttatttatctgtaaattatatatattcctatatggactctagactcgtcttttaatatttcttttttttaattcctaattttctgtaaattatatttctatatagactctatgctcttcttccaatattatttatgtttatttctgaatttttattatttctaattgtatttctatgtagactctaaactaatctttcaatattctttaattttaattttaaatttcagtaacttctaaattgtattcatgtattatgtattgactttagattcttcttcccatgtttttttaaattttgaattttagttatttgtaaattgtatttttatacaaactctaaactctacttttaattttattatatttattactaattttagttagttttaaattcctatatagactctatactctacttctaatattccttat

SEQ ID NO: 66389 - DNA, 30211 bp, Oryza sativa
  unsure (1)..(30211): unsure at all n locations
attgatgatggtgctatcatcaccaaatgatcgatcaaagcacccactatgattgatcttcaggtaacaataagcagacaaaaagtaattagtaatatctctatttacaaaagctgttcatatgcatccataaaaataaatagtgagaggctagggacatagtgctatattggtaagtgttataaaaccaaaaggtaaatcttcaatggagcccacaaattctcaactaataccgcacaaaaatttcaccccaaatcaatgacaagcaaagctcagctccttcattaactcagattgatttttaatacaaagccaaagagactgacacgaacacataacatatttttgccgctatcgatcgccagctgattataccagcgagagaaagcgtacgtacatacgcacgtaggcgcagggaagagaggaaaaaaaaaagacaaatacgcacgtacgtatagtacacggtacatgtatacacgtatagctagctcaagctctctcttcttcttcaagcagagcgggcccacgtacacacagcaccaccacacgtacacagacaccgtacacattacatttcgacttggtagagtcgtcgatcgtacaaacaatggcttcccgcgctcgtgcacgtgcgtacgtacgtacgcgtgcagtacatacatacatatgtatatacgtatacagtatagcagtacggtgtgggtccatggcgtcagggcgattagacgttgtcgaactcgtcggcggccatggactggctctgcaagcggcggagcttgaaggaggagagcttctggggggcggcgccgccggcggcggcgggggcctcctcgaagcggatgtaggtgtagacccatgcgccggagagggtgccgacgacggggccgaggaagtagatccagaggccggtgtagacgttgctggccaccgccggcgccagcgtcctcgccgggttcatcgatcctcctgacaccggcctgcaatttccactcgcgtcgtatttcgccgcgtcttaatcagctatacatccccattaatcaacacatactgatctttttcactactcgtctctactttatactatggttaattaccccttttcttattttatatattttttagaagtttttttagtttcagtcagtacatgcaagttgtgtccttgtagtgatacggtcaggaataatgtgtgtgagtgttaggaggtccaaagaatggtttgtacaggctaatcaggagtccatgttagcaacgtcgttttgtgaagtacataattaaacagtagcttaatggctgatcgatgtgagagacatagctagcttggtgcatgtgccttgaacctaactatctaagtactgtgtatactaatataagtcatctgagtccggctctgctctacgtcagtctgtgtgtgacaccttgttataaatatggcgctttaaattctctgtagaaaaaaaaataattatgtgggctgaacaacgaagattctaccaaagaatgtcgtcagctaagctagaatttccagaggtttgttgaaaagccacgatggttagctattacccactacatgcagcgtactagtggttactaaaatattttgattacggttaattaaataactaatccggtgctagttaattcttcccaagtttaggggtggtcattagtaatcgattcattattaccctgcgaagatcgacgtaatgcaaaccgcggaaccgactgctaaccccgccaactcacccacctgcaaccaaaattaaaccaaatctcaattaatttttttgtaattaattatttacagcagatttaagaagccaattaattaatcttgtgagtaaatgtattattatatttaccgctctggagtcggtggcaacggcgcaggtgacgaacatcatgttgaaggtgacgacgatctcgatgacgagggcgtgccagtgcggccccgtcggcgtcgtcgtccccaacacctcgatcgggtacagcaccgcccgcagcacgaacgccgcgcacatcgcccccgtgaactgcgccgcccagtagaacggcacctgcaaaccacacaccaccacaccacagtcacacagccgcgaatacgtataagccacacggccgacggccgtagtgtactacgctcaataatattatgctttgcttagaggatccgatcgaaaacgccacacaaccaaagctatatatattgctagctccacgatcgtgatgtgaccgcgaacgcaatgcacgccgctcctcgcgaccgatcgattatacggccgatcgagacatgggaagaaaagggagaaaaaaaattaaaagagcgtacgaatctttggagtcttcttgaactccccctcttgatctaaatctatcgctgcagagaatgaataatcgtatctatctatctatctatctatctctgggcatcactcagatcgatcaggattcagacatgcaagtatgcaatatggctggctggctaactgtatgggcaagttgggtcagattgatcgacatgctgcaagtagcttaattagctatagatccttagctagccatgctcgcgtgtggcgagagactggcacgcaagagcgagcacagcatctatcgcatcgcatcggatcgaataatttcttctcgccgaaagggcggccggcgtggtttcacggcagattgagggcacgtacgtgattcagaagcgtgcacacgtgcctttcatagctaaagcccggcaactttctaagcatatataggcattattatctatggtcgtggttttgcagaggctggaagttatactttttttgaaatttgggttctatcatcatggctgattccagaactattccactttaatgccattgttggcacggccgatggtttggttagctcaagtacgtacgtgagatgttgtatttgtgacctacaagcaagaacggcttcgcaataattgggaatatggttgctagggagcaaggccgtatgtatgcatataaatatattaaggatatcaatgatcaaaaatcacatggttaacaagggaaccatgcgaatgtcaaaccccctctccttagcttaggctggtacgtggtggtggttggggttagtggcaactcattgaggctttcatggtaagccgaattaattatgagctaattaatcatgggagaggatcatgcatcaagttgccttatccttctcatctaaaaagtactactactactgattgtcttattctcctttttttttgttctaattttgtccttttttaattacctagagccttggttcgatctgatgaatgatgggcttgttcacatgttgtgattagcccagcatgttgccagtaatgccaattattttttgtcagcttgctaattcctcatgcatgctactggcctcatgccagactaggtaaggacaaatatgctgaggcagaaaacatattttatagttcgcaaaaaaaaaaggaaagtatattttatggcattattatgagccagtcctatatactcttttatcaacttgtgtgtcctagctacttgatgaataggatgaactatttggctggctgcttcgaatatgttcagttgtcagaaggttatgcatcgtccatgtgtacagtggatgcgatttatttttcaaggagtggtagatgccaggtaggctccaaagttttgcttaattaagccgtgactaattcctgtgcacgtccaggagtacatgctgacaactcctattcacgggaagttttttttttcgaaagataatggaaaatatatttttgtacagtgatttttgaaaaagaattttggtactagtatatatttggagatgaaaagtagctggttaatatatgaggttgcatcgatgtccaaacacaaggagtaaattaaggagctgagtactaactaacagtactagttagtagaactcaaccaattaatggaaactccttttttcttttctttttttttttgaggaaatagagttttctttttcatccgaaacaacccatgaaaaaggaagaaagaaagcaagaaagaaagggagaggagatatggaaaatggaaataaagtaaaggagatagatagccagcaggcatgagtgatcgatgtgttcatgcatgtgcatgaattaagttacctgaatccaggggaaatgccggaagaaggcgaaggagagggtgacggccgggttcatgtgggcgccggagatgtggccggtggcgtagatcatgacggtgacgatgaggccaccgaccaccgactgccccagctgcgagatgcgcttcatgtcctcgccgtagatggacgccgccccgcacgtcacgaacacaagcaggaacgtcgccaccacctccgatatcacctgccgcacacatcatcgtacaccatatatatactttatcttctccttcttcttgttgttgttcttgatttgctagctagctagctcgatcctgattgatgatcatcgatcgatcgttgctaactagctaggattattgcttgattatatatatataccttcttgaggaggttaggagggaagatgtcggcgaaggatttctcggggtagtagacgctggggacggcggagacgctctgcacggtggagaggtcatggatctcgttcgagtagttcacccgagagttggtcctcgacggcgctgtcgtcgatgccatggcccccctttagctatctatctaggacaacgaatcaacggaccagcgcgagcgagcgatcgagagtactgtgagcgctagctgccgatcgatcgatggaagaacgatcaagctgtgctgcctctgcctctgcttctgctttgctactgctgcttgccctggtctcctctccgcagcgggggaggaggcgtatttatagccgcgcccccgcgacgacccgtgcagtgcgcgcgcgcggagggagacgacacgcgacaggtggtaggcgccacccagtgtatgtgtgtgcagtggtgtagccagtccgcgcgcgcgcgaggctggcccccacgctccactgcgcatagctgccatgcccgcctcgcgcgcgcggttgggttggggcctttgcgtttgtggccgcgggcgcgcggggccgggcgctgtttgtggcgaccgagttggggatcaggcgatcgaggagccgcgcacacacgtacacgtacggaggttacatgcggagggccgggaaaatttgtacttttaccgtgacgaccgcgagggtggatctgaacaagtggttttcatcggtagacgaccggccgggcacgggctacagtggtttcgttcagcgagatataaatggagctgctgttaaatttaactggagtagtcgtagtggtgtaggagtacgtgtgggaggtagtaataattaggctaatttgaaccatgccattataattttgtaaagtttgagatatgccatcggtatctcaatgacatgtaggacccacataaatccctgacatgtgagttagcctgccatatcttaaactttacaaaattataatggcatggctccaattttccttaattattatgtaggacggcctgtacagtacgaggggtgtatgtactatgtagagtactactttacccaacccgaataatcgtctacacacgacaacatagaagtgttggagagttgacgctttctttaccctggattttgtgagtatgatggtaattgaacttgtttggtttgcttgttttgggctcagtttggaaaagattaatgagctgattttctacttgattacaggaatgagttaaacattttactgaataaacttaatagataaataactcaaagcaagttatctaagttatacagtataaaaaagtttttgagaaaatgtatcttttaaaggatggagcaactaatccgtttcaataatctgaaaagaacccatcctaatagtgttggtatgtttctgtaagttgtcgatagcgtgggttcgaaagagcacactcatatgtctagcctcggctcgagaaagctcgttatcaagatagtatgtgtgtcttatgtccaaagagatatttcttcaaagaaagcaacacacatttataattgggactacctatatacccattggatttgcaaaaagaattcctctatcaaatttgacgatttgctgatcttcactagtccacctccattggcttcacgtgctcatcttcctcggaaccacgcaacttccgttgtcgctgccatctttttggtccaccgctctctcccgcaccatgtgccactactcgtccgcctccctatcgccggaggctatgctgacaatgtcttctggttagcccccaacaccatcgcctttctccctccatttcttccaaccttcctcactcatcttcttcatatagttggtgcctcgcaccgtttttcacatatgtttttgatggctcctgccgttggatccgtcaccactaccacaaagcacctaactgccgctttcttatgcttctgctacctccattgcctaccaccgtctttcatccctgcagctttggttacgccggtgccaccatgccaccttagtcttctcattactgctcactgccaagcctatgctacctttctctaaactggggaactaccccttttctagctctccctccaccccgaatcctaattagctagtatgagttgtcgccaccgttattgaagtatattgagatcgtgaagaatattaaaaggctaggaatctacaagattttgactttagttttcaactgaatgtaggttaattagaaaatccgtttataattgatcatattaacaaacaggtttttagggtttgttgtcctaacaccttaattataaacgacagaggctggaatataaccattatattatttctgaagataagttgtcacttgtactgcaacagaggattaatgctttcctactcactccttgctttgtacatttgtacggctgtcaaagtacttacatcggaaatttttaaaaaaattgacaccttcatcgatctctacctattccgcttaaccctgtggtcgttcctgaccgttgttcgtcgatccaacggcaggggcatcatctgacgcaatagattcttcgttccgtacacgttcgatgattacccagcttattgtaatcccagctgaccctgttgttggacggcgattggatccaggacacaggggtttgcttattggctaattaattaatactaccatcattttgattatacttttcaattatgctctatctcgtcttcttggcatgtacgactatgtgagtaccagtaatcagtagcaagttggaatcggaccagacgagagcatcttgtcacacataagaacttccaagcagatgctcatgctcttgatcgatatatccaaagcccttatgatagaaaaatatacaaactttctgcacaaaagaacccagaaattaattaatctcttgatctgtacctgtcctactaaactagaacaagctctttgtacaattgtaccgtgtcggcacgggcattggtcaatgttgaaattaaacatggatatatatccgcgtgcactttgtcactttgtcagatttgttcaagtacaaagctgaaatttttttttgaaaggaacaatcttggacgtgtataggagctctgtcctagcgacagagacaaaagaaaggcaagccattgtacttttttcatactgaaagtctgaaataaactaatatgaaatatgacaaattctactgttaccgagtctgaagagagataacagaaataaaagccattgtaagtccatagctagcagctccattggcctgcgcgagaaagcgtggcggacgtcattgtcccgtgatacgctggtaaaatggcgaggacaacaacgaggaggaggacgaggtggaggaggaccagcaagttgcatttctagctagccatctaggctgggggaaatttttctcgatctttttggatggcaacctccaaaaagagagattttttgttctgggtatttttacaggtacaggactatgctgcaacatctaaacaagttgtgtaggacgaccgtacatacgatggcggcgacgacgtctacatgcactcgcacggaattacctagcactgcgcagcagtacatgccccttgtctgacgccaccgactgcagcagaaaaaatcaacggcaaggactctgaataatgttcagattcaacgatctcgatcaatcgagcagagcaattaatcaatctgttgagatgtaatagcatcgcagtaaattaaatcgaagcaatcaatctgtctttcagatgtggcttgaaaggatgcagcgtttcttgtttctgatcgtcaatattcaggttaagaaaatcttgtttccgatcgtccatattcaggttcagaaaagggaccgatcgatggatcgcccgctcgcgtgcgtggttgcaggatcaatcaagattaatcagacttgtcatgatctgcgagattacgcgagtaagtaaagcattagtacggctttgctctagccactccacgtcgagctaatctgcagccaaaattttgctcccaagattgtcgcattcaggcgtagttaaacacggtggtgtcacctttgacaaacgctgcatgtgcgaaaacctctcgttcagttaacttcaccagcttccaagctttggcttcgatcttgggctagcttagcatcgccatttttttcctctcctctcgttccgtaacagctgcaggtacaagcgagttttatggcatgcagcgagagaaattaatactaatcaaagaagaagatagagagagaggttcagagatttagacgacaataaatacagcaacacagagcgtgtcttcagagttttgagtaaagatcaaagtcttcaactcctcatctgtcagcttcagcagctgagacgacgacgctgctcactgatctgtgtgaaagtcaagagttgaatactactgggagtactagcttgaatgccatcttcaatggcgtgccctgccgtatggaccgctgatctgttgagtcagctcaagaatttttggatctactcctcctgcatcagcaccagtacactctgataccctgcatgagattggctattgcagtgacagctaggaggaggaggcattgtgcagtgtttcatgcatgcatatgcactctagtgcagtgtgctgcaatgttacaatgatgccaaatccacttggtagtacttggtagctagtagctggccggtgggcaattgcaagcagctagatgagggcattaagcaagtaggagtattaagcagtaagcacctaagctgcctcttggcttaattgctcttggcttaattgtggtgtcctccatcgagagagagagagagatcagcaatgtgctgctgttgctgctgctactgtgctgctacactactgtagtgaatgggattgtttggagatcatcatagtcattaagcctgcctgataccggtgtcggccggcctaccagctgacggacagtggcttcttgctgagggaagaagaagccctctggctctggtcaagggaagaattaactccggtaataaattgccaatcgctatagctttagctagctagctagagacttttgttgtctgaacgcaggatggatcaatgttggatcccttgttaacatgttgagacgttgcttttgagtgacagatggtagattttaggctgagttccgcatgcatgcactcacctttttcaacttatactccctttgcttccgcacatacgttttcaaaattgctaaacattatatttttttaaaaaaatagaaaagttgttttttcaaaaaatgatattaatcttttttaaaaaaattagttgatgcttaattaattatgtgttaatggattattttgttttacgtgcacggagtggaggttgggaactctacttcctgtacattaaacgaaacgatccctcccttagcattagctaacataaattttgaaataatggattaatttgatttttgaaactactttttttagaaattttattttttaaaaaaatacatgtcgttttacattttacgaagcgtgcatgtgaaaaacgaggaaatataagtcagggaggtgtttctaaaaacaaatatggtttacaactgtggtctctagatggtagatctggtcaagttgcttaccctgttctctcttcttaaccaatgattttgaggaatgcacacgcttctcgaatttctaaacaatacatttttttcttaaaacaaatatctgcatttgaatttcttatgaaattattccaaatatttttaatttatataatagctagttcattatttatacgtttaaataattatcgcaaaattattcagctatctggtcatttcgtttggcacacccaactttttgaggcaattttcttgctccccactagaagtggtttgtgagagcatgccgatgagttcagacatgtaaagtggtcgtgcaaatactagttgcagaacaagggtaaagaattctaaaacaaaaaacattttgcttgtgggagttggagggacagggtgaaagtttttatttattttttttccctttggccggaagcaaagcatgcgtggaaggtccggcgcaacatacgaaacgcactcacctctttctctttgggaaatcacatgttttaatcaagcatatattgtttatttttgactttttcccaatgaaagggaaatgacagttcctcctcctaagaccatgaaagcattcgcaaaagaggtgacatccttcttttcttcccttccattattgacataaaaggactgatgactatgagtgacgcatcgcatatgttggggtggttataggtagaagcagctagtagctgccttttttattttgatgattagctaattttgtttcttgctgttatatatgcttgtttcagaatcatgtcatatactcgaacaaatcaaagttttcagatttgacactactgttcgttagtttaccattaattacttgaaatggaatcctgacagggacttaggatccgtctcctcttttcaggtcccgtccatttcaaagattgcatatagagtacaaaacaacagatattttaattaaactattgtaaaactacagatttaaaattatgtataacaaaaatatagatatttaacgtaaactatagattaaataatgaagttagcaaagaactagatattttagagttcatatccatagcactattgaggttataaaagttgttgttttgtgataaaactgatgttaaatttgtagttttctgatgtgataaattctgtagttttttgaaaatataatgttaaatctgtagttttgtaataaattgatcaatgcacttgtagttttgtgaaatttacttttgcatacatcataaaactcctgtataaagtgattaaggttaggaggtgtaataatcaaaaatagcaactgaaccctgattattgaataagtttagtggtactataatattcttatacaatgtcacagtccaaaggttacagttagtataaacagcttcacaggaccatgtttgacctagaatttattttattggtattggaccggcctattggaatattaatggtcaacgattgtagagattcagctagactttgttgaactagctaactgttcagatttcatgcaattaacacaaacttatgagacacaagtggggatcattaacctttcaatttgtagttatatgtactcaaagcactgcatttcttttagccgggccgatcgaagggttagaccgaccaaatttttttaagactgaagaggatgttacagattacaagtacgattaattgtggacagatcaggctgtcgaaaactggttgctgaggctcaaagcctcagactgggacacattaaagacctctcgcacatcaagccattgtactagccattacatcctctgaagcactgcatttttcaaggggaacaaatggtcaaatatatggtcctactgataattatgtcttatttcctgatcatcaatatatgattatgctgggagttcccctctccctgtttgtttttttttccaaaaaaaagtatgatgattagatatgcgaatattaatccagtgcttaatcgatggtctcccgtatcaccagcaaaaccaaatgcattgttgggacatgacatcttcagtagatgagtagagaatttcagattggtattgtcagttatagtggactcgtggaaaataacctgtgtggctctaatctgagttgatagaaagtgggttgaatgttgttagacaaacctgaaccagtatgaaatctctacaaattttcagttcaggttaggttctgttggtttctgcatgcattgggcacaatacatgtgcctgatcgatggctcctctcatgtaaaaacttgctttttgtgtcaaattattttctctgaactgaagattgcgtggcattcctggttttataaagtccaagatgaattggacgatggaaggaaaactctatgaggctctcctcatctttacaccttgcactgttgctcatcaggcccttccaatctctttacaagtgtcagagtgtcatcaacaagattatcttcaacacagagatcaaagctagaccatgtatcaattcaaggatccaatccaaccgatcttgaaagcacacaagccatgcatcaattaccacccaaataacatgacagttgtagctagcgaagcaggcttatcagtgttatctacagatgcactgatcctgacatccaatataatcaccatatagctaacttttgtctgcatcaaattgcacaattacaatgtaacaacagcagtagtagtagtagtagtagtagtagtagtagtagtaaactggcagtagatagctagctaattagctaggctcttgtgcaggggcacctggtcgtgctgtctcagccatcgaatttgttcttgccactctagctaattcagctaactatatatccagctcgatgtatcatgtatgtgtatcaccaaagttgatctctaggacacgcaattaccgcggattaatttgtggccttaaaacgacagtaatttcaggcctcccaaatagtcaaatactatgcctgagattcgaattgcatatcaaaatctcctgtgaagaaaccacattgtgcgaggtacatgctaatgagcaatgtcgacatggtcatctctcgcaaaaccgatggatcgacgaagagattaaagcgcatgcgcgacgttgaccctaatccctgttgcatatgcttagcctggggacagatggactggaagagagagatcaggagataacttttttcatagtgctacaggaaatcgccgtcacattcggggaaattttgtttcgtgacccgtattattagtggatctcatggccaataattcgtcccttgatcgctacggctagtggtagagtagcttagagaggtggcccttctctgtacatctcagtgcttggccgtggccattggcgcacgcagctaagctaggtaagcttagcaagcatgcgtatcaacctagctaagcttgattagagcatgctggattgctgatggtgggtgaggccaaagcttcaggtgacggtggtggagcatgtttatttttttccggtatttgacaagacatgacacgcccacccaatcgcgacgcgacgtgtgcgtgcatgctcgcgagctagtgtggtataccccgttccgcttacgctttcgttctcgcccgctaaattatactccctcagtcttattttaagtgcagtcatgattttttgctcttaattttgatcgtctatcttatttaaatttttttgaaaaaatttaaaaaataagtcacgaataaaagtactatattcatgttttatcatctcataacaacaaaaatactaattataaaaacaatttaaataagacggacgattaaaattaaacatggacactcatggctgtacttaaaatggaacgaacggagtaatttttttttctctcctcctttcaagggcgaaaacaacaagtcgagtggcggatgccagatgggatgtactatccttcgccccaatacaccacctttctacagtcacattgctctcgttcgtgcaccctttttctctccatgcaaggaagtgcattcacagctactactagtgtcgtagtgctccctgcttacgctttttttttcctctgtaggctgtgtggtccaaaagcaaataatttttctgcaggctaagcatctccgttgacgaatggcttagaattaatacgggacggggtacgaaataaatgtgattcaaatccatcgtgcatccgtatatgcgttctaatggtctaccatgacgtgaacaattgatcccagcgcatgagatttctgaactgttttcgtgcctgatctcgagctatcatccgctgggttttgtggaatttttggcgctgtattttggcgttcagcgagagctcgtgcaattatgcatacgatcaggggaagttggaggaagttgcgtttgtgtccggccaattaagaaacagggtgaagacgatcgaagctgtgtactggtgctagctcgttaatgacgaactggagaatatatcatcattatcttgaaagaatctctcttggtgccttaatcctgctatctagttgactagttgcatggtgccagctttattttagtccaggcaggctgcaggtagtgagctgagtcaacttacatcggtgtgtagaaatgtttgttggacttggatctaaaagacaagagtgaactctttttcacctttccacaaaaaaatttggttcaaaaaaattgctaagaagattgctgcactaattgagggttttacttctctcgctcacttagctagttcttttttctccaaggatgtgttatagcagtggtgtgtttttctcctgatcgtagcctcacaggactatataaccttatattttttttctgctatatacaataaaatcgacacaatcgtgcggtggttggttcgaaaaaaaattactaagaagagaaaggtactacatttgtttctaaatgtatgacacaattaacttttaaatgtggcatttcaacatgatttatgtcttttatatttacaccaatttgtgtaagtaagttatgcccaagtcaacaacctcctacatttcaaaacgaaaggagtatatacaggagcactacctccatcctagaagactcaatttctaactttgacttgataaattagagcctgtttagttggcaaaaaaaatttcctttgcatatcatatcagatatacggacacatatttgaaatattaagcgtagtctaataacaaaacaaattacagatttcgccaggaaattgcgagacgaatttattaagcctaattaatccgtcattagcaaatgtttactgtagcaccacattgtcaaatcatgacgcaattaggcttaaaagattcgtctcgcaatttcctagtgaactgtgcaattattttttttctacatttaatactctatgcatgtatccaaacattcgacgtgactgcgcgaagaattttatttgggaactaaacatgcccttagtagggagtgtaaaagatcgaaataccccttattaataaaaaaaatagagttgtaaaatgtcagctaattaagggatagaagataatgatagagaccaatagtaggtaagatggtaaaatttaaatctttttgttatatggttcgatgggctagctagctaggcatgaagtaagcatttactgatctctccacttgttgagaccaaaggattaatttttgtgttctttcgttttccctcccgcacaaggaggcggcagatcagcagacacttgcaagtgggaggtaggagaaaggagaagtaactcaaagccgagatcagctcgaagctgctactaccacctcacttactagctctcagtcgtctcagcttagctagtggcgcgcgatctgcaaagcttagctgcaaccgcggccgatcgatgcaacccattgttctttccttttccgagaaaatttgagccaaacaaggcgccgcgcgagacagccagcgcgcgcgcgcgtgtggcaaaggcagtagtggactccccctgtggcctcgccatcgctcgcccccgcgcgcgcccgccacggcgtcggcagtgcgttcgtgcgtgccccgccgcggggcgaccgggtttgaccgggcgcgaggaggaggaggaggtcgctgtgatgtggcgagggcgcgacgtcggcgtcgtgggacgacgacgacgacgacgacggcggcgacggagacagtcgatgggtcaacgacggaggtggtcgctgctctccctttcgatcgagggccatggcgaggggaattgagccgagcgagtggcattgccattgccaatggcatgagaggaatatgttcacaccgctttaggagagggggagagaaaacgatgggagaatgcggaaaatgaatgtacgtctttgtttcctttaggaaagtgggatatggaactgtgacggttcagctggagccagggaggaggaaatgtggaggaggggggaaattgttctctgcattttccatgtgttccaaattgcgccctgcctggctgcccctaatttagagtttcttttgaaacgcacgattctaaaaatatagtttacaaggatcaccttgacgggaaataggagaatcatatcttactataaagttataacccactaattctaaaactcaacatacaaacgtgctacctcatcatccactagcaataattacatacaaaacttatgcaagcatgtaacattacctataattcattgaattctgcaaatcaacatctaattatctttcttcacattatttttaacatatatatatctatatgttaaaaataatgtgaagaaagataattagatgttgatttgtagaattcaatgaatatatatgtgtgtgtgtgtgtgtgtgtgtgtgtgttaaaaataatgtgaagaaagataattagatgttgatttgtagaattcaatgaattatattataggtaatgtgtgtgtgtgtgttaaaaataatgtgaagaaagataattagatgttgatttgtagaattcaatgaattatattataggtaatgtgtgtgtgtgtgtgttaaaaataatgtgaagaaagataattagatgttgatttgtagaattcaatgaattatattataggtaatgtgtgtgtgtgtgtgtataaagttatttaataattttcgcagtaaagcacgggaaatcacctagttcgactgattctcgtccccaaggagttataagaatagaatatcatgctcacaaaatttcttcatgacttgcaaatacaagaaagtttttctaaaaaaatattagcatgatacacggaagaagtgtagtattttaatttataaggagaaatatgagacgaaccatgcttgttttcctccacaatttccatggaaagagatttgctccggtcaaaaaaaaatatctcgaggtatcgatacctcacggtaccaaatcatttctgatcgttggatctagcaatgcacatcctgcccagttagatccaacgattgtaaactatttggtaccgtgaggtactgatacctcaatgtaatttttgctggattgactggttaattatattatgaaaatgctaataacagaaatataaatgttggtttttaaccatctcaaaccaaatttactgagctgaaaaatggttaatttgatcagctaattcagtttaatttgcaattctacaagatactagtagccaaaatgctcttttttcatgtccaatcaatagcttgatgtctaacatgttcttcacataatttatgaattaaaaaatgatctagagttcaaatgctggtgattattgatttttattattggaaacgtactcaatatcactacaacatattatttttttactttagttatgtgggaatactataacttactgtaacaattcggcctatattggctatattggtttatcgaagtaaaaatccgaactacactgaatgctagtttgcaaggctcaagcccggggtttgaatgtctggtatccgaagccccaaaacaacactgtacccttgttgttcattatgatcatgatatatgttaatcctttttaggcttttcctagccttaattttgaggcccaattaagcctcaatcagggctagcagcccatgaacaaatcgggctagtacttgtccacttttgaggaggcagtacacttactgattattaatccacgttaagtaatatcgagccaaacgttattatattttgagatggagttagtatattggtgtaaatttatattttaaaaatatatatggtagttatcgaatctcaatgcctattgaagaacacaaagaaaaagaaaaggggaaaaagaaaacctctccagtagccttacatgtcaataacaggatgtataaaagacacgtagcacacaacgaaagccaaagtcaaaacacatgacaagacctatatacatacatatttccttctctcctctctgataagatcgaaaagaaaagcaaagaatcaaacacctgatcaaaagtagcatgcatcatacagatatttaaaacagcatgctggcaggcactgtttgcgatcgataatggcagcatcgatcggttgtcggttgacctgctacagtgcctactacaccatgatcctcttcttgcatgtttggtcaggttttgtagttttcctatgattacgcaatccgcgccggtgatgatcaatcgatcgagcccggcagttgtccggccagaccgatcgaccgaccgatcacgaacgcgcaaaaaattacacgtcacgctcatatattacgatcacgacgctccagtcgatccgtcgatcgacggcggcgaccggccggcgcttttgcaacaacgccggccacaatgggtcgatgagatcgatgcatgcaaacgcagtggatggcatggccttggcctcggtgctgctcctgttgggggaatgcattattaggctaaaatattgcagacagacacagatcaaggttctgatctctccctctcccgtgcctttgttctgtctcgatcgaggcatcgatcgagatggatcgaggtcgagagctgtgtgtgtgcggttctctgtgttgttttgtcatgtgtgtgcgtatggattgggatgcagggctggctggctggctcacggggagggataagaaagatgcagggatgggcaggggagggggatagggttagcacattgtggccggcttgcaacattgtcttctgacatgacatttgtttggcatcgattgttctgttccatcgaggtcttgttgtgtgatggggtacagtaaagtagatgtaactgtcattatcagtttcataatctgcactcgtaataggaacctaagaagaagtcacttgtaggatgtagtttgagaatgctagatttttatttgacatttgatggagaacaccctaaaatatcttgtgaattctagaccgttggctttgagattcgttcagtgctcacccaaccctaaaccctccctccccggtctcactgccgccatcgcaagagatcgattacagtgacctgagtagtaccccaaggtcctgagttcaaatctcatatggagcgaatttcagattgggttgtttgcggggctaagttccctacttcaatggccgtatatatccggttggatgtagaggccgggtaaaaaatacccttctctaaaaaaaataataaaaaaaatcgcaagagattgaggaaccatacgtgagcacaccttccctcgcaagagattgaggaaccatacgcgagcacaccttccccaacacctcctctgttgtcgccacctagcctcgttggttgctagaacctagaaggtgcaaacgacgcttgtgagtcccagcggacttccccgtctccctcctcgcctcacaccctcttcaagccggtggtggcgaggcaccctcactgtcgtcgtcttcctaaccattcacaccactttgcccctgctgcaacacctgcccaccatccattgtcaaccttttgcggcttcaatggtgccatcgccttaccacccttctactactaggctgccaactcccatggccatccttctaagccaagtaaaattttcatatcttcccactccctccaccttggtcccaactcggatacctaattggttggggggtcgtcgccgctatagtcgaagtgggaggagaagatatcggtgcaccaatatcgaagcagatcggtgggttcaaaatctgcaaatcgggcctctgatttttcaaccaaataaaggttagcaaatttctttttttttaatcagccaagtgtttcaaaagttacaatcttgggtgaattatctttttcttcttgccaggatgcttggggtgaatccagggccatagagcggcatgtgcggggtgtgcaactgttcagggcctcaaaatttaggggcccaaaatcttaattatatggagtattaagtatacttaattagttgtaaccggaatattaaagcccaatagatcaggattaaggcccataactaaaagtggaaaatacaacaggcctaataccgaagctaaatcgactagaaatggatgtaataacgctctacgagtcatcgtgatagaccatctgtccgtcttctcccgttatacaagtcatacgtgtcgatcacgataaagggtccatgagaatttggctatcaaattttaaggcacgattaattgtgcattttgtaccaggttctccaattgttagctacgggtcctgggtgaatcctcgttgaatgtagttttgtgaaacgggtccacaaataaaaatatagttgtatgaatataagagtgtgattcttgaagaattttcacagagagcatagttgtctttatgtcggtttcctttttctctactacttaaaaaaaaagaggtgcttccatcgttcgtaaaaaatcgagcgaaaaaaaaccaagtttatccgataaaaaaaccgggtgaaaaaaagtgcgaaaaaaaaagaaaaaccaaatatgtcctatccagaacaagggaaaaaaagcgggcgaaaaaaaaccaaaattgtccgattaaaaaaaccgggcgaacaaaaacgtgcgaaaaaaagaaaagaaaaaacaaaatagcgataaaaaaagtccgactcggtcaaaaaaaatatcaataaaaataaaaaaaagtccgactcctcgttccctctcagaaaaaaaaaaggtccgactctgatccgagtcccactcctcacgtttgagtccgacatactaggcaccacttctctcggtttcaatttataccgtgatatttcatacatcttggtgaaaaaaaattaatgtgccagattgaagatctgtttgcaaaaacggaacctacatgtcgagagcattccattttaatatgattttaattttttggtttgtacatttgcatttgagtccctgtaatttttatatttacgtttaagtccctataatcttgcaataaggtgcttttggtcttttttttaaaaaaacaataaataaaggggatagaacaaaggcaaaaaggtgcataaaaaaaaagaaaagccacacaaaaaacaacaacaataaaagtctatttcccctaagtggcgaaaaaaaacgtagatgcaaacgggaaaaaaaatccgattcctataaaaggaaaaaaaaaagtggtgaaaaaaacactagatctgattcctttaaaaatagaaaagaagtctgattcctgtataggcgaaaaaaatccgaaaaaaacatctaaaaaagttcgtccgattccctaagaaagtggcaaaaaaatggttcgtaaaaaataaaaagttagttcgtataaaataaaaaatgcacgcaagaaaaaaagtggaaagggcgaaacaaagtccaatttctaatcagtataaatctcttctctatctctaatctaatataactatttaaaaataaaaaatgcacgagaaaataaaaaggtcaaaaaaacgtgtgagaaaaaagtcagaaaaaagcacagaaaacacactgaagaggtttttccatcttcttaaaaaaaataaaaaaacgcgtgagaaaaattatttccattgccggcaaaaactttttaaaaaaacatacgaggaaaaggatgtcagaaaaaatgcgccatttctaaataaaatggtttgaaaaagccacgcaagaaaaaaacactatatatatataaaatcgctctaaaaaaattgtcagaaaaaagctaatttgatggacgcttgagtcggataagatacatcgattttttaccatctactacccggcttttatttcgtcatatattctcatatattggaaaaaagcaaaaaaataacattccgaaaaaacaggcaaaaaaaaaaaaccatgcgagaaagtaattgtcagaaaaaataggcaaaaaacacgtgagaaaagcaaaaaaaaaaggggagaaaaatatggttttcgtcattagtaaaaaaaaggaaaaaaacatgctagaaaaaaaactgttagaaagaaatgcgagaaaatcgtgcaagaaaaaaaaacaccgtttataaaaaaaaaacaagccgctcattaaaatacaaacattgtcattgacatgattatgcataaaaaacgtatattatcattagaatttttttcacccgttacaacgcacgggtattttagctagttttttaaaaaggaagaagttatatttccttcgtgtggcctttgaaacgttgggcctcgtatgtgtaaaccacccaacctcggcccgcttcacggagaatcatggcctgcaacgtgaaaaccttcgaatcgcttcaggtgcgctcgtttaagcttataggattagattctcttcgttttccgttagcacgtttttcaaactgctaacggtatatttcgtgtgaaaacttctataaaagtgttgtttaaaaaaatccaacaaatttattcataatatatattccttatttttaattctgaatttcagttatttcctaattgtatttctatatggactctagtatcctcttctaatattcctaattttttaattccgaatttcaactatttctaaattgtatttctatatggattctagtctcctcttctaatattccttatttttaatttcgaatttcagttatttctaaattgtatttctatatggactctgttttttctttttcttcgattaatgtgagaatttctaggccatgaaagcgaacgtggaggctcctttttctattcctttaataatataatagatttagactgatacaagtatctaagtttaaattgagagatgcacatatggtgaaaatagataaattatagctaaaattttttttttttgaccggattcctggacaccccccctcccctatctagctccacccctatgtgttgtacccggttttgtggtgatatgtgattgagacttaaccattaaatgaggggtgtagagtggacgttttgttattttcttaaagaaaagagaccactcagacacagcccacccggcaaagcgaaggatgcatgcgcgttaggcagaggcgccatcggttctattatacgtgggctcgcgcgaaaagcacggcctcgtcgcgcggcggagtaggctggctcgatcggcgggtagtagcgtactagcgtgcgtgggggattcggctgtcgcgcggtgcgtgggccgtatcggttattttgctcggccacgggacgggaccgtcgtcgggacgcctcacgccgccgcgccacgcgtgacagcaatttaaccgccgaaccgcccgcgcgccgcgcgcgcgcgacgatccagcgagagaaacaacacacactaccggcgtgggcaggggcggagctaaaacgaaatggagggtggtgccacctgcttaatttactctattttatatcgagtttaagctgatgcgggtgcctaagtttgtattgaggggtacatatatagtgaaaatagataaagtatagctaaaacttttttttgaccgggttgctaaacactcccctgatatatactagctccgccactgccgcatgggcgggcgtgcagtgtgcagcgagcggaacacctgccgttcccgtaattcgttcaacttcgattcataccagaatcatgcatgcacgcaccgatcgactagctctcgatccatcctctcgtcacgcttcgtacgtgctcgtgttcttcggcgattaaacgaccgacctcacctgatcaacaacgcacattccgttagttggcttttgcatggggcatcagctcatccaatgatccaaagatccaacagctagaaagccaaagtccggatatcttttaggttgccctcacattccgatatgaaaaacggagcgatggattagtacatggttaattaagtattagctaaaagctttaaaaataagttaatatgatttttaaagcaactttcctatagaaaatatttaaaaaacacttcgtttttaacatgttaagggacgtgcgcatggaaaacagtagaagaagtttggaatacccaaaaaagaactcaaccttaagcgtgtacactgaagatgcacgtgcatttgatgattatgtgtgtaggtgtctgtgttttttttaacaaataaggacagcctgtacccattttggcgtgtacactaaagatgtacgtgcatttgatgattgtgtgtgtatatgtttgtgtttttttaacaaataaagacagactatacccattttggcgtgtacactaaaaatgcacgtgcatttgatgattgtgtgtgtatgtgtttgtgttttttaacaaataaggacagaacatactcatttttttattggtatagagagaaaaagtacactccctaagcgaaaatagaaccagttacgcgccttgggcaatctatactacatgtaggaccatcttaaggtggagctttgggcttgccattgtcaatgtgtcctcctcttttaactttgcaaagagtccaatggttgaggatctgttgtaatcgaagattctttcatttctttcttttcatatcacctagtagatgatagagtatcagcgagcgagcacattttcccttttagagtgtcatgtctgtttgcaagcatacatctcccatcattttgacaccgtggttgttggattccattcacttggcagttggcacaatttgttggtaggcagcctagctcgctactagtctcaatatccttccgaaaaatctgcactagacgaagaggtggaaggatgactcatttgtggcacaggagagtgagcataatggaattattaggatatcctcttgttgcaagtctgtgtgccgttcatactctattttgtatcatttgtgacgcggaaggatgactcattggtgattgtgtgagtgttgtgtatgtgtcaaatgtgtacatccgattgtatttctccgggaaagaaaccatcttcacatgactttgattgtcaaaccgtgtgctgtcttatcaacaaggcgttttattttaggacaaatttatttttctcacacaccgaaaccttgtttaatttgttgtgaaccttgttttatttggcactttctctttcataatactactattccattggtgtttaactttttctttccttcgctgtcaacgaccatcttatttgtccctaaaagaccaatgtgcccttatgaagctaaaaattatataagaaactaatgaaaatatcatttattctttagttttaaaagtattttaggaccaatgtgcccttatgaagctaaaaattatataagaaaccaatgaaaatatcatttattctttagtttttaaagtatgtatcaaaataggacttattttttcagttaaaaaattcatggggaaattttcaattcatttgaaaggtttatacatgtaacttaaaaaatggaatagtaaagtaaaaaacatttttgcataaccacataaatatagcatagcttccaatattcttaaaaaattgaatagcaatgcacatgagaacttaatatcttctaaggggaaaattgttatcttaatatgttacagtatttgctaaaagttaaagtactatttcactttggaacatctataagggcataacgatattttaattgcaaacttaatagccaactacccttgactagatagtgatggcataaaaatatacgaactaacgaaagggtggtaaaagaggagtacaaactttcaatggtggaagagatagtacaattgcaattatggatgaaaacggctcgaaaacaaatggaaaccacctttaccattttcgttttaatattttttattcagaatagggaaccctggatagaaaaacggaatcaaatattatcaaatacaaaaaggaacgaatacgactcgaagcaaatacggtaatgaatatttattagaatgtaaaaaaccctccaactaagattccaagttttgtctaaaaaatagataaaaaattccaaattttagcattatcataaggataacatcgtagttcacatatcactatgtcaactccattttttcatcttttgagacagtaaacattcttcgaaaaaaagaagttccaaattcatttaggagaaattcttcagaaagttttcgaacatttctactttttgacgaataatgccattttgagaaaagaaaatctgaatttgtttcctttcttgaaaattacccaaaagaaattccgacaggtacgtgcttttcgtttgtgaaaataggtcggaaatctagaaactttccaaattgttttcaaccctagttgcaatagcaatgggtggcaaaaatgaaatcttcccgaactaccctagttgcaggcatgacttgttaagagtttaatctagtttagcgcaatttcaagaaccgttcgttcatatttattttcaccagcaacccattggtgtttttatttgttttttccccctgaggggagtgtgtttttatctgttctgatttggaatcagttagattcgagggatcgtgcaaaaaaaaaagtggctttggctttatgaaaatagtaatgttatactgcttctcttagcaactttggccacatggtaaatttttgttcatgtaagaatattgaatcttgaccacatccttgctccagctgccgacatcaactttggttagcttttttcttttaaaaaaactttatctgtgttatcctgttggcaatcattttgtgaaatgggaaagatgttttcactacttactgtactagtttttctgcagaacatatagttcagttgtcacccctttattatggttattatcaatgagtaacaaaaaaaaacaggtttaggaatgaactccattttttttaacaaaacactggatttattcttggtgcaaattcttgttttggcaatgaaatatgctggtatttcaataatcgagttttttttcaaaaaggggatttcaataactgagttatcttggttattcctagagaaacggaaatgtgcatgcttccttttaacgcaactttgtgtgtttgctttcgtctagaagcaaacatttagctttttagtgacagagccaatataggtttgaaaattgaaaagtatgcaaattggcaatgatatttgtccctgctaaatcctttagtttaggatatagggtgaatcacatgtagtgcatagacaatagcattctcgataccctaaaaggagagaccatttatatgtcatctcttgcgttagctcaagtgctttacatgcaaccacctaatgcatggcctatcagttttcaaacgacaggaatggaaaaggtcttcaagttcacaaattctttaatttagagcatgcatgggttagagcagatacaatagcaggctataagcttactataaatatattttaagaagataaaggaaaagagagaagagcagcgggctacagatctgtagccagctgcagcacggactccaaaacgtaatgtgtgtatgacagatgggaccaggtattaatagtatatatagtaagcaactattgtataaattggctatagataatttagagctagtaacgggctatactattaaacttgctcttagctgtgctttagtacatgttcatctctaagagcaaatactagactgtttgtcttttctaattgaatagatcatatgtattcataatcccatatcaacggctggtagcataatttttttctactagtggtagaactcataaatcaattgctaaaatcacttctactgataataatactggtaaataacatttagttagagtgaatgaagatgaagattgtacgggcatgtcaaactattaataccgaatttagtgtccattcttttattcgggacttcaggtagggtaattgatctacatctcttcttgttttattcagatagacaacttgtaaaattactgaaagtataaagagggaatattttttttatcaagtgcttacgttcagaatctttcaaacagtactatgctttacgtacttatcctagcatctttcaacagcacatctgtgtggctgtgatatcatccagtaaagtgtttttttttccatttgaactaatctgaattatgcacttcatcagtattgcggccagagctattctattgtttaggttgcaaaatattactaatgctatatcactttggtactaattatttgacatgatcccattaggcgtaagttagtggaacttgtttttttttaggtatgctcctgcagggcctgcagtaagcagcacaaagctttatgcttgtgttggttgaatactatactagttgagtgcagcaaatcttttcttcttttgtagttaattttatcaccacaatggggacatcacaaggtgggaaattttgtacgttcatattttagacatatattgttttctgctatcattatgcttagtgcagcaggcatgtactagtgattttgaattgaaggaagctcgtagggttaagatatgaatgaatgtcttattattatatttttaggaggttaattaattaacaaagattctgttcttctgcataattcactattcgggaaagctttggtctctcattaaatcgtacctacctttaactgttgctttagatgctctgtcacttctattggtgacttggtgttggatgctgagatagtgtggttctgtccgttttactgtctgcatcatgttacagcatctaattaacagaaactcgtgtgtcgatatatgttccataaccatcacctctttaattaaaaaacgtgggtagatatcgagatttgttagcagatctcgttcttttcagtattgccagagattatgtgaacacatttcctattttactacggctttgtaagtctttgttcacattatttgctgggtctaatcgtactgacagatactctgtacaacatggtggcaagaaattcagagtattcttcttgcattgagacatcactttcatttggtgccatgcaatgaacaaaagaatgaactcatcacctacctttataagatgatcggattgcataaactttcagaatactgtagccttttccaaggaaaagggaaacaagtgcgatgaaaaaaataatcagaacttcaaaagtttggatatcctagtttctcacgtgttttgaactgaacaagaccaagaatatatgaccagcaaaatcttcacttgtttccctgcttttcgcatggctgcttgcacacattttgcatgggcgtctctactcctctccctgcatctggtatacgtatcttcgattctctcatgctttgaaccatatctattaagtcagaaactaaaaataatacattgggttaatccacttgcttttgctgctctgtgcaactccactcgaatcctttttttttctttgatttgttttccccttcttttcaggaatggacatctactcactgtcaccacagctcacgagaggtgtcagccattgtggttgtagctctgcacactgctagtgcttagttcatggatgcaccacccttctcctctttaaaaggcagggtgtgatgctcagtgtctagtccaagagcactcaggagttctctgaattctgatggaaaccaacactcctccaaagtctgggannnnnnnnnnnnnnnnnnnnnnnnnnnnnnnnnnnnnnnnnnnnnnnnnnnnnn

SEQ ID NO: 66390 - DNA, 1109 bp, Oryza sativa
cttccaaaattcctcaaatatcgagatctatctaatggcacgcttagaggtcaataatagagctttatttttaccgtttgttgagttgtcccgtttcgcgtgtagtttcggagcccgaagacccgcagtgcgaggatttcgaggatcaagctcaagatctcgagcaaggcaagtcacctttgatcatcttgcacctataatttaaatctaagtatttctcttccgcaaatattgcatgattaggtttaacacaagtaatttggccgcggcttgcgagaaagcctaccggccccaatcctaattgctgcaattaccctccttgaattattgaacaattaaaactcccttgtcgactgttgtgcttcgatgcacgggccttcaggcacgtgcatgggaacacctcccctcaaacttaaaatatccaacgatgggtaaaacttgaggttttacaaaagacttggaaaacccgacgcctgggtcggtgcttgcgaaccaaatgaatttccaaaaatcgcagaccgggggacgtgccgggagcacggtttcccactcttgcacttaaggaccgatttcctttggaatttcatccgtacatataacaagtacgaccacatgggtggaatgggacacccctggctgagtaattagctaatcaggggagccttgatgcctggagacaagtggattcaccagggtggtgtcggagaggacccctgggcttcctggcacagtatggtctgggacctaacctgttgttggtctgggacccctctcgtcggcatatggtaaacctgtgtcggctctcgaaatgccttgttatgaaagcctcaaggtcaccagacgtggctgttctgcacgggctgggtgatctgggttagtaatgtcgtgtgggtaaagtgtgccccctctgcagaggttattaaactgttcgaacagccgtgttcacggtcatgggcggatgtaaagtgattccttagcgtagttttgtttgactaccgctttgtgaaattgctgttgtggacttggggttcgatgtttggaacatctgtggctgacgggatcagctaggcccgggtggccattttaaagttgtggccgggtgccaatct

SEQ ID NO: 66391 - DNA, 2251 bp, Oryza sativa
tgttattattcgcatgcagaattaaagaggcatcaacggcatcggagccagacgacttcgttttagctgtgcgtgcaatcgcgcatgcatgcttgagttgttaggagagaaagctagctgcaaaagcagtacagtaatggccactagattagtcatagttaatctgaacggtaggtttggattggtttggggtagagtattccacaatttgcgcctgagtagtttaacgcttaatcttgtccaaaagcaaatcagttggacagctagtataggttagggagaggacaagctagggaacaatttcatcatcattaattgatcaaagttaagcgggcgtgtttggttgatgggagcatcattttgggcactagaattacgaccgggaattggggcttttaccaactcatattcctcatcatcaagcctggcatatgcatgcatccatattatgcactagctacacgcagcatttgttttctgaaaattatatacatcgtcaggtctctcatggcatccatggcatagtgcacacgtacttaaccgatcgaaccgtcgcggccggccgaaaatatatacactctcgcctaactcacccatctgcaattacgcagcatatattccactgaacattcgcactccaatcttcagttacgcaaacatttattctattatttccactgaatgttgacacggaattggaagcagcgacaagtttaggagctcctaaactgcaatttgcaaatgcatatgtagaaaagtgagccacatgcacgtacggttgatgcgccggaattagcataagttttattctggttctaccagactcgcatcaacgacagtaagcatttgagcagaggtttatacatgccctggatagatttgtttttatttacatgaactacagaaaatcttcatactatttattaaggtctactcaagagataatgctatgggctatgtaactatggatctagatttctttttaaatcttcttcttaattattatcgcactagtattatcttgtctgcctggaagtttcgatcaatcctgcatgctggatctccaatccgatctgaaacctcgagagatgggcactaggtcaagtcagacggcgtgctaatctgacgggccccggagagatgatcgtaaactgaatatacatgtgttcagcggatcagacgccatgcggccgatcgatggatggatctttcaactgaaacttcgatcacttgacacttccaaccacagaaaactatatagtatgatactatgcagtatgcacatcagatcatcagatcacacggatccatcttggtcctatagatgcatttttatgcgtcaccatcaacagttaacgaacagttgattacagagacatgagaccatgccgtctgtgttatttcaaacaaatcttatcttaccaaacaggaaaaaacagagaacagcatgctctgtgtacataacgacagggaaacaaaccttaagcataccaaaagaaacttaattatatttgttattcagggacagagagctgtacatagagaggtattactggcgagagcacgggtggaacagttgaggtgacactggtgatggcaaaatgatcagtctaatttctgaagctacctgcttgtccagggtaaaatcagttgcgaactgtagtgacctgtgactagctttgattggctaaactcgttagggcacatggcacatcgctagaaggcaacgtttcaacgttcaaactcttgactggtcacttgacttcaggggaacctggttcgatcaccggcaaacacaagaagcatgccgaccatgcatggcaaaacacaactactagctgctttctggcaagagcagaccgtaagctcgatcacaatcacaagagacctttgttggcaaaaacaaattctccgtatcaagatactttaaagtaaaaaggtgcacatagtcaacaaaacgatgtataatatacatatctggatcagcaagtcattccgaaaagcacagaccgtgtatcaattgcacaacacataggcctcctttttttttttccctgaaacgaacctcaccacggcacaacataatattttctaggggctgctatataacggaatcccgtttttgaacgggatgatactggttaggtatcaggtccggtatcgagtgatatatataaggtatcaggcaattctaccacgttttcaggtgatactcgcgacgtatcaggtgatacctatcaggtatcatgcg

SEQ ID NO: 66392 - DNA, 3151 bp, Oryza sativa
tgcgtcatgcatgtgtgcaggcagcgtgcgtgacagtgtgagagcgccaacgcggtttacgtgtgcgtcgcttgtgcgcctagcctagctgtgtgctgcaacactcgtacagaatccaagtatgcagagaccggccggcgatcgatatcatttcgatatatgtaatttgttgcgtgcgggcggctgcatgctcatgctgagcctgctgcttgcaatgcatgcaggctactggtaatgtgccaagtggatgtgcatgcatgcatgagagtatgaaactacacataaaaaaaatagtcctagccctagcccagtgccccagtaggccagtagactcaaaaaaaaaaaatttgaccaaaaacaacgtatcaaatatttagacatatgcatagagcattaaatgtggatgaaaaaaaccaattacatagtttgcatgtaaattgcagagacgaatcttttgagcctaattacaccatgatttgataatgtgatgttatagtaaacatttactaatgacggattaattaggcttaataaatttgtctcgcagtttatcggccgaatctgtaatttgtttcgttattagtctatatttaatactttaaatgtatgtccgtatacttcaaaaactttacacccaaaaaattaaacacaccctaagccggcaatcgcgggctcaatgcgaaagtttctaatctctgtccagctacgagagattttacgagcatatatagaatgtcatatcgatcgatcatcatcattgctaatgatgccagtcaagcaacattcacacacatcctgctataaggacatcatagcctcacgtggcaacgtgttggcaagtcatgtactactacattgtacatgccttgccataacgggagctactccagctacgtgcagcttgggcaacgcatgcatatgcatccaatgcctggttcgcaaagctctgctttccatcagcgcgcaacaaaagcagccagttggaaaagggttttggttcaagaaggtgctagctagctagctagccatgtccatgcatgtctctctctctctctagctttggcaaactcccatgcaagaagctagcgaaagcgaaggcccgcccatcattcgccttctgatccagcaagcccacgccaactccttgtctctttctttcttgcactgcatggcatattggcatggcagctccaacgaatcaatcattgtctaggttccgtgaaccaccgccatctgctggccccctgccgccggcgccaagtctttcttatgcccatacctgtatatgacctcttcttctctagcttcgatcgatcttgccatttcttggagaatactagtaccagagagctgtcaattaacacaccataggtgctttacttttgttaattaggatcatcagatcactggaacttcttttagtagcttgatcatgaaaatgatatttcttcattttcatttctgaataagaaatagattgaaacacttgtctaataataaagtgatcgtgctaattcgttcattgcttagagatgattttttttcgagaaatgtgcataaggactgctcatttgtttgaagatatgaataaagagggagttcagctgatttgttaggctgataattcaatagctggggaacatacccacattgtctcacatgctctccccatcatattttatttcaccagcccccacagagagagacacataaagaaatgccagctccaatcatcacatgaacaactactactcgctgaggatcaggtgatgctacatagccagaaggccacttgtacagcttaatttgtagccagccacttgtttgatttaattttctgctctccccccatattcatttcttgacatgccagccagcttagctctcggctcttggggagaaacgcattatttctgaatttctgatgggtccatcagatcgtagctagtactagctagatagacgcctcgctcctgctgggagttggagttaatcagctaattatcatactgcaactcgatcgatcgcctcgtcgtcgtcgggtccccttcgtttcagagaagatcatttgttcagaaaagaaaactaaactaaagggttcagagacgatcgatcaatgcatcatggaccacagaacgtgtccctgtcgggagaaacatgcagatcgagcgatggctggccctgcgacgcccattgaccgcgatttgtttaagcaaggcgcgcgaggcgaaatttgtttagcgatgtgatcaggctaactgtggagactgatggagttcgtcagtcagatgggggcggttgccaattggatggcagagggccctgccttgttggtggtttgcctgcagagagttagagagagagagaggactgacaggagatgcccctaactaactgcattcataaccgtagtacctacctactcccggtaggtaagttgttttcagatctgcagagtttattatggctagagcactgctacatttactaatttttttactaaacttttactaacaatcatcttaatcatttaatttagagatgaaagttatgaaaaatctatatgtactcatgatatgacatatcgtttctttaaaaatttagtaaaaaaaagttagtatgtactagccttttccacatggctaaatgggttagtacaggcagcaaacctatctgctatggcagtaatctttttcgtttttacaagtgtgcgaggccgcatccacgttaaacgactaaatgcaaaggacataactacacagctaaccagctaccactctatctataagaggtatcatccacctatacttcaaataagattttctcttaaactactcatctgatctatgatccgattacaccgttgtgttcataataattaaatctttacaacaatatctcacatgattatatttcgatgaaaaattacaaattacttttatgatatgtctaaattacttttagactttactgaatttacttcttagacatagaagtaacttagtgaaatctaaaagtaatttagatatattataggagtaacttataacaaaagaaagtaacttcaattacatgcacggggttgacgagagacgacgccaggtcccctccactctccatgtcatcggctgacacatagggtcagatccag

SEQ ID NO: 66393 - DNA, 1937 bp, Oryza sativa
  unsure (1)..(1937): unsure at all n locations
ctgaatttacttttatatatcttagaagtaacttagtgaaatctaaaagtaatttagacatatcataaaagtaatttgtgatttttcatcaaaatataatcatgtgagatcttgttgtaaatatttaattattacgaacacaacggtataatcggattgtaaatcggatgagtaatttaagagaaaatcttattttaagcatacatgataggaatatttcccctactgctaaatggaataatagcaaccaaaacttctaaagtacaagcacatgggtgtctctaattaagactaattggagaggcctctccaaatagatttaccgaaatgcaaacctttgtttgtacacgtgattagcaagaaccaaaccatgtttcaacctgtcacggttaacaaggccatctgaactgaaggcccaatacgtcagcgagggacggccttcttcttggctttacttcggcggcggtacagcccatgtgtatttctggggtttaggcccacagcccacttgaggccgtggatttttgctggacttcggcccattttgccgcctctcctttctcctccagcaagccacctgcacgcgcggcgttccggcggccacgctcgcgatcctcctcggttcctccgcctccgtcagcgacctcggaaggcggcggcgcgcgtcgtcgtgctgctctccgccgcgcgccacccggccttcccgcagctccggatcgcgtccccccagctgagcatggaagtgtgagtgctctctacttggcttcgattgggcttggaagtgtgggcggagagggctccgatctgatcgtgttcgatcgctgtggcagggtggcgtcggcgccggggaaggtgctcgtcgcgggaggctacctcgtgctggagcggcccaacgccggcctcgtcctcagcaccagcgcgcgcttctacgccatcgtccgcccgctccgcgacgagctcagccacgactcctgggcatgggtgagccccgagccccagatttctcgaacaaactttactagtagcatcgcggagaattgctccttactctgccgagcacctgtaccatactaggcgtggacggatgtgaaagtgacctctcctcagctctcccgggaggccacctacaagctctccctgaagaaatcaacgctccagttgacgtcttcaaggcaagtcattgatcatttgctgggattgtggcagcagcgctctggtctgtagttgttttcggaattcacttttggtgatagtgttaacaacttaatgttgcagggaatctgcaaacccttttgtggagcaggcagtgcaattctcggtagcagctgctaaagtgactgtcactgacaaagaggggaaggaggcactggacaagttgcttttgcaaggttttgcgattttagtctgaagttttgctcctgtgcaaatcatgtttttgtatactatgctatattttgatttcgtttagttgttaaattttcatctctatttttttttgtaggtttgcacattacaattttgggctgcaatgatttctattcttatagaaaacaggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 66394 - DNA, 877 bp, Oryza sativa
ggcggcggcggcgggcgttctccccacaaggatgcccagcggcggggaacaccgggggcttctccacggtggcgggtcacaggaggtggtggctggacggtcggcgcggcggattaggccacgccggttgcgaatccaccttcctcgacgccggatctagcctcgccacggccagatcgggtctaggcgaccccgacgatggcggccggaggaggcgcgacgtctcggctatgctgggggtggtcttcgagcggtggcaggcggcgaggctagccccagctcgtctcttccccctctagctcccagtggctaggacggcggaggaggggaggtggaaaggcgttggcgacggagtcccttcggacggcgcgctagtacaaaaaggctttttccatacgggcaaaaggcatctttgcatgcggttggggcaaccgcatgggagagaaggtctgtaaaaatcacccttttcgcatgcggccggcccaaccgcatgcgaaaatcccattttcgcatgcggctgcttataccagccgcatgcgaaaataaattcagcaaacaaaaaaaaataaaaatccaaaatatcctaaaccctagcccgccgccgcatggtgccggattcatcgcccccgccgcccgccgtcgtcgccggcaccggatccatcgctcacgccgcccgccatcgtcgccggcactagatccgtctcccccaccgcccgccgtcgtcgccggctccggatccgtcgcccccgccgcctgccgtcgtcgccggcaccggatcggccgcccccgccgcccttggcgctggatccgctcgaggcggcagagccgcccccgccgccgcggcggtgaggaggggggaggggcggtgaggagggga

SEQ ID NO: 66395 - DNA, 2470 bp, Oryza sativa
tttttaaaaagctaatacttaattaatcatacgctaatgagctgctttgttttgcgtgcaccaaggattagttcccaactgtgtctgccgaacacagccttagtgtgtatagaacaaacaccatatgttttgacaagtttccatagctaatattatttgatttattgcagagtaggggtgggcataaaaacaccgaaaaccgtagaccgaaccgaaccgagccgaattggtggtttcttcggtcttcggctgcttgcttgctcggtttgattttttacatcatttggtgtgcggttttttcttcagtcttcatctgccataaaccgaactaccgagaaaaccgatctgtgtgtgtctccctcctggcccaactacacaaggcccattaacttttccccatatccctaatttgtgcgtggggtcgtgtgggattcgtgtggtcgtgctgctcgccgtcgcggccgagtgcagcaggggttggcgactagcgctcctggagcttgtgctggacgattaagcagctttggtgattagtggttggacggtggaagatcagaggcatgtcgtcatcatcgagcgagctccatggctgcgtgtgcgtaggtcctcgttgagcgcggcattcttcggtaaaaaccgaaagctgataaacccgaactgacattaatcagttttggaaagctcagtttttatttttccatagctaccgtcggttagtattttacataaaccgagttatataaaaaacctaaaagaccgaccctattaaaccgaaaaaccgagtgcccacccctattgcagagtatgattgttaattgaactaaagccactgactgtttccgtgaatgatgcttgcccaatagaatgaaatgttttgtcacctcatattttgactagcattcttgagattcttctgatccacatccaagtaccaactgctggtttttatctgtaagggtttccatagatcttatttgttttgaactgcagatttcaagacttatttacacaaattctggtgtcgctatcttggctttagcttcaaatgctgttcatctgctctggaaatggcctcgcaatgaccgaaactcaagtggaaaggttaaatctggattatttacgcacataaatatgctcagttttacctacctgctctgtataccaggtccaggggcaagcaatttgtgcatatgattgttactaactttttatgtttgctattgactcttctaggctactgcaagtgtttctcctcaattatggcaacctccaagcggcatcctcatgactaatgacataactgacaaccctgaagaagctgtccattgctttgctttgtcaaagaatgattcatatgtcatgtctgcatctggaggaaaaatatctctgttcaacatgatgacttttaaggttagttacaagtttatttctattgtttgtctcttatgtagaaattgaactttaatcatatggtgactgcagacgatgacaacttttatgcctccgccgccggcggcaacgtttcttgctttccatcctcaagataacaacattatagcaattggaatggatgactcaaccatccaaatctacaatgttcgaattgatgaggtattagcacatctaatggcattgctatgcgttattcttataaaaaatggaacaagattcagatacaattttttttttgattctttgcacaggtcaaaagcaaacttcgagggcactctaagaaaattactggacttgctttttcaaatgtattaaatgtgttagtctcttctaggagctgatgcgcaggttatttactgaactatcaactcacaccatagagcaagccacttctgtttgtctttagctgtttatacttttcctccgttgtagatagtgtgtgtggagcacagatgggtgggataaattaaagagcagaatgttacagataccatcaagtcgtccatcatctataatcttagacacacgtgttcagttccatcaggatcaattgcactttcttgttgtgcatgagacccagattgccatatatgaaactacaaaattagaacccgtgaagcaggtaaattctctcttcacgtgcagttcaagttaactacaaaggctatttcattactcaccttaactttactttcagtggcctgtccgggagaactcttctccaataacgcatgccatgttctcctgcgatagtcaattgatttatgcaagctttctggatgccactgtttgcatatttaatgcatcgagtttgagactccaatgtcgaattcttccagcatcctatcttcctcagaatatcaggtattctacaaaaactcaacaggacacaatatatcctttatatattctaacttactggattaaattggtactcttgcttctgaaaacattttgtcttgctgttctcaatcaatctcattagtttagtcagtgcactagcatattatgctaagaa

SEQ ID NO: 66396 - DNA, 1033 bp, Oryza sativa
acttgatgagaccatacagatgagaaacaattcttctgtaaatatgaacttcattgaatgtctattgagtattgatctgaggtttaatgcctattgagtattcagcacaatttcgttagagaagccaacaacacaagattcactaatgtctttcaattttgagtaaatagcatactatcattttgcaacaacttaaatcatttcagtctagtaggtttgatgtatgaagagtatgcttgacttagtattacaagggcagtgcattcagtaatgctctctaaaccagtatatgaaagagtacgtacaatatttgaaattagaatatgcaactctctgtcatactatgcttaaaacattaaaaaaacaaaaaataaaatctttgatcagcagataatatatgtttcataaagaaagcatattatatgtcagcaactagcaattcttttgatgtagctgaaaaaatattgcaagaatttgaataaaaaattgtgacaagcagcaggtaggcagataaaataattatatgtagattgtccctaaaagtatgatcaggaaggaaccaaaattgaggtagcagatgaaatttatagggatgcgagtacatttgccaccacactgtgagtttagtgagcattcagatacatctaacatgttattcttatttgcactatcaatttagcttctatgcttatttgcagttaaattaaagcaaagtaagtaacaacatttataacatgtagtgtaggagatgttgtgccactcagcacaagaaacagcggtcatttcttagatgcaataatacccagaacatctttagaaacatggatgcaaccatataagaaaatttgaaacttgcataaatagacacttgatgaacaaagtagagagcttcaggattgaagatgagcttagaccttcagcctttgcaacttcatgctgaaaaaaaaaagacgaaaggtaaaaaaagacatatatgtcacctagagcagaaaacacacaaaaaaaactattagtttatcacacaatgaacaga

SEQ ID NO: 66397 - DNA, 2010 bp, Oryza sativa
tagtggttttggttttgagcattgtaggatctgtcgtttgtctagctcgtgtatagatgtgccccagtactcctttgcttttggctactgcccagcgggcaatatttgtcctcttccctatccccctccaaagcaagccaccctctccgccatagctggagcgcccgcaccgccgccgagggacctgagctcccgcgtcctcctagtagccggccagctctaccttgggcccaggcggccagccctggtgagatttgtgaatgtttagtctcgtccatggctagctccccggcgacggtcggcagcgcagcggcgacggccatggcgcagtctatcgggaggaggaatgaagcgaggggcagatccggcctccggatccgcaactccaatggccgcccgcccgccgctgttgattcgtccatcgcccgccgtcgccgccgccgatccgaacgccgctgtaaaagcgaaagagggaaatatagaggagggaggatgacatgtgggacctacatgtttgtgggtcccacaattatttttgggtgaatgactgggccctgcatatatttttttattttaatgccacataagcgccacgtcaatgccacgtgggacaaagaccggatcaacgctgccacgtgtgcaccacgtcagcgaaatcaccctccaaaaccaccaagggagtcaaattacaccggttttgtaagttcgggggttaagatttctggtattgtggttgaggaatacgatttagatttagtggtcagttgagggagtcaaagtgatcttattccatctagatttactagattcgggtgggctaatacgatgcagtaatgttgcgccctgaggtgcccgtccgaggcggtattgtactgtatacttcctccgtttcatcattctaatattttacacattcatattaatattaatgaatataaatagatatatatatgtctgaattcattaacattaatttaaatataaaaaatattaaaatgacttatattgtgaaacggagggactaagaattcgggccgtaagtttagaggacgcggagtaggcacagagtgcacagtatttccgacgcgtcgcgctcgcacggttttggagacgatggacgcgtcttgcattgccatcgatcggcatctcgccatcgagttaacagagaatctcttgcacaactttaaaaacggcctctcgcacgtacacaattctgtcgcggttaacagcgagcaaataagtaatcaggagcagcaattaacgggaacgctcttccggtgtccgttctcttcccatccacctgacctgatcgatacacgccaacaacaccgttttttcgacaaattggccctttataaaaacttattttgaaaatagtccctgccaaaaacttcaaccaaaactaggccgtcggttcagcgccattgaggttggcgctgaggtctaacgtctcagcgccaaaaacattggcgccgagatttttgttgagctggcattgaattttcacgtggcacggggttagcgtcaaatacctcggcgctgaccccatatacttgctaattaacaatttgatttgttctgtgtaccaaggtagtggtgccatggtttggttgcttgccttgtgtacacatggtcctacgttcgaatctcaccgatcgctagaaaagtcattttttttccctgttcttttttattctcttacttgtttgtattcttttttattctctcatttgtttgtattctttcaaaaataaatatgacactgattcaaatagaaagataagtatggcactgagtcaaatagaaagagggagcatacaccaagggaaattaaagacaaaatttgcatggcaagggaatcgaacccaggatgccatgcatgcaaaagctcaccaccaaccatcaggggcggatccagaaacaaaaagttggggggactcaacataccgagtacaccgatataaacatataatctcattattaaactatgctaaaatgctattataagac

SEQ ID NO: 66398 - DNA, 2706 bp, Oryza sativa
  unsure (1)..(2706): unsure at all n locations
attttaaaataagttttcttaaagggtcaatttgtcaaaattacagccaacaccacccaggaagacaaatactcctactcctactataaaatatatactacgcgcgtgcacgcactgggcgaatgaacgagtgaacagtcacccctgtcccctactaaccagcaccagctctcacaggttttggcccctgctgcatcatcacccatagatgcctacaaaatccatgaggctttattaggttaatccccccaaaaaagatagtattgaggaagaataattttacatacaatagacatgaaataaatcctcttaattcttttatgagagaaattaaccgaacaagatgcgacggggcggtcacatgtgtccttgccccttcacgatcctgttactccgtgtgtataggataaaaacactaatgtcaaactagctacaatggccatcagtttatcacagtgctttaagtcgagctggatgcttttttaacgtttttatcgagcgcgacagtgcaaacatatcgtcgtcgtcggttggttgattatactcacaaacttgtcgttaagagaaaggagaagcgacatggctagacgtgaccggcccatcatcgatctgatcgatcagatggttggttagctttacgtcgttgttttctagtctctccctctgatcgatccatgtatcgtcggtgcaaacggccatatggaggagtacctatggtaacgggtggcttatcatgtatataatgtggctcttatcctgtaaaatggctagtggcactgtgttagaaatagattgagatccaatgcagttgctattgccactgcacacaatttgagccttttatttcttgatccaatggttcaaattgcttgccacagtgaattctgaaatatatatatttttttcagaaaagcgctacagtacttgctacagtattgcggtgcatctggatcattcatttcaaatccagtggtgcttgtgtgactgcttaatttatagtcacagtagcaactgcacctgaaccaaatccgttagaaatccaacggggttgacatgtagtacaccctaaagcctagatccggggaacatctgtacgactgtacttacgtaccttaccagccaggggagctgtaagcctggagaaaatcatgacttcaactgcgagctggttgacttgttgtctcgccgacggccaatacggccaggattcatgtccgttcttctacgcataagcgtaggatatgcaactgtttgggtttgtttctaacagtaacatgatcatttcccgtataaattacaatacagaaaaaaatactaagaaaaagatcaaagaaaccacttaccactctctaccggctttatagataaagttcttttaccatattactcgctccgtcttatagtttactataagagattttgattatgcaattatgggatggaggtagtattagttatgctagtatatagttgaaatctaacgctctttattttgtaacaataaaataatttaaaattgcgcaccatgctattgagaataatttagtccataaacgatattttcttttcctatatgagtctctcgtcgattaatacaggaatgaaaaaggaacaattccggtaggcagtgatttctgtgactgaatggtttcgcaaatcatgattccggatacatgtcctagtaattagtccaagaccgctagcccgttcccactaaacctcgattcttcttttaatgtatatattaccattcagctggttccagacttgcaattatcttatacccgtagcactatctactctatcttgttgttggtgatttcagtcaattattcagctatgcgtttgtctaatgccctgcccatttgttttactccatggttagattgataagtcagtggacagtgggtcaccgaacatcaatcttaaaggaagatgttactagtactatatatacttgcaacggcaacatagacagagcgtctcaggatattaatctcatgctatttcaggcaccaaagacaatcagtctgcgcttgcaagttgctactaatataactagctctatcatntccataaaaaggccagggaccccaatatctctgatggagtcgatgtagttgatcacctggtataaggattatggatgtacagcctaccgtaagtggacttagacacgcaagatattagattgaagtgtattgatgaattgatctagcgcatactgacggcgactcgtacaccattatcggaagatacaaggagcaactgttcttttatgccaaatcacgacttcatgagcacccgtctgcttatcattcctactgctgccccgtgctaaaatataaaaaataatctaggttgaacataatattaaaaaagtattatgtatacatatttttagaaacgcagtataaacgcagaaacttttaacacgcacacactcacccctataaaagcacacacgtacatcccacccgtacgagcacatatgaaagactgggctggcatattatgagattcacgaagtcaccacggagcatctcgctgtctgtcggtgacatgggaccaggagtatcatgactagaggcttgaggcagacacaatcgcccacgtggcctggcaccctcggggggcgtcgggcccgagggtgatgtgttcgccctcctctttgtctccccgaggggtcgggccgcacccgcctcg

SEQ ID NO: 66399 - DNA, 3370 bp, Oryza sativa
tgaggagccccacgctccgtcatctggcgcgccaggtagggggctctgcgagtgatcttctgagctctcgcactcttgcgtgtgcgccaagcttttcctgttcagcccaatggccgaacaagcaaaggcgcacaacctctctccgagcgttagcggtgacgatgggaagtcaaacccacgccgtcgagctcgtactccatcgccccctccacgccaaagtcctaggagggaggaggtgctcgagagggtcgaaggatccgcgacttcgacatccacgggtgatggagaaggacggcgagacggggagcgtcgcctcctcgtctacggcgacggcagcacgccccagggtgcgctccaagctgcgggcgcgctcctacgtcacccgcccattgtccctgacccggagtctccagcccaacgttggctggacgacgtggccaacttggtcatgacggcacggcagcgcctaggtgctggtgggcggtcctccgccaccaagacctctggcgctgctaccaccggctccgtatcgtcaaggcggagggcgcggcgagcggcggctgttgctcgccattcggccgccactccttcgtcagcgcctccgacccaggaagatctgcgtggggggccggatgcccgcatcagtatcgagcgccggcgtaatggccgacgtgctgcccacgcaacggagggcgcctcctcgtccggagtgtcacatcaacacggacgcggggatcagccctccgtgcccccggttggtggtgtcggctgtagagcctttgtggcgagccttcggaacgtccgttggcccccaaggttccggcccaccatcgccgaaaaatatgacgggagcgtcaaccccgccgagtttctccaggtctacacgaccgggatcgaggccgccgggggtgacgatagggtcatggcgaatttctttcccatggccctgaagggacaggtacggggttggctaatgaacttgccacccgcgtccgtccactcttgggaggatttgtgccaacagttcaccatgaactttcaaggcacatatccgcgcccaggtgaagaagcggacttacatgcagtccagcgaagggatgatgagtcacttcgctcatacattcagcggttctgtcaagtccgcaacaccataccatgcatccctacacatgcggtgatctacgcgttcagggggggtgtgcggcacaaccgcatgctcgaaaagatcgcctccaaagagccccagactaccgcggagctttttcagctcgtggaccgagtggctcgtaaggaggaggcatggacctggaacccctccggttccggtgtggcagcttcggccgcccccggatccgctgctcagacagggcggcgtgacaggaggaggaagaagaggtcagcccataccgacgacgagggtcatctcctcgccgtcgagggcgcttcgcgggccacccgaaaggggaggcctgcgagcgacaaaaagaaggaagccgacgctccctgacctcggctacttggaagagcgaaggtggcgcgcggcccttcgagccgcgcgcaaccagcagagcctgcggcgctaccatcagcgccacgtccgggcccgataactctgcgtcgacgacctcgtcctacgccgtgtccaaacgcgtgctggactgagcaaactctcaccaatgtgggagggtccgtatcgagtgatcggcgtcccccggccgggctccgttcggctggccacgggcgatggcacagagctgcctaacccatggaacatcgaacaccttcgtcgcttctacccctagtgggggtcgggtgtcaggtcttgggctcgggccaaccccgcacccccccgggcgtgcagggttggccgggggcttatcttttttctcttccgtatttcaataaaagcattttcgatttcctaaaggctgtatctgtgctgttgtttccttttgaaggatcttgacttgaaataggtcactcgtgttcaatcctgccctcgggggctcgggtcagctaaaatcgccaaacggggcccagaaccgagccgtgccccgggacgtggtgaactccgggggggagggaatcggcaaaaacccacaatcgggtcacccataaccctcggtcaccacgctcccggcttggccagtctcgacatgtggatctccccaggcactagccttgacccgcgccgtttgaggctgggacctgggcacgagcccttgttcaagccaagacacagaaggaccgtggcacagaccatcctcgtctcatacacagaacaaatgaaattgacacaaaaatttcctctttatttgattgcagattaaatcagcctataacaagaaggaggcccgaaggcctcggaagaagaaggaaaagaagaaactatttaaagattggcgggggcctgggggctcactccgatgcacccgtgtcgccagcctcgtcgccactgtcggttttcccttgctgatgcgcgcgatttgcgaccgccgggattctgcccgaagagagagagagagcagggaggagaggcccccgagccgaacggcggcccaaggcccccgacggccggaactggctctccgcctgcttgtccgacggtgccaggcgcccccgacccccaggatggccccgaggccactgcgggaaggccgcgcctgtcgccctctgaccccgaggtcgtcggcacagaagccgagtgcgccccgcgtggcctctcggatggagagcgccctggacatgtggcccctgacgaagaagatcggccccacgcgaaaggtgcagcggcccgtctacttcgttagcgaggccctccgggacgccaagacccgataccctcaggcccagaagatgctttatgctatcctgatggcttcgaggaagttgcgccattatttccaggcgcatcgggtcacggtggttacgtcttatcccctcggccgaatcttgtataaccgagagggtactggacgggtggtgaaatgggcaatcgaactctctgaattcgatttgcgctttgaaccaagccacgcgatcaagagccaggccctcgccgactttgtggtggagtggaccccagctcccgagctcgtctccgtccccgaggccagctcgagcccatcgcagctgcctcacaccgccctctgggtgatgttgttcgacggcacctgtaggaaccggccccacctgtcaccaggccttagaagtggcgtcacgcccgaccgcttccctcggggagggcgatcgccctggcataacgccgggggctactgtcggtgacatgggaccgggagtatcatgactagaggcttgaggcagacacaatcgcccacgtggcctggcaccctctgggggcgtcgggccc

SEQ ID NO: 66400 - DNA, 1868 bp, Oryza sativa
gagcatctacgcgactccaggaatccgtttctagcgtcggattggacgggtcatcgccgaggaaggccggcgacgggcggctactaccgagcgcgggcggcgacggcggcgagcctactgcgagcggcggcgtggcttggggcggcgccaactagctactggggtactactcgagctgctactcaaagctaaggggaagagatggagcgaggagaaagaacggaggcacgccctaccgacacgagggcgcctgctgtgaccaggcgccgacggcccctcagtcatccctccggcctcagggcggggaacagcacgcctgcgagcgcctaaccacatttattgcggtttggctgagcgtgtcacgccgcatgtaacgcagtgcagtgcactagtttatccagtcagtgaccagtcacagaccggtcagatcgcgggttaggtggcgacaggcgatctgacacacgccttgccccatcccgtcaggacgagggcttctaggcgctcgtccccagctggagctagcgtgttacctcccagagatggcacgttagtcctagtcagatatatgccaggcttcatcctaaccattgcaggcaagatgttgtgtgaagaagggcgaacatgtagattgctaagctgacacgtggtggacaagaatgaccgacgtgactggtctgacaccggtcatgtcgtcagcagacagccacgattccacgtcgcacctgctcccggcgaaagtggaggtagttgtggcccgtctcatcagaaggtgactcggacggcaactatacaaatctcggtccatttatgaaaaggtggggtaagtccccacaaaaaaagagagaaatggtgcatgtggtatccccttaagatataaaaggaggaccttgcccactgagatggggattggatttttcggatggagaaggatcagagagggagagagtaagagctctctggttctccagctctttgtagcttcttcatacatagatccaccaaaacacaggagtagggtattacgcttctcagcggcccgaacctgtatacatcgcccgtgtcttgtgtgtttccattctcgcgaaccttccacatacagagagcttagaatctcaccctgagtccccggccgaaccggcaaaggggggcctgcgcggtctcccggtgaggagccccacgctccgtcactgtcatacgcacattcacccatatgaaaatacgtgtgtataacctacccttattagcatctcccaaagactgggccggcgtatcttcatatttacgaagtcaacattagatgcatcaatgtcgatgggtacgtcaactaccattaaaagaactagcaaggtggcccgcacagattgcgcggctagcatcattatattttctctcatataatagcatatatgttttctcattatattattcaaatatattaaaatgacaacataattttaaattttgcaataactttacaaaactactaatgtgtaatattcatattatattttatatacgtgttagttattaattatttttaatatcaaattttagttatttgtaattatatatattcttatatggactctagactcgtcttttaatattcctttcttttttaattccgaattttctgtaaattgtatttctatatagacactatgctcttcttccaatattatttatttttatttctgaattttcatattatattttatatacgtgttagttattaattatttttaatatcaaattttagttatttgtaaattatatatattcctttatggactttagactcgtcttttaatatttcttttttttaattccgaattttctgtaaactgtatttctatatagactctatg

SEQ ID NO: 66401 - DNA, 3824 bp, Oryza sativa
ttcctaaattttttagggtgaatccgaatcgtgttggcgacatgatcaaaattagacgcgaattgagcaatatgcatgctggagaactcctcttatagtcttattcccttttttttttgtcgccaagatgattagaggtgtagttaattacttaattatctttgttggttgctctacttttatcaccgtctactcccatcattccttcgccatataataggatgcaatcacttggcaagcttgtcaggtaggacaatgttcttataccagattccatatgaaccgggaaatcgggaacttccgtttggctctgttcagcaataacaggaagaaattagtactagcagcagtggtgtctcttgcaggtgcagtgtatcgataaggttttttttttttttttgttaatgtgatctggcccttgatactgtagttgtttatgtaaagttggtctcgtgttgttctctaacttctatgtgctgaggagcagctgttccttttcttgtctgcttatcttgtttcttaatttaaagacgcacaggttctttttttttaattccaatgatagttaaacgaaattgagttaatctatacgtaaacgtgcgtggatcaacaccttaacacgtttggtgatacataaccatacaaaaactgcacgagctgcagtattttccaatagggccacctaagcttcagactattaataacagcacctaagcttcagactattaataacagcacttacaataatgcaatactcttgaataagtcacagttgtgtgtatacgccttttgtaatcagaaggaaacaactctcacctaagtcgcccagggtcgtaaattaacacccgatagacctagacgattacataataagcatatcaattctgcaacccgtataataacagttattttggtaaaatagaagtatacttacttccttcgtcctataataaatttattttagctcatttcatttgtcccaaaatatttagagtggtcattgtattcgagtttatgaaagtagaaaatagttgtgtttgaagtagataaaatgaggaatggttatatattgggatttgataaagcagagatattttaggtttttagttttgtattggtatgtattaaatggatgacaaatgaatttactttagaacggaggtagtaaaaaagatgaacaatacttgatttgagtaccaccaccatgcacccaatgtagtatactctcctacttgtagctgttttcctgcgatcaggatcctctacaattgactgcaccatgcatttatcactgacatctctctatccgtctccccgtacctccacggttactctcactcatagtatcaggcaacttcgacatcaagcaagacatgaaccacatagtacaaaacattaattatagcaaaccaaatcattccggaatgcatcggtacggtagctattgcgtaccccgtaaatgcacacgatccccaattccccatcgagcagttgtcaaaaaaaaaaaagagaaaagaaaccaaggcctatttgatgagaaattagctagcttatcgtgaaattaaatttgtatgtcaccgtgcattcagctcgtcaatctcgtctgtacgccgccctgacgttgatcattgcctcagctcgttgacaacgaggaagtcattccatccatcaccgccgccgctcacaccggcacacgcgtgtgctagtctcacgatgcagtcccacaccgacgaccgggagaggcgcggacgagacggttctgttcagtttgtggaaatcttaaaaaaataataattatacaacctctatcttgggccatgtttgtttcagtttaaaattattgtaatctagattatagaactagattaccataagttagattataatctgtttgttagttgttagtcacccaataatctaaaataagcacctttagagtggcttaccagattatagtaacttggcttataaattataataatatatcataataagctatctggtttttcagcttactcctaataatccatattataataatcctaagctgtattaaacagggcctaatttacttttttagatttcttagaatctgtacgacaaactaaatgttagaagaaacttctgatagctgaagattataggagaacctatagccattagaagcttccaaacaagatctacgacgcgcagcgggatgtccacaccgccttcccccccacgctcccgatcgtggaagcagcggtgacaagaaaaatggcctgttcactttgatgccaaaaaaaccttaccaaattttggcattacaaaaattttggcatagttgccaaaattttagcaggattttctatatagctaccaaaatttggcagcaatctaaatatagccacttttttagcaactttaccaaaatttgataagtttgaaaatagcatcaaactaaataggccaaaagaatagcgtgcggccggctgcctgccctcgtgccaccaacggggacaggggatcggatcgtacgtgccgcctccccctctccagcctccgcgaccggccgcggcgccttcgctgccgtgcacgcaccgtgccgtgcttgccttgcctgcttggtcggcgcggcgcggccatatcccccgcgccgcccgcacgcacgcccgggccgcgcgactccaccgccgctcgcgtttgaccgtaaccgaaagcgccgcgcgcgagtcgtggacccggcggatcgggccaaagaggcttttctgggctcacggaccgccgctgcgccgatacactacacacactgtttgacccgaccccatatcctcctcttgtctccgccgcgaaaccgcctgccccgggggtggacgtggaccgagccttcggtacaccacagcagcaaaacggatcgtacgcgacacggggacacgcaggcgcaggtccgtctaatcctacctgaggttgcagccttcggctaaaaagctctactgtttccacaccaacaaagcagagcctacacgctgacatgtccattgcttctgctcccgacagatcatcctcgcggcttagctgtggaccgggtgcatgcaaggtaggtaccccgctccccagctgatgaactggcgtccacgtcgtcacctcacccagccaacggcagccatcattattaactcgccacttacgctgcctccgagatgattttcacttgaccacgcatctttaatccggattaatcacctccttccttcgcttttaattactttttgtatgtttaatcaccccgccgaaccccaggtgacgaccgcgcgcgcggcggccgcggctactcgtggacctggtgcacggcgcgggggtctacccgcggatctcgaggcagcggcggacggaggagattcctccacgtctcccgacctggtgcggagcgtccacgcgctggaggacaagcgggagcatttcttccatcggttacggcgcagcagcaagacacgatcaaaggagagagagagagagagaggaagacgacgacgacctttgttgttgtttccttctttctcttctcttctcctcatcctcctctttagcttcctctcgcgctcgccgtctctctctctctctctctatcgggcgcgcgcctttctgtgttggtcgtctctttcctcgcgtgctctgccgctgcgcaagaatcaaaaggcgccggccactagagagagtgtgtgtttgtgtgtgtgtggcttgagttgagagttgagagaccaatcgaccatcggctgtgatctcaaaagagagagaggggctaagcgaagtgggcagacttgggcggcaatccttgcgaatcatca

SEQ ID NO: 66402 - DNA, 5501 bp, Oryza sativa
tcgtgttctcgcgcgccgacgccctggagagcgagagctactgacttccgcctctgcgaggtcggcgcgcgcggcgtggatcggaggccggccgattcgagcccgccgaggtcgcgtcggtcgacggcgccacgtactgcgccgccgtggacggcgggccgatcatgggcagccccgccgccgccgcaatcacgcacgtgcttcacaacaagcacaagttcccgttcgtgcgcggcgtctaggacctcctcgtgctctccatcgggggatgctccgccggtggcacgggggccgcggccgacgccgacctccgacgcttgcgccgctggggtcccaaggattgggcgcgccccatcgcgcgcatcgccgccgacggcgccgccgacctcgtcgaccacgccgtggcgcgcgccttcgggcagtgccgctcgtccaactacctgcgcattcaggtgagcaaattctcccactgcattgcgcatttcgaacgaacgttccctcggattaaccctggtacaaattctccgccatgatcaggcgaaacgggagagcatgccgccgtgcgggccggacggggagtacgacccaaccccggcgaacgtgcacgcgctgctcgcggcggcggacgagatgctgaagcaccggaacgtggagtcggtgctgttcgaagggaggcgtgtcggcgagcagacgaacgcggagaggctggactgcttcgccgccgagctcgtcgccgagcatcgcagcaggggctcccgtattggccccaccgtggcgttcaagcaggcgccgcggaagcagccgccggcggcggcggtggcggcgatgggctgagccggtggccgcgtgcactgtggagtaaggacatgtaggccctctctttcttcttgctttcgctggaatcctgctgcattttttacgtggcagagtggcattgctccaagaagcattttgccaatgggaaattcgacttggagaaaatatgaaagaacatctgtgatatataatttcagcttcatttcaatttagcatagaattgtactagtatcatctttcttcagaatcatatgcttctttgttttctcttcacatactttgatgttggtgttcagtattaatcttctttggtaagtggatgcaacggcgatatctgatggtgatcttcagaagatcaattttcatgggtctacctaccaagtggtcagtggtgtggtgtactgaatatctgaatgcatttccagttcaaagtacttctcatttccagtactgaatatctgaatatctttgtcatttccactacctttgcttgatgactagatgacccatcaaccatgtcaactcttgcttctgctacttgcatatacttccatttgagcattcatcagttcctacagacatctggatgaacctacctaatacctgcaattatgtctgggaacctcttcttcttgttcatgaaaaaactaaacacggtcatgaacattaacgttcagcatttcagccatgttgctgcactgtattttcttcagaagcaaccctatgcaaacaaaaaagggaagacatatttcagatctttgtctgcgataagaaaaaggagagaactgtacatgcatgtcccatcgccatcctgatcctgatcacaacgtacaccgtgttgtttaaagcgtctaaagattcctccaagtacactaaatcaagtaacctttgtttttacagcaacaaacacacacaactcttcactcttcagctcttctcaaaccgtcggcagccacatagaaacaattaagcaaacctttcatgacaataatgagctttgtcactttgagctgtttcttcggcttagctcagttgcatagtcgcgctactgtttgtgcaacgccccattagctgacacgcgtggtcgctgtcactaagctctcgcagcacttgttgattgcaacgcccatgatctgattggaggccacatctcggctgttcttggatgttgtaatcatctttcttgtcgaagcaggtttggttctggttttggttttggttttgggtttggtttggtttggttttggtttggagatgaacacgtcgtgtttggagaccgtgatgggaatcgggcggtggctgccccatgattgctggttgttgggtttgggagtttgcagcatatttcgctgtccgaagagaggatcacatcaaacgccaagatgccggaatagggcgcccgtccgtaactttgtcaaccgacagagatcattagtgccactcggttgttagttgttacagcaccctgctactaaccctgaacctttgcccctccttttttttcagtcttcttatctcctcgttctgaattcatgtcaaaaacagataaaagaagagtgattcatcacagccgttaatacttaataggtatatatactcctagctagaatttgcgttcgacgtactgtctggaatgcaaggattggtcgtcaaaaactgcaacccggaaacgtcgtaccggtgcagatttgaggttgtggagacggaacagtggaggtttagtggtacaccgatcagtggcagtagtaattgaggttttgcacggtgtttggtgcaccgcctttgttggatcaggtcgtattttttggtgttatcgcccggaggcggcagcgggaggagcacggcatgctacgcgcggagctactaccgctcgcgaccgagcggggcatggcatcgctgttgctgtcgctgaacaccacgtcgcgatcacatctcctccctccgttgctcgtcccgaggggcggatctaacatgaagacgaaaaggctcaaaccctcattaccgcggaattatgaaaacagactctcctttaaaattctttttgccaaactaaaaggggttaaagttctactatttctttctgtatgcgtcagtgctcaccatcactttcgcgtcggcgtcaaggtgttacagcttgggtgaaatgcccgacacaacacaaccaacaaccacttcatgatccttcactatatagcgtctctgttattagctggatctgaaaaaatgctgaacttttttcggtttcgataacttttatttttaagaactagggctgggaagcaggtttcgataacttttgtcatattatatcattcttgttatgaaatgagggtttttattaggtgcgtttagttagtagcagccacatttttatcacggttgattcggacatcattcaccttttgagcttgtttagttccaaattttgattcggacatcattcaccttttgagcttgtttagttccaaatttttttttcaaacttttaactttttcatcacatcaaaactttactatacacataaattttcaacttttccatcacatcgttttaatttcaatcaaattttcaattttggcgtgaactaagggtgtgtttagttggggaaaatgaaattttttgtgtcacatcggacgtttgaccggatgtcggaaggggttttcagacacgaatgaaaaaactaatttcagaactcgcctgaaaaccgcgagactaatcttttgagactaattaagccgtcattagcacatgtgggttactgtagcacttatggctaatcacggactaattaggcttaaaagattcgtctcgcgatttcccccataactatgcaattagtttttctttttatctatatttaatgcttcatgcatgtgtctaaagatttgatgtgatgtttttgggaaaaaaatttggggaactaaacgggccctaaacacacccttcggctgtgtttagttcctgaaaaaagttagaagtttgaaaaaagttgaaagtttatatgtgtagaaaagttttagatgtgatgtaatgtgatgaaaagttggaagttgggggtagttagggtgaattaaacacggtctttgtagacttgtttgactgtacctctgtggctaaactttgaaatgatctgcagagttgtaccgatacggatatagtactagttttttttttcctactaaatataggcctgattctactccatatccaaatgccatagagtagcagtttagcacgttgtgccgcgtgggttccatttcgctatgctccatatatccataatatggttgtgtttggatccaaacttcagttcttttctatcacattaatctgttatacacacaactttgcagtcacatcatatccaatttcaaccaaaatttaaactttacgctgaactaaacgcagcctatatccacagaggcattctctccctcacggttaaacatgaactccaccgggtaaattcacctttgcttgagatttgacaggtcaaagtgcacgtttcagaaccgaccgtttggtcgttagtactggcacggataggttatctggttccccttaatctgcgccctgcttttcccaaatttttgtgctctctttgcatcgaaagacgagaaatgctgtcccagcaaacaatgacaattctttcccgcgacgtgcagagcacataacaaggggttctgtgggtttgtagccagtaggttagaaaaaggctcgtggcaatatattgtctagcttgatgcataatgtcgtcttaacggactaatgtttgggctccgtaaaacacagtataaattttacagaattttcatagaattttgtttaattcctccaagagcccttcaaaattgcacctagtatgttgtatgctgaaactttttttttcatggctcctggggcaattcaatttcaatccaatcaaattgctacaaaacttttaccacgtttatggggtcaatcaatccaaacttcaacatcttcatatatatgtaaaccatggggcctgaaaaaaaatgcaaaatgctcgtctggcttgtcatgcagaacagagaccaaaatttgcacaaggagctttccggtatttcactgggagcaaaagaagagcccataacttttttttttagataatagatttccattaatctagcctctatatccacgaaggatatatacagccaaaatgatacaaaagtacttaggctcacacctcaacaagaagaagaacacaaccaaaaaagaaaacaaaaccaaatgacctcggcacatcctgcttctctgcatcctgccatagtctcttgaaacggccagatttgactagtggaagtctaccagtcgccttcgcccctagtgcaccgtcgatgcaaacctccattggtgcaatcttcatcaatttcaggtgagctgacgtcacacgcagcttgttagcccactctcaatcgtcgtcatttgtcgtatagtcggaactagccaaccagacacaaaccgacgggatcgactttgacctcaccgaattcctagacatccactattcaaagtgctgccgctatgctccgccgcagcccctagggccgctggtgccgataggaaccgccgctgtcctggacgaccgcagcccctagggccaccggcgccgacgatagccgccgcagcccctagggctgctagcgccaatgggagacgc

SEQ ID NO: 66403 - DNA, 925 bp, Oryza sativa
gcatgcggctcacttaagcgcccgtatgggaaaatcgatttttccatacgggccacttaaggaggcatatacaaaaataaaatttaaaaaatttgaaactagtgtatctcactcatatgcactccaaattagatgattcttttttctaaatgtttctaaaatcatcctctatcatgttattgtgttcttactgctattattttggccattttttcttgtgactttattttatcaattaaaactttgaatttcaaaacttcaaataatattttgaagcagtaattgatttcagctgaaaaagtcatcaacaacaaagttgtataacacatcaagatatataacttttattttggtcatttttttcatccgacaaagatttttgtaagattgatcacaaaatgtacatctctcttatagttttataaactatatagtattttaaaatgttgtttgaagttgttataattttaaattcaaattcaaattgttcaaacaaagtcatatagaaaaatgaccaaaacaaaagttatagatcttgataagttatacaactttgttgatcacaacttttcaatttgaaatcatttattgattcaaaatattatttgaatttcttatattttaaaattcaaattttatatagctcaatcaaacttggatggagaaatgaccaaaagaaaattggtagatctcaatgatctctacaactttgtttttgacaaccttttcacattagttcatttaataccacaaaattagatttaatgttcatttttatctagaagtctgatttgcctcctctccctctccaccacttcaaaatttcagcaaccttatctccaaccttatcttctcttatctcctctccaccattacttctcctcaactccctctccccctctctttctctccccctcacacacag

SEQ ID NO: 66404 - DNA, 2808 bp, Oryza sativa
ggggggggggggggggggatctcaagcgtcaacaagtaaacttatgccaattgagattgtcaatccatcaacaatggtgtgacgttatcgtctgagagagtgccacgtgctggtgtcagcaatcaagttcacatagacgattgttctaagtttgatcaaacaacacgatgcataatttttttgtagaagtaaatacaagcacctcaccttagaacaaaacgacggcgattccgatgaacatttttacaacttggcgcgccaaaattgcccacctattttgaccaaaccaaccgtactatctccatcccataaaaacccaattctagatttgaatctggacacacactgaattaggtattttataggacggaggaagtacatcacagaacttaacgccggcatagaagtttgggccatgaccctgagatctcaagccatttccagcacataggacttgttcagattgtagccaaaataaatcttatcaaatttgtatttaccaagatttggccacgaactaaacgtagatatttttttagcaactttgccaaaaaaatggtatggttgaaaatggcatcaaagtgaacaggcccataatcagttgataattaccctaaccattccgtttctttcattttttttattgttttctgactatctcgttgcttaacacgtcgccgccttgcgattaaggctccttgcgagcgtgtttgcgaccggaaaattaattcgtactccagctcactggccaccagttttgtgaatctttacatgtcaattcctctgttttcgttgaaacgcaacgttcctctccgtcatgatcgcgaggcagccgtgaaagcttccccaggtgccggactgtaaaagcggaaaacttgctgctccagcagcagcagcagcagccactgctgcaattgttattcatccaaagtgggagtagagcagccagatcctgccactgcaatttttgtcctccacgatggacgaatcatcaatgaggagaattactgtaggtaatgggtggagtactccccccacctcgaaagtactagtactagagtaagaattttagcagaaattaaggttaaagttaaaattcaatgaaatccttatattttgttacaggtgggatggagaaatagactgagaaataaaatgatactccccttgtttctaaatgctacacacatggcataatatacacgttcatgacataacaaaaggtataagaaagccgcatatttatttgttcctagtattttaggttctgaatttctaggcctgatgaataactccattaatataacccccccccccccccccctaaaaatagaagcggcgtgcggtcatgtcaaacattgtctctctaagtttaaacttactgtatatatgggcttgcctatgatgtggaagtagtattgcgtcggaccaagtcatagtgtagcctcacgccatccgcacttcagtgttccactgtttcagtcgttcgtcgatcggatgagtgagtcaaaatgtatagtaggattgttctaagtagtcgattgagatacatactacatggtatccgtggcacactttcaaaaatatgatttccttaagaacttgctacatcagcatagtttagataaccttttctaggttatactccctccgtcctataaaaacaaatctaatactggatgtgatatattctaatactataatatattctaataatacgagtctggacatgctcctgttgagggagtatgtatttaatccatctatatgttcaattttattttatccataatctatccatcattcagtttgaaagtgacctaactttttttttgaagtactgcatcaaattatcttgattctcccagccgtggatgattaatttcaagatattgagttgatggacccggttgtcttcatacttccaaattgctaaagctatatttagtgcaaatgctttctatatatatatattttaaataaacaaaactgttttgaaaatttataacaattataccaccgtctcacccaaaatgggatggaaggagtagtacttaactaatcagctgctaacattctactccttcgtctcataaaaaaaactaatctaatatcagatgtaacacatcttaataccataaatttaaacaaaagattcgcagtattataatgtgttataatattggttactatgttggtttttatgtgatggtaggagtaaagtactgaactcagccgtactcacgccaactcctctctaaggctgtgtttagatctaaagtttggatccaaattcagtccttttccatcatatcaacctgtcatacacacacaacttttcgatcacatcatctccaatttcaaccaaaatacaaattttacgctgaactaaacacagcctaactccacctctcctgcgtcgaccgtacacaggactgtcccccgtgaacgtacggtcatctagcggatggccacatgaccacctgggcagcttcgcatttgctgcgtagtagtgcgtgtacgagggcgataaacagaacgcgacgcccaagtaccagtactaccactgcacgtactagtacgctgtaccacactggtcacatgtactgatccaaccagtgcagtgcagtgcagcagctgggctagctgcccccagctatggcgatccaccgaccatgtctctccctggcattcagccatgcatgccaaaacaccatccagtcctttgcatccctttccccagcgagagcgtctctgatctggctgccctgcccgccccagtgcgtgcgtgcgtgcaacgacgacccc

SEQ ID NO: 66405 - DNA, 717 bp, Oryza sativa
ggagcagcaatttactttctagttgtgaataaaaggtgataataagttcagacaaattgttgctacagcttaagctacttgcaaacatcttttttcacagcacgacagacagcaaaattaaatactaggactaactcttccctcacttaatacagataacagtgagacatataagcaacaaatgaactgctgttaagcttgtctttttattccgtccgttcatcgactaccccttggaaccagctctacggaagggaagctgtaagagtgaagtgcatcgtctgcataataaaagaggggtcaggctgaaaaaggtgaggtttggatatcagctaatgtcaaccaaaatgtgtgcatcctcaactaaagaaaaggagaacatatattattcttcatgcgtgcaaaaacacttctcaggaatccagtagatatttttgtggtaaattaatcaaactaatcatggagtggtaaatttatcacactaatcattgcaagtgatgcattatgattgttctatatatcatgtctcaacagagcagcgaatatgtgacttttgttgcttttgttaactttgtaagaaggcccggtgaattaacttgtaagaaggataccttggttagtgaatttgtaccgtgcaagtacaaaaaatgtaacacttcaaactcctcatcattatctttctggttgatcagaacttgatgctccattaggaggtgt

SEQ ID NO: 66406 - DNA, 909 bp, Oryza sativa
atgatcaccggaagcgttgcagggacctgctcccagttggtgttagctggcagggtcaggccggcaccgaatgctactgcagacacctcgatcgtcagcagtaatcctgcatcagtagacagatcacgatggtagttagtacttagtactagtgcgcaagacagatcacgttgatgacagcaagaacatgaggtgtatggatgtaatatggttatcagctacagtaggtttgctcttacttcagcacagtgcattgtgttgcaagtagtatggagctcccagtggggagagtgggtgtttgttcgtcattgtctctacactttcagaaatgagttactactccactacatgccatctttgaattccagttgggcgaaccagtgtttgttcatctctgttttcacaatttcagaaacgagttactgttccatatgctgctaccatctttaaagtcacattttctttttcttgcttaattagcttggagatgttcagacagcagaatttcttctgaaagaagacggctgcagatgccaaaatttgtcatttaagcgtattaatgcagatctaaacaatgtggtatttagtaccgttggctgttccaagtgttgatcacaacgatagcttaccaacctatcatgacgaaagtgagcagctggttcactttgtcggtgacgcccgtgccaccggcggcgatgaggagcgcaagggcggcggtgaaggcgcagccggagacgggctcgggaacgccggcgaccacgctggagagcacctcgccagacttggacgtgtaggcgaccatggaggtgtaggacaggaacaggtaggccgcggcggccaggttccctccccactcgcccagggtctcctgcgccatgctcttcagcgatatgacctccagctgcccgc

SEQ ID NO: 66407 - DNA, 895 bp, Oryza sativa
ctagaactgctgctactactttcatttttggcgatcagatatcctgtcagttccgtgccaaattcatggtcctgaatcctgatagatgggccatcactaattacttcaccgtacgttgtagactagtattagtagtataatctttcggtgtcatgtggaaaggtcaaggcaagagagggacctgtcaccggtccgagatatgaatatacttcctccgtttcacaatgtaagtcattctagcattatctatatttatatggatgttaatgaatctagataaatatatatgtttagattcattaatctagattcattaacatcaatataaatgcgagaaatgttagaatgacttacattgtgaaatggagggagtactacgatgagagggtgattgattccatcgattttttcgcgttgtcttcctctaaaatcatgcaccgtgttgatcacatgtcgaaatcggcgcaggcgatcgttcgttttagggattctgattgtgatgatgctagcaataggctcgtcaggtgtagggtagtacggcgactcaccgcgggcgccgtgcgctgtggcacggcgaggatgccggagccgatgctggtcccgaccacgagcgcggcggcgccaaccacgctcccccgcttcgcgccaccgcccgaagacggcgcctctgccacgcccgccgccacatctccctccccctgaggcggcggccgcgcgtcgccgccgcgcgctcccgccgctctcacctcggagacggcccgggccctctcgccggtggctgcactactgccgcaccactggacgccgccgccgcgatggactctcctttccggcaagcatgtcgtggtcgtcactgggatgcaccggtacggggcgcggtggaatcagctggcgg

SEQ ID NO: 66408 - DNA, 1587 bp, Oryza sativa
acttcgaaaatagagtaaactagcatggtggtccagtccgcgcagattgcgcggctagcatcattatattttctctcatataataacatatatgtttttttattatattattcaaatatattaaaatgacaacataattttaaattttgtaacaactttacaaaactactaatgtgtaatattcatattatattttatatacttgttagttattaattatttttaaaatcaaaatttagttatttgcaaattatatatattcttatatggactctagactcgtcttttaatatttcttttttaaaattccgaattttctgtaaattgtatttatgtatagactctatgctcttcttccaatattattttttttatttctgaatttttatattatattttatatacgtgttagttattaattatttttaatatcaaattttagttatttgtaaattatatatattcctatatggactctagactcgtcttttaattccgaattttctgtaaattgtatttctatatagactctatgcacttcttccaatattatttatttttatttctgaaattttattatttctaattgtatttccatgtggactctaaactcatttttcaatattctttaatttttaatttttaatttcagttacttctaaattgtattcctatatttgtattcctatattgaccttaaactcttcttcccgtgtttttcttaatattgaattttagttatttgtaaattgtatttttatacggactctaaactctacttttaattttattatgtttattccaaaatatagttagttttaaattcctatatgcactctataatctacttctaatatttcttatttttaattccgaatttctatttttttcttaattgtatttctatatggactctatactttacttctgatatttcttatttttaattccaaatgtctattatttcctaattgtatttctatattgcctctatactctacttctaatattctttatttttaattccgaatttcagttatttcctaactgtatttctatatggactgtatactctacttctaatattccttatttttaattccgaatttcagttatttcctaattatatttctatatggactctagtctcctcttctaatattccttatttttaaatatttcttatttttttttaattccaaatttcagctatttctaaattgtatttctatatggactctgctttttctttttctccgattaatgtgagaatttctaggccatgagagcgaatgcggagggtcctttttctattcctttaataatataatagattactgttcgtgctgtatattcttgccaaatatttttaggagtgttaatttaatagggggtaaaagagaaggttgagaaataggtaaacgggatgattcattagcgcatgattaattaagtattaattattataaatttgaaaaatatatcactatgattttcttaaagtaactttacatataatttttttccataaaacacatcatttagtacttgggaagtgtacgcatgaaaaagtcaaatctactcaca

SEQ ID NO: 66409 - DNA, 5562 bp, Oryza sativa
acaggcgcgtcaaggagctcgccgactccgggaggcgctgctgcagctgcggtccgagctgctcaaggtggagcccgcgccgccggagtcggaccagctggcgcgcgcgtggctgcggcgcgtgcaggaggcgcaggacgaggtcgcgtcgctcaaggcgcggcacgatggtggccagctctacgtgctccgcctcgtgcagtacttcgtctccacggcacccgtcgccgggtcggccgagaagcagctcaaggccgtccgcgcgctccgtgagcagggcgaggcgctgctcgaggccgcgctgtccacgccgcaggcgccgccgccgctgctccgccagccggaggagctggagctcccgccggggaccagtctcacgaggccctacctcaacgaggcgctccgcttcctcggcgactgcgacgccgcgctcggcgtctggggcgcggggggcgtgggcaagaccacggtgctcacgcacgtccgcgacgcgtgcggcctcgtcgcgccgttcgaccacgtcctgctcgtggcgacctccagggactgcacggtggcgaagctgcagagggaggtcgtgggcgtgctcggcctccgcgacgcgccgacggagcaggcgcaggccgccggcatcctgagcttcctcagggacaagagcttcctgctgctcctcgacggcgtgtgggagcgacttgacctggagagggtcggcatcccgcagccgctcggcatggtggccggccgggtgaggaaggtggtggtggcgtcgaggagcgaggcggtgtgcgccgacatgggatgccgcaagaagatcaagatggagtgcttgagcgaggaggatgcgtggaacctgttcgaggccaacgctcgcgaggagacgatccatcgccaccctcggattcctgcactttcaagacaggtaatcacttgatctgtctttgtttgaaatcagattggttcaaaacaagcgctacgtttagcattttcagttttccttcaaaaaatagatatcttccatccgttagatcatacaatggtacatgcttaagtttcagtctaggtttgatgctaactgtaaggatttatttcgattgagaaatgagatggtcaaattctcatgtctccgctaactgaatttccttgtatatttttttataaatggattttccgataaacattagctacctttttaaatcaggatcatctctgtgatttcctgttctttccagctactaccaaattgcaaatcacaaattgaatgctatcagattattatcacccaatggttatggtacaatactaccctttgcagaatggtcttgcagaagattttaaaatgtgttccgttttacacaaaggcaatcgaacaattctgtttctctattttccatgataatctttctgtttcttcaatccttttgcactggcttgttgcacgacttatcaacgtgttatgtacttatgtgccatcaagtttagttgatgtatttcatttacatttgatctgttccatcattgacaactgctaataaattcgttctacaactaaacaggttgcttcagagtgcaagggcttgcctttgtccctcgtcaccgtcggccgcgccatgtcgagcaagcgcacaccgaaggagtggggcgacgcgctcgacgccctgaagaagacgaagctctcgagcgcgcccggcccggacaagatcgctcaccctctagtgaaattctgctacgacaatctggagaacgacatggcgagggagtgcttcctggcctgcgcgctctggccggaggatcacaacatctccaaggacgagctcgtccagtgctggacagggctcggcctgctcccggagctcgccgacgtcgacgaggcgcaccggctcgcgcactcggtgatctccgtgctggaggcgtcgcggctggtggagcgcggggacaaccaccggtacaacatgttcccgtccgacacgcacgtcaggctccacgacgtcgtccgcgacgcggcgctccggttcgcgcctggcaagtggctggtccgcgccggcgccgggctgagggagccgccgcgggaggaggcgctgtggcgcgacgcgcggcgggtgtccctgatgcacaacggcatcgaggacgtgccggcgaagacggggggcgccctcgcggacgcgcagccggagacgctgatgctccagtgcaaccgtgccctgccgaagaggatgatccaggcgatccagcacttcacaaggctgacctaccttgacatggaggagaccggcatcgtcgacgcgttcccgatggagatctgctgcttggtcaacctggagtacctcaacctctccaagaacatgatcctgtcgctgccgatggagctgagcaacctgagccagctcaagtacctctacctgcgcgacaactactacatccagatcaccataccggccgggctgatctcacggctcgggaagctgcaggtgctcgaactgttcacccgcgagcatcgtctccatcgcggacgactacatcgcgccggtaattgatgatcttgagagcagcggcgcgcagctgacggcgctgggcctgtggctggacagcaccagggacgtggcgaggctcgcgaggctggcgcctggcgtgcgcgcccggtcgctccacctccgcaagctgcaggacggcacgcggtccctgccgctgctgtccgcgcagcacgcggcggagttcgtaggcgtgcaggagagcatcagggagatgaccatctactcctccgacgtcgaggagatcgtcgccgacgcacgcgcgccgaggctggaggtgatcaagttcgggttcctgacgaagctccgcaccgtggcgtggtcccacggggcggcgtccaacctccgggaggtggccatcggcgcgtgccacgccgtggcgcacctgacgtgggtgcagcacctcccgcacctggagtcgctcaacctcagcgggtgcaacggcatgacgacgctgctgggcggcgccgcggacggtggcagcgcggcgggtgagctggtgacgttcccgcggctgcgtctgctggcgctgctgggtctgcccaagctggaggccatccgcggcgacggcggggagtgcgcgttcccggagctccggcgcgtgcagacgaggggttgcccgcggctgaggcgcatcccgatgcggccggcggcgagcgggcagtgcaaggtgagggtggagtgcgacaagcactggtggggcgcgctgcagtgggcgagcgacgacgtcaagtcctacttcgcgcccgtgctgatctgaacaaaacaacgtcgtcgtcgctgcaatctcgccgcgccgtgccgcgcgtgcgtgcatccgattttccgatgcagaggttgaagttttggagacgtgctgatctgttagggaaggaacgtcgggggaaatttggtgactgttaatttggattatttttcattttcctttaaatttgggacggtttcttttgaacatcttgtgtttcgttgccaaaaggaaaactcaaccgctgaacattgcacttctttctttgttttgctcaaactatatcctatgctacaaacaagcaaacttgaatatctgatatgttcatactagttttgtgctcgaattcccgacgtgattataaggctgaattcctgacgtgattataaggctgagtttagttccaaactttttcttcaaacttttaacttttccatcacatcaaaacttttctatatataggcctggtttagtttccaactttttcatcgaactttcaacttttttatcacatcaaaacttttctacacataagcctggtttagatttcaactttttcttcaaactttcaacttttctatcacatcaaaactttcctgcacacataaactactaacttttctgtcgcatcattttaattttaatcaaattttcaattttgacgtgaactaaacacgcccatacaaatttccaacttttccgtcacatcgttccaatttcaatcaaacttttaattttggtgtgaactaaacacaccctaatacgtaggacatgctgatgtttactggggggcccttccggcctggggagtagcaggctgggttggctatgggccatggtttgggctgcacctggacattgcagctaaatggatcggttaattacctaagcagtcactaaaaagggctgattagagttttctttttttttatctcgttatatcttttttttcttgtgagaataaagctaaactcagttcgttcctttctcaaagtatgagatctgttatgtatgaaatctacgacctgtttggatgttttccagcttttgtcacgtggaaagcttttaaaagatctattgcacaccatgatgaattcattaccagctttgactggacaaacaaagatgtataaaagaaggagcgtatcctatgcacacaggctctcgcgtgtacacaccgtgtacaccaactaaaaattatcacaaaaaattctaggaaaattcatacatgtactttcaatagtattacatctacgtgcaaagtcgcatcttcaaattcattctacatagagaataacaaaaaagataaaattctgacaaaattgcaaccttaaaactgttagattttttgtttttttgttacggctaaaatataatgaatttgatgttaagattttaaccctatgtgtaatacaattgaaagtatgtgtatgattttttctagattttttggtgacattttttagttggtgtgcacgtgtgtacacgtgagggcctgtatgtatagaatatgttgccataaaaggaaggggtgtgatgtagatattgtctgtactcaactaaggagaggagaggaagaagaacagagatgttgagatgtggatctaaataaacatttactggtgcaaggagaaagcatccaaaacgccgcttgctaaatcataggatactttagtacgagtgtattatataagtaatcaggtaaatatgttgacatgaacataattgtagaaatacatgatcattttcatttgaagccaaaatatggcatatcaaattcttaatagtactttggctagtgtttggtttgctattaaaatgtgccattggactcaatcaaaatttacctatattttgacattgccaatatcttaacatggtagcgaagcaaacaaacctataatgccaatttttattgaatatatgtgataattgttttcactcgattcaattcagattcaagagacgatgagtggttaaaaacaaaccacaaatgaaacaaggagtaaagcaagggcttgtttggattgaagctaaattttgtccaaccaaaatcatggcaaatttaaccgtgtcacgtacgcctcactagttcaaattatatactagcacaaaaatttaccaggttttggcaaaacaagcctttaggttggttcagatccgtttgttctagcatggaaaacaagataatttattagcgtatgattaattaatcattactccctccattccataatacaaggcacaagtactttttagatttgttctataatatatggcatacatgcatac

SEQ ID NO: 66410 - DNA, 709 bp, Oryza sativa
caccaccactgaatcttcttccaagggtggtaatgcacactgtttcagagtttatcagagtttcagaagattcagagcaagggcaatcatggcaatatcagcttgagttgagagctccagttaaaccttccctatccaattccaactccctccctccctacacaagcaacaagagcagcacaccaacatccaagaacaagaagagcaagaagaggagaggagaggagttggaaggtagagagagacaagccatcattagccaccaaatgcaggcatgcatcatatagctgacaggacaagaatcagaggaagaagaagaggaggaggaggaggaggaggagacagctgctgccatgtcgtcgtatgaccagatgctcgcgccgcttcttggcgccggccggtcggcgtggacggcgcacgacggcggcggcggcggcggagaagccgtggtgaggcagatactcaagtgcacgaggtggcagctggaggagacgacggacttcgtcacctgcccgtaccactactactgcgacagctcgtacccgggcgactaccacgccgccgtcggcgtgctcgtcgccgcctttcgccgcgtactgcttcctctcgacgctcgcgttcacggtgctcgacctggcgaggagcggcggcggcggcggcggcgcgggcggggtgagggggatcaggaggaagtacctgctcccgtcgg

SEQ ID NO: 66411 - DNA, 1935 bp, Oryza sativa
gctgccttccttgtcactgctacgaacgtttgccgtcagttcatcataagcaatttgaatttgaattattaaagtttgattcaatgccgactagtagtctcctttggaatatggaatgcaggaatttcaaaacaacttttccccccgggcaatttggaaagatttttacataactgaactaaaatttttaaaatgtctgcagaattcatgcggtccagagaaacccgtacaattctacaagcccacaatccatttcctgattatctcaaaccagcagataactcacatttttccaaaaaatgaaaatcataacaatttttgtctaagtcacacattttcactcagcgaatagttttcaaactgcgaagtacaatatgcaaattatgtgtcaaactatctatatcttaatatctatactgctttaaatgatgctagtggtaatatctgagtttgtttctaacgccacaaactgatatgtaggaccataaggtctcacgtgaattttttttctttgcatatgacattatatgcttaatcaactaactatgatgtgaacttgtactttttgcttttaattgtatcttttcctagaaaaaaatacccgtgcattgcaacgggtgaaggctatcttaattttattattattatactgtttagttaatgtgacattcactgtagaaatttgattggatacttgttttacaagatcataatctataattaggagtccgatcgtttcaagttaagcatgcgagttttctttaagagatttcttatatgactccttctatatttctaaaagcaaatggatttaacaacttactcaaataaaactatgtaattccaaaagcgaataaacttaaaacccgactcaaacgcagatgacttacgaaagtactagtaaaaacatttttaatttttataataagcatagaagagatagagatataatatccgttgtagcgacctttaggtcgtgtacaaaaaattctcttaaatccggatagctgataaagagaaaaaagaaggaaaaaaatacaccagaggtcccttaacttgtcatcaagctacaaaatcatcccccaaccacaaaactggatatatggcatcacttaactcacgaaaccgttcagtttaggtccttcggtggttttgaccccagggttgtccgacgtggcggctaagtcagcgtggatcccacatgtcaggaaggccacatcatcgccctctctcctctttctttctcctcatctctcccttcctcggttcctcctctttctcactcttctccatggcggtggtggctgcgaggcgggaggagggcggcgccgcggcagtggatgatgccgggggggaggggggcgatgacgggggagaagggagggcgttggtgtcgatggcggcagcgacgcgggagaagggtagggcattgccgcgtgggcaaggtcgaggatggagaccccggcggcggcgaggtgaacgacctcatggcatcgcacaagcatggcggcggcccgacggagctctgctgctgccaaaaatgggcccgacaggcatgcatcggccgtcgtgggcgagcgctgggtggcggagctcaaggaagatgagggcgccgctgccaccgcctcctcgcccgccgctgcatcgtcgggcaccagatgtcctctctcgcctcgtagccgccgccgccgccttgtcgcccactgccgcttcgctgggtgccggatgtcctctcccgatttgcagccgccaccgcgtcgctgggcctcggatctcctctcccgcctcgcagccaccgccgccgccgcctcgtcgccaggcaccgcgtcgcccactaccggctctcctctcctgccttggcacgacgacctcctccccacccgccagcagccgtgcagagagaagcaaagtgacaaaagagaggggatgaaggga

SEQ ID NO: 66412 - DNA, 3373 bp, Oryza sativa
atgatcagtctgagctggtgcaaggggtagagcaggatatgctcgtcacagtcctgccacggatgaatgggctggtgcttttgcttgctgggcagcacaaaggattatgtgggcaccttgttgaaaagaattcagaggaggagaccggagtggtggagctgtccaatacaaaggacatgatacgagtgaaatacgaccagatcgcagaatatattggagacccagagtctcttgagtactagttcttcttattcttgaggagccagcattgtctaccaagagttcttctacgtgctaggtaattccgatttcttcttaatggtaaactatagagttgctgcttggacgtgaagttttgaacccgatttgatagttttgctttgcagtaacatatttatgtaagtctgctacatagtgatgaagtctctctgagaccccgagtaatgggtcatcttgttttcatgtctcctttgcgtttgtttctttctaaagccttaagtaaactgtcattggcattctagtaattagcaacttgcaataattgatgattctgatagccctgcaatgaagggttatatatcaatgttggaagcttcctgaacatcctagcttctttaaatcttttacattgctatgcgtgtgaggacaatccttatggttattactgagttgcataggctgtaggcatggcctgatctcactgttaaacttcaatatctgcaaactaagcttgtgaaaaacatttttgtatgcatcacattatattatacatttactgtacatttataattaggaattttgttgaatatcagcatacacaactcgcttgggactaaagtataatgttctgttgttgattttcctggacatcataatgtgtaaatccttggaagggaattcttctttcaaatatttgtagagcctttatggagcatactaaaatttgtggagttttcattaaggggtttttgatgatttgccactctttagattggagatttgatgatttaccatcttgacccacatgtcatgaactcagagggtcccaaatgtcattgtcatagggtgacaagtggcaaatctgattattaataggtattgcagcacttatatgagttaatataaaaacttgctcttattttgtgattatcttgtatgttagctattgattgccattggaacaccgtgggatccaaactttgtagatcataataccccatgtcggtcgcatacacatgtggagtgcttcacagccataccattatggtactaatttcacttcaaggacacgcatgaccacaatagttgggccacagtattatactcacctgcctattaggctgactctctttacacttattttaaaatgagcttctatcatgtgtgcatattatgaacaatggttgcttgtatcgatttgatgatgataaacatccacagacattaccctgtgatgccataatcccataaccacatcaacgggatctaattattgcaacacaacattaaactggtaaatgtggattatgtttatcatttctgatgatacagtgcattttgttgcacccatcatacagttcccatttgtggtgctcatcatacagttccctctttttattttgcgcccatcaaacaatctaaaaaaacattgtcctgtgattttcctcactaatccattaacacttcttacaccttctggttcttcatttgcatgctgacaagtaatggggttatttgtagaatcaacaatgagaaggtcaataaccttccatcaaatatgtcatgacccgaggccatgactagataaacaccgttgggaagatagtcgggcggtgtcggctcctgtagaagggatacagattttgtctagggagaagaacattgttgggagggatagattagactaattgatattcattgcttaattcataataaacacaaccccatccttatatagatggtaccaacttgacccctaagtaaggacttaatttatcttatctctaactaactaataataatatctctaacttaattgatctgggctgcctatgggcctctgccttccggcccaatgcccatgacaaatatgcataaacttttgactaagttcctttggaatatcttgaatgcaccctttcggtcagcagcttccagttatgttggcacatattactccatagtgcaaattggtttaagcccattatttcttattcactgatgcataaatgcctggattttactgtattactgctctagtaatatagaatataattggtgggcctaatttatgtttttaaaatggaggaatgcacatttccccgaagatgtccttgatggattgtaactttaaggtgttaatgagggttacataaacctgaaaacagagaagccaattgcttatggatgttgcaaaaaaggcaagtcttactccacatgtatgtttcatcttgcatttaacatgtgatgatgtccgcctgtttttctcttcttttggcatcagtaacttctgcttaaccataatcagcaacagctccatcaaacttaatctttttttctttggcaataatatcaatcttgatttttgcgaactatctcgtaaatgcatgcagttaaacctcctaactaatactccctctgtttcatattataagtcgttttgcctttttttttctagtcaaacttttttaggtttgaccaagtttatagaaaaaaaatagcaacatctacaagaccaaattagtttattataacattgaatatattctataatatgtttgtttgtggtgaaaatgttgccatatttttctatacactcggtcaaacttaaaaagtttgactaggaaaaaaaagtcaaaatgacttataatatgaaacagaggaagttctcttctttttttttctttttttttttgggtgaggaactaatagttcaaatttggtttccattgttatcatcctgaactcatacagatctatccaaaattccttaccacaaatagcaacaatttcataaaattttttttgttttggtaataccatcaaatcttgaatttgttaagtatctcataaatgcacagattaaacctttcaacagtccaaccattatctatacaaaactaaggccctctttgtttaggcttataagccaacttataagtcgaaaagtctaagccaaaacaaacaagcagctttttcatttggcttttttaagccataagccactctaacactattaagccaaaagctaggttggagaagcttttttttggcttatatgagatagatgtatgactctaccattaaacttaggacattaaatccactggcttataaatcatataagccaataagctgacttaaaagtctaggc

SEQ ID NO: 66413 - DNA, 11354 bp, Oryza sativa
ttttgtctctcccaatgccaatggcgggattttctcatttggctacccatctgtcagctctgtggcaaatcgcttcctcgccaatgctccaaacaacaccagtgtgagtagctcaacccaaagcgggagggatgtggaaatccgtgaactagaacgtgaagaaagagagttgaaagagcatctacaagcttccacagatcagaataagcttctgcgggaggcaatagcagcaagggatggagggcaattgatgcttctcctgcagagtgattgtagtgagttgggaccaaaaggtctggtgagaggaggaacaaaatattgaaggataatgccatgcgtgtccatgttttagcaaaaccataatttctatctggttgttagtgtgcacccttggcttggctctccctgtaatgttgcttgtagggtttgctccatgggaattctctatgattattttgccaaatgatgagaacaaatttatcataataatgttgtggttgtcatatttgcaaggactgagtgcgtagatctatatattaatattggtggtgttgtgtattttattttacttctagtgctcagttctctttagaccttgtttcttttaattccagctgctctaatctcttgtaattggtgaatttatattatttgtcctgcttgtgatgttatatctatctacttgtttgtatgtttgttgcatcaaatatagttttcatttcgtgggaacttataccattatctcattgtgatcattaaccatcagtttaatctttaaacgtcttgtctgtgcaacatttttgcttcatgtctctcgtaatctattatgttcatggtgaacttacctatccaatctttaaacccatgatgcatatgcaggtgaagctgaaagtagaagtgaacttaacatcatagcctatcgcaaagcggttgaaaactgacatgctttcagatgacacatgtaccattctgtcccatgggtttattgacaatcaactggattttatgtatttgaagtatgatgccctttctctgattcgcatatcaatggaaaaactcaaaaccgtctctagattttgcagatgacagttacgaagttctctgaattgcctcaatcatgtcttcatttctaatttgtagctcttcttcgttccacaaactcactgcttgtgcatgatatatgcaggtggcagttgtgcggttgtggttccgcaattctcttgttggcattgggcttgatcggttgtgctggctgctgcagcaaatactctttggtttggattggggctgactgactacagctgcgctgctgcagccagcacttccgatcaggctgattactttctgctaatatactgtgagataatttcctgtgcagaaatattactattttctacattgtactaaacaacacacggagacatacaaatcgtgctattttccagtttcgtaattccgtatgacaatggaacgatacagttaatgcacatgcccccttgacgagataaaattccacggaggtcgcgcaaggagaggtgcgtgtttgatctgctaatacgttggaggtcgagcaaggagaggttggaggtctaatgtgttggaggtcgagcaaggagaggtacgtgtttgatctgctaatgccttaccgtaaaactgtcgtagcacttctattttgatctaacgtgcgccatctttattttaacatgtagaacgttatctaattgaatgaatattctattttattccttgtgtttgtgagccatattttatttattttgatctaacgtgcgccacctttattttaacatgtagaacgttatctaattgactgcatattttattttggaatgtcagctgcatgtttgattgatgtacgatgatgtgaaattgttcatacgcatgtgtcgagatggataattagggggtgtaggtggtgttcgtaagaccaaggctgtggccacacagccttttagaatgcctatggcactgttgccgttggattgagatcccctgactagtattttcagctgtttgatttatagcgaacgaaagatcaatcgctacagtactgaaaaacagtagtatggtattaatgctattttcaaccttactaaattttggtaaagttgcaaaaaaagtggctatatttaatttgccgccaaattttggtaactatataagaaatcctgtcaaaattttggcaagttaccaaaattttatgccaaaattgctaaaatttggtaaggtttttcttttagcatcaaagtgaacataccataatttactgtttcaaactattgtcacaggaaacaactacaacatcactgtttttgcactgtggcgttagactcattttattgtgtctctggctttaacgcctaaagtcggaggatctggatctgttgtcgttgactatcgtaaccacaactcaagctgacgaagatagccttaatgggaaaatgtaatgtacagacctagtaagccccgtttggtagggctccaaactttaattctcaactctaaactctgaatccaatgagaaagaagtgggcatgaaaatgtttggctagattggttagctccacgccaccacgtcctttgttggcattttgtcgaacacttggtgttgtcgccggcgctactcagcctgcgcgtcgccgccgcccgccccgtagccaccacgtcctttgtagccacccgctcgccgtcggtcgccggtgtctaccgaggaagatggaggagagagaacgtgaggagatggggtaggaagggatagttcagtggcattttggtgtaaatactctccacagttaaagggtagtcggtcttttagggtggagtggagctatggagcaacaaaaacccagctccgtccctgtagtacaaatctgtggagcagctctactaacttcgctcaaaaaatgaacaatatataccgtttggcataactctagctctaggtaaattggaattgggagctgcagctatgtcaaacggggtcttgattccacattgattatgggtttacttatatatatgtagctgtggtcttttcatagggttgggaactaatcccgctaaccgtaaaaaaaaaagcgattcattagcgcataattaattaagtattactatttttttaaaaaatggattaatatgattttttataacaactttaatatagaaagtttttgcaacaaacacattatttaacaatttggaaaacgtgcacgcgaaaaaacagagtgggttgggaaaggaggggggagaacacagccgtagtattggcattatctgatagaaatccggcccctgtactgtacccatgaatacgattacatctttgctcaacagtcaacatcttcctaaacttgaaacttagggtgtgtttagtttaaaaaagaaaatttttttgtgtcacatcggatgtttgaccggatgttagaaggagttttcggacacgaatgaaaaaactaatttcttaactcgcctggaaaccgcgagacgaatttattaagcctaattagtccatcatcggttcctccacgaccttggctagcgagcggtgccctcttcccaaacttaggccggtgcgcgcacgaccttgcctgaggtgtgcttgctaagttgctatcgccgcatcgcgcggtacttaccccacaggtcagcgccctcatcatcacggcattacacatcgaggggagtagccatccatccggcactgcactgcagccactgccagtgttgggggaggagaagccgtggctcgagatctctctcccagcgccgcgccggcgctggccgtcgcacggctacacgctgccccctgcccccggtctcgcgtggcgcgtggcggcgtccgctctcccccgcgggccgtccgccgtcgcacccgcgcttcgtcacgcgaaacacaaggattctcccgtacgcgcgcggctcgtcgccggtggagtcgcggacggcaagaggcgcgacccgttcagtgcttcgcgtttccatatgccggaccggaccggcctgtggcccatatcttagcctgggctgaaaccgttgccgctgcattgcgcattagctcctagtacgtattttccactgatttattactacttccaattttttagagcgtttcaaggaatcgtttcctagagagccagttaaatgtacgtacgatcctggcgtccaaaaatacaatttatttttttatcagggaatcgatagatgtcaacgtcgattctatctgtgcagcataatagtacacttgtggttgggttgcagcatgcagactaatcattttgctatagctcactcaacgcacttatataaatataaatatacttgagtgaaaactaataatgttggcgatcagttagcatgcacttgctgattatcaactaatcgtccaattctgagagggccaaactgctggttgttaatgagggacaagcaaaccagctgcaactgaaaacttcagctcatacaagtttcagtaagagccaaagcctcccacaactacagtattaaaaattgatgcgtatagtttctgtatgaccaaactgatgatagctagtcataggttcattgcacatttcattgtatttgcactcaggctatacaaaattaccctgtctgttgttgaaaacaaaaactacataatatttgattgctccatgtgtgttcaaattacaacagtggatatcaaccaaatacatataatgcaagtgctataattgtataagaaatgcaattcagtcatatatatatagctgatttaccaaactgcagtaaattaattaacagcccagcgagctagatagaacatccaaccaacccacacaacgcagcacgtcctgctgctgttctatgcaaagacaagccccgttttctttataccaacttgcaacagtcccatgagaaatgattagtccaatgtcaattaggggaatctcttctcagatcatagtgtcctcatgcttaatgacaacagcagcgttagttaacctgcatgtagcgcttccctgagaggggagccgataaactacaatatcataatgcactctgaattatacggtagcgccccggccggcctcgtgcctaacggttcagaattagtttaactgattaatgctttgtattactgtgctcttgaacaaccagcatatacatggacggcggctccagcactgaattccagtgaccctctgaaacaatattttgccatttcccaaaaagtatgtactgcataatacagtaatttcagagaaccaaaagagtattcatatatgcagtcagttctgttacttcttatccatgtgaatcgtgatatctcatgtggttaagacgatttaataaagttataattaagtcatgtggtttttaagctagaagggagggtatgtatcaagcatcggcatcaggctaaaaaaggccaagcgaatatgctgctgctgccggcaaagacatttttggggttcagagaaaggggatgcaagaaaagtaagagggaaaaaaggggcagaatgagaatgttcatcctgtgcgttttttgttgctgaaacaaagtgcacgtcgtcacgccgagcaggccagtcccttcttgagcccggaataaagcttagtgtgttcctctttttgatcacccaaattcgcctttaaattcaaagtcttttaattccttatctctcccttgccgaacaatgcacagtgatctcggagtactgaactactgatgatcagatctaggctggccctaactattccccggatcgccaacatggtcacgttttggagcatctcgatcgatcgatcgatcgttctctctcccatgccattgccatccattcactcatgcaatgcatccgtggctagcttacgcacgcattaattcaccacgcacctgcagatggtgagctagctgctagctgactgctgatctgcctcgtccaagctgagataccacgaggaggacgagggcatacgttctcgcaataacctatatatatatatattaggtgagagataaatcaatgaatgatcatacattgattagtctctggtaaagaaacaaataataatagtctgtgttgctccatctttctctgctcgatgctatagaaaaaaaagaattatttgattaattaattacaaaataaatatttgattaattaaggcgacgtcaatgagagggtcgtatgattagcagcacgccgtagggaagacttgagaaaaatagtactaacgaaaaccggggaggtggtgtggtgtgaggggtttcgcatcggcgcatgtgacgcgtcgccggccgtgtctcgtgcctgccgatccatcgatccatccatgggagctagcgatcgatccgctgcccgaagctggcctggccggcacggcggttgaatctgccccgctctcgattattgcgtttgagggtgtgggtgatgcatcgtgctcggcaggcaggctgcagcatcctcctgcattggtggaattcgatgtgtgtgtgaatggatgtacctgttgaagtgtaggcgtatgcatgcatgcatgcatgcaccagcaattcttcagagtttgcatgtattcgtgctacatatgcatgggaggtatatacctgcaggctgcaggctgtattttaagtgttccaatgagcagagatttccaaacaagtgtgaacagttgtgattggtttgttattacatcttccccttgttcacattggtgcaccgacgacgactgttctctgaacatggtcagccgtggcgcatctggcgcagttcttgtcagtcccggctccaacagaccaacaggacgattcacagcccttcaacaacgtactgttaaacagtactactacttgtttttcttttccccgccggatcggttaacagtagtacgagtgcaaaatccctttctcttcagggattgcgaataatttgcgatgccaagttgacaactcgtcgcctcctctgatacgacgatgcactcagcctgacgacgtttccactgaccattgcgatcgagctcaactgactcgcatgaaccttcttcagctagccgagcatggcatgcctctcttcaggcgaggcgagcgaaaaggaaagaggaggagtgcatcgtcgcatggaagtgcgggaaagcgcatcagcggacggaacaacgcccagctgctgcaaaggcgcgcgcctcccctgcagtaaacaatccccttttgagccttttcctctgccttttctgaaccctccctttgttactatctgcctctccacttaattgctttggctaaaatcagtacatatgcagctgcctttgcaaaaagctcactagtattgcttgctctcgcactcgcatcgcacccagcacacagcagcaagcaaatcggcatggcaagtggcacggcggcgctgcatgccaaacgagcgcactgtgcgctgatgcacacagcggcatctctcaaatctcacggcggcgtggcgcgcggcctggctccgcgatccgtgtgcgtccggggcgcacgctacgtgttcgatctacctgctaccgactcgcaatggcaaagctcgatcgatcggtggatctctctgatgatcggtggatctcgctgctatgtattcgttttttacttttgcagttttttcgtttctttcttttcttccctgtcgccagacaatgatcgtttggtcaattgtgttgtctaagaactcacagctttcttttagtatattgacgtgcaattattttacgtggaaaaaatctgatcacctcgagaggctgaaaattaaaagggcgcggcacgagcatggcgctgtgggatatggcggatataaatgcgggacttgtggatgcaggcatacgttcatgcacgagcagttgccgtccccaatgattggataagaatatgtaagatcgatgcatcatgcatgcacatcatgtaacaggagaggagccagcgattggaggagtttgatgaagtgtgtgtattatatgtagcttctgggttcggaccagcatcggtattcatcagtatggggtgttgtttcatctcgatcggtcgaggtgaggatttgtcagttgtcagttgtcacacacgtaaatattgctacattcgtctcaaaatataacaatatatagtatgagatgtgatgcatcgattttaatatgacgaattaaacataagatctatctagatttatagcactaacatgcgtattattccataccatattgttatattttagaatgagtagcttcagagttactggctccggcgttttctgcctcgaatgctccctgctacggccattgtgagcaggtgacaggagatgggcaacatgctacatatcagaagtcctgctattaatttgtgaaattctggccaatgatctactgtgtttgtaaatttatgtttagacttctgagtgcaagaagggatttacttaggagttaataatataatttgaacataattaatgcagaactctttcaattgaggtgataatgtagcctagccagctaagcaagaccaaatgttcgattgggaaatgttggagaaagaaattaatggttgaatcccacgtttctgttcattgcattgttcaagagaaaataataattctctttcaaaatcaaaaacaaaagagaaaagaatcataagattctaaaggaacgtaacaacgcacagagctaatctgtcagaactggaactagtactctaatttaatttccacatagaatcttatgtttataagatgaaagggcaaagcattgtgtgcccctgttttctgaagtctccgataaaaatctgaaacgaaatcaagctcaaccactcattcagcagagttcattacaaataagctaattgagaccattagaaggaatcgagtagttgactgaaacaagggatgaagtttctccatatatgaacatggatcaaaccatgtcaacgcagtgacatacatcgcctcgatctttgtacaaagcgcctcctcacaactcataatccacaccacacactatacaaaagtaacaaattaatcctagctaattaaacaaaaaccttgcaaacgaaacccaaaagggaagcaaatctcacaaaaagggtgcaaatttatagcttgactttgttcgtctttgccttcttggatcggctgtcttgactccagctcatcagtttgcggaaaaccccctgcctttcctcgtaattcgatttcctcccgaagctgctgcgcttcttgcctcccatgctgttccagctccccagcttcgccttcttgtcgccggcgccggcggccgccgagtccttgtcgggcaccaccggcggcgccacgcaccgtatgagcgcccagtccacgccggcgaagaacgggtgcctcttgatctcggcggcgccgcgcgcggagcccatgcgccgccgcgggtccctctcgagcagcctgccgatgaggtcgcgcagctgcgcggcgtcggcctcgccgtcgagctgcgggtacgtgacctgcttggcgaggatgttcttgagcgtggcgtccttggcgtgccccttgaacggcgtgcgaccgtacacgagctcgtagaggaagacgccgaaggcccaccagtcgacgccgttgccgtggccgctcccgctcacgagctccggcgcgaggtactcgtgcgtgcccacacagtcctttgagttcgccgtcgtcggctcggcgacgaactcgaactgttccttcgcgttaacctcgtcgccgtcgtcgccgctgccgccattggcggagaagcaggacggcacgattctattcttgcgccggctcagtttccgaacctggcggcggcggacggcgggctccacggacgccgggagcgcgaggtcgaagtcagagagcacgacgtggccgtcgccgcggagcaggacgttctccggcttgaggtcgcggtacacgaagccgagcgcgtgcaggtactcgagcgcgaggagcacctctgcggcgtagaacctcgccgcggcgacgggcaggcgtcccccggggcggcgccggagcaccgcgtggaggtcgccaccggagcagtagtccatgaggaagcacgcgtagcggccggcgtcgaggcgcgcgtagagggtgggcacgaaggggtggtcgagcgaggagaggacgcgggactccgccagcacgtgggtgacacgtgacgggtcgtcgtcgcggaggtcgacgaccttgagcgcgaagagcggggaggcgggcggcgagctcttgaggcggcacaggaacacccgcgcgaggtggccgtggcccagctcgcggatgaggtggaggtgcgcgaggcggaggacgccgtcgggcgtggcggcccgcgcggccgcgaggagcgcccagtgcggggacgaggaggacgagtgcggccgcggggagagcgaggtggaggacgagaaggatcggcagggagatgcgagcttccgcgcgctgaaggtggtggcggtggtgaaggaggaggtggaggcggaggcggtggaggtgaaggacaggtccagcgcgccggcgccggcgtcggcgagggagggagggaagtggggcaaaatgtcggaggagagcggggacggcggggcgtggtcgagtacgtccattggcggcggcggcggcggcgctgcttgcatggcacggcgagagggaagatgaaggaaggagaggaatggaaagcctgggtgggacgcggggtgggggtggggttataaagacgtcgtggagagagatgcgggcggaagcggagaaggaagcgggagatcaacggtcgcgactagggtcagattccatatggtttctgtaatcaatggactgatcagatttgctacaggtgattttctgaaatctcagccacctgatcagggcaatccaacggtcagatttccttcgtcagactcaccttgggtgggtgaagagggagaaaggcagtggggacacatcgggtgtgtggttcgcagccaaacattggcacgtctaacacagaaaaggagattagtacatgattaattaattattagtttaaaaatttaaaaatagattaatatgatttttaaagtaacttttctatagaaaatttttacaaatcacacaccgttttgcagtttaggaagtatgtagtaaacgagagattgggggttaggaacttgaaatgaagaatgcagcccctaaaacacttgaaattgttatctttactaaggaaccatacacaccgtagcgcccgttccgtcgtggcgcctagtgggaaaactatctcttaaaaacctaaatgcaaaaattgtttctttatttgttgtccagtgtccgcgccattccagatctcaaatccccaatccatcgtcgaatccaaagccctatctcaaa

SEQ ID NO: 66414 - DNA, 3014 bp, Oryza sativa
  unsure (1)..(3014): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatattcctaaaatttggtgacactaataagaattcaacagggtcaagacgtaagcactgcccaaacaacctctggtgggttcaattgagcacaggcagctttgcatcagcaggagaattggttctaacatgcatggtgcagggacaactgattctacgaaaagccaggagtaggaacaatcattaccaaagctagtactcacgtccagcgcaactacatatattaaggcaaataataacaccacagaaaggcaaaaggattacattatattagattaaacctaagatgttgtcatgtatttgcgagaaacagtaagctcttaaaattactaaatatgcccaaaaaaaagggaagcaaatgttaactagagataacaataacctgataacaagccatactgtctgggtgacgccgcgagatacaaatacagttgaccataaatattaaggaagcagatacagtatgaggaagtactctcagagttccaattttctatcatacggtacgcaatctaatggagactgaatatcgattattgcatcatccctttcacgatttcaaaccatgagatgccgaaccctacgaagaagccaccggcggagatatcagcgcaatatagaagcgttacgccgcagagtttgaacgctcgtataaacgtaggttccgcaagcacctcaaaaccagactcgcgcgacttaacgcctaccacgaggcccgccagctgacctcggaccaggaaagcgtgagaactgcagccgcaaatgggctgaatcacgatcgtgttcgtcaaacttataacctgcaaaacgaatcgtgttggtttatgttttttccaatcgtcgtgtgagcaagagtacgaacctcaaacgcgcattccgtgcaatgaaggatacgcatggaaagaccaaacataaacaggaataggacatcaagctaagtttaaatcgtgcagtatcctatagtgagctcattcttagcagcaaactataaaatgtcacctctagaagacacaaagcgcatcaaaacgtatgtactatgttggcattctgcagtgggaaaattgtagatatttcccaattgatagccaacttaatgctaccttgaagtagaaagtttaactaaataagaaagcaatactatgaccagtttccaagaagcgaggttagagaaaaagaggaatgcacacatatacgtgacagatgcatgttttcaaagtgaagagtcatattatctgtaaaacaacacaatccatatctacaaatataagtatgttcaccttgcaatgcttcaagagcaagagtagcttgcgcagggttatcaaaatcaacaaagcacaagacatgaggatctcctccaggctgcagaaaattagacagttaaaaagagatatagtgagagcacagaatttcatagcaaaagcatattaagcatacgtgtcttgactccttgttgacaagtctgacttcacgaaaacctacaaaagggcgaaatatatctgcagagcgaaaaggtcaaggagcaaaagcatatacctattgatagccaaaaaagaaatatgccaatacaccaactcatagagctattaaggaaaaaagaaattagaatatcaaacaaaacaaagttgagttgttaagggaacgaaatttagagtagaatacaagtacaattatacaaggatacgtgacacctcccttcgtgtgcagtttgcaggcaggccttcaacgtacagagtgcttgatgcatctgctgggagaggaggctcgggccttgcaccatagcccatacctctgctgtccatgccaacaccaatcatccgacgatcatcaacaggatagcctcccattccacccattccacccataccaccaacaactggcctattggtttcagtggcagcaacagaaggcatctgcaagcatagcatgcagactaaaagttaaggaactatcaactttaaaataatgcgtatatttatacagaggaacttgaagttgtaccccattacgcaagtagcgatcataggatgctccgatagcctcattctctctcagtgcatggtaacctgtcctgtcagtctcacgtggataataaccagtcatgtcttgtcctgcaggcacatctgcaaagtaataatattaagtttaaaagacgattccaactatctcatataattgatacaatcaatacaatggtaagttcaagatccttcaatagataaattgatgagaaaaggaggaaacgatattatagtaacaaggaaaaggatatgatgacataaattatgccaccaaccacaactaccaataaaacaacatgcagtaacttagatactgaaggatctatacccaacagaatctattgaaggatctacaccctgtcagaagatagcatagaatctacacccaacagaatataaacatctgcaacttatatatgctttgtgtaaatcatttcccataaagggagcagcaggaattcttcccaaggctccaaagacaatgaaactagtgactcccaaccggagctccttagtcaagaccataaaaaataattctaaacaggcacatattgtgttacagggctgtaacactgcatggaagatagtgcaataagcatagttagaaacttatcagtacaccttcacccctttgaaagttccgggaagattgaaactcacaaataataaa

SEQ ID NO: 66415 - DNA, 25493 bp, Oryza sativa
  unsure (1)..(25493): unsure at all n locations
actggctaaatcaaataatcatactgcagcattagatcctatattgcaagctttacgagacctaaaagcgagggtaaacatactgactgttacatacaacgaacaaagttcgtatagaaatttcttgtagatctcgtggcgaaactaagggtaaaaacaacgtgaaatttcaactagatcttcgtcaataatttcataaatcatggcacgcaagcaatatcggggagcaaaacaaccaccaaaacgaggatatagcctaaccccctagtacagatccagatctaagatggcgtagagcgcgagcaacggacgaacctccgtagtcggggcgcgcgcgcttgagcggcggcgcggcggcggcctgctgcgccatggcggcctgcgggggcatgcccgccgcggcctggccggccgtcgcgacagtcgccgccgtgggggccatccccgccgcggcggccgccgccgccaccatggcctgctgctgccgcgcgtcggcgaacctccagtagttctcggcggccatcgctgcctccctctcctccgcctcctatccccctaggtcgtggatctcgcctcgcggcttggtgagcttgacggcggcggcggcggcgcgcggctagggtttcgcgaacacgacacggggaggagtctggttcgggcaagaagatgagatctcgagagagagaattgatggggaaaagaaggcgaaagcgttggaagggaatacgtattaggacagggtttccctcgcaaaaatgccaccgcaactcgtgctcgcgtcgatctgggccgcggaattccgatcgtacggctgagggagtcggccaaaataggtggagggttccaaagggtaaaagcgtactactgcagggggtttaacgtaaaacaacaagcgctacctactaccacgatctgggccgtggaatcctgatcggttggcttgtgaggaccaaattaaggattgctaccaatggtaaccacactattgggccttcacaccctgaaagtttatatgggccgaactggagcccggtccccgttaggtgggcctattcggccttagatgtgcccatttcggccggatgagacgttactctacaatccatgggccttttagagatgatttgtggccgtacagtgtgtgggcttctgtctaattatcgtgtcagtcacttcgcttatagatatgcttatcatgcaaatgctaaaaaaataaatctttatctttatcttttatttatactattataaaattgaatatgtttttgctagtactctggtacgttatccttgtttgagtcggtttttaatgttgttcgcttttggaaatatggattcgtgtttgagtcggtttttatgtttgttcacttttgaaagtataaaaggagtcgtataagaaatatctttaagaaaactcacatgctaacttgagacgaaagttggactcctaattgcagctcataattttctaaaaaaagattaagcgaatttctagtgtaaattttatcttagctaaactgtataacaataataagattaaaatagccttcacccattgcaacgcacgggtattttttatagttaaaaattaaattttggtttataggtataaatataaacgaagcgatgggatttaaaaaattaacttgttgcaaaccggagttggtgaatcgtccttttgcaactttggtcatttggtgcatgagcgcctcgttttacttgctcctctttatgcttacatcctacctaatagctatcatgatgaatttgttgaatgccttagaacagaggaacaggaggttcccatgtcaagcaaaagggaatgctttaggcagatcatggagataaagactctatagaagcagcacacgtgaacgattcttgcgtaagtactccgccataatttctgacgaagatcggtttactaataggaacggacctttgtagggtaagtgtgcgtgtagatataagtgctcgcgtccatactacttcctctgtcttaaaaatataagtattttttatagacacgagtatattaataaaatatgtagaaatgattggataaggattgtgattggtggagaagataaagtatgtcaagacaacaacagttgtaaatgtgatctggacataagcatccactcaaaatcccttatatttttgggacggatggattagtatttatcaaaaatagaaaagaaaaacagcaagtaattagtaaggatcagctaaaaagatcaagaaaagcaatagtacgtgattagtaaagatttgctcattaaaaaaaagtataggtacgattacggtgaagaagcggagaaggtgattataaaaaagaagaagaaaggggcgcatcaccttcacgttccgagatgtggcacgaatcccgaggactgcagcccgagatcgggcgcgtgtcccgaggcagcatcggcgccatcaaccaacaacaaagatagtactagtataacaactaatcccaactcgcggagcagcgagatgagatgacactcttcttcacttgctgaacctgatagcgacattattcttcctctcaccttgccccttcacactcgtcactcgctccaaccagccgcctgagctctctcgccgtacgtcggcgctccatcggccggaattatcggcggcgatggggctgctgtcgcaccgcgtggagcggtcggagatgaagcccggcgaccacatctacacatggcgcgccgcctacacctactcccaccacggtacgtccctctgtcgatcgccggcgccattgccatttgccgacgctcccgtttcaattcgctcgccttccaaacccatctgaattatgcgagtttttttccggcaatctagccatatcccgtgcgacctcaatcgccggcgccattgccatgtgcttgcgcttccgtttcgccctccgaaccatgtgaattacgccgagtttttctttctggcaatctagttaattagcttccgagcaggcaagcattttcagtttccaggggttatgagatcagaattcccttgctcttcttctatactctgtagatgctgctgctgctgtgatacttccagcaaaatttttcagtgaatcgctgctgcaaattatttgctaggccggcattgtaacctgcactttccagttcagtgatcatcgatcgcatctgcagtcatcggagctgaatttttcgtgctaaagctgcgcaatgttatctccggtatgctgcttcactaatggatgattcgcactcctgccgcaaccaaatgttggttttacaaacatggttaggatatgatttaattacggttatatctaaccatatatattatccaagccccagttggctaattatttaattgatgactatttattactatctgctagatacccaataccaatccttgttaaccaccattcagtaagctgtgatcaaaggtgcctgcttttcttttaccatcactttgttaccaacacgcatcagcttcttccagctgcgttgccttacactctttttactttgcatctctcacttttacatgctccattgatttaatctctttattacttcaccgacgaacgacctttgatctctgcgattggaagaagcgtaaaggggctcgcctgtgtcgccgcttgctgctaccttccttcctggacggcatggggccggcgttctcgccatgagatttgcaggtgtttttgcttccgatcattggcatatgtagggcagcatcgacatggtggtggttgggtttctccacatgactgcctgcatccaaaagatgcggtgtgtttgcgagctacgatcgagtactgtgtctagtctgtcatttacaccttttgcaccccctccagcaatctctctggcctgtaaaatcttcgggtcagatcgatcaaaagaaaatcttaacttcagtaattgtcgcatgattaccatgctaactaagagtaattttattgtcggtactataggtatcacatcttctaaggtgaattttgatactacctctctcaataccttaggtatgactgaaagaaaatcttaacttcagtaaggaaaagtctatacatactaaattctgtctaactaaacacttattactaaaattgcgtgtcacattattttttttccgaatgtgtaaaagtcttgcacgccaaaatagtacatctagatttcttataacttccatctacttaaatcaaacggttgattacaacttaccattactgctttagttaaccgttagtatattacagaggattaaaacaacaaaaaaattctccttggagatcatgttgtgaacttgggtgttgcaatattcagggatttacgttggagggagcaaggtggtgcatttcacgaggaagaaggaggcagggacggcaggtctggactcggcgatcgccatctccagcctcctctcgcagggctcgccggagtgccccaccttcccggactgcggcttccagctcccggacagcggcgtcgtcctcacctgcgtcgactgcttcctccgcggcggctccctccacggcttcgagtacggcgtcccgccggcggtgttcctcgccaagctccgcggcggcacctgcaccaccgccgccgccgacccgccggacgccgtcgtccgccgcgccatgcacctgctccagaacgggttcggcagctacgacgtgttcgagaacaactgcgaggacttcgcgctctactgcaagacgggcctcctccccgccgacgagccgggcagcatcggccggagcggccaggcgtcgtcggcgatcggcgtcccgctggcggcgctcctctccacgccgttcaagctgctcgccgccggccccctcggcatggccgccgtcaccgccgggatgtactgcgccggcaggtacatcaccgacatcggggtgaggaaggacgtcgtcaaggtggaggtggagaacctgtcggcgcatcttggctggcgtcgcgccaaagccgaggaagaaatggccatgaaaaaacagcagccttcatcacatgatactaaggtcaagaagagtttacttcctctcaagagaaaacgtgacaatttctgcgaaattattacgagctgaaattctactacaatttgtatggttttgtgtggataggttttggagttaaaatgcaataagtcctggaaatatatgaagcgtcaagtgtgctttgatttaatcaagcattcgctgtctctgtgtgtgtgtgatagatagatcgatctgatcatgaattgggtgtgccaaggagattggattgctgtaccactatagtattatagtcagaaaatttactctctctctctctctctctctctctctctctctctctctctctttttcatttgaaccatctagtagtatatatctctgtattctgataagcaatatctcaataacaactttcatgcagagttgcagaccattgtctactagtggtgttgcgagcttgcattctttgacaatgtgtgatgagctgttgatttgccagtgttcagtgagctgaactgtgctttgttcatggatctagccaagatgttccaaaccacagtacatttccagaataataaatctgcgaagaggtccccgtcgtcatttcctgaataattcaggactcatgacagtaacatgtcgctactgtctacttgcagctcgtatacaatgtctgtactcgtcgtcagtagatccttctccccggacccatgattgttaaaatgacaagttgtggcagaatcaatatgaggtcgccgacgaaacttcatcgcctttactccatgtgagaatgtgagaagatgagatctggattggatgaggaggaggaagaagatggtaaagatgtctgttgtttcttctgaaattacactcgggatcggacccttttcctttcctctgtgcttgttctgcctttaatgattggtttcatagaccctctcgtcagtaaatgaaaaggctggccacgttgtgtgatttgtgagatctggggttgtgtgttggttgagccagacagaaaagtaccagttacagactggttcacaggggaggcaaccagaaatattctctgcacaagagttacagtttacagagttattactacagaaaaatgatctctttgcctgaattgtgtcagtgcatgaagatatggagtagtagtatgatgaatatgttgcagatgaaattcagtcaagacacaagtagaagttcatttggttggagcctttggagagcatgtgattaggaggtggttgattaattgttccaatttccaaactgctctcttcgtctagctgaagtagttcttgttcctactatctgtttgcatgagggtaggtaggtgaagaagagaggaaaaaaaaaacgctgtaaagttgaagcaatggcgatgaggcgacgaagacctacccctagaagggcacgaaagaaagaggtgagcttgtaaataatcgatgattgccagggagaaaacaacaagcaatgccggtttctgttcctgaaaggttgtgctcaacactgtttctgtacgctgcacagctgcagctggaagaattccttgcctcttatatggatccaaggagcagagatgtatggggatccatgtggccaacgggaaaattgtttcattgacggtaaaggatgtcggtaggctgatttctctgatcttgtgtttcagattggacaaaataatctcattgttttccttgacaggtagcgactagcttcgattttgctatatatttattgataaattttcttttaaaaaattatcacacataaatacggtataattgtagtgtaattacattataagttgtatgaaactataatgttacttaatttgtatgaaatttttgcataatttcaaaccgttagatttatttcattcatgcaagttgggaagaaaaaaaatcataacgggtatacgggtgaggagatttggtcttgcgacctccacttcatgaaaatagcatgttactgtgggattttttaaagttatatacaattntattatagttatatgcaagtcatgattgcactatatttatatctgttaaatttataggagaaaaaatgtctacggatgtacaggtgaccgatgggaggagcatttacgtactactgatcttggtgagcccatctaatagtgggccaggggcggttgaatggataggccactttgggccgcctgctatggcagtccatcttgatattccgttcctgtccgaaatattgacggcctatggagtttggtgtcaggctgtcagcttacgcgatgtgcggaagcttagcaggctgggccgttttgtgggcctcttttgcttgttctgtgcaaaacaacactaacaacatctccactgcacccatctctcttgcaggctgcagccacccataagtacttcttttataggcaaaatttactaaatgacactaaaaatttgtgtaatttattggtagatatcgtaaaagcgtgtaatttattttttactgtaatgttgtgtttaaaccatgtgattctaggggcattcttgtccttctcaagaatttgtctttacaatcgagttgaaagtgtcatccatcaaacaaccagtttcttaggatgtcttttaaccgtgacataatttttcgatatctatcatcaaactactcaaaatttagacgtcctgtagcagattttacctcttctataatggttgaacctactgttactgcaccaaccagctaaacccatgaatgctgttacgcactattttgataattaaccaactgtttttcatatatttatatttataagctaaattttacttcctccatttcatgttaagtgcaaccatgagttttcgtgtccaactttagtcgttcgtcttatttaaaaaaaatttaattagtatttttgtttatatgagatgataaaacatgaatagtacattatgcgtgacttatgttttttatttttttaaaaaaatcaaataaaacggatgatcaaaattagacacagaaactcatgactgcacttaaaattggatggagggagtaaaacataactatagaactattttttatagtttttgttacagtttattttacaaacctttaaatcagtaaaaacacatacataaaagttttgatatttttttaaggcaatgaacgaggcccaacgaatactctacagaaggatgtacagtacagtaggaggagtctatactctatactacgctccgtacgcacattgtttgcggcagtcttcaagacaacttttttttttttactgccatgaaaggaagcaggcttgcggtgaaagaaagttgtctgccgatgacgatgccaatgccagagactttcgcacagtacagtaatccattgcggtcaactagggcctacggtcaactctgcagggtgccagggtacaggcagatgcagccgaaagccgttcaaaggaaaggaaaaattactacaagccgagcagaaacaaagctctttcaagttcacacttcacactagaggtgtgtttaggtggtgtttgaatccagtgacttaactttaattcacactaatttagagtattaaatatagactacttataaaactaattatataaataaaagctaatttgtgagacaattttttaagcctaattaatccataattagataatgtttattgtagcatcacatatgctaattatagattaattaagttatagattcgtctcacgaattagtccaagattattgatgagttttattaatagtctacgtttaatatttataattagtgtctaaacatccgatgtgatagggactaaaaatttttagtcccatctaaacaggttcttacttcacgccaaaattggaagtttgattgaaattggaatgatgtgacggaaaagctgaaagtttgtgtgtgtagaaaagttttgatgtgatggaaaagttggaactttaaagaaaaagttgggaactaaaccaggcctaggcctagttggcaaaaataaaaattctttgatgtcacatcgaatgtaaaaagtttttagacacaaatgaaaaaaactaatttcataactagcctggaaccgcgagacgaatttattaagcctaattaatccgtcattaccacatgtgagttactgtagcacttatggtttatcatagattgtgtaattagtttttttatctatatttaatactccatgcaagcgtataaagatttgatgtgacatttttaagaaattttttttgaactaaacaatgtctaaaagaaagcccagtcacaatttaaaacttaatttagaactattccaagcatttaaattttgaaaattaattcaaaataattctaagcattttttttcctattttcagccttgaccttaaaatcactaacgcaaagttctttttttcaccttcccaactaatctcttgcttttcacgcgcacagtttttaaattattaaacggtgtgtttttttaaaatatatataaaagtttattttaaaaatgatgttaattgattttttttcagtgttctaagctaatataattaatcacgcattcaaaaggaacacagtttgtcgtaccgggatgtgcagtaactcccaaacacagccgaagagtagaaatatgaaaatcctacccaaaaagcatttctcatcatcagtgctacagtacctatatgtgctattgacggattaattaaatttaataaattcgtttcgcggttttcatgttagttatgaaattagttttttcatttatatccgaaaacctcttccgacatccaatcaaaacgtccgatgtcacaacaaaaattttcttttcgtgtcaccctcatttgtttttctacggtttgtatttggaaggtaaccaatgtgacactgcatcaagcagtcaaatgtcaaataatggaaaatcaatccatttccgtcttctgcatgctcagcaagctgtccttgcctgattggctcgattccctcgggtttcccttgaccacttctgtcggaggcacatgtactccagctgcacggtcgttagacgtctgaagtctgatgtatagacggcgcacgtctccagaccaaaattccaaaccaatccaacagaacatgtgtgtagaaattccaaaccattccaaacctttgttggcctctcggtctccatgttcagactgattaattaccaactgacactagcctaaactctttgacactcgtttcgaactttcgatctcaagtaggataaaaggtaatatgctccgtgagtcattcccaacccaataactaggataatttccatagtattaaataagctaccacctaaaataaaaaataatgtggtaagtgaataaatgagaaaaaaaaagaaaccaaatcttgtatgagatatggtttctacataatatacaagatattatatgagataagtagcattaaatttaagtatgaaaaatagtgtttgtattgaaagagtagtgtcaagtgatagtttctcgatgaggtgagtttatagaaactatatctactgtgggaccggcgttagtcgaagcacactgcacaaaacagtagtatatcaacgcgtaaacaccaatcattatgggcataaaaccgtcataaataaagcacacagcatgtactacagttaagacctactcttagaaaaaaaaaactatagttaagacccctcctgatcattcttgcttcctagataatcagggtgccaacagaaaaagaaccacacgtttctactctcgagtaattgaattcaatcaacaactattggtgttcctgcaaatgaaggcctggaaaatactctcgtgtaattcgctcatgaacacatgtctgtatcacccagatagtgcgagattaaattctagcagaacatggcatcatctactccaccattacattcctatgcaccaactgtttttggtgtagacgcaaaatatcagcgacagacagagaagggaacgtactagtttgtatgtgatcaaacgcatcgtcttcagatcagatcagatcagatcagatgttggatttccagttgtacttacggcgaccaaaaaatatctgatccggcggaccctcgttcagcggctcaggccatcttcggctgttactgttgggaaagagctagctcgttctctccttggctactactagtagacttgcggagtatttccgaaccgctgcgttcaagatggcaacggtgaattcaccatcgggggtcacacccgcgtccccgtcatcgcggtgaaaaaatttcaccgtccccgttccagtcaatcacgacggggctacaatttctccagccccgatcaccacgtggtgaacccgtccccggttaaacaacaaattcatcaacaaatcatataaatgcaatggaacacaaatcagcagtacatcacattgatatttttccaaaataatatactcaacaaactactggtcatatcgacggcgacgaacggcggaggaatcaatggcggcggatggcgtgctggccggaggcggtgggtgccgcgaccacggtctgaggcggcgcgtgcgcgacgacggccggaggcgctggtcggagcgatgacgtccggaggtggcgagcgcgcgtcgacgacggccggagacatcagtcggcgcgacgacggcaagaggcgatgggcggcgcgacaatagccggcggcggcacgcgtgcgtcgacggctgggggcaggaccgcgcccgcacgaggggagacgacggccagcggcgctatgcgcagtgccgcggtggctggggagatatttggagatggggagggttgattagggttagaagatatatatacatggttactgagcttcatttttatgggccaaaacaactgtacagtctagaattggtccctagctacattacatgcgggtcaccgcgggagacggggatggtgaatggtgcaccgtccccgcccccgccatccccgatggtgatgagttttggaccattagattcaccatgggtggtagatatcaaccatccccattctctaatatgtgaattcatcgcggggaatcgatgatcaggtccccattgccatctctattccttacacaagttttccaagacttctctttcgttttccgcgtgcacgcttttcaaaccgttaaattgtacgtttttttaaaaaaagtttctatacaaaagctgctttaaaaaaatcaaattaattcattttttttttaaaaaatatctaatacttaattaatcacctgctaatgaatcacttttttttccgtgcagtggagttagttcccaaccccaagtatcaaacacagccctatatagaactttactgataatcaaatgaatttaattttgtatttttttaaaaaaaataatatttaattaatcatacgcctgattatatatctcgtttggtgtaccgcaatcgtttcacgagccacgtctggttcgaacaaagcctaagtttttaaaagtaaaatactccatcacacaaagactcatttttatccgcttcatttgtccaaaaacacttaatcttcaatacaattaatatattggagtttaaaaaattgatagacaaatgtgttagagtttaaaaaattgaagatcaaatacatcgagtaaactctttatatcggtatatgtgtaaaataggagtaagcaaaaataaaatctttttgggtgaaggtagtacactctaatatcaaattaatacgacttccattgtaaaatatagtattcttgtattttctccaaactaaaatgaaatgtgacatattttataatagaaatctgagtttcatcatatctagaatcaaattactaagatatgtcgtatctgtactaattttttttgaacgaaaaagtactatatataaaagtaagaacgcgtagaaaaaaaatatagggcctcatcttttcgcttatgcttatacttattagtcaaaattaaaaaaattaaccttaaatttagagctgattcgttaggaacgtgtagggcttgtttggtttagtgctgtaccaaaacattggtaatgccaaacttaggcatgttttggtactaccaataatttgctagggtagaattcttactaatgtgtttggattgatatgaattgagagccaattttttttatggtaaagaaagttctagaattataccaattttagcatgggcattaccatctatttgtattaaaccaacccatcatatttactattcaaattgtataaaaaaaataagcatggcacattttaatatcaatctaaagtgacccgtatttttaagtaaagaccgagatattatattttattataaaaaaagtgatccgtatgtaaaagttacccatggctccgctatatgtacaatatggacaagcaagcgaagcaagacaatcagagcaaacacagtagcagtagtatgtaacgttatccgagctactagtagtagtgttccagtacgtgactggctgtgcctttcctagtggaggcccacaccacacccacgaaacgtgtccctgattcccccgcctccaacgaacgacttgaaccttccagaacaaaccaaatccataaaaaaagacacggaaacttctcgcactttcccccacccattctcccacctcccgcacgcaacccaaccctccctccgtccgatctcccgcgcgacgcccatccaaccgccggtcagtcgccgtgacacgaccgacttgctgtgttagcccctctttagattccacgctaaaactttacccccttattaagcgaacatttgaacatatgcatgaagtattaaatataggctaaaataataactaattaacagattacgactaatttgcgagatgaatcttttaagtctaattactctaaaatttaatatggtgctataataaacaattactaataatggattaattaagcttaatgaatttatctcacggtttattgacgaattctataattattttttattaatgtctaaatattttatacgaaagtctatatataatgtctgttgagacacgctaaaattttactaccctaatctgcacacccccatagtttatatctctcccgcctcacccgctcccacctctccttccgtttcctctcattaacttcctctctcgcttcttttctccacgccacgctacccgaaacttccagaagcaaccagacaccacggtgtatccaggccagatctgcgcggccgccggcggcggcggtggcatggctgaccagaccgctgctgccgttgtcgtcggaggaggagcggcggcgacgatgggggagccatctccacctccgccggcgccggcagcggaggcggcgggggtgggggtggggcagcagcagaggacggtgccgacgccgttcctgaccaagacgtaccagctggtggatgacccggcggtcgacgacgtcatctcctggaacgacgacggctccaccttcgtcgtgtggcgccccgccgagttcgcccgcgacctcctccccaagtacttcaagcacaacaacttctccagcttcgtccgccagctcaacacctacgtacgcctcgccgccgcgttttcctttctcttttccgttcgatttcgatcagctcgactaatttttgtctcggcctcgccggaatggattggattatacagggatttaggaagattgtcccggacaggtgggagttcgccaacgactgcttccgccgaggggaacggcggctgctctgcgagatacaccgccggaaggtgacgccgccggcgccagcggcgacgacggcggcggtcgcggccgcgatcccgatggcgctgccggtgacgacgacgcgggatggctccccggtgctgtccggcgaggagcaggtcatatcctccagctcgtcccccgagcccccgctcgtgctgccgcaggcgccgtccggctccggctccggcggcgtcgcgtccggcgacgtgggggacgagaacgagcggctgcggcgggagaacgcgcagctcgcgcgggagctcagccagatgaggaagctctgcaacaacatcctcctcctcatgtccaagtacgcctccacccagcagctcgacgccgccaacgcctcctccgccgccgggaacaacaacaacaacaactgctccggcgaatccgccgaggcggccacgccgctcccgctccccgccgtcctcgacctcatgccttcctgccccggcgccgcctccgccgccgcgcccgtatcagacaacgaggagggaatgatgagcgcgaagctcttcggcgtctccatcggccggaagcgaatgcggcacgacggcggcggcgacgacgaccacgcggcgacggtgaaggcggagccgatggacgggcggccgcacggcaaggacgaacaatcggcggagacgcaggcctggcccatttaccggcccaggcccgtttaccagcccatccgggcctgcaacggatacgagtacgaccgagccggcagtgaccaagacggttcaaactctacctaaaagttgtgtgttagacccgtctcgtttaatcaatctactctagcaattaactacttctactcctcgatagaaaaagaggcaatcaaccttgggatttacctagtcccaatgtctttgtagtgttcttttttacttgtagtatgtagtactcctactagttttttttttcagattattatcctttgtatatatactgctgctgctagtgagaaggcataaaagatcagatcgagttcacttgctatttctaaccttttgtttggtcatagacggtgtggagatgtgagatttggctgccggattaagatattccaagggggggattagtgatggcgtttgttgtgtaacggggaaaatatcttgcccacacggcgcacctactagaaggtgcgaaagccacttttcttccaagccaaatcgggggttttgattttattgcgatttggacagtgacctgtcctgccagccagccaacggtcgagaccacaggattctagtatgggcatttcgtttcccagttcagtttcgttgttgttgttgttaggagcgagtcaaattagtcaaagacgtcgagtaaatatcatttttaattgacctggttaaaatcatgttagttctaccgaacattgatggttaatttttgagtattttttaagcaacatagaagcaaaacggctgtctgatggttttgtgccattttacactttacagttacccgttattatatgatacagtaaattatagccaaagggaatgaggtacaagttgtgaggtgctactctgatttgagtacttgagaccattttaggcacgactcaaggttggaggtctcaaagttgatacttggcgctccatctgcttgtacaatgcaggtttactataaagatttggggccttattacctcatggatggtctaccaatagctatatcgattcaggctgtttttagttcccttcaaactttaaactttttcgtcacattaaatgtttggacatatgcatgaagcattaaatatgaaaaaaaaagcaattacacagtttacatgtaaattgtgagacgaatcttttggcctaactacatcatgatttgacaatgtgttgctacagtaaatatttgctaatgacggattaattagacttaatagattcatctcacagtttataggcgaaatctctataatttgttttgttattagtctacgtttaatatttcaaatgcgtgtctgtatacgttaaaaaagttttagacggagaactcaacacggcctcaatggagatcgacacagaacattcaaaactggtgggagacaaatacaaaggagtgcccaagaaagatctacgcacactaattctcctgattgtctaggagacctggaacgagagaaacccagcgatattgcagctccgaatctactgagaaagattaagcaatgacttaggctctagtaggagtatagctgctacaggattggagctattacctagtaactttgtatactctatgggtgtgtttggaagataggttaggagaggttgtattttctcctctttatttaaggaaaaaacacaatctcatactttttttttcaaaaattgatactccagcaatgatttaatcttttcttgagctataaacgtgtcctcctcacattgctcatattttttcccttttgaaagttcacgttgtctcacacctacgatccatggctgccatcctcaagtatgcttcatggtggccatgcagacatgatgtacctttaccgtgtacgatgtaacaaagagtgtggagccaagccgagcaaccaggacaagaaagatgtgagcactgtgtcgtttaatcctctctctcgaattctcggagttcattgatcctgacaaaaatgcagttaggctgtgtttggatctaaagttttttttttcaaacttttaacttttctatcgcattaaaacttttttacacacacaaactttcaatttctccgtgacattgttccaatttcaaccgactttcaattttagtgtgaactaaacacatagcttcttcgacggtgggttgttctgatttctgaatctctgcaactgcacggccgtcaagttgtgggggctgtgcaagaatggcggcgcgaccgtcgtggccatcgacggcctcctgcaggtcacgttcagttgcgtacttgcgtcaacaacctcctggtcaccggcgccggcaccctcgacgctggacgagagtacgagaccaactccctacccaggccacgacggtgagatcttagggtttgtttagttactgaagtttgaagaaagttaaaagttcggaaaaaaaagttaaaagtttatgtgtgtagaaaagttttcgatgtgatatatgatgtgatggaaagttgagaataaagcggaaactaaacacggccttattaaacttatcgatactaatttactcagattatctcctcttatgaagaaagtagtggggaaattctcgtacatcctgcagattctgaagttggacggcgtgacgagaacacggtgataagagcggcggacatgagacgcggggattccacatttccgcgtctccatgacattgttatggccgacgtgtctacaaccccatcatattttgaattcaggttgtctagcccaccaccttatatagctaatcggaagatccacgggcgtttctcgaccaacattactcctcgatagccgcccatggcaaatgctccaacgccgccaaggtgacaagaacagagctttccattgccaattcgccgttgttcttgcagctacctctggtgcagatcagcgagacgtgacgtccgagaggatcaacggcacgccgaacagcaggaggaagaaccaggtcgatcaatcagtctcagttgtgaccaaacgccggctataatgcagcgcaaagaacagcaacgacgtgccagggatgcccaactcgttgggccaagcacccagcccggtcgcctgagcaagacgctgatgtcagagtactccaacactgaacaaattcaagtaattgagttttgttactctggtgttcaagtaattgagttttgttactctggtgtgtttggttcacgtttaaattggaacgatgtgatgaaaaagttaaaaatttgtgtgtagaaaaattttgatgtgatggaaaagttggaagtttgaagcaaaagttatgaactaaaccaggcctctgatgatagagagttaagggccggaagaaaattattaattgagcggcgaagtgagcgtagcttaactgattatattttttaggtgacctatctgggttcaagtgttagacttgatactgatgcttatatagttatatttacgactaattattcttttagtggtaagtgacatacccgtcgactatgagatacctataatgactttattaatctcagtatatatatcagttcagtttttttaaggtgattatatagataagatacatgcgtgtatattcgtagggacgagtgtgtgcgtgttgtgagcacatgcgcatgtgttgtactatgtttaaaaaaatattaattgtatttataggatttaaatttgtcccaaaataattgtcacaatagagtactcgtaatctcattaatcatttctcatttaaaatatttctaattttatcctcaaccacccatccactcttacctacaaatcatttaataaaagacgtcacaatcttttttcttaaattttaatatatgctaaactatttagaattataattattttgggatgcatgtagtaagtctacttttaacatccgactcgtttggaagtaactaaaaaccttcaaaacactacactactttgtcattagaaatttttaaatgctcataataaagttgggtggcacaaacctctcttcataataatttttactaaatgcttaacaaaatcctatctcctcctgcctgtcaccggtcaccgaccgatggtccccgcaatccaatccagccagccagcctcgcatccccccctcccccactcgccggcgaccgctgccgtcgccgtcgtccacctcattccccacctcgtgcctcgtctcccttccaagccaagccaaaaacccctccacgagccgcgccgtacgccatcgccaaccaccactccactactacttccccccacactcactcactccactcccaccacagcaaccgcttgctttgcttcgcccatctgagctataattagctcgaggagagagccctaacccgccgcgccatggcgagcagcagcggcgaggggaagggtgccggcggcgcggggtaccagtacgcgccgtacggcgggtcgtactacgacgaggagcggcggtggtggccgtggctcgtgccgaccgtgctcgtggcctgcatcgtggtgttcctcgtcgagatgttcgtcaacgactgcccccgccacgggagcccgctccgcggcgagtcctgcgtcgccggcttcctccaccagttcgccttccagccgctccgggagaacccgctcctcgggccctcctccgccacgtacgtaacgctcctcctcctcgctgcttgccatttgattcgattccccgttgcgcaattgagcttggaaattggggggaattttaggtcccgttcgaatccactaaaaaaagtggatttagtcaagcgtgtgaagctggcgtctttgtcgttacaggggatttccttttccgctccaggtgtctaggagataaaagagagagagagagagagagactgcgatggcgactacttggatcttttcaactaccgttttcgaaagagaaaattacaaaacctttagcagcattgcattagattatcttgtgccatctatacatctgatggagtattaagatttattatgctttgtgccttcgtagaatggagcaatgcaaattctggaacaattcggttggcacaggaatattttattcttacatgatttgtctactagtagtgtttacgtcacttgcaggtttcccaaattgcagtcgtgaaatgtaggtagtatttttatcaattagattattagaattaggtgattggcttttgtattggtactactaccccttgcaatccaggattatggaggagtgacgttttttttttccaacacatgttaaaaagggtgaattttgtttgttctagcctgcgaatttcatcacatcggaagctttctgaggactacattatctatcttcattgatgcatactgttctgtaatacgcctgtgcagtttatttattttgatagtgttaagaacaaggggggttcttagtgctaacaagttgtttgctccattggccagtttggagaagatgggagcactagactgggcgaaggttgttcatcagcaccaagcatggcgtctcattagctgtatctggctacatgctggcctaatccacctgattgtcaacatgctaagcttgctattcatcggactccgtcttgagcagcaatttgggtttggtaagcttctacaagtacagaatcggtcctttttaccctcagcacagcataccgtttctgtttgaagcaacttggtttactatctttatacatgatcgtcccgtcttttatttgcaattgagttctccgaggtagttttgacttggcacttttagaagtacttgtcgtaccctatgttactcattattcatattcatatcagagtctcaaacccatatattaccattgtgttaaagccaattaactggttagattgccatgttatcattttgtaggcattacttacaatgcaaggccattgttctcacaaatttgagaatgactttatcttctagtcttcatataaagatgtagtcaatttacatatgtctatattctaaatattggacccataactttcatatgtcaatgtgtacccatttctcattttgagtttgaatctggtaatgttcctgcacactgacaacagtttccttacttactagtgcgtattggaatcatctacttgctatctggctttggcggtagcgtgctgtctgtgctgtttttacgtaataactacatctccgttggtgcctctggagctttgtttggcttacttgggtctatgctctccgagcttattatgaactggactatttattccaacaaggtcagcagaacagagactgtacctatattgtttactccaattcagttgttccctgcaagtttcagtttgttcactcttgcaggcagcggcaatcataactctcctgtttataattgcaatcaatttggcgatcgggatactacctcacgctgataactttgcacacattggtggatttgtgactggattccttcttgggtttgtcctgctggcaagacctcaatttggttggatggaacgtcatgagttgcctcagactaatcaaccacgaaagtacagagcataccagtatgttttgtgggctgttgcactcttcttgctgctagttgggtaagtctctccacttcatctaaaagcacagtgcatgtgcatagttaatactcgttcacatctcacttttgtagtaacaaaagcatagcgtcgacatatgcaatgctatagactgacataaaatagcttgaataagcaacagtttgacaattcatcaataagaagctatacctgaaacctgacagaggtgaattactgatgcaggtttgtgattgccctggtgatgcttttcaaggggaagaatggaaacgatggttgtcactggtgccactacctgaactgcataccaacatccagatggaagtgcagtacttagatgcttcagaattccgttagctcttctccaaattacaaatattcttcgggaaccattttcaagcttgtgtgcttgtagatatctacaagaaatttgccacagagtcgaattctgccctttccaaagtgtagtacaattttctgctttgtaatttgagattgtaacagctgtttatttcagcccaactccatactgcattgctcaaaaaatttgtgatgttcaattggattctcttatatcatctaaagttcgaaacaatgttaatggttatggagtctaaacattcttctttcaaagtttcaaggccttctctggaagactagaatgtgggagtttctactggtctaatggaattaaaccaattcatatgaaactagtaataaattgaaactagtaatatgcccgtgctaatgctacgataaaaattgatattgcaaataaaacacccaaaacattggtactttcagcaatggaacagatagttaaaaagtttacgttagcactgaatttttttcggcaaaatattatgtattacattttgtagtgggtactaaatacgcacacaagacaagccattcctattttagacagaaatcaagctccactgtattttcctttgaagttaaaaaatggaaaataaacacaacttctcagcatgcaaccagaggacaatatggaaagaaataaatgattgcagtgaaacctcatttttatttccatacaaaataaaaattaatgtaaaaatcagaaattcactgagcagaaccacatcaatatctttacattagatgaacaatatctttacattgttcttaatgaaaatacatcaatatatattgtggtaacacctaggaggttcaataaataaaataacttaagatcttgcaacatgtgtcactaatatttaacaaagtggaacaattgccatgtaatttgtctattcttcacttggaggttggtgatgctctggtagctggtagctggcaattgagtgaaaatagctataagtgaaaagatttgccatattctcaccaaccttaaagtgcaagataaaatgttattttgcaaggtaatatgtatcaattgtgatgaaaagaaaaattctcagcatggaaattaaaaaggatgcttctctaatgccaccttggatcctttggaataagatcatttcaaacaatttattctcaaatggtttgcagaaaaaaaaacagtaccaagctagcgccaacatggccttgcatgacacagacacactcccggtgttcatggaagtcgaggcaaattatcatggggtgtgcaatatctcagcaccttaaagcaccatagcccttgcaatctttaagcttgacaaaatattgtccctcaaataattcctaggtgacatacattctaaacacagaactaaaaactggagtcattacctcacttcttttttgagaaagtagtgatcaattgaagtgaaaaatattcattcaaactcatttgtttttctgaatcaatgatcacataaaaatggtttgttgaagttcagtgatccagcactgtaaacaatatttattttctcataatgaggagaaagttgtttactttccaagacataactgcacaacatcttctcgttactattgtacataactgcacaacatcagaacccgaaacacttcctcgttatgcgtgcgtggaaaatcacttctcaaactgctgcaacgaacgttgtcaagcaatctccagtatggcagtatgtgatctttggtgatatccaaacctaagcaattaaaaaaccagcagactccgaatcagctccaagaaactgtagttcagaatggaactcaaacaacaccgagaaagattttttaaaaaaaattaggaatatcaagtgaatcaggaatggagtatgtgtgctgtcaaaaaataatgtcattacaaaggaacaactaaatctttgatgtggtagtagtacaggtcttactttaaatatttccaaggctgaaatgaaccaaaacttctgcaatgtattgattgttttgcctcaggttgagcgattaaggatagcagatctgttgacaaacaatatgggtaagagttgatgtcaggagaccataccaccaatatattgcccaaaattggatatttttgcaaatacacggttttcagatagcaaatagtgcatgcggcattaaatctaacaatttcccttttcttgagagggagagagattctattacatgcagtacaatatacacatttggtgatttgataatataaatctgttatttgttatataaatttcagtatatacccctataggaaataaagcagcatataccatctctataaagaaaaatgcagtatatatgctcgtaatggtgaataaaaaaatagcacatagggaacattgcagtaaatacttctgtatataaaaaatcagtatatgcatttacaggaaacattcagcatatgcatctacaggaaaatttagcatacaaatctgaaagcatgcaaggactgacctacaaaatatccatatatagaaacataaagatattaaatctaatggtctcctaataaaccactgggaacaataaatctaatggtctcctaatcaaccactggcaataagttttggggcatacttttgactcaagtgataaaacgattctcctcacctgcaaacgagtagaaaattttagacactgtgaatgatcttgcattagaaaaacacctgtactaacctgctgctttgccacatgtacgtgaatactctgctgctctccttcagatgtgttcatcacatcgggtcaaaagaaacccagatggcagccgggctgatgtggtgacgatggcggaattcaacaagtcaatatatcctgcaacgaggaaaacaatggtgtcaactgtacatcattgagcagacagacaaacaaatcaacatgttgttgatgaatgtcgcaagcacagattgtcatggaggaaggcgtgcgacggcgatgcagatcctggtgatgcagcgtgcgacggcgaacaggcggcaggatggaggggaggggcggtgctgggttgggcgttggcggcggggtggacggggaggaatgcgtgcgacggcgacggcggtggcgttgatctggccgagggatggactcgagcggggaggggcggcggtgggtggggcgtccgcgataggcggggcatcaacagcggtgtctgtggg

SEQ ID NO: 66416 - DNA, 12071 bp, Oryza sativa
attttcagccgttggatttgatgaatgaagtatgaaggatgtaaaagccggttggtgaattatagggtagaataatgtaaattttttgcgttccaagtggaggcatgagagcatgaaatccgacgctaaaatttataacgtgatcgaagatgtttacatggggcgtgtttggttgcccggctcgtacttggctcgcatctcggatgcaacttgtaggatgtttggttgactgtacatgtcccacaactaagcccagcggatgcaaaaactccctcgcaggcaggctaaggaggaacggccgaaacgagcttcgctgcttgtcctggctccacgcatgcagccgcgctgcacacacgcgtgcaagcgccgcacccgcgcatgcagggagaggcgatggggtcaccaacaccaacctgcctccctcctcatttcttccgtcttctctcttcgctatcgccggccacagccacaagttgcgaccatctccatctccaccagccagatctagctgcaagtcctgctcctccgtattttcttcaacaatgggccacgaagagctctccgcaagtggatccgaagggcatgagctcactactgccagatctaccagtctggtagcgttgaatatggcgggtgctcatcaccactttcctcaccccagagagaaggatgagctcggctccaacttcttcatgtcattgtcgtcgtcgtcgttaccagcgccaccaccttcctcgtcggcttgagctcgtcgctgcacgaatgcccccaccgcagtcggcagctaccttgaatctctctcctcctcacctttctttctttttttttttgagaacacttcctcacctttctttggccggattcagaattaacctaggaacttaggcccgccagatccaagtagccacaagctcctgaccgccagacccgctgcacccacggcggcgaacatgcctggctgggtggcacgagcggctagctaccggcggcgacaagctcctctgcgagctctcttatcattttcttttttttcttattctttcttttttcaaccgaatgttattaatcactaataaatatacttgatttactgctgtgtgaccatatatgcttttgacagtgtcttaaattattgtatatgctcatctgacagtgtcttaaattattatcgccaggaactccaatatcaattttttatacattctgcttatattaaatctgctacaatataccgtaaataaatagcttttacatgataagaattttcactctcaaagaaagtaagtactcgaacctactttccatacaatcaaccaaacaaaatctctttcaaaccgtatcttcgatgcaagcaaccaaacaaaatctcactataatccagctaaaccaatacaaccaaccaaacagctgcatgtgtatctacttggccaggctaaactcggtctggacgagagagatgggccaggctaagaagatgcgatcaaccaaaacacacccaggagatgggccaggctaagaagatgccatcaatcaaacacacccatggtttcacatcggagaaggcaaggtatattcgactaggggcagaggaggtgcagcaaaagtgctttcttttgtgccttcttttgcttcggggagatgcctcgcttctctccctttcctcttccacaagaagatgggcaaagcagcgagtgtagtattttacctccatgcccctaacactgccccggcactgcttcggcttgttcctacccttcggagggtaataacgtaaatgaacctagcctagtgggctaaaccgctaaagcagttcacggcccacggcccaacaaaccttaaactacggggaaaagaaaagaaaaaaaaaagaactcgcaacttgtcaaattaaaattcttcacacacacacacagcctcgtggcttcacaactcctcctcctcttctcatcttgggtttctctccctcctcctcgccgtcgcgtcgccgcggaggcggaggcggagagccaaggccgcggcggtgcagccgccctcccctcctcccgccgccatggtgaggccgacgcaggacgcgatcgacaccttcgtcggcatcaccggcgccgatgaggccgtcgccgcccgcaagctcgaggtgacgcccacccgctccgttcccgtttgttccccccatcacccccccccttctcctcccttcaccgtcgccattctacgcctcggaatgtgtggggcttggatgcgtcgggtctcgagttaggtttgttgtgttagatggcgttgcgctgcggcgggggatgggtggtgcgggtgcgatgcgcgatttgcgggaggtgatgagaacgtggggggggggatggggttctagggtgtttagagttgagaacattttggggattggggattgtgtggtgcaatgccttcgaattttgagctttttagtgatgcatatgctcttagttttctcttcagcttgcgcggtcaggaatgctgaacacattagtggattagtttatgggcattgctatgggtacgattgtgaattgtgattcacgcggtaggacatccaactttgtttatgttatggaactttgttgacacaatcctacttggagtaagagttggatggagtaattcctattttaatgtttttttagggaaatcctattataatgtcttggtcttccattttgtaggaagaccgctgttgtcactgaatggtttaataaatgtttgcagatctgctttctgtaattttattgaacattgatttatctatcgggcaagatggtctttattgatcaatagtctttgtgagaacaattttcagattatggtccattgagtttaagcatgagaaaattactttattcaatctttatgtggatttttgactagtacagcaaataagcattctgcttagtgaatatttggacaggttagttatattgttgttgttgcaataactcttgccaatcattggtctgtttggaaatgctctgttggagtgctgagtgaagtactgctttatacttgtttcttctggttgcagtaggaataacttagcatagtaccttctgcacctctgccgaagatgctgaatcagagtctgttgggccttagcctctttcttcttcaattatgagtttggaaagattgttatcttattttgttaggaatcatatatattaggatccttattacaactcctctttatataaaggaaatatcaggaagaaataatgcgagcaaagtattacgctacttcttctgcctctcttccactgcatttcttctgcctctcttccactgcatgcttctgcccttttccccgttacccttgagtactacttcttccgttctgaaatataagcatatctaggattcaaattctgtacacaatataaggattcctagaatacttgtcccattaatcacctttcattcaaattgtcttcccatcttaccacaaccacccctcatttaatcaggacactatattcttctctcctcaaaacttaatctatgctaaacaacctagaactgcatatatttgggaatggagggggtacaacacacagaggcatacacaaagtccttacacaagtagatatttcaaaacgaatttctaactgactaaaatcattctaccaggaacatcatggtgacctaaatgaagctgtgaatgcctatttcaatgaaggagataggaccaggtacgtgttttttctcctagcggttcttatgtgcatttattgacctgataccatgttgttcccgttgttatatttaactgactcatacaattttcagcaccagagccaatgaaaatcctatacctaccggttatgatgacatggagttggatgaaccatttggtcctgttcctacatttcacatgcctttgggcaaccctttttcacttctggatcaaggttttttagaacgagctgctgctgtgtatggtgagggacctcatattacacaccctagggaggtgaggcggatagatgttgaagttaaggacaacaatactccagcaggtagttctggtcatggtcctgttattgaagatgttactggacatgagttttcacatgggccggaaattcgtgggactgttctgattgatgaagatgatgatgatgataacttgccatctgctcaagatactcgtctcccaagcaatccttcaacttcaaactattctgtaccaagagctcctccaattgctaatgttagtgactacaacaatgacatagaagaggagatggttcgcgctgcaatagaagcatcaaaaagggacgcagatggactgacaaatgtaagactgcttatcagatatctacttttaaaaatttggaacctacacatcttttttatcaaaacatttggtactatgcagggtctaagaagtggagaacgtgaaaatgcatcacgtggcagagatgatgatgagattgctcgggcggtttctatgtccttggaggtagttgttgaacacacaaagttctgtttttatgtgttctgttttttgtgtgttatgctgaattcatttttttttgtgactatttagacagcagaacaagagagagttctgcgccaagtgggagcgcatgtgtctgatcattctgatttatccgataaggaagacattgaaggagcaactgggacagtggaaaggtgtccatcaaatatattgtctaacaatctatgcatgtgtgatttttcattatatttggttattcatatatcaagttttattaggttcctagttaccaatgtccattgttccatgaatcttgagttctcttaatggtttcagcttcataaaagcaatgcattcttgcagctgcacctaccatattctttggatatcttttttgttattaagtttgttgtgattagctgagcatgacttcttctatctagttgtgactgattcattgtacatattatttcttgttgtaggcaagtaccaacttcagggaaagttggaacatctgatcagttggtagatgaagagaatttccaggatgatgacgttgaggaacattcttttgttagacaacactctaggcgtgtaccatctggaaatgatgagtccacagaagcacttgaaagggccaacagtcatccatccagtctcctccctcataacattgaaaacaatcagcagttcaatggagtttttccatcagaggtggtattttaatccatcacacctgtaatgagatagaatttaaccatactacagcttcttcactgcttacaaacccgttaatttttgttgcaaagtggggtggcatttcttctgaagaacatgatgaagctgttatgcttgaagctgcaatgtttggtggaattcctggaagagcagcatatccattttctctcccgtatcatcaaaactcaagtcgctaccccacggttgctcatcctccgtcaccaacattaactgcacaacggttgttaagggagcagcaggtatagactttggagtagtatctatctgtgggataacataacaacggctgcatgcaagtatgttaacctggtgtttgaattgtaggacgatgagtatctagcatctctcgaagctgaccgagaaaaagaattgaaggcagagcaggaggctgagctccgcagattagaagctgctgctgaaagagaagctgctattgcaaagcaaaaacaagaggaggaagaaaagcgaagaaaacaactcgaggaagaggtaattgagttagtagttagcgcgtttgagagttgaatggatagtagtcatagaactgttcatacattagttatattggcatataaccatgctaatcatatcgttatggtttattaaattaaagtcatgccacactgttggcaggccagtgtgcttgatgaattttatcattagtgcagatacgattgcatgtcggtaacaatgtctggattgttgcaagttatattgctttacttgtttcttatctggaggacttctcagactaactaactccttaggtctgatgagaaacattcttctgtattcttctgtaaattatgtcattagtagtaagaaaaggtagttaaaagctagcactatgatctgactgtgaccatctttaccatctacgtaatatcaaataaatgataaggaagtaattatgtgtcctttagaacttgcctactatgccttttccatggtttgtgttattttcaccacacagtggtatattgattatgttatttatggcaatgtgagaataggaattggagtccaagcttgcagccaaacaagcatcattgccaaaggagccattaccagatgatgtaggggccgtcactgttgtagttcgcatgcctgatggtcgtcgtcagggaaggcgctttatgaaatccgacaaccttcaggtaacattcttttagttgccagaatacctaatgaaactcactggtattccctcaataaatttttggaattcttgcaggtcctttttgatttcatagatatctccaggactttcaaaccaggaacctataggctggtaactttgctaaccttttcatttttttcatggtgtttcaggaatgttctatacacagaaatcagtgtagtttaccattaacctgttgaaactggatttgcactagcacaagctggttatttacgccagcacaaaaagaaaaaaaaaacgatgattctgcctgcttttatgtcattatgtgtcagtttattttgctattagtgttatcaagtatcatgtaccattcctagaatagatcaatttctgaactatgtgattttaaaagatttaacatcaatactggaggttgtctgatagtcagcgtactcatcccgttgagctaggtcaggataatatgcctgtggcatggtagactgtaaagagattacattgaaaccgcagcaccagctattttttagcactcacacaacatttagtgggcatgctttttattttcattcctctgtttaggtccctaagatttaggatcttgtttgaatatcgtatacacaatgcattctagcttgttggttttgccatgttgtgatatttggattataaaaaaaaactagttacttaagtagcctgtaaacaggggaaaattaatgcatgggagatttcatgttgtttctgttttatagcatttttagatgttgctgattgaatcttgtggtcctgaatattaaatataaatgaaaatctacaatgtgcaggtgaggtcttatcccaggcgtgcattcaccgactctgagtctcagatgtctttaagtgatcttggcctcaatagcaagcaggaagccttgtttctagagcagatttcaggatagggggaaaccgggaaagagttaattgcaattaacacaacagggattcacagaatttttttttctttttacttatgcctggcacatgttcgtgaaaatattagcaaggttcgcatgaaacttggcgttaaggtctcatgaccctcttttgtgttttggaatggtgactctcaagtaccgggtttcatgtgatactcaccctgcatatttgaacagtcagaactcagaatgtacatagactgctgctttcagagctaccgcaattcatcaattcattaatctatgttcgcttgttcaagatagtatctgcactgttggactgtttataatggcatgaatccaattaaccctagtaaggtactagcatgtatgggtggcctcttggcccttttgtccctgaacataacttacctgctccattgattcgagatgtagccagccagagggtaggttggatttatgttcgagagtgcatcgctggtgctgttccacggaagtcgattcttccaggaacgcaatattgttggcttggatcgtttaacataagctgagaaaggaaaacacacaaggaaaacaaagaggggcacgatagccaaaggaggtcatcgttaatgaaccagcaaccgggcattacatgattgttccatagtacttactggtattattcatcgacatcaatagcaactgcagtacaatctgaagattttactaaacgagacacgaagacaacgacggcttcgtcaacaccttgattattcttcttccatggcgtccggggttaactctcgtctcgtcttaggcagctgcacacagcaaaagaaacaatgatgattagaggcaatcatcatgagaaagaagccgattagttttaagagggggttacatacagcagttgatctggctgaggtggcatctggaaggcaggctgttcatgatgctgatggcgctgcaggcgcagccctgggagatggagctgagcgcgctgcagcactcggcgctggggtcaccggcgccgggcaccgcgtacgcgcggcacgccagcagcctgttcagctgcggcacgcactcccccccgccgccgccctgcgcctccgcgcccacggccagcagcaccagcacgagcgcgcacgccgccgccgccgcgttccccttgctcgccgccatatctcccctgctcctgtgcttcttcagacgatgctgcaaatattaccttacctttgctgctgctgctttgctgtgcttgccggtgacggtgaggagcggcgggttttatagggggtggccggagcttgggggcgcccggcgagctttgcatggctcacctatgccggtgatcgatggagaagccgagcacggcagtttgtgcgcgtggtaccgaacatgcgtcacgctcttggactgtgagcctcttccccgccgtgcgtctcggccggggtcggagaggaagagggagcgcctgctgctttggtgaagaaacggcccatcaacccttcgggccccgtgtgaactaacacgacccaatctcgaaattaatgggccatattatatgggccacgtggagcaggtaatgcccaagtagttctttgcaggcctatgttagcttttttttttgggccttcccagctgccgagtcgagtatattttgcggattaagtccactttggctctctgaaaaaatgattcaagaacctaaaccacaaagccggatatctcgacccccgaactattgaaatcggtatgatttgactcccttagcggtttcgctaatgtggcggtgttgacctaatctgtggggttgacgtgacgcttaagtggcatttgaattaaaaacatatatgtgggacccgtttggccccgcatatcatcctctctctttcttcttcatcccttctctctctttctctctctctctctctctctctctcccggagtggtaccgaccagcgggagctaaagcggcggcggcggcagcgaaggaggagaaggaggcggtcccacgttgtccgctcaggtctccccccagcaccctcaggccgcgccgacacccatctcttggcccgccaaagccatcaaccaccgtccccctactcgatctcgttggcgtcggctctagctcgtcgtcgctgccgctttagctcccgccggctaccaccactccggccctcgcccgccgccgctccagcctgtgctccccgtcgcctgccgaaggggagagaaagagaaagaaagagagaagggaggaagaggggaggaagaagaaagagagagaggatgacacgtggggctcacctcacaaatttttttgtgtgtgaatgtcaaacaggtcccacatatatgtttctaattcaaatgccacctaagtgtcacatcaatcccacagactaggtcaacaccgccatgttagcacaatgtcagcgaaaacgccctccaaaaccgctaagggagacaaattgcatcgatttcaatagttcgggggttgagatatccggttttgcggtttagagtcatggattagattctggtcacttttcaaggagtcaaagtggacttattccatattttgctggacttattccacacacgctgacgctgtgtagtagtgtagtaccgtacagatctgaacacaatactgtatttctgatcaatgtacaaaatacagtgtgcgttcagttgacagaacaagtggctgttgctcgcattgtgccatgcatcaatttgtttttctaagcaagctagcacacacgcatctctgcagaagaatcccacgacctttggcatcttctctgcatcgtccactgaccagcggtctgaattccggctcggctcatcctttcccggaaagaaattctccatgtgcggtggccactggatctgtatcatgcaacacgagggactaattaatttgatataagcttaattggaactaaagtatcagctggaatcaggacgtcaacttgattagatagccaggtattatcaccttattatttctgtccattaggcatgaaccaggaacatcactctgatctcccatttcagtactgaaaaccttcaccaaagcagaccaggccgttcagattgtatttatatatgctcttcgagtgcgattctgaattagattatatcaaaggagctaggtacacaactacacagagtatctcgtaaagcagatcaatgagcaaatcagtgatcactgaataattgcagggcttttttcttctcctttatggtccacatattcttgttcgccatggtccactttagatcataaatatgtgcatgtaaccattacaaaataaacgctaatccagtgtcttttttgtgataaagaacgggccagtcggcaaagatatgaactttattcggatgccattacattggtcatgaacagtgtaacgatctaaaatctttttcctatgatatcctacatgctagcgatgcaactcatagtgactatgagcatacataattgagtgggcaggcacctaggagtatctgtatatatcaataatatcatcgtctaacagttcatttgtcactcttttgtcagctgatcgttcaacttcatgtagctatataggagttgatgttgcaacttaattattaacccctgaaatcttaaccagtactggccaaagtaatctagatgatctggcagcgcataccgtgtggagttaaattggtaggtgcctttgatgctttcacgatttcacctatcgaaatctcaaacgaaaacgatctttttggtgcggtttttctcctggttcttttgtgtactttataccataaccaccagagatacacaccaaagcgatgaacagtgaaaggaacagcaacatccttcagacttgagagttcagtcttccagatcagcaagcgaactgaatttaatcaaatgtactagtactgttttctggcggagctacaactgtatgatccaatgatcagcttgttggtcgtctcaagcatcatatcccaaacaaaaaaagaaaaagaaaaaagaatcagtaaagtacacctctcgcttgattgattgcaatggtggaccaaaaattacagtttgatcgatgtgaagcgtgttgcatcagtaactttttagtttttactacgtactctccttttcatcgaaagagcgagatcgagaaaggatgcagtgtttgcaaattgcaattgacgacgagaaatcaatcgaaaacgaaataattggcagtacggcagtaggtctgactcacgcgtccacgaaaattaagcgacgccaatattcttcaagctccgtttcgtcttcgtcttcgtctacctctgtcatgtgcctgtatcgtacacgctcgtgcgcggatcgagtacacgcgcgagcgatcgagccgtaccgttgtgcgtacgtacgctctcgcgcgaccggtcgccggcggccggcgaccggtggccggctggtggttgccgcgtcggcggcgagggtggggcccccatcgatcggtctcgttcacctcgcgtagtaggttacggcgtccctttccgatcacgtacgcgcgatcctctcgcgaagcaaagaacatcatccttgtgatggaggacgtgggtgcgcgccgacgtggacgcgtcgccgtgctccacgtgtgccccggctgtcggtggcctcccttgcccgaggaagaagatagtgcagctctcgctgacagatggcccccacctgtcataggcaagcgtgcagcatccgactgtacggatcacccgc

SEQ ID NO: 66417 - DNA, 12097 bp, Oryza sativa
tcgattcattcctgtctccaattgaaggtcacaattgcagctggcagctagctcaaatttccattttttgtttggttgtctctcggcagcaaagcagatatagagcagaggaaagctaagctaaattagttagttagattactagtctctggcagctgggtgatcttaatttgatcaaagaagaagaagaagaagcaagtttttttagctcctgagtatattataggattaactactactaggatagtactcctatatgagaagaagatgatgcgcgggaaggatcagaaatttccggcgatgaagaaggagacggcggcggtggcgaaggaggaggtgtgggaggtgcggcccggcggcatgctggtgcagaagcggagcccggagtcggagccaccgccgggcggcgcgccggtgccgacgatccgggtgaaggtgaagtacaacggggtgtaccacgagatctacatcaactcgcaggcgtccttcggcgagctgaagaagctcctgtcggagaagacggggctccaccccgacgaccagaaggtggtgtacagggacaaggagagggactccaaggcgttcctcgacatcgccggcgtcaaggaccgctccaagatgctcctcctcgaggaccccaccgcccaggccaagcgcctcctcgaggagcgccgccattgcaaggctgagcgcgccgccaagtccgtctcccgcgtcgccctcgacgtcgacaagctcgcctccaaggtagctaccccgctgctttgctttgcttgtcttctccgactccggcgtcgttgagctgtttggtggtgtacgtgcaggtgtcggcgctggaggcgatcgtgagcaagggcgggagggtggttgacgccgacgtggtggcgctcaccgaggcgctgatgaatgagctggtcaagctcgactccatcgccgccgacggcgaggtcaaggagcagcgccgagtgcaggagaagcgggtgcagaagtacgtcgaggccccgacgccatccgtgccaagaccaagaaagcggcggcggcgccgcccaaggcccggccgccgcacctgccgccgcgccgccgccggcgcagcagcagcagcgccggcagttccagccgccggcgcccgccacggcgaccgcgccggcgccacagaccgcgacggccagctgggagtcgttcgacctgctctcatccgtgccgtccacgtagtcggccccggtgaccaccatggcgccggcgaccaccaccaccacctcgccgtcgccgaggttcgagtgggagctcttctagacgatgtggggcccacactggccgcatgtgtgtacacgttcattggccggtcggtacctatgcctttcttgcatgttcatctttggtcactcatggtgcatgtcaattgtcattcttcctttcctctctctccccaattctttctttctttctttctttcttttttgaattctgagtgtatattgatctctacaaaaaaaggggctaaaatgtcaagtgagtgagtgagtgtgatcctcatgaagaagacaacatcaaaaccatgagacactctgatgatccatggtctgcaaaaaataagtggtggcctttgagatgatgatcaaaaaggaaatttttcatgacaatatatatgtacagtactgtatactactactagtgtacatcaatggtctcagcatatgttgcctgtctcattcatcttcttctacactgtatgtatgtattatcatcacttcctacattgtacaaacaatgctgctactactacatttctggtactcatattcagtagaattcagctgtctggaaatgcaagtgcagcatatgcatcacagctctgaatttcagattgattggctgaataattgtggggactgatgggcaattattaggcatctgccagtgcagggtagttagcaatttggatgcattcgatcggcggcataaaactatgtgctctctcctccatgctttggaccggccggattttatgtacatgccatggatcaaaagcctccatttttctgcacttgtttagaagctctgtttggtcagcatgacaggtagcagtagtagtagtagtagtagttgttgttgttgttgttgttcagagttcagaatttgtgtgcaaggagacaggggaagctaataatactgggcttgtggggtttgtataaagtttgatacatactttcattcatgtgatggccagatcagcctatcaattgtgagttgagtggtgcagcaacaacaacacttctgctatactatagtgtactctattacaagtagatatgatcctctgtcccattttttcagctggcactaatgacatgatcactgcacaacttaatttgttctgttccatgctagccattctaccagctcttctcttcccttcacctgaatacacaagccaaaatgagagctcaacatttgcatcacgagctcttttcggacaatctacttgggttggtgtgcacacaattgtagtagtacctgttgtgcagagggcagtaattggtgttgtcctcaagttgcagactttgcagagatgcctttcttcagagaagcacagaaagaaaggcaggctgagttggaagcttcatgcccagctattagaaatagggagtctaggagatcacagtagtagtagtagcagcagtagctcatttggtagtaggataaaaattaattactcaattaaagagaaagaagctgcttgtagtagtaacctaggagcagcatcataatcgtattggcttcacgttgtacttttgccgtcaattcgttgcagatgcgtagtcgctatctgcccgtaacttgacaccaatggctggctcgacagagacaacccagcttataattaatcaacatcacagaagaaaaagatcattagcgtccgtcagttagtcctcaagtacgtacgcctccctgttcctttgcttgcacattttcgtgcagatcagaatcagttcagagcaaccaaactttcgtcctcaacacacacacctgcagcctgcaagcttgcgtttttctgaattttttcagtcggtggcgtctcaacagctcggtaggtgcgtgagagagtgaggaggaaacgtcgcatttgacttgtgaagctggtcattccttttggcttttagatctgcgtgtactgcttgggcttgatgctttacctgccgctgatgtttgaagtttctgctaattaatcaggctttgctcatcacagagaaaacacttaaaacacccacttgctgaagctggtcaatggtgattagctatactatttgccattgcagcatgtgatgctcgccccgttgatgtagtatatatgaatactcgagtcaagttttggagcaaatgagaatggtgatctgcattgtcaacggttggctcttcctgtaattatattcactgttcagagctaacacatgctcggccatcttctgccatgtctttcttttgcatttctgacagatcttctgccatcagccatctctagtagtagtagtagtagtagtagttgctcagtcgttagatccattgcaagccaagatttgtagcatgttccatgttgtacattgctgacagaggattcaacacacgattttgactgtgcacattttatatggaaacaacgctcagtcaatcgacaactttcgtgaccattttcacccagcctgccatccacgatccagattagtaaggcagaaatgggctagaatgtaatggtgcttgtgttagagccacacgttgcagctgctctccacacggtacagtggatgagtggaatacagtgtgttgccgtcagcgatcgagtgctttgtggagttcgtgtgtggacagacttcagcaattgtgtagtagcagctggtggcaggctggaccattctgtttgggccggtcaagctgttgctgtactttagatgggccttgcaccatgaaacgaggtgtcaaattttggcacattcaggcccatgaaaaccatcccgggctataaacactagcataaacagtactggactcacagcccaaacagaggaactgtttcagcccacaaagtcaaacagtactggactcagcccaaacagaggaactgtttcagcccaaaaagtcaccagtagccctgttagtgttagcccacgcatgaagtcatcgtcggcccattatcttgggccgtgtcagcccatgaagtcatcgttggcccattttctggagattggaatttccagtcctttttgccctgttctttttcagcccattcactaaattattaaaataaattatttgcctcacgtttcaacaaatacgtttattttttccaaaaagttttcttgcactgtcttgcgtagatcacttgttttaaactatttgttatgtttatttcttaaaatattttattttgctctatagttaagtagaatagtagatactccctccatctatttttaatagttatattttcaaatctgaaaaatttatttttatagacatatttcaatctaacaacctatcatcttaatgacttactcagatttaatgcgtaaatatccattcttccacacaagattggctacatgggcatcgagaaatgtaaatattaatgaatcgcttgtttacgaggaatgactagtagcatgtttaaatagatgataagtagaattacttatctttggtctgtgtgccaagatgaaatatgactatcaaaagtagatggagagagtaattcacaaacacaatgcttttttaaaaaaaataagatattttttttgaaaagatgacaaccacaatgctttcaataatctagggcctcgcaccaaacttccctcaaactcccaactttccatcacaacacgttacatctaaaactttcctactcacataaactcctaactttttttctaaactaccaactttccctaaacttctccccaatttcagaaactaaacacaacctagattaaacgagacagttactttcagtgattcacctagcagcttccaggtgtgtatgcactatgcacacaagcagttgcactgcaggttcaagtgccccatttgtgcagcactcttggtgaaacagtatcagcttaagcatgcacacaaacatgcagtacagtgtatcactggtgatggatctgtggatatggtggcatcaggtggaccagtactacacattgttggtatgtacccctccatttttatatcataagtcgtttaacttttttgttaattaaatttttttgagtttgactaagtttataaaagaaaattctaatatttttcatataaaacaaacagattatcgaaatatatttaatgttagatttaataaaactaattcaatattgtagatgttgctaacctttttttataaacttgatcaaacttaaagaactttaactaagaaaaaaaaatcaaatgacttttaataggaaacggagggagtacctcccaactgtagccatgcatcatctctgcacattttctcttcttgagcccaagaactgaacaaacaaacatgcagactagatagctcctagcattgcctgcatcatcatcattcgtgtactgatcaatcttgttacgaatcatgctgcaacagaggcgacacccaacaaaccagagccatgcctcagatctggtcgattcattcattccgatatcgatcgatgcgtccaaacctgatcgagcttgcctgcaggatcgcccctgttgcatcatgcaccatacatgatgcatgcaattgcaattgcagctgcaaattaatttgcaattgcattcatcagctagcttagcgaggctgcatatgcagtgaaatgtgcatggatggatggaagcaagcattctgttcagtctgatcaggagacccagcaagcatgtgcctccagaaaagcagcttctctaactaaccaggccctgttcatccatcagactttcagtggccagcttgttattatgggcctctctgattatctctttttcttgccctcgatctctaccgactgcctgcctcatcctctgctgtgtatgtgacgttagctcctcgatctcatcaggcaaagatttattacatcgccatgcactgaacatgggagactagcctacatttgctaacaacttgtggcgccgatttggaaaagataaacgggcgaaaaatttggcaatttgcactctaggatttggatgtcacaagaagaggttaggcaagagcaccaagcagtcaggaacttagataattaattattgtcccaagaagtaagctaagctaattctattgccaactagcaagttaattggtctgtttgatttagattattaagtgaattactaattctcatagattatatattcacttaattagaaacaaaaaaaatattttaagtaataattttaatgaatagattaaaataagtggtctaaaaaatatagtaaaataaactctctctttttttttaagataacgcatcttggaaacatgggacaaataatctatttcgataataatctgaaaagagcgcatgaaccggatgacgcatattaaagttcatcatatccactctctgaaatgatcgatctgcttgctaagatggaaatatccagagagtgatatatgatccaaagcagagactatttcccggcttttttggcacagtgaaattttgctggtccgtcacctcatcggtcaatcggcgagagagcatgcatgcagcaatcatttcttgcgtcctggactttgattattgatgctaactgctgcatgctctcgatccagctcccaactttctcaaacgaggtgggctactaggtacaggccagatcgatcggaattatattcattcatgcagcaaatataaagctagaaaaaaaagatcatctcctagctactagataaagtgagaaaaagacctgtagttttggactgatcactgaacaatataggtagctaggggagttacatttcacttggaaaactctgattgatcgatcatattcatgtagataattagatattcttgcgtgacgcaagaatataccggattagacgcacctaaccgaacaattacccaaacagtgcagggatccataaccaaaacaaaaatgcgatgacaaaatggctaattaacccgcccagaggattgcacatctatccatcacatcgcttgtgcatgactcggcacaaacatgcacatatcagcagtggtagctagcttatcaagagacctctaattaatcatgctctttgtgccatgaaccggggaaaattagtaatccaagaatgccgattctagaggcagcacacgtacatagatcagatttgtcaggcaaagaagatcaagaaggagcaagcaatcaatcataaatgggcaggcatgcacctgtgcgtgtaactgaatattcagctagcgtttgcatcattcagatgtggtagtagcagatagtagctactccagtagcatacatcgttcgtcaggatgatggtcagatacatgcatggttaccgactgaattcaattggaccacagcatcgatctcctagtgtttctcctcccccgcaaggagtcaaattcatccccaaggatgacgcacgcgcaagtgcagcccagccagctactatccctatcttgtactgtctcactttctagtgggcagctgcatctaacgaggacactggacacacataaggtgtgtttaaatgcgagtggatgatggacattggcttcatcttttcgtttatacttatgcttatcagctaaaattttaatttttaatcttaaatttaaagctgattttgatgttttctttatcgaagtttatttttcagtctttgcttttagatcgctaagaacacatatataaaagttttattcacaaattactttttgtttgcaaatatgccgtttggtttattccacgaaccaatgaattaactactagaaataacataatccgccatccgttagctaaaaataacataaccttaatataagggtccgtatatgtcagcgcataggctataccaaaaaaaagagatgttggatgtttatgatgtcatgacatatacgatcttatagaaattgaaaaggatgattttaccatccttgagaaagtattaggaggtattatattttttagtgtaaaatttggtaccaaaaattttagtataaaatttaggtaacttgagatactctctaaaggatcataaaattactcaattaaaaatgtttgaaccaaaagagcttactccctctgttgtcaaccggtgggagtaactgaaagattcttacaatgagaattgttttttagtttttgagaaggtgccaagagatttttacattttatagtataaaacttgttatattcaatatttgatatactagtggtactaatttttaccataaaaaagtggcctcgtggtaccactcaaggaccgcaaaatcactcataaaatattcaaggccagtcccttttttttaaaaaaaaatagatactcaaggctaattgtgtaattcaaagggcttcataggaaaaggtcccacaaagtttcaataatgaaaaacaaattcttctcagtaagtactgttgctaatattcgaccttgacatacataggtcaggctgtcaaaactaaattatcatggccttcatggtttcaggcctaactactagggagctgtacagtagcatggaaaactttcagtcaggccggccaaactgttagaggcctgtcactgtggtaaactatgaaactgatgttactgttgtctgttgaagttggacaatggacatacctacctgtgctgtatcatcaacattatagataggctgattttgtttcctttccatgatttgtatagtactagtagtgtacaataataccaccaatgtgacaaattcagttggattagacgtatgagcgagcctagcgaatatgtagacagtgctcacctacagtgtcctagctcgtcctaacaacctgcaaattgggctacaattgggtgccaccacacgatggataagaggaggtagatctatcggggaaaagcctgcctttcctctatctagatcgaccgatggataacaagatactattattcagtaaaaacactccaattttcagttctgacagttgtgtacttccacgttcagaagaacaagtcaggacagcactgtaaatatgacagctagtgttcactgaatgccaactcggtggtatagcaattcagaggtcagaacaggaaagctagtgtagtggactctgaagattggcatgatggagaaaagaaagttcagacttctcccatttcctgggagcatatagctagcatatgcgtgtctcattcccattgcatctctgtatcgtcttttgcaccgaatgcacagcgcgatccaggcaacgatcgatcaaggttgtcaatgaaaagaggaggataagaaaagctgtgcaaccaccgggccactccatgtgtgcatcgatcccaaaccaaagtggaggaacaacttacacacatcatttgccttacagcatgtcacacttactagtgacagagactgaaagttttcttattatctactttgcatctaaattttgttgagagttatatataaaatttgttttaagtactaaggacataactcgatttcattttgttagtagctccaagaatcaaaattagtagttactagaaaattatatgtagaatgcatcctggaatatcttaccaaaaaactgcatgcaccatagtacttgtgtactccaagatccttatgtacggaattttgcagctacttctacttaactgtcattcatgtcattttcagtcatctggagcagtatagtgtcaatgcctgcttgagaggaatcttgggggtcaggtaacttcacatggagacctcatcaccgagcctaattggccttctccagaatagaagatgcaaaaagaccagcataggattcactgcaaatcatttcgcacgtttccaaatagctcttacagattaaattacgagatgttcaatcagtctgcaataacacccagttgtttctgccatttcatgacaagaacattaccgtatgttcggtgtgcattgctatcatggagtccgatagttccaagccacaaaatttcagaatccagggcacttggattagtatggttgagagcgccatgaaaggaaagaattacaaactgttgcttcttatgtactttaggaaaagcagagagcatcgtaatggttgtgtgttcgtttcccgtcaccagtcacactgaaatgatgcaaaccccgcttgttggctgcctcttatctttttgtttgattccaattctactaatcatcatgtttcttgctccaaggtatctctatgctgactctgaaaaaaaaagggccatgcatgcatgatagtttcagtttctgaatgtgtttttccagatttttcacatactttggtctttgcttagctctgcctgcatggttcgttgactagcataaattggttcaggtgtctccaattacattgcacgagtcctcgtgtgtatatggatcagggtttggttcgaaatttcagtaatttcgcctcccccctcccactggcaagctcacatctcgcccgaaattttcccttttttgctttttttttgtaaatttggttaaattttattgaaactcatttaaaattagtcaaattttcaaataaaattagccaaaaacttccgaaattttgataattttggtccccaccggcaagaaaactaattccaaaatttcaaaccctgatatggatctggccgtctaattgtgcgctataagatttgaaactaaactttttgaaatttagtttcaggaagacactctcgatggtacaataatgtatcaggtcttttgcaccccaaattggaaaggataatgaggtactccttctgtcccaaaataactcaacctaggatgagatgtgatatgtgacccattcttatccagattcgttgttctaggatgggtcatatccccctaggttgagttattttgggacagacggagtatgatgcaaatatactcttctttcgatcatcaatagcagcataaagcacctgaagaaagtaggggggggcttcaaatgaaaacgttttagtattcagtattcattccgagggaacttacttcctttttctttactatacacggtacaaatacaaatgcttacaaacatacctcataagatggtgggctagctagcctggattcaaagtctcaccttttttatttatttgatattagatctttccctagtgttcgcatcttttttttaataaagtcacataggcagctcgctatcgacaaacacgtcgtatacaaccaaaagaataattacttgaaaatacgagttggaacctgtgtatacagattcagcttcgcacatcaatctaatttcacaatgaagatgcttatagagccataattaaaaatcttgaatcctaaaactaagaagagaagaaaaagaaaaagttggaagaaaaaaaaatagaaatgcctttttttctgtgggccccatgtgactttgatcatgtcagcagggcaggccggctggatcagttataaatagttccaagtccctcataacttcctctccatcagaaaagcatcactccataacatccttaaccatttgcacccaagaaacgccattgatgatagggtaagctgctgagctaagagtaagagctctcacattagctagctgtaccacacactacactagcagctggagcagcacacacatcacactacaatgtgccactgctcgtccaaggtcgtagccgtagcacaatgccaccagcctctgctcccgccaccggaggcatgccccgccctgcatgaccgccccaggtcggcgcgcggcggcggcggcgcgatcgccgaggtggcatccatcgtgcggctcgccatgccgatggttggagctgggctgctgatgtacatgcgctcgctggtatccatgctctttcttggccggcttggccgtctcccgctcgccggcggcccctgcgctcggcttcgccaacatcaccgggtactcggtgctg

SEQ ID NO: 66418 - DNA, 4945 bp, Oryza sativa
ggcgcgacgacgacgacgacgacgatggagtgggggtggttggtgaagctgtccgtgcacagctgcatgtcggtgtgcttggagtggtggtggtacgagatcatggtgctgctctgcggcgtgctcgccgacccgaaggcggcggtggcggcgatggggatactgatccagaccacgtcgctgctgtacatcttcccgcactccctcagctgcgccgtgtcgacgcgcgtcgggcacgagctcggcgcggggcggccggagcgcgcgcgcctcgccgcccgcgtcgggctcgcctgcggcgccgcgctcggcgtcgtggcgtgcgcgttcgcggcgtccctgagaggggtgtgggcgcggatgttcaccgccgacgccaccatcctgcggctggcgtcgtcggcgctgcccatcctcggcgccgccgagctggggaactgcccgcagacggtcggctgcggtgtgctgcgcggcagcgcgcggccggggagggcggcgaggatcaacgtctcggcgttctacggcgtcggcatgcccgccgccctggcgctggcgttctggccggcgcgcctcgacttccgcggcatgtgggccggcatgctcgccgcgcagctggtgtgcgcggcgctgatgctgctcgccgtgcggcgcaccgactgggacgagcaggccgcccgcgcgcgcgagatcaccggcgccgtcgccggcgtcgtcgttggcgatggcgacgtcgtcgtcaaaggcgatcatgcagacgccgccaaagtaaaggcagacagtggcttgctcgtggtcacagtgctaagttgattgccatataatggagtattcttgactccttaaaattcgtttttttttttacctttttgatctttttttgaagcatccattggaaatttttaggtattgaaacgatggatatttggatgatacatgcatcctactaattttttcctcttcgaaaaaattaactatgtacatgatcgaagagacgagaaatcttctggcaaggtaatcgtgtgtgtgcactattatgcagcagtgaagatcgagttgcaaatagcggcacggtgatgtgattgtacacgtggcgccctcacagcgctttggcctaatctagtatatacttttgggccctaattaactactgttaaaccccatatatatgcattggatctcattattgtgaagttacttttgaaaggatgcatgattatttgatagtggttataatcatctttttaatgtgcatgcatgcacaacctccatggctaatcactttctgatcgatttggaattatgcatgtgtcttttggatctatgcatatggccagggtaatctatggggttaaattaagatgattgagctgaagtgcacttcagtctgatcatttacatcattgtcaattattttgctgatgaataattatgccaaatccgacagacaaatcccttttttgtcggtgtagaaatgacctctctgatcagcacaccatgcaaaactattttcgtcctctttcgtcagatgcattatgcaccaaagtacagtcgttaatataattaggctgatcgagctccccactgccatgtcaaaagattaaaaagaaaaaaggtgattaattaaatgtactactaggactagctactaaccagttagccagctatccctctcaaaagaacaggaaagaggttgctgattggagccctgtttggcccgggaccggaagccatttgggattcctcatcaggagacagctcaaatccttgctgattgcagtatgttaacatcaatcacacgaacacaacacacatggtaaagcccttttttgcgttattgcgcttttctactgttgttgttctgtactactactactttgtactttctcttcttgtcctgaaatgatatagaaaaatggactgaattggagcaaaagtagtatgtagtgctaggtcagaaacattaattagtaataatatatatgtgctaattcagttcagttccgttttgcttagctgtagctcacttggtttagttaatggcttaatgtcacaacaaacacacctaggctgtttcactcaaagcagcacacataacaaaaggagagattcctctctccaagttccaacaaaggtgagcttcattacacactgatctacatctgctttaaacctagtcagggcacaatgcattacattaacttttgtcagatattgtatttttctgtcagatattgttaaaaacgtactcatgcttggaaaagtgtctgcatgggtgtcaactactccctcaattccatattataattcgtttgtcttttttcctaattaaacttcttttagtttgattaactttatagaaaaatatagcagcatttttaacacaaaataaacatatcatcaaaatatatttaatgctagatttaatgaaactaatttgatattttagatgttgctaaatttttctataaatttgttcagacttaataaaatttgactagaaaaaaagataaacgacttactataatataaaacgaagggaataattaacttgatccaattaaagtttctaactagattggccgtagatgcagatatgatatgtgccccaggggcctaggtgtgtgtcaaaaaaaactgtgcattgtttgcgatccacgtaagcaacatgacacaagatgtactgtgtatattaatctattagtaacattttaaaacacatgattacacataaggttctgaacctacagtactagacaggtagctgatgttccctttgctaacgagataattaaagaaactactaattaattagtagtggtcctctgatgatatccaagagctaagccgtgcccaataatgtaacataaaattgtccgaagactatataatacctgtgtggaattgtacgtcgacctttctcctttgtggatggacaatttagaaaccagattgcttatgtgtaactgtaaagacggccaaaaggccatgaataaaaaaaatgttcagattcatcgatcgggcctgaatgtatctgaaattctctctgaacatacgtacgcacgagcagggcagctcagagcactttgatcatcagggactgaactggcggctgccatagttaatttagctcgatcctaattaaatgcctgaacagtacttgagcttaatttgttaactaactgatcagtaactggctgcgtgcagctgctagctaatgatcaattggcagatatagaactttatgaaaaggaggccacatctttttgtgcatgcatgcatgcataaaatgcaggccatatgatggtgatgaaggaacgagcaagctagagagatcaatcgatcgattgagctgggtggcctcatgtcagccaggctcgtagagttagacacttagatagatagatactccctccgtctaaaaaaccaacctagaagtgggtgtgatcccttctacttccttcgttttataatgtaagtcattctaacattatccatatttatatagatgttaatgaatctagagattcattaacatctatgtgaatctgaatgaatctggataatgaattatctagattcgttgtaagaggggtcaaatgctgattttttttgggacggagggggtagataggtgcaagtgggcagacatgtgggataatttggaggaacgtaacgtgtagggtacagtagtgtttgttaaggcgtaggcaagcagcacggcgatggcgatggatcgatcagtgtagtacgtggatcgatctactgcaatgtccaatggcagcatgcatgcagttgcagccgtatgtatgtgcgtcacccagctatctgcatgcctgcaattcctgtagagaaccatgtgtaacctgcactgcatatatatactgacatgaacgaacgcatggcatataagagagactgacatgatgatatatataccgcgcgcatgtgagaaattaattgaaactgatctttcgatggatgggccacttttgtgtagagatgcaagcgggctaacccgtgaccgtgaacagcttatagacaaaattagtgagtaatccgccggttacttactaatttaaataattattatgggttgatccacttgcatctctacgacgcgacaagccaaactatgatgtgaaaactcacggattaccctttacttaacatatataagtagttttgtagatcggtccgcttgcatatccctacttttgttgtcggtcatagtgcagtcgcgatggatcgatgaagacgacgcttggtggtgtggtctctgatactgaattgaaggcaacttttaatttaggccatccaataaaaccgatggacgccttgcagttagttgcaggccagcaaataaagctagagatcgagcctgcatgcatatatatcagcatatggatggctgtattttagcctgtgcatgtgcatgtacattgcacgttagctagatcctagaggtagcaacgtacagccaacgcatactttggtgactttggggaccgataggaattacgtacggtacgtagctatagcagtgtgcagtgtgtggtgtgcatgcatgccaggagtagtaattaaaatgagtagtaggagaactgttttaaacattcgggtggacgtccacccgtttcttgtatgtcatctaaatggttatgaaaaattttcaaaaaaaaattgacatgataggttaatatgtaatatatcatctcacaaacatgcaaattcaaattcgacttctacaagttggaacaagaacaacaaatttgactgtgaatatacgtatactagttagagtttaatttgttatttttgttacaacttgtagaaatcgaatttgaacttacatgtttgtgaaatgatatattacatattgaagtatcttataattttttttaggattttttcataatcatttaggtgacatgtaagaaacgggtgg

SEQ ID NO: 66419 - DNA, 12858 bp, Oryza sativa
  unsure (1)..(12858): unsure at all n locations
acggacaggtttgtgaaatgagatatgacataggggagcatgcaatacgtagctatagcattttttcattatcagttaggttgcatgtaacaaacgggtggacgtccacccgagagattggtggtatgtaaaaaatgggtggacgtccacccgagagattagaatccatctcctgagtagtagcagcagcagcagcagcatgcagattggattttggttgggttagatggggcgtccctgtcgacacacgagtggcacagtacgtagttgaaaggagatcgatcctgccgttggcgagaggcgccagaaataaacgtgcgtcatccaggctatccatgcgatgcatgcatggaccaccaataatataatccactcgtgctatagcctccacctgagacagtgctcttaattgacgcaggcgtagatatcagtagatagactggcagccctctcgtaagtagtagatccagcaacagatgtacgcgcatcgcatcatggttggacaagtatgtgtggtgcataagagcagggtataagccagctgctaacatatatgagaaagatcaataagtagaaagaagagcaccggaatacatatgtgtagtcagctgtagcaaggatatcaatacacggtgtgtgtatgatatatgggaccaggtattaatattgtagtatgtaactattgtatgaatgagctattagattggctatagatgaattggagctagtagttggctatactgttaaacttgctacaaatcatctatagccaatttaacagccaatttatacaatagttgtttattatactattaatatctggtcccacctatcatacaaacattacgtcttggagtccgtgctacagctgactacagatctgtagcccgctgctcttctcactcatcttttatctctttaaaatatgtttatagctggcttataatctattattgtacctaactatgtaagcggaccgacccgtgaacctacttatacgttaaataaagggtaatttatgggtttttcacgtcgtagagatgcaagagtggatcaacccataaattcattaatttatagattaaattaattagtaggtaatccacaccgcgtgttttactcactagttttatctataagcgggttcacggtaggccttgcatctctatcagttgcatgccgcgcgtgtgtacgaaatgaagaagagaagaggcatatatatgatgtcgatcccgaccggctggcccaatcgtgcggccgccacgcgtgcaccggccgacggtatgaccaatgcctatatatagagatgatcagatgaccacgtacccggctggtgtatatacatatagctagcaagatagacataataagctaggagagcttagtgacacatcatcttacagatgcacgcacgcacgcacgcacgtacagctagtgtacaccacacaaattaatctcagatggatcaatcgatgatgccaaattgccccgggccaatgcgtgcgcgcgtacgtctacctatatatatcatcttcatctccaactatttaacatgcagagatatatgcagatgcaggcaggccagcatgcatgttacatagtccttcgtccgtttcacaatgtaaattattctagcatttctcatatttatattgatgttaattaatatgtctagattcattaatatcaatataaatatagaaaataactagaatgaaatatacagtacgtagtatatcccactttacctaatgaattatctatatctagcactttaatgcacgagaccgaaagagacatatatggccaaccggccgccggggcctccatcgccaaccgatcgaccggttgcgctgaaccctgtgcacgcggaggcaggcaccatgaacatccatatgcacacaccgtgtcgtcgttgcgtgtcgcccgcctcgacgcacgttggtcgggacggagtcctagtactattccacaactgttacgtttgtgctgcagccagctagtgtctgacgtcacaagtgttcgtccgatccgtcgcgtagctaccacacacgtacggggtacaccttaatttgccggctccaatatggagtacgtgtacgtcttccagggggaccaataatcatccacacgcatgcttgcagcacacactactgctgcactctactcacctgcatgcatatgcctctgcacacacgagatctagtcgagagtaaactaaccaacacgatcgatcgatgccaccttaattgccactggccggatagcgcgcacgacaacacgttggtgaggatctcgatcgatcgaagcaaattaagatgaggatagctagaccgggaggttgatttccacatgcttcgcgggtaaaacatacgtaatccctcccgtccaaaaaaaaaagccaacctaaaaaatatgatcccttctaatccagatttattatactagaagggaacacatcccctcttaaattgacttatttttggacaaagggagtacgtacgtactcgatcgatactacctagcggacctgtacatatgtcttatgggtggcgggcatacatggccattattcatttgatcgggagctaccttgggaaaaatatatactgctaactttaaaaaataatgtaaacctataaatcattgtactatttaaaaaatatgtatacatatgatcactctaattaaaaatttgatgtggataaatttaatacgtccatttctcaatactccctacatcctaaaatatttgacgccgttgaattttttaaaaatatttgaccgttcgtcttatttaaaaaatttaagtaattattaattctttccgtatcatttgatttattgttaaatatactttcatgtatacatatagtttttacacatttcataaaagtttttgaataagacgaacggtcaaatatgtttaaaaaagtcaacggtaccaaatatttaaggaatgagggagtactatgttagttttcagtttggcactataaatatgcgattttcattacatgttttcgatcccttccctcccagctttgcaccaataataaacacgtactccagctttgcacgcctgatactaccgtgagcctgtgcatttcgggcctacagctacatataacaacacctccaactgttttgtaaactgtataatatttttgtatcttcgattctcacacgagcactttgattccctgtatgtatatgttcactgatctaatttactcttacgggaatagtaaatgaacgaatgatccatgctatgagcaaacgggcacagctagctagaaatggctcttcgcctgctctgaaactcatcgcacgcattgcttgcttcatctcctgttcttcaattaactatacataatcatcaatgatagactaattactatacatgatcatcaatcatagactgattactattgactgtatttaatttgagtacttgttgatgaagtcatattcgatctcttatatggttatctgaattttttatggcaatgctgcatgtgattctcgtacaaacatatattcagccatacatcgcgtgacactggttatgtataatacatgtgtgaagttgaccgatcagcgaatatgtgtatcatcacggatgaacgcataagagatcaagttttgacaattgggcgcaggagactgtatccttatctttcgtccaacaactagcttcaaaccatgcatcacgaatgatgttatcgccttatcgggggataactaatatatttgttcgtgaaatgcatgattaattccattcaaacaactaatttaattttggctacgattaattagttaacttctatgttataagtaatgtgttgaatgattgcaaagtgaacgtagattaactggttagattccttgtggtagaacaagcctatccggttcaaattttcgacttggcacatgatagtctacgtacctgtcgacaatgagacacttgtaatgacttcgttagtatcaagaatacgtggtccaaccatagaggtagggtgtacgtgattatatgagctctaatatttgtattgtgttgtatgattgtaagtagacatacttgctagagcggcatgatcacatatactccctttattttatattgtaagacacttttttaaaatttaagtttgatcaagcttatagcagaacatagtataccattttcaatcaaataaacatactatcgaatatattcaatatatattacatctaatgaaactaatttggtgttataagagttgctacatttacttataagctaagtcaaacttatataagtttcttttaaaagaaattaaagcgacttagttataatttgaaaagcggggagtatttgctaaatgtggatcagcagagcatcaattccgcgctggtgagccggtagatagtcgatcaggttcgtcgcagttaactaaaaaaaggaaaatctatggctacctgactagatgaacaattatgcaaatcatgatctcgtcaaagcctaatctctacatctgttaatttaactcaatatgttggggtttcgcctccattgattccattaatctacttgctggctgcaggcccatgccattatataacagcaccattttccaagtatgttaagcaagaggaggcttatatatgaacaaaagatcttttgcagtcggcattgattgtaatccggagttcctctagctgaagtactctgtcccagattaattaatgcgttatcgagatttggccttaaaatgctattgagatttggcctgtcttttaactattagagcaagtttaataatatagccaactactagcttcaaataatttagagccaatataatagctaattcatacaatagctgcttactatactattaatacctggtctcacttgtcatacacacgttacgtcttgaagtccgtactgcagctggctacagatctataacccgctactcttctctctcttcctttatatgtttaaaatatatttatatctggcttatagcctgctattgtacctgctattaaaatggagctgtagatcgagatcgatcgatcatcagtacgaggattcagcatgaggaagtacgtttagcctgctgaacatttgcctatatatattcagatcatgtaccaaatggttttaattaataatggaggcagatcttgtaccgatatatctatatctgtatgcatcgtcaagttgagcgcatcggaacatgcattactggctctgtatgatttggcagaatctgaatccttgtccatatattgctagctagctagcttgacataaatcgatcacatgtatcctcctacttgtaaatattttcttttccttgctcgtgaagcgaatctagcagcatgtagtcccaaaaaagatctacacataattatcagaagcttaagataatcctgctaagaaatcaagcttccaggttgtgtgtactagtgtaatgtttggtttaccagatccaaacaaacagcttgaggttagcacttaggagtggctgtagcagtgaagttcttcaggtaaagaaatgcatgggcaaagtgatcagcggtccttatattgggccgtacagtaagcccaatacgacccgtgcgaactgttgacttggccgctagcaatggtagcggcccttttgttgatgggccaaacggaggcccaacgttttgcttctaggcctgctcagccggagctctcagggggttcggagaaaaagatgccgaacccaataaacggcaaagtatcctacgcacacataggcttctcgtgtacactctctacataccaactagtaaatgtcttagaaaattttacaaaaaatatgacatgtactcttaataatactacacatattacaaagtcttacattcaaattcattgtattttagccgtaacaaaaaagagaaaaatctaacaattgtaagagtaaaaaccagtaagaattgtcttttttttttgttacggctaaaatataataaatttgaacatgagatttcatagataggtgtaatactattgaaagtatgtgtttaattttttatataattttctgtgcacgggaagcttgtatccgtagtatatgttcccccaataaacacggattcaaaaatgccggcagcccggcactggtgctctagcttgttcttgggcatcgttcaattggcagcagcacatatagctgcatacggctatatatgtattatttcatagatgattgatgatttctgatcgatgtcaatgctagttaatttgtttttgcaatttggacgagcttggaggtccctcccggccctctgcttataaaaacaatctttttgtgtttgcactgtatatgtatagatggttgctttttgggggtgtgatttgaaactctagaaagtatatctcctcgtttttagagcttttttacggtacattctactgctagtatatactaccagtatatttgatctgacggtgtaaatttatctgatttccctcttaattatactgcaatataaattggatagggtatatttgtctttttatctttttgcgtgggagggtatttttgtaaattaatgcgaactcacttagtcagatccgtttcaccacatcgactcaaactgaatccgctcggctcgcatgggcgaccgccgccgctggcttctatgggcgccgcccccgccgccgacagccacagtcgccgccgccaccgggagccaaaatcggcgccgccgccatcgaaatcgattcgatttccctcctcctttcctcctctcgtgtcttttccgtccacccaaaaccctatctcttccaaaaaatccccaaatcggcgccggctgctgggtctacgggagggcgccggctgctgggtctaccgaagggcgaagcctgctggggaccttgtctgccgcagtggcaggggcagccggccagcggtaggcggcagcggcaggggcagcaggccggcggtaggtggcagcggatggctgtcgcggggcagaccctcttgttcggcgcgggagcgatgtgcaccaggagcagcgacgctggaaacgcgagatgtatcgagaagaagcagatgacgacatccacagaaaaaactaacgaaggaaaattaatccggatgaaattaattctctaatttaaaggaccaaaaagccattttcagacttttacctaataccaaaactacccttgtatatactggtagtatatactagcagtagaatttaccgtaaaagtcctcttattttatactaggtatcaactcaactgtaaaattggaaaataataatgatatgatatattaattcacaaacattaagttcaaatataattacaaacatactttaatttgctaactaacattgcattataacatacttttaactttcataagaaaagctgcgagacgaacatcagccagatggccaccggctgcatgcatgcgctactgcacacgctctgttgagcgatcgccggctagcgggagagatggatcagaccctgttaacaaatggactaaataagtagtttagtcatgcgtttggcaggtacatcgatctcgatccagacgacaaaccaaatactcgtagctatttaaaggcttaagcgctctaattaataatcacccctaaaccatatacactcctgtaacctctgcctgccttaagctaagccgatggagatcaagctcgtcttcttcttcctcctcctcctgggttttggcaacgcggaggaggaactcgacaccgaaacctgcgacgtcgccaagctgtcggccgagattggcacctactgcgaattcgaccaagggaggatgtaccccggccggtgctgcgacagcatcatcgacgccgcggatgggcacgatggcggtggcactcagtgcatctgccgcgtctggatggaggatgcggtgagaaagaccgggatcactttcagagagttgttgcataagtacattgattgtggtggtctgcagcccagcctacctcatcttgccgactccgcttgctcagctggtaagtaattaagcattaattgcgtctccatctcgaatcgatcagtctctaattaacttttgttgtttcttccttttctgatctgtctgattaattcacttgatcagctcctgagatggtaggcacacttccaggtccaggcaagatcagcggtgcagacaccaccaacgtcggagtcatcttctccgccatgaggccggccattatcgtcaataaaatgctagctagtacttgatacatatatatagcgagtgttcgttggggtatttgttaagttaatttagtgttattgccggctaataatatatatagtagagaagctatgagtttgatgtcatattgcagtgcattacatcgttttgttattatattttgaaagcagactgtaagttccctgacgctctatttgagagataaaaagattattatgccgaaagagatcaactactccctccgtcccacaatataagggattttgagtttttcttgcaacgtttgaccactcgtcttatattcaaattttttttgcaaatataaaaaataaaaagttgtgcttaaagtattgcggataataaagcaaatcacaaataaaataaataataatttcaaaaaaaaattaaataagacaaatggttaaacgttgtaagaaaaaactcaaaattcttatattatgagacggagggagtagtagtctagtaccagcatgcagtgtgtatgtttgtgtgtgatgttgatttgttttctaattgcatggccatcagccccatgtcttaggttcaggtgtcccgtgctgaatcttgaaagtgctactagtttgatggctcacagaattttcataaattcggtcaccatttaatgcatgtggcccttacaccacaactgtaatttaacagatccgatcaaacagctctagtctacggatttacccagaaacatgggtagcggtttaatctatggattgatagtaactaaaatatatgtttctgttaaacttttgtgcttgagagatgttctagttgtttcttttttagctgtgtgtattttatgcagaggccgggggtgactcagtttgattatatcatcttgatgtaaataaagcttccattatcttaaaaaaaaacagctctagcacttaggattagcggtgatgttcttcttcttcttcttcttcttcttcttcttctttttaatcagccgtgatgttcttcaggtaaagaaatgggtagaagtgatgaaagatcagaccgagacaggccgtcatattgcgctcctactacgcagtaagcccaatacgacccatttgttggttcggtcgatttgttgatgggccaaatggaggcccaactttgtgcttcttgccctgatctgacggagcgctggggtcggagaacaagacgccggcccctactcatcatagctactgattgaatacaattatcattcttctacattcttgagttcctacttgtaacagtctcgaccgcttcgtgcgacgttgccaagctgtcgactgagattaattggcacctagtgcggttcagggaggatggacggcgttgatcagtgctgtgacgccatggaagctcggtggtgctcagtgtctctgcccgtcgtttctacttgtgggttatgttaccgatgaaaaaccatatacatgggtcctcctattcgtcgcagttatactttatttgttaagtttagtgttaattattgtctgctaacagtggagagctatgagtttgatgtcaatgccgcattgtcgttttgttcttttattttgaaagcagacagtaataagttcgaacggattctaaatctctcaaatagagcttcagatttaatgttcagtattatgctagtactaatgttttaattatgtgatactcctatattaacattgaataatgtgactgcaagcaattagcttgtcaagataaaatcatgccatgttgtgttagagctgcatttatacttagaagacagcatgcagctgttcatacaacccccaaagtacaatccctattattgtgtccctaaccagccctttgatgagtgagcttgcncaggtatcagatgatgctctaccaacaagatcacggaatctcaagtctccttgatcagaaatcagtgcatacaccacaccattcatatgtccctttccaatgatcccaacgacagttttgctcttgtttacagctttgctcctcttcagagaccatgcaaggaactgtaaaacagacgacaaattagcttcagatagattgttcaattcagagaccatgcacttggaagcaagatacgtaactaattaactttctgcgtatgagtgatctttctgcaggttgtaaaattcagacaagttaccgaggaatataccatgtcacgctcatgtatcagaggttgcagtagtgagggatatgagatgctcagtttctcatacaactcgtaggggctacctgcagctttctcatcctgctgcattaccactcaaacaaggatatcgacgtaaataacgcgaaaattatgttttgcaatgaaatgatttagaggaaattacactcgtgtaaaaatgcaacactgctgagaacagagagatacttctaggagtatttagaacttacacttgtgtcagttgtagaggtaattccacggaacaatgaaactaccaatttagtcttctcatcccagctaagggatttccaagctcgttcaagctgcaacaacaacttggcatgagcttcagaaaacttatcatttatattttgcgcaactgcaaatcggaaaagagttcgcagatatatagtagtagttgtatatatacagttatttcaattggacgatccccaagaacgagctgagcgccaagatcttcagacaccttcctagccgctcggaactagcaaatgatggagtaaaagaggaattgttttcaagagttgaattaaatcatcagaaaaaaaatgaaaactaatgacaggaataatttaattacacctcttctccgaagggccggtttgcaccagaagagatctttgaggagaaaacggcaagaagcagacgcagagcaagtgcagtctgcccacctgcaagcatcgtcccaagcagaaaagaattaccatcttctggctgattggcagtaggattatatcattgtagagtgaaaaagaatttcaattacccagattgatgctccggttgacggctccgaagaacttggagccaccgagagagaacatgttggatttgaggagcggctcgccggcagaagaatcggtggtcacgtacatgattccagctctgcagtgaaggctctgcaatggcagcaattagctcaagaagagatttcacggccatgtctgactgagcaggcctagctaacgacgatcttgcctgctccggcagagctcgacgacgacgttgtccgggcggacggcgcggagcacccgctcgacgtcggcgacggactcctcggagaggtgggacgtcccgaggatccagacgtcctctggctccacgaactccggcggccgccacgccgggacgggcccgaaccgccgccggggaacgcgcaccagtgcgcctgactcgaccagcgcggcgagcgccgggtccgcggcggtcaccgcggccgcccgcgtgtgccccagcatggcctccctgtagtcgaagcacggcggcggcggcggcagcggcggccggaacgacgccgccgtggatggggtgggccccgctgccatccctggcgcggcgcggcgagaggaggaggatatgagagcgcgacgcgacgcgacacggcggtggcgagccgcggggtcatacaacgttgtggatgacgtagatgggctcgctgcctctcgcaactaaagatttttttatccctacttttccttgatttttttaattttatttattataaaatatttaaaaaataattttctatttgaaaaatttacaaaactagtcacccatagccctctataaaagtcaccctcctaaaaggcgattttattggcttggcagatggctgtgggcccttccataacggttggccactgaggacgccgaaattctgcaggcggcccccttccgctctcgaggacgatttttttactatgcgactgcctgcaaaaataccaccccctaccatcctttaagcaagtggcccctcgcattggaaaaaatcatcctcctaaagggcggtaaggagaccgcctgcacatttttggctcttttggtggctggccgttataggaggttcaatggctgtatgccacgtcggcaaaatcgctctttgggagcgataggcgactagttttgtaaattttttatttatgtaaatattttaataaaaaattcacttttccttaccggcaaatgggccgcattttttatgggcccgcaagttcgtgtccgaatccggtccggactccaacccggcccaacgagcaagagtttccgatcgatagtgacgaaggattaataagtagaagaagctgaagcaaggaaaggaagaggccggcggaacacgtacggcgacgttgatggaggacctgccggacgacctgttgctggaagtcctccgccgcctcccgccgatcagcctcgccgcgtcgcgcgtcgtctgcagcgcatggcgcgccgccgtcgacgccaaccgcctcctgcgcgcggacctcctccccctctccgtcgccggcatcgtcgtcaaccccctctccctgggctcgcgcttcctctgccgccccaatgccgcggcgaccatcgccgacgacctcgacgacatccgcaacacgagcagaggcatcttcaaccgcttcgatttccgagtca

SEQ ID NO: 66420 - DNA, 767 bp, Oryza sativa
gtgtgattcaatcggagcctagcatgtcgctgagatatagggagaaacatccagacctttatcttgggaaatcagaaaagggggtacattgtgcacgcgttagtttcgaccatcttatggtgttgttccttagtgaatcgcatggtcagatgaagtgggtgttgaagcatcgtagctgaattgcatccttgctacctcgtcgcaccacctacgaagaacagagtggcgaatcatggatcttacatggtgctaactatcaaggagattttcacgctgatgctgacgatgtatcatggatgtttaattgggaatggcagagggactcttatgatgacgatgatgatcatcatgagagcaaccgccatgccaaacatgttactttcttaggattccatccttttgatgaagaggttgtgttcctcggtgaaactttcagaaggggatttgcctataatctgaacaactcagagatccaagacctgggtaacttgtgcccaaaattctatgatctcacttatcaccaggcgttgatacaaacgtcttttgtgtacacgccttgctggattggattagagagagctctctctctctctctctctctctctctctctttctctctccctgtaaatagctagtactccctccgtttcaaaatatttgacaccgttgactttttagcacgtgtttgaccattcgtcttattcaaaaaatttaagtaattatttattcttttcatatcatttgattcattgttaagggctgcagga

SEQ ID NO: 66421 - DNA, 1989 bp, Oryza sativa
agtcaacggtgtcaaacattttgaaacggagggagtagtatttagaatctcaccttgttgtagattattttgagtctgtgttttagtggcaagcagatgaagagagcagatgtactatttcatcccaatatatacttacattagttttagtagcatcaatctttgaaatttttaggattatatgatatctttcttaagcaataatatatatccatggcaagagtactgcatgccacattgctacactgaacatgcttaatcagcaaaagaaaacctgtagcaccgcacgatatccacaaaatccatcgaactaattaaacaaatatacacggacaggaacggctcaacaattcaacggatcactgatgaaaggattgatgctctagctgctacacatggccaaatggtctttctttacaacagcagctagcggaggagtgttgtttgtgtgtagtgtttgtgtggatggaaatggagctactagtcctacatggataaactccgcacgtcagtcgccctggtggtcgtcgctgcatgcgctttctgcactttttttctgaactttttgcttacaaaaccttgcgctttttgcccttttccccgacgagttgggcggttatggcgagggttgggtttctggacgcaagttggcagcggtgtagcacgcaggattgattgcacgttcgttgcagcattgagaatctgctggctttcgcataccagcggccggacgtgtacgacgccggttttgggctcgagaccaaaaacgggtggtggcgtccttgcctctattgggctctgacgaatgctatgtttatccggatgaggtagttagcctactagtagtagaagaatatttgtttccgttttaaggcttattgtttgattaatcgccgatcgagattgtcatagtggagtgctactctacgagttgatgatgggccgaccaacgagaattgcttactccctcaatactaaaaaagaataaaactatttttacacctttcgaccaagcataactttttttatttaatttattcaattattttttttcttcttaataaactaatcataactattttttatttaatttattaattttcttctaaagcaaccataacattttacatccactttcttgatccacatgaaaatattatgctgatatgttttttctttagaaacatagtataaatacaggcgctcacagagaatctattacgctcacttggttctgtgctggcatgttgaccttcattttctgtgaaactctggatgcagaaacatttattcagtttaaggttgcccattccattccagagcgagtgcgacctgtgcacgccgtgaccaccaatcaggatagacttccttccacggctgcacctctcgcccactggaccaaaccaaaccaaaaccattgccacccccacaaccttccacgtctcgtcacaagccgcttacaaatactcgcgttccaaaccaccatttcccaccacaaacacctccatcaccatcaccacggcaccaccacctccaaattccaatgtgtacgagcaaactagaggagatcaccggcgagtggccgccgccggcattgcaggccgcctccacgacgtcgtcgtcggagccgtgccgccgcctctcgccgcccagcagcaagcgccccgcggggcgcaccaagttccacgagacccgccacccggtgttccgcggcgtgcggcgccgcggccgcgcggggcggtgggtgtgcgaggtccgcgtgccgggccgccgcgggtgcaggctctggctcggcacgttcgacgccgccgacgccgccgcgcgcgcccacgacgccgccatgctcgcgctccgcggccgcgccgccgcgtgcctcaacttcgccgactccgcctggctgctcgccgtgccgcccccggccaccctccgctgcgccgccgacgtccagcgcgccgtggcgcgggcgctggaggacttcgagcagcggga

SEQ ID NO: 66422 - DNA, 19036 bp, Oryza sativa
gggagtcatcatcgtccgtgttcccactcgccatgaacgtcgtcgccgaggacgccatgtccgccacgtccgagccgtccgccgcgagcgacgacgacgccgtcaccagcagcagcagcacgaccgacgccgacgaggaggcatcaccgttcgagctggacgtggtgagcgacatgggctggagcctgtactacgcgagcttagcggagggcctcctcatggagccgccggcttccggcgcatcgtccgacgacgacgacgacgccatcgtcgactcaagcgacatcgctgacgtgtctctgtggagctactagcattgaagcagacgcgcgtcatgctcttgtacataaaagagtgacttcctaattaacagcagctgagcatgtatggccttgtatatagggtttttttttttttgatcgctgtacatttttcctacctctggaatctttgattcctatgtacggtttcctcatttcggcatgttttgagtgattgagagtgaaattataaaaaaatgtcatgcataatcaaagactagggaggaccaaaatattgcaaatgaacattgtttgtgtgtcgctacgtttcattaatagtgtagaaagccaaagttatgttttaccccgaaacggctaaaattcaccaccggtttttaactcaaatcccttaatttcaactcaaatcagggggccgttccagggttccatatttcaggctgaaaggcattgtttcggctagaataatatttttttcagttaagcaaaatttgatcatattcaactttgtttttctagtttttgttttttttttttgaaatttcaattctacccgatcccctcgaaatgttttttatttatatccctagatggttccaacgacataaaaggtaagaacataatttttattttttttatttgaaatttaaaactagaattattttgacgggatgccagcatgaacagtaaccggatgtatcgataagcagcatgaacggtcaagatcgtcttggatctgtctaggatttcccttatcattttcggcacggttaccgaaactccatagtaatatagttatcacgataaccacgagacatatcgtggttttaaaaactataaaacgattttgtaaaccctggatccatctgttgcagggtcctaagtgtgcgtgcacttcaccacacacgcacccaaaatactcttccgcttgggttgattagttcctaacaatatcaaaccaaaacgtcatttcgtgagaaatcgatggacttcgatcacagctaatacccgtgtacagtggcgaatctagaatataaattgagggggtgctagagcaaattagagatatgtcaactcgagaaatatttttgatgaaacccaaatatgcataagatcaacagaaaacacattgtttgctccattttaatttccagttacattaatatgcatctacaaaatgtatgaacaaattagtattttgtactgagagagtgtaagagtgcattatatatttgcaactttaatcaccaaactcttcagctaacatcctggcattctttacgtgcggccaattttactataaattactgattatactcactaatgactaactaaatacatgggacggagctggggcttgcgcaccaacaagcaccaacaatggattcgccgctgcccgtgtataagggtgtgtttcaggagaggagatagagaagatcggaaagatacgcaaaacgaggtgagccattagtatatgattaattgactattaagtattttaaactttaaaaatggattaatatgattttttaaagcaactttcctatagaacttttttttgcaaaaaacgtaccatttagtagttcgggaaacgtgcgcgtgaaaaacgaaacaaaactcactcacaatcacctagatcacctagtaaagaacacagcctagtcttcatcctgatcaataatgctaaacaatcagtagtacgagagatggtacacgaactgaattcgccggctactcacaatgatactactccctccgtcccacgatataaaggattttgagtttttgcttgcaacgtttgaccactcgtcttaatcaaaaaattttgaaattattatttattttatttatgacttactttattatctacagtattttaagcacaactttttgttttttatatttgcaaaaaaaatttaaataagacaagtggtcaaacgttgcaattaaaaactcaaaatcccttatattatgggacggagggagtatcatactacaacttgcctcgtacggaaataataataataataataataataataataataataataataatagtagtagtagtagtagtagtagtagtagtagtagtaatacagtacagtactagaatgagtagaatactctgctttgtccgtacacctgtggggcgcatcaatagatccagaagaggcaaaaacagcagcggcggcagcagcagaaacgcccgcccatgggtgtgtgctcaataccagaaatggcaactagcctcggatttttcccttttatgtcattgcaggctgacacgagaggtttgcatccatttgacttctttttggataataagctaaacaaaagccatgctttgctttgccttgccttgctctggaaaccgaggacaaccgaaccaacagattttggccgcgcgctggatacggctaagcaattcgattcccttgtcgacacatgcgtgtcagctccaggtttataactactcaatttgtctcaaaataaacgaatttctatagtttagaatttatcctaaaataaactaatttctatcgttttacctatcagtaaagcgagaaaattttattactttattcctttcaaaaaaaatattactttaacatcctttgcttatccatcaatcaatataatttttacatcaattaagagcattgtgatatattgtttctcaccttaaaattttcctgagatattagggtttgggtaatttgggtacagatagtactctgttgcaccaatctgatgttgtattattgttactttgtgtttccagtgagcacgacacgagatcgatcaaccgacctgcgacgagaaattgctacgacattttcttcccctcgaagatatccatgtgtatgtcaatgtcacgtgatatgtcttgtgttgctgctacaatcatcatcatcatcacgtccgtcatgatggcgcaatcaaactaacaccgctttacgctttcgccgcctggattaatttctcctcttctcttcctcccgtttataataattctctgtttaaaattaaaagccctccaaaatccaccatttttcccgcgtcgcagccaccttacaatacgcagccatacctatatatacaagctttccccgtcgccgccgccgccgccaacaccaaccaactgcggcttgagacgtcgcgcgcgacatggagaagaacaccaccgccatggggcaattgatgagctcctccgcgacgacggcggcgacggcgacggggccggcgtcgccgaagcggccggcggggcggaccaagttccaggagacgaggcacccggtgttccgcggggtgcggcggcgcgggcgcgcggggcggtgggtgtgcgaggtgcgcgtcccgggcagccgcggcgaccgcctgtgggtcggcacgttcgacaccgccgaggaggccgcgcgcgcgcacgacgccgccatgctcgccctgtgcggggcctccgccagcctcaacttcgccgactccgcctggctgctccacgtcccccgcgcccccgtcgcctccggccatgaccagctgcccgacgtgcagcgcgccgccagcgaggccgtcgccgagttccagcgccggggaagtactgccgccactgccaccgccacctccggcgacgccgcatccaccgctcctccgtcgtcgtcgcccgttctgtcacccaacgacgacaatgcctcgtcggcgtccactcctgcggtggcggcggcgttggaccacggcgacatgttcggtggcatgcgcaccgatctgtacttcgcgagcttggcgcagggtctgctcatcgagccgccgccgccgccgaccaccgctgagggtttctgcgacgacgaaggatgcggcggcgctgaaatggagctgtggagctagcatcaaattaaccaaacaatcttcactagcttgttggatgtagtagtagcagttctagctagcacaagtgcagaacacaaaaggatcgtttgtgttgtgcctgcgaaaaattccccaaggaaatatttgtatgcatttcatttaatttgcatggttacaaattcctacacattctatttgctcgaatacattataaaatctatgaattgtcaaaatatcaattctttcttccataaacacaggataacacaccagaacttcaccccttttcagcaggttttactgcagtcaactaatatgaccatcacaacaaagtagccacagaagtaacgatggcgacctgatcatccaaagtcaaacacttgcacggtacctgtggccacaattagaaatagagagagatatgatgttaggatgagatctagcgttagtaacagtaattgtactcacagagttataataatttattgaactcagcttgcgatctcccatcagacggggactgatgatggtactttgccatgggaggctggaggtcggcatgacaagacggctacgtggacgcctgcggattcattcgatcagagctgataaggtaaacgctgcagacggcagcgtcgacatcagcgtacgtggccgccgccggccgccgtggcgcgcagcagcacaaatttgctcctacaactcagcccaaattttatatatgtcgaggacgtgatgaacaattcaacgacgattagtgtcgtcactagtcactacacgcacgatttgaaaacaaaaacggctgcggttgcaattcatcctcgtgttcattcccctggccggccatcactataaatctttttgctcatttaatctgcaaagatcacctctgacggatttgttagtacgtagaagaggaggagtcgtagatggcatcgttgtcttaggccctaagtcacacggcaaagccgccaagagcgtttgctcctctgatcgatgggttgacttcatcatctccatctgatcgccatgaaaaaaggcgattgttgtcgtgtcccgccgccgaggaaacgtgcggccaaacgtggttgttccgcgggtcacacgcgtcgcgccgcggtatagttgggcgtcggcatggcaaccgcgcaccagcagcaagttgggcgtcggcttcggctaacgacgcgcgcggacgaggaaaacccggagatctcgcggaggccgcgaccgttttatgggcttgcagcactcgacctagctggcctcctactaacctggttctctttcggcccaactattactagctccgcagagcccaatatcccatcgctgcattggacgtgacaaccgggactatgggctggataaggaataagttcacctaccatccctcaactttacgtcgagtctatatgacatccctaatccccaataccagaaatcttcactcgtcaaatgtttaaaactgtacaatcaagtcccatgacagtatatatgggtgatctcgctaacgtagcatcctactcaacaatctagacctatatgtaagtgggtaaaaaatattttgggggccacatcccttctttccaccattttcttcttctttttattttttcttctcctctttttgttcttctctttgccacaaagagaggagcggctacggcgtggcggcggtgatggcaggcgagcacacggccgacggagtggagtggtggccgggccatctgccgccggttgcgcgtcgagaagattggagaggaaaggagaagagaagagaagaaagaaaagaaaagagaaaaaaagagaagaaatatgatatgtgggcccccattttttcatctcacttacatgtggatcacatatttttttattttattgtttactaggatgcctcatcagcgaaactacccatatatactgccatgggatcttgattgcacggtttttgaacatttgaagggtgaagatttctgatattgggaatgtcatacagattcgacgtaaagttgaggggcggtaggtgaagttgttaacgttaatgagttcaaaggctagctcggtttggctcatgagttggctcattaatgaggtatatctcatttgtatcatattaattatttcaaatttaccattttatcatgtattaatataataataaacactaattaataaagtactcaataaatacgaatagttttaatgtaactaaaagacaaagtacctgttaaaaagcaccaagtttacgaaggtttggttatatcttgtactaacgagttaaacgagcagctcatgagttaaaaggctagctcagctcgactcattaagattacgagtccaagctgatccaagccgaacttgctacaagccgatccgagctgcgagtttcgatttcccccctcccacccctagtgttcaacaaccatcgaatgaattgaaacagacaatgcacacgcttagtccatgaggacagaacgttgccgccttttattcatgtagagacagacagacacggcaaccagcaaagcaagcacacatttttttgtccgatcgacatacgttccaaacccgtcacatattttgctgtcgatcgatcgatggatggatcgatctagaggttgaacatgaccttgatggcgtcgcggccacgggcgctgacctcgaacgcctcctccacgtcctcctgcgagaacccgaatcggtgggtgatgagcggcttcacgtcgatcttgccgctgcggaggaactcgatgcagagcggccacgtgtccttgtaccggaatatccccaccacgtccacctccctgatcgccgccgacgtcagcggcaccgtcatctcgttgtgccccatcccgacgaggcacaccttcccgccgccgcgcgtcgcctccagcgccgtcgccaccgtcttgctgaacccggcgcagtccaggctcacgtcgatgtccccgcccatcgccgccctgatccgttccacctcctcgccgacgtcctccgcgcgcgccgacaccctcacggcggcgtcggcgccgagggatcgggccacggagaggcggtgttcgtccacgtccacgatcacgacgcgcgtcgcgccgaacgcgcgcgccgccagcagggtgaccaggccgatcggccccgcgcccatgatcagcacccccgtctccggcccgacgtcggcgcggcggcacgcgtgcacgcccacgctcagcggctcgcacatggcgccttcctccaggctcacgttctccggcagcttgaagcacagatcaccagggtgcacgatctgagtaccacgacattgatcagaattgcatcttcttcttggagagaaatcgaaatcgagctgaattgcttgcttgcctggttggcgagggatccgtggacgggaggggtggcgaagaacttcatgtcctcgcagaggttgtagcggccgcccttgcagtgcctgcagcgccagcagctgatgccgggctcgagcgccacgcggtcgccgacggcgaggtgcgtcacgccgctgccgacctcctctatcacgccggcgcactcgtgcccgatcaccatcggctccttcaccacgaaatgcgcaatgcgcatctcctgcacgcactcaaacaacaaacatatataagccacattatctttcattctttctgtgagcgaacaacagatcaccctgaggtagtgcacgtcgctgccgcagatgcccactgccttcatccggacacggacatcataaggccctgaaaatggtcatctatctcagtgttgtttcatccaacatttttactgaatttcacactcacatttgtagccatatacagcagacgaatgcaaatgcttgacgcttataaagaaacaaatatcataaaaaacatatcaaaattcaggagctgagcttttgagactcaggcatagcatgagctgattgcatagtgaagtagtaggcgtccacatgaaacagactagcatttcataaacaggaaagggatatttcttctttctaagtgccaaaaccttagttttgtactagcaatcatcttttttcgcgaacacgcaaaagaattacacgtcaatatattagaagaatagagtttttgttacacgatgcactcagcaagtactagcaatcatctttcaggaaactggaaacgtgctactattactcaacatgctttatatattatccaagacaggataatataaaaaaaaaagggaatagtcagaactacctgggttattggacaggaaaataaactaccacaacaactgatgaaattatcagaaaaagattggaaaagaaagtatactactacacccaggggatttctgaactgagttactgctacaccaaaaattctgaactattcccaaggaatcaaattagcacaacaaccggccaattttttatctctccacgaaagaaaacatatcaacaagaagagagtagcactcccatcacagagcaaagtgaatttgtttatcaaagaacaaccaaggtcagggacaggagaggatttcacacgaaccaactggcgggagcttgaagggcatgatcttgagggtgttcttcgccaccagccacgccgccatgttctcctcctcaccggctccggccaccgccgccgccgccgcctcggctcctttccctcccttccccatcttcctcctcttcactcactcactcactcacccaaagtcacagtgtttgcagagagcaggtgatgactgatgagctagtgatgtgacgattaaatagggatgaaatggcacggatgcgtctatttttagcggaagagaacaaagagtacacggcctacgctgcgatgcttatcgccatacgtgacagacacgatgccttagcaagttgaggacgcaagaaaacgacagtggcagcgtcagatttttcttggcttcatggtcctgctcacgtaattatctttgcaatcattccaaggagagaagaaaaaaaatcagtgggaggttttagaaggagccaagcaaattgtgtgatcagaagagcgaagcactgcgctttacgattggattagacaaacagcatttggttctttcagggaaaaagatgtaacaaacatttggtatctgcttcgtgatcccaggacgcgtcacgaaatggggagagattgttaaaaatctgggtatcaaaatccacgtatatgccctgtttggaccacggtttttattgcgttccgtccacaatcagacggcaaccggtgacgacgaaagcagcttcaggcttcaccttggctgtgacgatcgatgaatcaagggcaccatgtgatcagtgtgtactacctataacctactccatccgtctaaaaaaaaaacctaggagccggaccggtggtaccagatcctccgccggtctggtccagctaaaagattgcctgtgcatgtgaacacgtaaaaaccagctggaccactcggttttctgggaaaacagcttaaaaccggtcagaaaatcggcactaaaccgctaggcaggtgctgtagtaacttagagggcaggcgcatgcgggggaaagaggagaccggcggtcagaccggaaaaaaaccaaccagagcggactatccggttttcaaatcggcactgcactaaaccgctaggcaggtgctatagtagctcagagggcaggcgcatgcgggggaaagaggagaccggcggttagaccggaaaaaaaccaatgctatagtagctcagagggcaggtgcacgcgggggaaagaggagaccggcggttagaccggaaaaaaaccaatgctatagtagctcagagggcaggcgcacgcgggggaaagaggagaccggcggttagaccggaaaaaaaccaactagagcggaccgcccggttttcaaatccagaaccagagcggaccatccggtttttatataggtaaaacggttgcacatgcatgctggggaaagaggataaaatataggtaaaatgtgtgttgggtaggatttgaacccacgatgggttgattggaagcacgagcgccaaccaccaagctatgcttgtgtttgaaatgaataaattatcaaccggtcaaaccaatgacccatcaaaccgagggcctcgccggttcaatgaccggtccggtctcaattacaatatgatccctcataatacaataaatttggactactcttcgtccagattcgttgttctatgagggatcaggttgagtttttttttgatggagggagtactcttcgtccaaattcgtcctaaatttgtactactactctaaaaaaagaaaaaaaaatcctaaatcacagacgaactgatcaaaaggcccaatcaaattgggctcttcggccagattcatcctaaatttgtactactactctaaaaaaagaaaaaaaaatcctaaatcacagacgaactgaacaaaaggcccaatcaaattgggccgtttcgatgagtttgggccagggtgcagaagtctgaagtttgctactaacggcgacatagacgtcccaatgaatagacagtgatagaagattataaataactccaataggcgataaatgaacagtgcgcaccggaaaaacattaggtagtactccctccgtttcataatgtaagaatttctagaattgttcacattatgtctagatttattaaggccccgtttagcacagctctagctcccaactccaatttacctggagcgggagttgtgccaaacggtccagattcttttttttttcggagtggagttggcagagctactcctagaaaatgaactacgggggtggagctgggtttttgctgctccacagctccactccacccaaaagacccactaccctctaatattatagtgtatttacatgaaaataccactcaactaccccttcacccttctttcctcccgttctctctcctccccccaatcttcctcccaatcccgagctagtgcggcggcgtcggcgggctgcggtggcagcaacagcgtcaacggcgacgggcagcggcagtggcgggcggcggcggctgcgggacgacgacgacgggcggtgcgcgcggccggaggctggcggcggcgggctgcggcagcggcggagagcggctgttgcgggacgaggacgggcggcgcggcggcggggccagcaggtggcggcaccccatcttcttccccatcctccgatgacggccacaaccggttgtggcggcgtctgcgtcggcagcatacggggacagtgagcatgggccgcgacgcgtcggcggtggcaggcagtggcggcggttgcgggcggtgttgtggtggccgcgactggcggcatgcggtggcgtcggcatcagctcgcgagcggcggcgtcgacaggcgactcgcgtgcgggggcatcggcagaaggcagcctgggcgacggcgcttgcgcggcggcttgggaggcggcggagatgcgtgggcctcccggctgcggcggcaacgtcaaggcggcgcctacaaagtgttcgatgaaatggtgacaaaggatgtataaatgtggagctgagtaatctagccaaacacttttttacctacctcagctcctagaggagccagctctcactggagttagagtttggagttgggaattagagttatgagctctaccaaacggggcctaacatttatataaatgtaggtaatactgaaagttttacattataaaatggagaaagtacggagtgtatgattgagttattattgtggcattaaaaaagagaggttgattagacaagaaaggaacgtttaaggtagtataaccgatcatgcacggcattactactatattatatagagctgaaattctggatgctggagtatatatgaagttggtatttggtaagttgtcggttgcctcctttcatcagatatcagcgacaggtattcttcttcttcttcttcttcttctttagcttgacctggtatggacgtcattagcccatcatggtcctaatcatggtgtacgggccaacgttaatcgcctcgtctgttcaagtgtaagattatgcagtactactactgttgtttaagcataattaataataagtgattagttaaggcaagatgtacgtatgtacgtgtaggaaaggatagtgcaggggagagcccacatggtcgatgatgacttgaaacaggattatactacatttatactatgggcagctgaaaattagtcgatgcatcgccgtcagggaagatggggatttgatcagttgatttgcagcaataattaaatatttcagtggacacggtaaaaaaaaggaagaaattaactcaacgccgacatctatatgagtatgaccaccgaattgtctacttttcacctgtgtcggtacaaaatccagccgcaatatattaccggtcgccttttcacatacagtagtcctcccttcgtactcgtataggaaatcgtttagaacaatttaagtcaagactttaggaatataaatcataaataactcttaagttgttgagtttgaaaacgtaaaaattatattaatatatttatcttgaaaaatactttcatagaaacatacctatatcacttttcaataaatatttttgtaaaaaacaagtagttaaagttgtgttttaaagatcatgtcgctgttctaaacgattttcttacgagtacggagggagtacttgtatacttgatcgccgcagtaaacatcgatcgagacgactccagtttagccatagcaattggagattgagaagcacggagcccacacggttgagagttgatgtggggggaaaccgcgtcgattcgagctagctggagaggaggattggaggatattctcgatcgtcggcgagcggcggcggcagagcgagcatggatgaattcctccgtacgtcgacgtcgttgaacaggtcgcgggcggcatggatcggtgcttttctccttttcttctcggctattgtccgccacgacgaccggctaaactccatcactgtcccacatggcaaatgcccattggagctcctctcctcagatgacacatattctagtttctgacgagatgtgagcctgtggcgatccttggagtcacgtctgttttaatcttaacctcaattttttaggcaaaacaaaaaacaaaaattatataaaaaaattaagtctaaaagtctgttagaatttatcttttttaatttacctatatatatatatacatatatatatatatgatgaattacacgtagatgtaatattattgagagtacatatatattttttctagaattttcgatgaaatttgttagttggtgtgtatgatgtgtacacgtgaaaacttttatgcataggatatgattccattaaagttaatattaaaaaattatgacaaagaaaaacctttaaattaaattttggttgcgctgataagctgaccaacaacaacagaacggtatgcattcatacaaatatcaaatgtcggccaacccttatcttaggacccactgtcatggcttcaccgatgctatggtgcagccccggtcatcggatgaaaaaaaaaacagggggcttaaaataagggattatctatatcatatttaaaaattaagaccaccaagtctacttttcaaatggctcatatcggtttgatatatatgcagcctcatgcctccaccttatcccctccctctcctcgctcaaatcggcatgctcgttgccaaaccccttgttcatcgcgctacactagtgagccctcccattcctcctccccatctccagtggcttatgtaaccgccgctctcgtctcctaacctctcccgttccctcgcctccgtccacctctcgtatccatcacccataccaatttggtcactgctatgggtcatgacccaattacccaatcccaatctcaaacgccaattaattcattcataggttctcaacgtcaacgaggatcactctatagttaaaaggagaagggtccgagtgagttttgatgcggatacaatgatccagttttcattttttttaaaaaaatatacatcaaaatttcttagcattttcattttttttaaaaaaagggtcaatgagcagccgagctgaagcaagaaaggcaggtcaaacacaaacaccagtacatcactctgaccgcccggcacacggcgctttcaatcacccccactccacactcgtttccaaccatctttccacagatgaggaggccttttgccaccatcaccccctcatctcacatggcactagcactgtgctaatgcgatgagtgcatccatcaaacacacagcagcaagcagtggccgtcttgtcttgtggcatctgttgtttggccttcgattccgtaatggcatcgtcaccttgcaattgcaagcttgcaaacatttccccgggggttgaaatggtcagagcaattgcaacctacagcctcccaaagttggggtcccccccccccctcctactacctccctgcctggctgcctcccaagttgctgtcaacaatttactctgaataattgtgtccttttttcggtgtctgattctatttgttcttgggtaagtagtgaatcggttgcgatcgcagaaagacctagcggtgatatggaaatttaccgacatcagtaagaccgcgtcgatgtctaaaacgataacgttgttaggctgcgttcgagaaggtaactttcctatcctttttcgccacacacaagatgagaatagttattagcatatgattaattggtattaactattataaatttaaaaatatatatttttgatttttttaaaaaaaactccttgataaagcttttttacataaaacggtatggtttagtagttcagaaagcgagaacggtgagttggtaaaaataaatcgggagactgagccgaaattcagtatggaattcacatacataaacactcaataggagtagaaattgggccggtcagcgccggcagcgcaaataggggagccatatggagtacaagacaaggcgtgaatgctggggaagacgagcaacttgatttggtttctgaccaaattaagagaatatctggaggttgggggctttcacacctaatattaaaaaaaacatgttcttttcttcacctttttaaacaaaaaaatcccctttccctatataaataagtaaaaccctatcctgttcctatatgatcatcttgtcagtcagcaggatgccattgactggattgtagtataacaagatggatgatgcatatcagcatttgcatcaccttcatcaatcctctgcttggtatgttgctgtcactccctgtgagcctgtggccaactgaatgaaaaaaaaaaggaaaaaaaaacaagcctttttcccagcagcaggacagccactggcgcgcacatcgatccatcgatcaccacttcaccaccaagagccgagcaaaaaagctagccggagaagaaaaccaggaggcggcggcggcggcggccggcgacgagggagaagcagtcgcatgcggccactcggcggccatccggtcgctctcgccgtgacagcagcagcagcaattgcaactcgccgagctcatccaagacaaccctatccatgaggcaaccatgctcttgctcatcaacaagtacctgtccaggagcaagaacccggcagccggcgacgacaaggagatgccaccgccgccgccgccaccgccggcgaacggagcggagcgtgagttcatgtgcatccccggctgcgtgccggtgcgcgtcaagaggggaaccacgacgacgacgacgacgacgaccacggcgaggacgtcgcggcacaatttcgtcaagtcggcggcgtcagggctgttccccggcgcgcagttcaccaaccacgagtcgctcccggcgatggaggaggcgtacgccgagttcgtcgccgcgttcccgcagtacgccgggctcgcccaggccgacgccatcagggacggcgagtaccagcacctcgaccgccacgtgtgcctcgactacaccggcatcaacctcttctcccacgcgcagatgaactcgtcggtgccgtcgacgtcggccacgccgccggcgtcgtcgtcgggcgcggcgtggcagccgccgttctttgacatcgcgtacaagtccacgagcctgcggtcgcaggtgcaatgcggggacgacgtcgcggcggcgtccgcggcgggcgggatcggcggcgccgtgacgaggcgcgtcatggcgtcgctcaacatccccgacgacgagtacgccatggtgtgcacggcgaaccggaccaccgcgttccggctgctggcggagtcctactccttccagcagcacggcaagcggctgctcaccgtgtacgactacgagagcgaggcggcgggcgcgatggcggagagcgcgcgccgccgcggtgcggaggtgatgtcggcgacgttcgcgtggccgggcatgcgcgtccacgccgccgacctccgcaagaagctgctccgcgggaggcggcgcggcggcggcggcgggcaccggagggggctcttcgtgttcccgctggtgtcgcggatgacgggggccaggtacccatacctgtggatgagcgcggcgcacgaacaagggtggcacgtcgcgctcgacgcgtgcgcgctgggcaccaaggacctcgacacgctgggcctctccctcctccgcccggacttcatcgtctgcaacttcttcaaggtgttcggcgagaacccctccggcttcgcgggcctcttcgtcaagaagtccagcctcgccgcgctggagcgctccgtcatcgcccgcagcatcggcatcgtcagcatcgtccccgcacgccgctggtcgctccacgacggctactccaccgagctcgacccggtcgccgcggcggcggacgacctcgacaccaccagctccttctccggcccactcagtggcaccctcatcgcgctcacactcaagaacgtaccggagatggacgccgcaggcgaggagaacggccactcgccggagatccgcgaggccgatccgccgccaccaccaccgccaataatggaggtggagtgcagggggctggaccacgcggacgcgctggggctgatcgccataggcaaccggctgaggtgcatcagcaactggctggtggtggcgatgcagaagctgcggcacccgcagtcggagcaggggaaggcgctggtgcgggtgtacgggccgcgggtgaagttcgagcgggggccatcgctggcgttcaacgtgttcgactggaagggggagaaggtggcgccgccgctggtgcagaagctcgccgaccgccacaacatctccctcacctgcggcttcctccgccacatctgcttctccgacaagtacgacgccgacagggccgccgtcctcgagcacatcgacggcggcggcaagaggaaggacgccgccggcgagatggggatctacgtggtgaacgcgtcgctggggttcttgaccaacttcgacgacgcctacaggttgtgggcgttcgtggccaagttcttggacgccgatttcgtggagaaggagcggtggaggtacaccgcgctcaaccagaagacggtggaggtgtagccgacatgtccatccaccttcagcttccaccattggtacacttcactgtcactgtcactgttcgccattcttttgggatcagctcgatcggctgtgcagagctgctccgtccattctttgtgtgagagaggctcgctccagtgtgttcatgattatactgtaaaatgtagtctttgcttccttagaaaaaaatatgtgcctattacttgttcgctatactgaaatcatttggttgccatctccaggatatgaattctgcatcattgtttcaaagcagaaaaagttacagctattttcttttatctgctcaagacttaactgaattttttagataagataaaaattacatcttcaacgtctgcatcataagatgcacacagccaacagttttgcaggatattactgagaacaataaagcatggggagggaattagctagtaacaatgaagcaatagagctagaggaaacaaggatactaggacctagtactactacagtactacacaaaggtttattgttcagcttaaagtaaaaacaagctgaggggcacgaggggaacaatgaattattggaagatatctagactgagcactctaagaataaatacatcaaactgagcaacaagatggctaataatgcgcgtgagctcacagcattcttggcacccaatcagtgaccgtttgcaatgccgttgcagcccttgatttttccctcggcggctttcttgtcatagaacctcctgtacatcgaatcaacttttgtaagatagaatgttcctggtggcaacaagctggtatctttgcttgtttcaaaatcttttgctccatagcggtgctccatcagcttcaatgtctcaataaacttctcaggtgaggtctattataacatgtaaaggaacaagttagcttgctgtagagaaatcacactaacgaatggactattcagagatgactacagcggagcatttcacaatcagcaaacatataatatcatggaaactacagttgcatcactttttatacgaacaaatcaactagtggtatgtagccatccttaacaaaggcaatttttaaaatgcttgaaacaattaataacacccccccccccccccaagaaaaaaaatgttgaggtaaacctatccaatagtgaccgcccttgccctttctttccctggtgacaggtttggtggtacagtatatttgcataattgcatttgaccaattctttcatcaaatagcgacgtggccataatggaaataaattccaaaaccatgtccgatcataccgcatgtatgcaacaaatgtacatcataatatgctttatcgcatggg

SEQ ID NO: 66423 - DNA, 730 bp, Oryza sativa
ggtagccaaataaaccaaacattcccttagttttgcttgtggtaagaagccaaaagaaatagaactggaagattaaaaaataataagtttacgaaattgtgaacctaaacataggggtgaaaacggtaacggtaattaccggccgaccggcgttcgttttcgactttctaccggccgagccatatggaaatggtaatcgaccgaaacaaaaatggaaatggtaaaaaatatggaaatgaaaacggaaatggttttgctgttataccgatcgtttccgtatttaccgtattctcgcggaaatcaccgtttcttataatatggtaattaccgtattctaaatatgtcgatattataggacatgtctatacttgacccacagcttatagattgaatgactcttcaataaaatctctaacttttgtatatggctaaaatgaagttaatttataatttatatagtataagcttgaatttatgtatatatataacatacttatgtaaagttaaatatatgtttttatagtttaatgtttccgtatttgttaccggttttcgatctgtaccgacatgtttccgtccgtattgttccgttttcggttttccgatatttccgatatcgttttcgtttccgactttaccgtttccgatttcgtttccgagaaaaatatggttacggaaatggttgaggctgttttccgatcatttccgaccgttttcatgggctgcagga

SEQ ID NO: 66424 - DNA, 764 bp, Oryza sativa
ttacggtacctcggtttgagaagaacaaagatcaagcagttgccacaatcagtcgacaagctgttcaatctccaaacacttgatgtttaccttacaaatgtagacaagttgccaactgggatcgccaagctgaagaggttaaggcaccttcttgcaggaaagttgagtgctccactgtattgcggcattgttgagaagtccagaggtgttcaagctccaaaggtggtgtgggagtctatggagctgcaaactcttaagggtgttcttgcaaacctaaatcttgtggaaaatttgggacacatgactcaactgaggacattggcgatcgaagatgtcggagaagaacactatcccaagctctttgcatccatcagcaaaatgcgctctctacgcacactgaaagttctttcagctgaaggtaatcaaggtctgaactttgaagcactgagcttaccaccacagaatttacgcaaactccatcttaccggaaggtttcaccatgctgtgatggaatccaatttctttcagacagttggagctaaactggagaagctgtatctcacaggaagtaagacgaacattgatccattgatctccatctcctgcctctccaacctgaaagtgctccagatcggagatgcatacgacggagcaagcttcgtcttccagagcggatggttccccaagctccacacactcatcatgtgcaacttgttgcacatcaattcgatgatcatggagcagcagacgttgcagaacctcca

SEQ ID NO: 66425 - DNA, 3136 bp, Oryza sativa
cagcctgaagtgcacgtgccgtggcctcattatttggagcattggctacgacaggtatagaaagtaaggaccctgcattggtgctttgtacttgctgattggcattactagcagccttggctgcagccaaagtagcggcagcttgggcagcagcaatagcttgtgctgcaaggtcaccccccgccttacgaacccctccttcctcatcagaatccgaatctgacttatcctcctcatatccatattcccttgcctgagccttctttgcagatctccgagcttcatcctcttcttcattgaacttgaaaccacttccaccataccctgttccatgggcctgttctgttccttgcttcacttttgccatgaaacgatcagctaggcctttaaggtcctgtggaacagcctgttcagaaagctccagagccttggcaagatctggtgcataccgctcctcttcgtcagaaataaaagtcacagcaaagcccttcctaccagcatgaccagttcgtccaacacgatgaacatagtcctcataatggttagggacatcataattcacaaccagctcaagctacttcacatctaattcacaaccagcaatcagcaagttgcatacgttgctcttgaaatcagcaagagttgattcacggtcagtctgatctttcccaccatgtaaagataagcatggatatccacgctgaaacaagtctttaagtagagaatcacatttatcttgtgagtggacaaaaacaagaattttgcctctatcaaaccactctccaagcaactccaacagcctcaagaacctctcattttctggccgcacctcaaccagttgtgtgatatctttgttgacgacactcctcccacccacctggatctcaacaggctttgtcagcaccttacgtgccagtatctccacctgccgtggaaaaatggctgagaaaagaacagtctgcctatctgggcgggtattctgaactatccgagtaatctgaggctcaaagcccatatcaaacatcctatcagcttcatccatcaccaagaatgtaactctccgaaggttagtaatctttccactgctggtgcaaaggatatcgatcatcctgcccggtgtacaaacaacaatttcagcgcccctctttagttcactgatctgctgggcaacacctgaacctccatagatagctacacagttgatgccaagcgacttcgcgaacttcttaatgtctgaatgtatctgcaccacgagctctctggtaggagccataatgagcccaatagggccatctccaggcacaacaggcggctggtctttgacatgcctgagcattggcaggacaaacgctagagtcttgcccgatccagtctttgcaattcctatacaatcacgcccactcattatgattggtaatgcctgtgcctgtataggcatcggcttctcaaaaccaagcttcttgatggtgtcaaggagcttgctggtcagcccactctgcacccatgtttttattggcttgggcacatctttcccatgtaccttgagctccagatttttcctgtaggtagccacttcctctcctgtcatcattgtgatatccttcacctcaatgtacaaattcttccggaatggctggtactcaattttggaatggtcaacaatagccagcttttctaccttcgtcttcttgacacgtttcatgaactcctcatcatcctcatctttcgatccaccctcatcgtcgtcgtcgtcatcataatcagagtccgaatcatccccttgcataattctccccattgccttcttttgccctttcttatcaccattactcacagcatcctttgcacttttaccattcttatcacccatgttggaagcaggcatgctctccattgatgccacagccgtctccagctttgcgacctccggcaacaccatggagctcatgaatgcatcgagcggatcaatctcatcctcctccataggagcagcaacatttgcatcattcacctcactcggcaaatcggcagtgatgccaccgtcatcttctgcattttggctatcctccttgtatccctcctcatcagactcctcaccatccagagtccacttcttcccggcattggaatcgccgtcggccccagcggccgcggcaggagtgccagcaccggccgccgcctcctgctcgcggcgcttcgcctcctcctcctccaaccgcttctgctcctgccactccttgacacggcggcggcggagctccatctcctcgtcgagccgcttcttctcctcctcaatcatcttctgacgccgcctctcggactcctcctcatccaccaccaccaccacctcctcctcctccatggcagccgccgcctccggctccgcgtcgccgcggtggtggtggtggtgcgaggaccggcggcggcgcttgcggtggcggtcctcatcttccccctctccctcctcctcctcctacgccccatgcctcctcgaccgcgacgactcctcgcgccgccgcgcccgctccttctccttgtcgcgctcccgcgccttgcgctcctcgcgatcgcgctccttctccctgtggtggcgatcgcggtcgcggtcacgctcgccgtccttgtcgtcgcggtggtggtggtggtggtggtggcgagaggaggaggggcgctcgcggtcggggtccttgtccttgtcgcggcggtggtgcttggaggtggtggcctgtcacagcggttgtctgatgagcaacaatcgctgtgctgaatcagagcagaggtggaaaacgtacagaggaaaggcgttttctcaataagattgcgtaatttatttatgtaacctgtaagccactaagtggtgggacctgaggagtatgtgtcgcgtgtgtgagggggataccgcgtccaaaactatcgaagaaaaaagaaaagattcccctcctctgcttctcgtgttctcttcttcctcccgtctctactcctattctatcggatctccggcgagcagcgccgccggcgatcggggtcgtaacatggccttgtcgccggagcccatgttcacggcggcggccggcggcgagcgcgaggaagccctagacgcggcggatgtgttggggtttgggtgagcgcaattacc

SEQ ID NO: 66426 - DNA, 1442 bp, Oryza sativa
atcttatcgtgcactaagggaggagtatcctgagcgccatttgatgacgaagcacgtgatgatagcacgatttgatgatagaataatgaagaaaagacaaaattaccttttcaaactttatactgcaatctaattaactaaaaaatcaaatcaatctataccgttagatcatatatacttgcagtaaatatactagcagtatattataccataaaagtcctcttatattaagcttatatgatgcattcttaggaaattgaataataagatggggaccctacacctcagaataacgagaaaattgaaagacgtcttcgaagagactgaaagcttgtttagccaagaatttctattgatttttactccctccatcttttttgacttcccaaaatataagagcttctaatcttcattttttgggactaaggataaaaggaaaatatcatagtatccctcattatatgaggggctggttaaggagtcgagggtaaaattagataaattaaaatcagttgtagttgggtggaggaagtagtattctgatataagacaagtttaaaatattaaaaataactatattttaagaccgagggagcactagaattgagctatttctgttgaatctacgaggagtccagtaaaccagtgggatctttgtgtgtatgtgtgcgcgaatgcattcctaatggaattttcctgatgtattatatttttaaaaaactaattagataatgaagtacttcctgacttacaacagtactgcggacaatttaggctttagatcacatggaggtaaaacctgcttactgcacatgagcaatgcaatctcaggtgaaagccagaacaaaaaccgtaggaaaattgacaggtttttcatttctagaatccaagttttgcactttgcacagacagcttcctcaagttgttctgtactcaaagaacaatatgattttctatcacccacagagcctaactaaaagatatcctcatctgattccaacaaatttaaatggaaaccacagctgcaatgatcagcaacaccattgcaagaactcgcgcgccccatcgatctgcagcttgagccgatgacttgctgtttacctggtgaatctgtggcctgcaaggttttccagaacacaaggtaagtggccaaaaacagaatgtactactatcagtgaaacaaagagaaaacagaaatgatccggtgaaacttacttttgcaagtctttcagtagaccacagtacaatgcattatctggcatgatcatttcagtgatgttgtatcccagtggatcagccactttcacatagacctcctgcccattgtaccagttatccagcttctcagaccggagattccagatgccaacattgtcgagcgagactagaaccgcagtccaccctccagggaaaacctatgaaaaatgttgcaaatttgcatt

SEQ ID NO: 66427 - DNA, 6597 bp, Oryza sativa
accataggttttcacctagggaaattctgtgaactccagacaatgccttcaagaaagaaagaaatccattgccaagtacaaccaattaaggtcagacttagggatttaaccccggacttaaagaattagtaacaagtaccgcctgaatgaagccactagtattgttgccccctcattccgagacagaacctccatatcccaaacttaacagaatcacaaaaggccacgaacatcattacctgcatccttctatagataccctttgaagataatgtcgcgagaagccaaaaaggcacacgcccaaaatccatatctagaaagagtatgttgttcagtcaggtatctactagcttccgacaaattgtcatcccgtccccgattggcacctgcaagtctcccaagaaaacatagtaccattgtcaactaaaaaaatagagtcagagaagtgataaaattagaaggcatggggtactgtctccatggaaccatggtataagtatatcacatgaaaatcaagtaacaaatattatggttgtcacttgcatcatactgttttcttctcactgaagttgtacaaaaaactgaacatggtgctcaaaagaaagttcggataaaaggagttatatagattttggagcaaattgataattaaaaagatagcaaataggactaaacacattcatggtatatgtgatcctggctcaaatatgccacaacattaggcaaataaaacttccagacttgggatatgtattgcgcttcactgcggtactgctacacatcagtgccaggactgagttctcttcacaagctttaacggtcaatatacttgtgcaggcatataaataattttctaagtctttgcagtaaacacttgcaagtaatgacaaatctaggcgatagataaaaaaatatgagaggtggtgagagaaagagaccatgctgatgctgacacgattatcctccagaagtttcttgttgaagttccttatactaattgtctttcgatcattcacctaaggaaaaatgtgccagataatttcctaaaaaatcaggaaagagtgatccactttctaccatatagcttctatgtcatgtcaaaactaaaaaagggaaaaaagactcactagtggatcagcaactctaccataccaaaggacattgtctattacaatcaaaccaccaactcttacctgcaacacaacaaaacataatgctcaacatacagattataatcaaaacatgtaagttatggttgctacatacatggaacttataaataggatcataaaacttgcagcaaatcttctataatgttataaaaaagttatgatcattgatgacagttgacagaccacaattgctataagcaagaaagggttctatgtaatcttactagcttaagtagaagttcataatactcctcatacattctcttgtctgcatcaacgaatgcaaagtcataactagaaaaggtagaagagacaagatttgttagaccaactaagatgttcaatgatggattataccacaataaaattactgtacctgttaacctcaccaccatcaattagtaactttagggaatccgcagctaaagcatgtttgacatcaacctaaggaattaggtgatagatcagcccaagaaattcatcatgatccagaacccatcaagcaaaaagaggcgatcaccttgtgtgcaacaccagagcgctgatagtatttcttggcaacttctaggcatctttcatccctctcacaagcaaccaaacgacctgattcaggaagagctagtgctacagctaacgacgaatatccctgtgcaaagattaaacgaatgctataatgaagttattgaatttgcagaaatcagtggctttctacaaaagtagctaattcacaaggttttgattgcaatttgtagcacttgagataacatgtaccgtgtggattattaatttattattgtaccagacaggaaagactgcttgatgatgaaaggaaaacatatgcaagaatcaagcctcagtactaccagaaggcttgttgcatataggattcaaacgttgtagtgcttgcttattatggtatagtttccagggaaaacaacagatacacgagttctcacaaatatattgttaaccagctggagtttatttctcattttgatcaaccatcatgctttggttctgacaagaaacaataactttctaatgttgcgtttttacttacctagagtggaaatatgaataatttataatacaaaacaaagtaacaaacactaggtcagatcacatactgtatagactccgacttcaatgcatcgttgagccccaagaatttgcgcaagcattgctagaagctgagcctgcgcaggtgaaacctaacaagacaaagaaaccagctgagagtgtatatattgtaactgatttccgaaacatctctaaacagtatcattgcactttcagaaataaaagtaatcatgtatgaagtggcttcattggaccaatgttaccttgaaaaagattaggactaattttataggggaaaatggtaaatgagctctctaagaagagtagccaagtttatccatggcacgcacctgcatttggctccctctcatggccgccgtctcctcacgaagctccttgagaacctgatgcatttttccagcacgggataaaacggaagcacacattggcaagagagcatgacgcgaattccgcaccccaaaatggcggcaaaatttgctcgagacgaaccaagcagagagcggagggagggagacacgcaccgggtgctcgcggacgttggcgaggaggtactcgtagagctgcgtcgtcgcgcccagctgcttccgcccctgccgcgcctcctccaccgccgccgccgtagcagccgcagccgccgccgacgaggaggaggaggaggaggagcagaggtgtcggcggtgccatgggcaagtggaggcggtcagggctagcgctcgggggacacgagtggtggcggcggagccgaacctgagagccgcagcctgcgccgccgcggccgccgccgtcgccggcgccggcggcgggagggaggaggcggaggcgaagcggtgcatcgcggtggagacgcggattagcttggcgtcgacgaggccccacatgtcagtgaggcaaccacgcacgcaaaaggcccaataagtatgtgagaattaatgggctgtctcttcttttttttttctttcccagcccatgtcaaaagcccaacaagcccatgttaaaaaatttgctttcgcacagctgaatgaggtctccttaaataaaaaaaataaactacaaaacctctaaaatgttataatgagtacattcctcatgtaagatgatttgttgcaaatactaacaacaaactagacatactgagggcttcaaacattgctacttaccaaattttggtatttctagaagctttctctcttaaaacactacgtaaaatttggtaataccaaaatgcgcaaaaaaatttagcattatcaaatttggtatggttaatttgagcatcaaagtgaacaagcctttaattcaccatggactgatttggctctttcggtatgtaggtatgatttgtctcctgtgattaatatagtttataaaataataaaaatgcttttgcttgtaatatgaagtttggtttgtattacttctacgcaataagtttagtttgtattcctaagcgcataaggaattagattgttttcaaacattcaaaaaaaagttgcaatttgagttttctcattggtatctaattagcaacaatataataattctttttcatattaccttagtatatcttgattttcattacaaaatataaccgtagcgttagtacgggcatattactagtctctcttagttgacacggtcaaaccggtcatcagcagagtcccatgggagcactttacctcgttaagctcttaggctgcttgccagtgtccgggttcggaaagcttgcctccagcatggaaaacggagcgatccattagcgtgtgattaattaagtattagctatttttttcaaaaatggaacaatatgatttttttaaacaactttagtatagaaactttttacaaaaacacaccgaaatagcagtttgaaaagcgtgcgcgtgaaaatcgagacaagagagttcccaacctagactctcgaacgcagggcgttgttaagctgtgtttggaaggaggggttggttagggaaccctcctctccgccacatataactacacttcttagcatataattaattaagtattagtttaaaagttgaaaaattgattcatatgatttttaaagcaacttttctatagaacttttttttaaaatacacaccgtagaatagtttggaaaatgtacatacgagaataacgagagataagttgaaaaagaaggggaagaacgtagccaacaggccagggttgctatgttcaccccgaccggacactcggacaggataatatggtcatgttatccctggtcgttgcacccacatgtacacaaccacactgagctcacacacccgtgttgcgccctaaaatttatacgctaaaaaaatacatattagttgtaaatctatagccctagattattaaaataggagtacaattattaaaataggatatgatttatcctatcgttattatttagattacttaaaatattttgttagttttattaaataatgtttgatattaactgttcctctttagcagcgctgttccaaacgaaacatgtacgtacctggctcattgtgacgtgatggtcggaactaggaagatgctatgccttaattcctagaaggagacataatcagaattgcagttcagcaataatattcccaacaggaatatgttgcattgcaaaagattttcttaattttcaaaaagcatgcacccatatgctgtttacgacatactacatccgaccaaccattcgacttatttacatttgcattaatttatctgttgtgatttatattattatttaaaggtattttaagcacaagcttatatatatatttactaatgtattgaatatttttaatagaacaaatgatcaaaattatgtcaaatatcaacagtatcatataattaaaacgggagatcaattctctactttagattaaaccacaagaaaagaaaatatatatatagaatactaactctagtttctaatagataatgtcgttgactttttgtcacacgtttaaccatttatcttattcaaaaaatttacataattataatttattttgttatgaattgttttatcacttaaagtactttaagcatgattttatatcttatatatttgtataaattttttaaataagatgaattgctaaaatatgtttaaaagataatgttatctgttaaaatacgaaggggcatgagatatgtgaacacgcaaattttggtcgtcacttcaattgattgaaagggtcctagtacactgattgataaggcaatatctttggatcacagtaataatatagatgctctatcaaccttagctagatcctggacaagagattttagtttggccaaaatggaatataattaaattgtccaaagtactcgtcatttacttgtacaaatcatgttgcatacaccacacgtacaaaacatatattctcctgataaaaaaaagtatagtatcagatgcgatctctcagaagacaacacatatctatactcttcttttttttaaaaaaaaaccttaagtgatgctggtgagtgataaatttgctgccatctactcctattataccacctaatatatggatttcacttaattaagagtgattaattcatgcggattgttcatttccaagcttaagaaagggaaaaaaacatatattcaacctattccttgtaaaacatgggtgtttaagctagtatctcaggaaaataattaacccttctcttggctaccagattaacaaattgagttttttttcttaagtaaatgaagagtactttggacaatttatacaagtaaatgacgagtactttggacaaatttaattaacccttctcttggctaccagattgactttgataaataacaaattgactttgataaccatgcattgacacgcatttgatcatgattgaccagtgccattttaattaagccttctaaacaagtagaggattagtcgtatttgtattcttcctgcagggtaatcgtgccgtgcatcggtgcatggacgaccaagtacagcagtgtgtacggtggatatgatgcaaaagtcaaacaatgcagcgagtattatttaatttaattgctagtagtaattaataaataataatcctcactagtacaaagcacctagatatacagtcaacgcacatgcacttcatatacctcaattcaatgcatgcatacgcttagatctagcctgttcgagataggtgttagtttatctaacgtcacctccaaagaaaaaaaaagagaaaggtcctggattcatatgtagccaaaattattttgtaaaatttagtcctatatctttactgatattatgttgaataaaaaaacataagttatttcttt

SEQ ID NO: 66428 - DNA, 2101 bp, Oryza sativa
atgattattcattcgcaaacgttaacctttggtttgtagaaaaaataaattacaaataactaaaagcatttcatgcataatattatcgaagcatactaacatatataagtatgaaattaattaactttcgctcattcagaaaagaagaaggtagtagtcaatgccaccagctaatagaaaatggaggaaacatgaattaaatcatgttcaagaaatcgatggcacccatagctagaaaacacacaagaaatgtaagatttaaaaacgccaatggaaaaaaaatgccatgacaaaagttaggcatgccattaagcaagtgtagtttggttcatcgcaactgtggttttaccacacttttgcctactacatgtaatgtgaaggatgaaacaaaacacgatattatatactgcaagataattacgtccaatttaagaataattttgaaacacaaaaaacaaattttaggtgtttctcctgaatggaacacgtgtacggcaggcaaatttgaagtcgtctatatccattgacacgtaacgtagtcaacttcaatataaattaactggtatatatacacactttaattaaagtataaattatcgtacccatacaaatcaggtttctgtatgtctttatgtagacgtgggcaatgacaataacaggaaatggatcattctacgcagcgagaaatataccatccatccatgcatggttacacgcatatattgtgttgttccatttaaaattaattagggcatgtttagatccatttggaatgacaaaagttttggtgacaaaagttttggcattgtaaaagtactagttggtgtttagatgcatgttaaagttttaccattctagcactaaagtgagagagaaagagagtgggagtggtcccaaagcactttttggcacaatttgctactatggactagcaaatgccaaattgccaacttttgctactagtgtttagatccaaaatggcaaaaaatactacaaaatggcaaaacttttgccattttggaggatctaaacagggccttggacgctgagtgtggtagctagacactatttcctccgtttcatattataagactttttagcattgtctatattcatatatatgttaatgaatctagacatatatgtgtgcctaaatttattaacatctatatgaatgtgtgtaatactaaaaaaaatcttatagcctgaaacggagatagtaattagtttgcacacatgatctttactggatggaaattgagaatctttgaccttaggatcaccaaccaaataaatgctatcttcactccgttgaattttttcaggctgtttaatttacacacacctcataaatttagtactcgatctattattccctctgtctctgagacgtattctgttttattataggagaagattcttaccaataattactctattataatatcacttatataatatataattataatcatacgtatttttaatatgaatgtaaatataattaatttataaaaaaattagtagagtaatcattgaccaaagtcttatcctaacaaaaataaaatactccacatattttcaaacggagggagcaatagatttacagaaaaaaaatagtatccagcatattcaatattgagtatatatttgccgcaatgcaactagaaaagtaattcaaacggccatcaaccaatcattgagatcagaaacaaacataactgtgaacgactagctgaattagttaggttcttggagtagaatttgtccacctagattcaagtattttaccgatttagtataactgttcacatttacagctagttattatttcaatattagataatatgtctgttgatatttaaatatctttggtaactttcaacaatctcaaaatcaccggtctaatctctcgaagctggagctgctcatactgagcagtgtgcgcatgtgtatatatgagattctacgcgcgcatgcccgctgggattgtgctttagagaaaaagaaacaatatgaccatcaaatttactataaatgattgtttatttaagcgtacattgataccgtgttttgaaaaaaaccaatataagtaggggtg

SEQ ID NO: 66429 - DNA, 11213 bp, Oryza sativa
ctctgttttttaaaggggaaaagaaaatcatggatgatgaagacttgcaatgttgcgtgcatgcgcgaatgcagagaggcactactatagttcattgttgtggctatctacatagtactccctccgtattttaatgtatgacgctgttgactttcgacctacgtttgaccattcgttttattcaattttttttagtaaatataaaaatacttatgtcatgcttaaagaatatttgatgatgaatcaagtcacattaaaataaataataattacataaattttttgaataaaacgaatgatcaaacgttggaaaaaagtcaacgacttcgtacattaaaatatggaggtagtagcaaagtccactcttttgttagctacaacacgtggccagcatcgacgtagatggtgaatcctcggcctaggatcacggaccaaatttaatggtgtatctggactttgagtgattccatttgcacctgtatatttatttgttttagaacgttgtgcagtgcggtcaaaacctaaaaatgctttggtatagcacagtaaaaaatatattattatttataaataaaagacaaaggtcaaatggattgaaaaatactccctccattccataatataaggcacaaccatttttcttagatgttttataatataaggcatgcatgcaagtatgcaattaaccatgacatcttctgcattaaattattatttttaaaatcatccacttccaattattatatttattatgatgatccaaactataagatgataataattattttttagtattttagttaaagtggttgtgccttatattttggaacggagagaggatcagataataaagtagaagtacacagtaaaagaagagacaaaggtgaaaggtggatcgagagcactcgaagcgcgcgagacaattaaacgggtcgaatttgtcaccatatagtacacgtctcttctcccatcataaatactccacacagtccactacttctcctcgtcgtctccctcgccgccggccgccggcgaacccaagatttcagttcagacgagcaccagccgccgccgccgtgatgatgaagaagacatccaaggagctggactacgtgctggtgccgatggggatggcggtgatggtggcgtaccacgcgtggctcctcctccgcatccggcggcgcccggcgaccaccgtgatcggcatcaacgccatcaaccgccgcatatgggtgcgccacgtcatggaggaggcgtccgggaagcacgccgtgctggcggtgcagaccatgcgcaacagcatcatggcctccaccgtcctcgcctccgtcgccatcaccctcagctccctcgtcgccgcgctcatggccagcggcgtcgcccacggcatcttctcccccggcgccggcgacggccagggcgagatcgtcgtcggcgccggcggcgagacggcgctgtcgatcaagttcttcgccatcctcgtctgcttcctcgtcgccttcctcctcaacgtccagtccatccgctactacagccacaccggcatcctcgtcaacgtgccgctccacgcgcaccgccaccgccgccgccgaccggggctcgccgtcgactacgtgacggcgacgctcaaccgcggcagctacttctggtccctcggcgtccgcgccttctacttctcgtgccccgtcttcctctggctcttcggccccatccccatgttcgcctcctgcctcgccatggtctgcgcgctctacttcctcgacgtgtacaccgagtgggacgagaagccggaggaggaagaggagctcaacggcaatggcgatggcgacgacggcggcgccgccgcgtgccatgaacaacccaagatggccgccggcaacagggtgacgcctcagcaagacgtcgtctgaaaactgaaactctgaaggtgtttgttgcctgtgcctgcatgcaggtgatctggattcagcagctcgttgaatcaagattaataattagtttatgtactttggtataaataaaatcgccgtgcctaggattcaatatctcgttgaatcctagatttgtcgcgacaaattcgcataaaaaatgctttgaattgatgttaagtatgaatgccctacttctttcatgatgataatacttattgctttggacaaagatataatcagactctaaaaactttgactataaataacattatagaaaactatatgtgtcttaaaaagtatttcaataaaatcatatatttattaatatttctatatatattgtaacaaaaaatagtggtcaattgtctttattgtgtttttcccaaaattataagtattatcgagtctgagggagtaatttggttctacaaatggtctcagatttttaattacttcttagtaccagttaggaccttcttcgatcatgtttctacgacacaagtcagtgacttcatgaatactgtttttatagctggtagtattatatcttgtgaaaagtcaattacgttatgtcgtatataagataataggagaatatacacatgcatgttgttattttctcagaaaacaaactgaaagggaactgcaaacctcagaccatcaagttcagacttcagaaagctctatagataagtacttcatccgtttctaaatatttaaccccgttaattttttaagtacatgtttgaccgttcgtcttattaaaaaacttttatgaaacatgcaaaactacatgtatacatataagtatatttaacaatgaatcaaatgataggaaaaaaattaataattacttaatttttttaataagatgtacagttaaacatattttaaaaagtcaacggcgtcaaatatttagaaacggagggagtatattcttaatgagacgacaaaatgactaaacacacctcactaccatgcagcaattatatagtagtactactcttaaagaaatgaagggagagaaaataataccttttgtttttctggatgatgtatcctccggcatctttttttatttttttgaaaactattctccagcctcctgaatctcgtatgacattaatgatacccttctcaccttctgtactctgcaaatgatgctgaatgctagcctgcagtaatgtgaattcttcagaaatttaatttacatctagattatcgagtcaattatatagacctgtttggcatagctgctctagctccagcttctagccaaacagtttcagcttcacctaaaatgagagcggagctgggtggactggtggagtgctatcacaaaatgaactagagaggtggagctgtaactccactccaaactcaactcttggagttaaattttagagttaattggagctctaccaaatagacgcatagttattgaattcaaaatgcgcaaaaattaggataaacctgttcagttccaggcttccagcgttgcgtgatgtacatcatttgtggacctctgcagctgccattgtgcaacatgacttgcaaagtgtattacactcacaagtttgtgtgtgagtaccgaactccatcgacaaaacacaaaacatgtcaataaattgccgtgtttccttatgaacaacacatgtacggtggggaaaaaaatttaaggtgatctacatcgattggcaagttaacatggtacaaaattactggagtgctaactgatacattataataccttaattttttaagttatataaataaattgaagtggcagaactaatttgtatacgtgggcaactaattactctattccgaaatatagcatgcatatacgtacctgaatccctttctacccatccttttagaatctttcggtagatgcagagtgtggtagacgctacccacatggcgtctaacagtcgatctgaaatagccaattaatcttttgaccaaggatcacgaaccaaacaagtgatgataccaaaagaacatctcatcagagatagagaattaaagcgagagcaaacttgcatcgctctggtttgttcacagggcgcggccgtttagagtgctccttttgcgaaaataatatcagcagagatcatcagtatgacatttaaaaacttcattcattcggcgttgtaataatttcaatcatctttagttatattagttagctaggatatctggatatgtattgaatatgatcagaaaagcaactcaagcactagcacgatacccaaacaaaccatcgattagatcttgcaagaaccacagcaccatcaattcatcatccaattcgagaaataagccagacggcatattcataaacgaaaaataatttatgaataaaactttgatatactccctccgtactcgtaaaggaagtcgttttggacagcggcacggtctccaaaacataactttgacttcttgtttctataaaaaatatttattgaaaagtgatatatatatatatatatatatatatatatatatatatatatatatatatatacttttatgaaagtatttttcaagacaaatctattcatataatttttatatttttaagctcatcaattcatgatttatatttctaaggtttgacttaaacattattctaaacgactttctttactaatacagagggagtacatgtttttaatgatctaaaattaaaagctgaaaaataaactataataaaaaaaactttaaaatcaacttcaaatttaagattgataattcaaattttagccgataagtataagcatatgaaaaaagatgacaccataatagagatgtacagtttattacagcacatcgatctcacaaccgctaacttggcatgtctctgtatgtgtactctatatattgtttttttagaactactctatatattggttagctagctagcgagtaccatatctcagctgccattgccacccacttaatttgcatgcctatggagtgacagataacattacaatctgcattgtggaactttccacttttcagaattttgcatgaccgttcaaatggcatatgtaagatgatgaatctacacgcatgcaattggattctcgaatacttaactactccatttgtctcattttaagtacacttgtgagtttccgtgtccaatatatccgttatatttgaaatttatttatgattaacatttttgttattattagataataaaacataaatagtacactttatgtgtgacttatttttttaattttctttatgtttttattaaataaaacgaacggtcaaacgttggatacgaaaatccagaactgcacttaaataaaattgtgacaaagggagtacttcccaacttaactcaaattggagaataacgtgtgtaatgacgacagcaacaacattcgcgtttataaatctaattaaacagcgggctagctagccagcacaaacccctgcgcatgtggccagcaccaacgtacaaggtactttgagttttcaaacgtgggaagcacttgatcgaaagaattaatttaattaagcacgatacatatgatggtcgatcgagttctgtcaccatgtatctagacatgttttacgaccacgtacacgcttagccagggttcacactttagaatcacaccgaaatttcggtagtttcggtgtgaccgaaatttcatgatttccaaactcttttgcacgaaattatttgaaatattaacagattgtaactctggatttgaatatatttgaaccaaatttaacaaaaaaattgaaaaaaaaaaccccaaatattgacagagttgctcgctggtgggcagggttagaaattccggaatggaatttccggaatttcagtcatttcggactccttatacgatattattttagccaaaatttttatcttttttactttttcgtgaagttggtaatattttgtttaaatttgaccaatatttatttaaaaaccgaaaaattaaaccctgccagtgagtcccaaattaccgaaaattcaatctggcgatcagctccccctgcatataaatactacccagtccaacgttgtccggccactaccgttgtgcatgcttgtgtcgtcaacgacggcgactagcagtagcagtagagagtggcagtgagatcagaagagatcgatccatgaagcagctggactacgtgctggtgccgatggggatggcggtgatggtggcgtaccacgcgtggctcctcctccgcatccggcggcgcccggcgaccaccgtgatcggcatcaacgccatcaaccgccgcatctgggtgcgccacgtcatggaggagccgtcggggaagcacgccgtgctggcggtgcagaccatgcgcaacagcatcatggcctccaccgtactcgcctccgtcgccatcaccctcagctccctcgtcgccgcgctcatggccagcggcgtcgcccacggcatcttcgtctcctccggccacgccgtcgtcggcggcggcgtcgccggagaggccgagctgtccgtcaagttcttcgccatcctcgtctgcttcctcctcgccttcctcctcaacgtgcagtccatccggtactacagccacaccggcctcctcgtcaacgtgccgctccacgcgcaccgccaccgccgccgccgcccggggctcgccgtcgactacgtgacggcgacgctcaaccgcggcagctacttctggtccctcggcgtccgcgccttctacttctcgtgccccgtcttcctctggctctttggacccatccccatgttcgctgcctgcctcgccatggtctgcgcgctctacttcctcgacgtctacaccgagtgggacaaggccgacgacgaggaagacgacctcgacgacgacgatgacggctgcgtccccgccaaatgctaaataaaggacggccgtcttggcgccggtagggcgacgactcagtagacggatcgagatcttctatcttaggtcagatgactttaatgtcactgacatgtgggtccataacaaagagtacctatatgttagtggctcaaagttaaagttatataacttaagtcgaaggatcttaatcctcagcagacaacatagcggtatgtgagaacaactttagtgtacagttgaactagacttgctaaaggttaacccgcatacccacagtatgcttagtgcctagtaaaaagtcatgcctcttaaaataaactaaggcactaatgcatgatttgtgctctgtttttgtgtgctgtatgcttgtgaatggtgttgctagttctttgaaaatatatattggaatagcatattaacagcacataaaacgggatggttcattaatacatgattaattaagtattaattattataaatttaaatttttatttattttttcttaaaaaaaacttatatatagaattttttttacataaaaatataccgtttagctatttggaaagcgtgctaacaaaaaaaaatgagaaaattgtaatttggaggtgaagtttaggatagtatatatgtttcccctataatcacatcctagaagtgatctcagatttttagtacattggaccttattcgatcttgttcctgttaacgaccaaatttggtaatatcatcatcggaaaagaggattagatcgaagtggagtcgaaggcggagatcgattcgagaacagagcaagaatcggctggagtccggatcggctacgatcaggatcggctgggtccaagtcagactgggtgagccgatatagccgattctgacaatatgacttggtatacaacatcgggttgagttgatatgcttcaagatgattgccgcacatggatagagtcctgagaaggcaattgtatctattaattaggatattttatataatctccttagagatatgtttcgggcaaaagtctgccgtaaagacttatggtatcttagagtttgttagggataagagtcgtatccgacatggacatagtttgtaattttcgggtataaatagaccccgaaccccatgtaatcaatgaacacacacgttcaatacaatttcggcgcatcgccacccttttgcttttattttatttcgacgagttcttactttcgggttgagctgcatcggtttcgatcttcaacaagaggtaaaacttgttatgatggcttgcgttctcgggattagtacttccatctttatgatactctaatcttgtttatgtaattcgtcgagttatcatatatcttacataatctctggcaatatcgttatctaacctacaatcggctaacatctgttggtatagagtagccgattaggttatatgtcaacgttgacttagattatataagatatctaccactctatgaaaccttcagcggcttgattgtctacatattgttcttttcatacttaatgctgcatcaattgagtttgatctattaagtcgtgcttagaataccaatctctagcctgctttctggttgccgattagagtagtatcgaagtttcaaccgatcttatctgattcaactatatttgttttatatgctttattgacacgttagatctgccctttatgtcaagatattgttgcatctaagtatattaagcttctgtttagtatattctgcttgttttaacatcttaacatagagtcgtatcggagtattagccgatacatgctagatctatctgatcggctatgctatgaacatatataatcctgttattaatatatatttcgatctaagtgatttatactgtctcggcatggcgaccgatctattccagtcacttgatttaagtatatatcgatataagaattatatattgttaatatctacagccgatcgaatagatttatttctttattatctatttgcaactgccgatcgatttacatatgacatcggctcagagataaatgatacgtcatcggcacttagccgatcggctatcgtttataggtttaaccgcggtttgtttgtctttatttcttgttgattgcaggatcaaatcaactggcacgctagcatacccgaaggcgagttttggacctgcactggagttaagcagatctcctaggcctcgtgttttacgtcaatagttccctactatatatgtgacaactgataaagtcagtgccgtcatgtgctattgctttagctagtagcctggtattatattttaaatttttatagacactagaaaaaatacccgtgcgttacaatgggtgaaggctattttaattttattgttgttatatacggtccaattaaggtattttattgctgttatacaatctagttaagataaaattcactgtgggaattcacttgaatatatatattttagaaaatcatgagctgtaattaaaagttcgatcgtcttaagttagcacgcgagtttttctaaagagaattcttatacgaatctttctatatttccaaaaaaacgaatgaacttaaaaaccgactcatgcacagatgacttactaaataccgacaaaaacatcttcaatttttataatagtagagatagagatttgcatgcttgcataattataagtcaattacgttaataaactaaaaatggaaattcaaacctcaaacaatcagctctgaacatttatctccccccataattcattcatcaaatcccacggtccagaatcatcgaatccaacgggtcgagatcgtcgcggaccctctcccctccgcacgagctcctcacgcgcgtcccccaaatccccaatcacgccgccaatgagaaccccgtcactgtcctcctcttcatcctcgccgcggcccaccgcctccgccggttcctcctcctcctccgccgccgccgccgccgccgcgcagtctcgccaccacttcgcgcagggcgcccagctcctcgcccgtgcgcgcgccgccgcagggaccaagaagcggagccccccgcgcggcgctcgccgaggccgaccgcgccatcacccgtcgacgccgccacctcacccgacccgtgctccctccccgtccccaatcccgacgaatcctccatcgcgccgccgccggcttccaccacgccccccgaccatcccccctctccccaatcccggcagctcctcccatcttgcgagtcaccgatcgcccaatgcgggtttgtcgttgcagtgatcgaaccgtcgcaccgccgccggcttccactgcgccccccagccatctctcctcctccccaatcccggcggtctccgtcacgccgccatcaagtcgtcatcgattactcgccctccgatacccatcgcgcctcctcgcccccactccgctagccaggtaagcatcgctcaatccccttcccgttccttcaataattgcaagaattcgtttactcctttgattgtgacttcttggatggtcaaccaatgattgctacttccctatgcacgtattgtattgtgcccggtaggtgttcgcttaaatgccaatgaggagagttatgttaaatgccgttgagggatggatatggatccagtgcccattaggtgttcggttaaattctgttgagggatggatggatcggttttaccattaatgttgaagcaaataagtgcataggtgaattagattcttttgctgtatataaggatattttgtgtcacttgctttggttagttgattcaataactaggtttggttagttgattcaataactaggtaagaataatcggtaggtaacttgtctaagcaaccaattgtcaaatttctcatgaagtggtccttttttttcagaatcattccggtgcagccagcgaccccaacagctcctctcgccaccaccaccaccgtcttctccctttgtccaggtatccattttgtctctcttgtcctccgttggatgtctccctgagggatcgatgcactcatatgtgatgctcctgacagatatttatataaatcgctgctgtcttctcaaattataatttaccgtttttaataatttgtactggcatatcaaattaactgctgtttttaataatttgtactgatatatcaaaatcagtgttgtttttaataatttatacgcttcatggctcataataaatcgctggtgcattgatatctaaatgtttgctcatgtgctatttacagctcaggtgaccggagagaaagagagagcgcaatgtgtctttctgggccaagcgcttccagaattcctcttccctaggcccgcacacgacacgccgggccaccgtttggcctctcgccgccggtgactggagctgagaacgagccccccccccc

SEQ ID NO: 66430 - DNA, 6494 bp, Oryza sativa
tgcaagcaatgtcgtcagcctttaggtacgcatgatcctatgtcgctgcccattcctggccagtgcccggtcccacacctgctcactctccaccgtggccgtcgcggcggccgtgcggcgcggtgacctcaccggcgcggaggaggcgttcgcatccacgccacggaagaccacggccacctacaactgcctccttgccggctacgccagggcgctcggccgcctcgcggacgcacgccacctgttcgaccgaataccgaccccggatgctgtctcctacaacacgctcctctcgtgccacttcgccagcggcgacgccgatggcgcccggaggctcttcgcatcgatgccggtcagggacgtcgtgtcctggaacaccatggtgtcggggctgtccaagagtggggccgtggaggaggccaaggccgtgttcctagcaatgccagtgaggaactccgtttcctggaacgccatggtttccgggttcgcctgctctagagacatgagcgcggcggaggagtggtttaggaatgcgccggagaagggggacgccgttctgtggactgcgatggtgtcggggtacatggatatcggcaatgtggtgaaggccatcgaatactttgaggcaatgccagtgaggaacttggtttcatggaatgctgtggttgctgggtatgtgaagaattcacatgcggatgatgctttgaggctgttcaggaccatggtcagggaggccaatgttcagccaaatgcatcgacgttaagcagcgtgcttcttggttgcagtaacttgtctgcacttggatttggtaagcagatacatcagtggtgtatgaagcttccgttgagtaggaacttgacggtgggcacgtcacttgtgagcatgtattgcaagtgtggggacttgagtagcgcgtgcaaactgtttggtgaaatgcatacgagggatgtggttgcgtggaatgctatgatatctggctatgctcagcatggagatgggaaggaagctatcaatttatttgaaaggatgaaggatgaaggagttgagcccaactggattacttttgtggcagtattgactgcttgtatccacactggcttgtgtgattttggaatacggtgtttcgagggaatgcaggaattgtacggaattgagcctcgggttgatcattactcatgcatggtggatcttctctgcagagctggtaagcttgaaagagctgtggacttgatccgctcaatgccctttgaaccacatccttctgcatatggaaccttattggctgcttgtagagtttataagaacttggagtttgctgagcttgcggctggaaaactgattgaaaaggatccacagagcgcaggtgcctatgtacaacttgcaaatatctatgctggcgcaaatcagtgggatgatgtctctagagtaaggaggtggatgaaggataatgcagttgtgaaaacacctgggtatagctggatagagattaagggtgtgatgcatgagtttagatcaaatgacagattgcaccctcagctttacttgatccatgaaaaactgggccagttagcggagaggatgaaggcaatgggttatgttccagatcttgattttgtcctgcatgatgtggatgaaactctgaaggtgcagatgctaatgaggcacagtgagaagcttgctatttcttttggtctgattagtactgctcctgggatgaccttgaggattttcaagaatctcagggtttgtggagactgtcataatgcagccaaggtcatctccaagatcgaggatcgagaaatcattttgagggatactacacgattccaccattttagaggagggcattgctcatgtggtgattactggtgaagaatgtcgatgacaacagatatatactggcatttttttatggggattcagcactatttagtcctgtaacaaggaaaaatgttgatcactgtatacaggaagcactcaacagtcaacatgtgagcaatttaccaatgcgatttattcctgatgttacttttgacaggtttttatgctttccagactaggtgacaagtaatatacacattccctcgagtacatatcggtgcatgaatacatatcaagactgtatggaaggattgatgaagtgcattttacttatcacatgtaggtactagcgatttggggaattgtatgagccaattcccaacactgagtagctgcaatattgtattcctagagttgtgattttctagaatagtaaatgacttttggtcaaccttgagttttaggcctgagttcctggtcacatattttaatagagttgtgattttctagaatagtaaatgactttttgtcaaccttgagttttaggcctgagttcctggtcacatatcacatttaattcagctgtgatcagtaaactgaagttcttgactttgctggcctgtgttaaattcctgcctattcatagtagaattttgtttacctgtcctatgtgtttttttttggctttaacaaattggataaaacaggaccgaccaatgtccaatgatgaactgcaagatatagagaaagtgtcaattctgagtccttttctgtttcatatggtgagagcatcttttcaagatggtcatggaaaggaataacagtgaggtaagtttgaatgccttatgtaaaatggtaacatcactgtcatgttttctaactcttgaagactaaagaaaatggaaaaaattcctacaaatagtaagccatgcagcacaactaatgttagctacatgagattaggaatgatgcacatcatgcattcatgctggaactgaataagtttagccttattatccctgtcaaatatgtgattatatatctgtaaatatctgattaactcagattggtgaaggccagcaatcagcatcatctgcaaaggtcataaggtagagattctctacattttccatgtcaaaaaaagcatttcccgcaatgtagagatcatcagcatcaactccacaatattcaggagcctggggaatactgtaaggttaatatctctctctctctctctctctctctctctctctttatttattttctttatagtagtattttgctgcgtggtagtgaactagtataattcagtgatctagtcactctattctctcattaagaagactagtaatcatgcacgtgcaatgcacgtttctgtaaaaattattggttcagttctattaatagttaaaaaaaaataaattcattgtaaacctacaatgtcaacaacttaacatgaaacataagtggcaaataagggtcttcttcactgacaaataagcaaaaggactcattagtcctttttatttccgttgccatttcaaggggaaaaaaaagaatactaagtactcacttcatttaaaagaaaattctgcaagtgccattaccagttaatttttttttgcaaaagcaaccatagaaccatcctctcgccatagcaatgtgcgaccagcagataaaaacaataatccagttaatcttacaatgccagactatcagtcacaggaaacaaaattgagatgtcaggtcgccaactgagacacaaagtactgctacctcccctccttagtctcattctcctgcatgttcatgcagatcaaagtccagagattcgagctagcgttgatggcattgggtaggggtgaaaattaaatgtacgataatggtttcacgtttcctttttcagatgagctccactccggtgctctctacttgcagtagaaattaatctgaaccgtggatcatatttgatcaaagggttgagatttacttctactaccaccacacttgatggtagtagaaatgtggaggggtattattgtccatagaaaataatgtgcggaggggtatgatcgtattttgccgccggccccaatcgcttcccacgtctctgccgctcgtgccactccatcgccacctccaccacccgtcccccttcctcttcgcacttgccgcctccaccaccctcgcagcctccgacgcctctcccgctgccgccgccgccgctcgcctccgcattgcgcagcgcctcctctgccggcaggtgcagcactgcctttaccgggccgtgtcgcagcccctccgccattgggctcaggggcttaggctggcagccgccgtcccccgaccccatagcagcatcaaccctctgtggccggcactaaagcagcacctctgccgctgagcagcaggcaaaaagcccattgccatggagaatttatcttctctccggtattttgatcttatgtgctatctcttgattttgcaattagttcagttctcttgcatgccatgctagtgtgcagtgtaccagcgatgccttatttgagttctgcttaatgaacaaatacttttgttaacggagatgtgtgtttttgaattgtcagttgtttttatccactgttgatattttcagtataaggtgtgagtgatatgtcataatttctgcagaacaaggtagcgtgagggacattcttctcgggacagacaatatatgctctagatgtctattacagtgatttctgaatatgccgccgtcttaaggtaactatgtcgcaaccctgtactgtgtttctttggttgttcttctctcatttacagacagagtgattatttattgggcccttctgtttgtttgttcacgccaaatgtctttcattgtcagttgtttttatcaatttgtgatgatattttgagcacaatgtgtgattagtatgtcataatttctgcagaacaaggcagggtgaggcaatacaaagaaaaactttttcagcttgtgatgatattttcagcacaatgtgtgatcatatgtcataacttatgcagaacaaggtagagtgaggcacattcttctcggacagagaatatatagaagagtggcaagacaaagaaaaactctacatgcatattccagtgatttctgaatattcactgttatatgttctcgctttgttcacctataaatcagcatcttatattatctctggtgcagcagaaacccgtcatgctaacaaggttacggcgtcgcaaaatattggaaaagagaagtttgtggttctgaaagtgtcgatctgtgtatatcatagcttttgtggctgaatgtatactacttgtaattgcaattgtgaagtacctgtaaaaaaaaaacatactggtttattcttccgttgccttatgtctgtcatagttggattggagtgttttgattgaaatttggatttagacccggtccggacagtctcgtttgaaatttggataaatttcatctaaaaataaaaacgattttggatgttaaattatttcaaaaactttaaccgagttgtttatgattaaggcggacagtcccatttgaatttcagataaattccgtctaggaattaaaggagtaaattttacaatgggccacatattttgaccaaggtttcataatggactagggttaaatcaatgttttcacttaacaccgtacatctttacataagttttcagcttagactaggggtgatcaacacaagagaatatgtgagagagtttcatgtctaaaatatgatttacacatggataattataaaagttttcagtttagactaggggtgatcaacacaagagaatatgtgagagagcttcatgtctaaaatatgatttacacatggataattataaaaggcataacattttatgttttcttccttctttttagtgtgtggtacttaactagttctattttctattttatttttattcatttgccccaatgtattgatcattttgtgccacttttaaacatgttcacatcattattttagtgtgatttgctgaaaaaaattgttttctgatttgctatttttttttctaaagatatgtatcttaatactgtggcactaaaattgatgattttaactatcttttctctgacaacttcttttgatgtgctcaatcccaattcaaagtgccaactagtgcaaacgtatatggtgttaagtgaaaaggttggtgtggaccttacccattgtgaaactttggtcaaaatacatggtgcaatgtgaaatttactcgaattaaaatgattctgaatgttaattatttcaaaaactttaatcgtgatgtttatgatttagacctagtccgaacagtcctgtttaaaatttgaatagattctgtctaaaaattaaaccgattttgaatgttaattattttgaaaattttaaccaagttgtttatgattaagacctagtccggacaatccaatttgaaatgcggataaattctgtctaaaaattaaaacgattttgaatggtaattatttcgaaaactttaatcgagttgtttatgatttagacccagtccggatagtcctgtctgaaatttggataaattccgtccaaaaagtaaaaagattttgagtgttaattatttcaaaaactttgaccgagttgtttatgattaaggtccg

SEQ ID NO: 66431 - DNA, 9281 bp, Oryza sativa
  unsure (1)..(9281): unsure at all n locations
taaccgaatgaattgcagacgtaaatatttttccttttttccgttgtcaacccgatctagaccagatgaaatcatgataaatttggtgtaaaattgaaaccgaaatttgttgtgtttaaaaactttaatccagttttcttgacgttgtagcgtagcataacctgacacgtttttttttattcaacacgttcttttctgatcggacgtacggagtacgttcttttataatcacatacacacgtgggcccacgtcattagttggtccacacgagtctgcacaggcccagagtccgtacagcccattgacggacaaaacatccggtgccaaaattacccctagtctatattagtactcctacattagtacattactagtctaccttttaaaataaacggtttagattatttctagtatagtacggagcgtccctcttttcagatgtataggcggttgtgaatatgaatatgctgaaattttgttactttggcccttttgtaaaacttattttgtaaatggattgtgtcaaaaactaactatagagtaaatttcaccgaaccacacatattacggtttaagttgtacaaaaccactggaattttgacacgtggcacataaatctagatattataaccataaagttttataaaatcacactattgattattttattttgatatgccatacttttgagttatatcatcacatcttaaatttgtatgttctttacccatcatacaaagagcaatggcaattaacagataaactataagcacgttttcatttttcaaggacctaagagcaagagaaaattccctacatacacttgaaagtttcgcaatcttttctatacctctaaattttgcctcatccactacatgcccttgagttttcattttaatctcctctatccttattccgttagttgaccgtaagttgactgttagatttttctaaaattaccatatcatccatttctcatacttacgtgctatctacttcataattcacaatgtgaaaaattgtaattcatgataaaatcaaatggggcataattatttattgtaaaatttgaaaaagaaaatttaaattgttgaacaaatttattttttgacaaaatccatataagagttttgctagaaatcatgaaccaaaattatttatttatcgggttcaaattttgatgaattttgtaaaagttaatttaacatttatttaaaaattttagatttatattaaattttgttgtcaaataattatattcccttttctttacaaatagatcttttttcatataagaattgtgtttttggcactaaactactcacataagtatagagagaggtaatatagtcaattttaaaaatattttaacggtaactcatggtcaactaatggaatagcacagaggagatcaaaataaaaacttaggggtatataagggatgaggcaaaatttaggagcggatcgaacaaaggccccgttcgaatccaaataaaaggatggatgaaattttggattaaagtggcacgcttttcaaactgctaaacggtgcgttttgtgcgaaactttctatatgaaagttgttttaaaatatcagattaatccatttttcaagtttgtaataattaaaacttaattaatcacacgttattatcacctcattaatttacgtgaaacacttaatatttatcttcacaagattcaaacaccaccaaactcccatggtatagaggggagcaatggcattgtagaattacataacttaataacaaaagagtgagaaactttcacgcagagaagcgcccatggcctaatggataaggcgtctgacttctaatcaggcgattgtgggttcgagtcccactgggcgtgacttttaattgattttacttgcttttctttttttcccccattttttcgattctgccttttttttttgcgggatactactaattatttgctctaagaagtaaatttcctctataattatacatgtctctttccttattcttacttttggctaacctggcctatgtatattgtatccaaatgactcgtgtcatcgggcgtatggttagctgatgctgttcgggccattgatatatgggcccatacagacgatactgatcggtatcgaaatgaaccatcgttaaatgaaagagccatatgatagtcatgatacctaaggtttaattaaaatttacacaattcattctatctatatagatatagatagttgatgtgtactaacttctaaagctcaacgtgtaagtgtgcacatcaacacctactagtaattattatctacagtattttaaatatcatacaagcataatatatcattttacaattttattgtatttttagaactcaatatacaaacaatctcaaatcattatcttcataccatttttatattatgtaaacatatatatctattatttttataatgtattatatatatatatatatatatatatatatatatatatatatatatatatatatatatatatatatatatatatatatacacggggtatttttagaatgccacgtagatcatttttttagaaaaaaattatttgaaatcgaatcaactcaatttacgcgaaatttaataaagggaaaagtctattttacaccctccaaattttgtgtttgtctaaaatacactcccgaattacaaaatcggatataatacccctctaactattaaaaccagacactttaaccccttgagttgtttttatggtggttttggtacacgtatatgctaggtgtataaatgatctacgtcagcggttataggccaaagccagatgtctctctcttcggcgggggcgaggctctacaccgtggtcgagggggaggaggaggactggcccatcttcttccttcctctccctccgggagaactcgtcggaggcttagagctctggtatgcttccctgagcttagccaaggagagcaagcacgccgccggcctgtattctcctgagcttggcgaagggagcggtctctgttgagctcattgccgatcacctcttctccttgggcaaaggggcgggctcggcgccaacgccatcttcttcaaactcggcttgggggtgggcttcgcgttaggtagacgacgcagcgggaggctcaccaaccgctatttccatctcgttctggttgttccttaaccagtcatctttctcgatctgcttggtccaccggcgtgcgactgtcaatcaagggctacataatctccggtgtgttctatgtcaccgccgccaccggccatgccgtcaaccaaagctccattgatgcagtaaggcagagggttggcatggcctgtctcgttgccaagaaggagcaccggcggcatctctactagaaatcccgaccggatcaccgtgatggtagcaatggtggcagcacattggtttgttgttttaccttggcaacttttttttttgactaaagttgccaactttgtcaagaggaacctggtcagcttgggttgatcaaatcgtgctcatagacatgaagctaaaatcgagaattaatccaagaacaacccaacaattcagtacgtagctgatcctcctccgtgccaccgcctctgccagctaacgccgccgccggctccggcaagccacgcgcgcggctgctggccgctgcacttcacggcaaaccccgaaagggctttggcccatataaccactgatgacgtggagcatttatacagctgacatccacgcataccaaaaccaccataaaaacatattaaggggttaaagtgtctggttttaatagttgtagggtgtattatttccagttttgtaattcaggggtgtattttagacaagcacaaaagttagagggtataaaatggacttttccctttaataaaagaaatttatcgcgtgtcaaatatatggctttaaactatactagtctggaattaactaaagtaccaatcaggaattcaacataaaattaacgtacatcaatcattccgtccattaaattctcaaatacatgtcactatcaggtttcccctaccgctagtaaccgcgcttaccgcatggtacagtaggcattaccggtggtaggatttgatgaattttgtccaaattcaaaattttgaaaaaaaatccatttatatatttcttgatttgaagtggcagatggtgtagaattttttttttttggaaaggagtgagataaattcaaatttgagggcaaaacggaaagtacattagaaaataaaaaaagagaaataatataatgagccctaggtggacaaaatatccgacccattaaggcccataagtggagaaaatatctcccgggtcctcttatctctctctatcgcgctacctctgacacatactttcaaatgtgagcttgttgaattattatgctacgaaatgttgaattgcttcaagtccataatatagaaaaggtcatctcgaattttggtattttacaccaaaagttaggttcgcaagtatcctatatattcttcaaattatccttaatttctacacacatttaagtgttattttcaattttttaggactgtttctgttctgctacacaattggcggtaaccgcgccaaaaccgcgaaaccgctgatttctgaattcaaatatttaaggatgaatttcacgtggtttttgggtaaccgccttaccgccagggggataaccccctcaaatggtaagggaaactcttatcactattgaatatcaatgttttaactttgatgactaatatttttagatatttagattacaataaatgaaagattagtgcttacattaaggacgtaacatactacggtatctttttaagtatttattattttttttaaaaaaaaattagtgatcaaagttaaaatatgtatcttttttaatagaatattcattatttgctttaaaaggatacatccaattattacataaattgcttgataaagacggtggattacaaaatcacaatttcatttaaagtatgaaaagttcttataacaagatcacgatagagataacaagttgcatgtttcttcgactgtataaccattgtttcttcaacgacatacaagttgctcttgtctaactcaaatcatgaattgaaacagaaattctaaaatcaaccgtttgatgatcattgtaccagtttgattttgctcacatgaccgtggcagtcgttcgtccacatctttgccaccgccgcagccatcaaagccaccaagagctgagttaggtttccaacaatggacgctgccacacggaaaaggacttacaaagtgagaataacaagtactacctccgtatcccgttgaccttttattcaacgtttgaccattcgtcttattcaaaaaatttatgtaattattatttattttatggtgacttgatacatcatcaaatgttctttaagtatgatataaatatttttatatttgcacaaaaattttaaataaaacgaatggtcaaacattggtcaaaaagtcaatggcgtcatacattaaaatacgaagggaatatttagtaatggagatagtataatattttgagtacctatattctttgttatctactacctccatccgaaatataaggagttttagagttggacgcagtattatattaagaaaataggtagaactaaatgatggaggattgtgattggttgaaaagtgaaggtaggtgataaaattgaatgatggagggttgttattggttgataagggaatgttgatggagaatttgttgtatttaatttgggacaaattttaaaggctaaaaattattatattttagaatggatggaggatatatttatcagacggatattaattggtcgttcctctcttaaaaataaaatagaatgggacagattgatgaagaattttcaatacaagatcgcaaggctaaagttaattaatcttccgcaactgttggcgtgattcttctcgatctcctgaaaaagccaatcgagagataactgcatgtgtgcacttaaatacctaatcaccatgatccccatcgatccgggcacaatgtttggtcaaaatcagcaaataaattttctacacaaactaaatttattggcttgtccctctgcatatggctatttagctgatttcttaaatggaaatgatgacgactaaggtgctgcgtggccactgtgattcacttccgaatctcctgagattacatggatcgtgcggccatgtagctacagctttgagaacatgtgtgatcactgttttgatcagctgtaaatgaccaaattagcaagctaataatatatcatcatcaactgattgtacttgataaaatgtacttgggcatgatgtaacaaagaaaatagcaactttttttttaagagcaagcaatcttaatttgcttccaagataaacacatcaagtgtccaaaacctccacaaacaatatatctacatcaggagctttatatctaggttgagcgttttttttttttgcatgaaaaatgggtaaaaagtttggctgccaaatgctctgcaggattttagggcttccgtttgttaacatccctgaagataatatatggagtataaatatacaattaaacttatattagtgcataaagaaaggcttttttctagctagatacatgtacatgtatgcatgatttatggacactttggcataaaaaaatagttgtatatgtgtgtacatctcatctcaatcagttgcaacaaggtttcttcagagtccaaacattcagttacatacatatacatccctaattaattaaatattccagctatgtttaatttgtccatcaaataaactaagttgtcaagtcacaaagcattatcagatgatcatcagttatccttccatttttggctataaaaatgggcatcgttgcttcccatttctaggcgtgtgcttcacacactctctctccctcttcttccaaagctccaagctcgatcgatctcgccatggcgatgcagatgaactcggtagtgcacgtgtccacctcgccgtcgccgtcgccggcgacgtctcctcctccagaaggtaagcaagaacacggcgaggtggcggccgtccatgtcgtcggcgtcggcgacgacgaggcggtgatggtggtgaaggatgaagaggcgtttggcggcggcggcgtggactactccggccgcgcgcagtggctccgcgcggcggttctgggcgccaacgacgggctggtgtccgtggcgtcgctgatgatcggcgtcggcgcggtgagcgagtcgggcagggcgatgctggtctccggcgtcgccggcctcgtcgccggcgcgtgcagcatggccatcggggagttcgtgtccgtgtacgcgcagtacgacatcgaggtggcggcggcccggcgcangaggaggcaacgccgccgacgctgcgacggcgacggcgaggaggaggggagcggccggcttccgagcccgttcaaggcggcggcggcgtcggcgctggcgttcacggtgggcgcgctgctgccgctgctggccggcgggttcgtccgcccctgggccccgcgcgtcgccgccgtgtgcgccgccacctcggccgccctcgccgggttcggggcgcttggcgcggcgctcggcggcgcgagcccggcgaggtcggcggccagggtgcttctcggcgggtgggccgccatggccgcgtgctacggcgtgctcaggctcttcgcaaacttgtactaaaatattattattgtgtcgacacattttcttctcgattgcactcagatttgtatggtgtttgatctgcttgagattagtgctagcttgttttgcccgtgcagatgtgactcgactatgcgtttggcccattgtgattatggtttagatttagagatgagaaaaattacagtataaattttaagatttacatgcaagatttgaaaattataatgtaaatatataaatatgtaagtacattgtaatgtgtaagtgaatataattatagtgtaaaaacgatttgactattttttatgaaaaatatgataccataaatatagctactcctgtaataatttaataaaagatattatatggaaaatgttgcatggctattatcgagttgcatgcatcgaccaattcaaccaaaaagattaagctgatagagaaatgtgagcaattcactttatattccaacatccctcctcacgtgagaccccctcaaacatctagcttagaataaatgcgaacaattcactttatatttcaacacactccttcacgcctcctttgcatgaggccccctcaagcctatttaagctgatggagaagggtgggcaattcactttatattccaacactccccgcctcacgagaggccctctctaacctctaacgtggaatagaggtgggcaattcactttatattccaacactctccattacgcgaggctcccctcaagcctcgaacgtggaatagaaatgggctgtagtttttatttaattacgtaccaatcagaatttaaactcaagactcggccagtaagatagcagtgatgtagtggtgaggagtatgctagagatgaagatgccaaaaggggtccaaagtgaatcaaaatggcaacaaaagggagtccaaagtgaaaattttgatgaaagagatccaaaataacactacggtaatacaaaaaaggctcaaagtaaagtttactccgatgtttatgtgttatatcgactgtacaattaatacaaaccgtccgattctgatccaacagtagagaagatcctaaatttatattgcgatcaatggtatcgaactatcgatcttattgaggacttggtggaaatggtagagatattgataaggatctttctgcaaaatacagcgaaggctttgatcggacggctgaggagagacgcagctctggtcgcggacctcgtctggttctccgccgccgcggcggccgccggcgattactccgccgcctttgcccgagctcgctgcggccacggtctgcgcagtggagggggaggaggaaggggacgagagcggctggaggctaggccgaagcgggggtaatgcgggtgagtcgattaatctgagtttttttttttggcaattatatggaggggtatggattccccaatccttgtcgtttctgttcgagccgtatgattttgatgcgatttctagcttagctgtacgtttcgtgagggccaaaccctctcgtggatttgataggggtttcttcatgattgttatcttcttcctccacattttag

SEQ ID NO: 66432 - DNA, 1299 bp, Oryza sativa
ggaaatgaaatgttgggctatcctgtttctaacaaccaattttattcctagcaatataaactggtaaattttgtttttacatgttttagattggcatcaaatgctcgtcaatggtgccaagtccttttattttctgctgccgtcctatctgaagaagtggagatcttgaggatcagtctttcattcctttgctttgcatacagtacaatcttgagtaaacgccattgcttgttgtgaccaatgtttcgtggctgcccatctcgaccacctcgcctttgtccatcacgacgatcacatctgcacttgtgactgtggatagtctgtgcgcaattgtgatactcgtgatcttgttcgatagctcaccttccttgcttttccactcctttgctgccagggagctcatcaccaccttctcggtttcaccatccagcgcacttgtcgcctcatctaggagtagtatgactggcctcttcagtatagttcttgcaatggctattctctgcttctgccctcctgaaagttggcttcctttgtccccgaccaccgtgtcgtacccatttgacaggccactgatgaactcatggatgtttgcctccattgcagcctcaactatttctgtttccgatgcaccttcatttccatagctgatgttctctcttatggacaaattaaacaagattggctcttgctgaactagtcctatctgttttcttaggaacctcagattgtattctctgacgtccttaccgtcaacaagtacctgccctctgcaaggatcatagaatcttagcagaagagatacgattgtggattttcctgcaccactgggcccaactaatgctaccctttggcctggttcaatagctagactgaatccatccaatatgatcacatcttgtcttgatgggtagctgaaactgacatcttgaaactcaatgttgccagtaattctgtcttcacaatgcacttttggttcatctggcacgatctgcgtttctctgtcgagaatgtcgagtgcaggatccaatattgcgatggccgatataaccatagggatcaaagaccataactctgtgatggaagttattgtcagtgcaattgcttgataggcccgtacacagttttcaaatgttgctaggctcttgtcaagtagcacaatggtgtaactcaatgcgatggcatgtgtcatgtgccacaagcagagggaaaccccttgtaccaccccatactttatgctctctatcctgcttgtctgcattggttcttgcagcgacaaatctgctttctttagtatttcct

SEQ ID NO: 66433 - DNA, 2088 bp, Oryza sativa
cgcggcggcccccgcgtcggccggcgagcccacgcgcgacgtgcggtgggaggtcggctacatgacggtggcgccgctcggcgtctcgcagaaggtttggtggcgcgccatggcgtgcgctctgttcttgatttcttccgagaaatttgggccgccttgtctgatattttcttcttctttttttttgttttctctccgacatgttcttcttcttctctgtctccgttgattctgcgcgagtttctcgggtggtttcaaatcgaaaaacgtctctctctctctctctctctctctctctctcttgcgtggttttgaggtttgtttgatgatgaatctggggctaaaaaatgcttcctaatttttttttcgccggtttgcgtgggcggtttcgatcgcaccgatctcgtctcgtcgtggcggtttctgttccatgttcttgcaggggttgtaaatacgcgttgatcgatctgtcctaataaaagacgacgtaacctcatttcctccgaaaaaaataaatcggatcccgcaaactttgcaattttatcgttgataaaaggaaaaaagatcaacattgcgtacaaaagagaggggaataatgatatcatcttttctgggttggatttctgactctgtttctcgttgattttgatccttttgagtttttgttcatctgcgaaacaggtttgttgttgaaaattgatccatttcgagataaaacagaacacatttacacacaccagatttgagatttacagatagaaaatctggaaaaggatttgcggacacaattcttgtgcaagaatttaggggtgtcatgctcttgtttagttacagtcttatatttttttcttaccatatcaatatgaaacattgcgctatcttatgcgtattgttttaaaaaaatctagtgtaagaattgttttctgatggcatgaatgcaaatacttgtttttttttttttgcaggtgatcgcgataaacaaccagttcccgggcccactcctgaacgtgacaaccaactggaacgtgagggtgaacgtccaaaacaacctggatgagcccctcctcctcacctggtatttactaatcctgcatttcaattgcatagatccaaaattgactaagctggactagaaattttcgttaagatatttttatataaaaaaatcatgtattaatgaaaatttgcaccataattttcagtttctgtttctggtgaatttaaacagcacattcatagtgggattttagctgtacatttccattctgtgggggcctcttgggcttcacattaggcatgcatgctgcatttcggggaatttatgggcttaattagttgtgtcatgtagccaaatattcttatgctatattgagaatttgagataggataggcacaccactgtacttatccactggtttgcccattttctcaagttcatccgtgcaaaatgatcagtttcatcaacagttcattatgttgacaacttaatacattattatgtcaataatgcatttctaataagaataaatttcacttcaatacatgtgttcttcttgaattactgtactactagatcgattactagctaataaaatttgctgtacacaatctgtgttgcactttgcaactgaaaacaaggttagaaatgtgaagccatacataatagtaacatgcaaaatgccaaacactagagggtccttctgcaaaatttccttttaaaagtgagcctaaggctttgcctgcaatgggtgggtgggagtcattggcgccaaattttctctgcattggagtcttggagagctcagagctcacctccctcttggccatggcagggatggcatccagatgaggatgaactcatggcaggacggcgtcgccggcaccaactgcccgatccctcccgggtggaactggacctaccagttccagctcaaagaccagatcggcagcttcttctacttcctttcgcttgggtctcaacgagccgccggcgggttcggcccggtcaccgtcaacaaccgcgccgtcgtgccggtccccttcgcccagcccgacgcgaacatcactttgttcatcggtgattggtac

SEQ ID NO: 66434 - DNA, 15866 bp, Oryza sativa
caagcaaacaactacaacattaacaaatgctaatgtcaatttaatgaatgaaagttatagccactgactagtaaacaacatcaggtttttccttctaatacaaggcagaactagtatactcaggcaactaaatgaatcataaacattcaaaaatgcccgatggagtggcgtgaagaaggataaaatcgccagaagactatctgtgcagctaatcatgtgcagaaatagctcagtacgttctatgaaaacataccgctaaaatttccatgtcgagaactggaaaagtcatttcttgtcaacgccccctgtattatacttgcatctttgccttcctgcacaaatatgtgtgtaatacgtaaaattcctgcaggaaaagagagcagagtaacctttcaaggagagtaactttgcagagttagaaaacaagtcccaaagaagatctatgtattgatcagcagcattttaagaactaataagaatatcaagataaatttccacgggcataagaggtttttgttagctgccgattccattccaagttaggcatgtgaaggtttgcactggtcctaaaaatagggcatccaataattaacgcatgcagttccttacctcaaaatggtgcctacaggatccaaacaagcttagctggtcctcgtagcacagcttcagttgtttgcgaaagctggagaactccgtaagcacaatctgctcacactcttgtataagactttcattcagtccctcttgctgcatccgattccgaagcctggcagtcgagaccgaaacatcgctttgcacaaaagttatccttccgctgagtgatcttagcgaataaaaactcctcgccaagatcaaggcctcgatccaggcaacacggtcttcttttgaatctgtcttcaaatgaagtgtctttgtgggggaaaatatgtagaatctcctatcatccgacttgctctcccgaaatgctgacaactacaacataatgtccagttagctttgctatgggagaccttgcacatgaaaatgcagagtgaactttccaacatgtaacgctatccatcagaaataaaatagagcacacacacgcagactaccatccatcgtgttaatcaacagtcaagctaaatgcttattgcagaccaagacaaataaaaataaagatccaaagaccattagtttggcattccaggaagaaaggcatgtgaatcacttccactcccttcaactttaattaaagggtgagggggaaaaggcaagcaaaaggtacatcacatctaacatcaaaatatggagagaaaaaacaacgacaacaaagatttcaagaaaaccaagaaaatacaatcaagatggtgaccactaccttggaccaagcaagtgaagtgggcaagtagagcagttcttggagatccacaaggcccctcctgattcactctaacttacacacaggtcctctatttcaacccctaacccccttactatcttgctctagtatatgtgaccactggaagcaaagcaattgtacatcctttaattgttggggacccatgagcaatggccttgaaaagactcagtgctagtacgactactgcgagttcaacagctagtaaaagacttgtggaaaagcaaccctctccctctggagcagtacaaatcaataatgcaataaaattcaaaaattaaaaaaaaaacattcgctgagcatattctgtaaccacccggatttgttcaacttaatgcacagtattaaccatgcttcattaaggattaattgtgtcacagttggaattaattatatcatctacatttttttaatacgacagcgagggacggataaacttcactgtcttcatcgttctttagagttgccacagaaccctgccatttgtaagaaattctacaggagagcttgaaattttggctaaatccactaaaagttgagggatttttgtgcaaaagatgtgtctggttgtgtgatagagaaaggtgcggccctttttttttttttgggaaatctcgtatcaggaagagaaaaataggaatcatttttgttcatttgtaccttaacctgatactgctaaatttaggcattgttctgtggcattggaccacgaatgagatgattggtcaatcaaaacctcaggtgtttaactgctccaatatgcccccccccccccattcatgtcatgaacaaagcagaaattaattcggaaattttgttccattccaagaacacacaccaagatcatgttgaacaaaataatcgtccaaatgacaaacaaaaaagggaaaaaaaacttcaagaattcgtgaggacaaaagaacatcacgtcatttcgatccagcaaaatgtgacgcaatctcccaactaaccattgcatagtaacgagatttcgacagagaatcttccagtctctttcgccaacgcaaacgaaggaacaattcacacactaacacaatgcaaaatgtgattgatgcttgatcgattcagattcggaaagaggaagaaagagaaaattcctcgcagacacagattcgcaaaccgagaaatgttggggcaaaaaaaaaaaaaaacatgatctgcgagatcgcaggagaggattgggttaccttgaggcagacgacgccgacgggcttgtccggacggcgcgcgccgccgatcctggcggaggcgccgccgatcagcctgacctcgccgccgccgccgccgccgccatcctcgtcggcggcagcggaggcgtccctacgaatcttggagtaggagagcaccccgtcgtggagcgagaaccaccgctcccgccacccgcggccgtagttggtccacttgtggagcaccccggccaccgccaccgccgcgccgcccgcctcgggctccggcgtcggcggcgcgtccggcgccggcagcgccgccgcggagaggcagcagaggccgtggtggttcaggtggtggtggacgcctccgcctccgccgccgctctgcgtcatccgcctccttgattcgacggcggcgacgagaacgaaaaaataaaaagaaaaagagaaaaaaataatgggaaaaaaatggatttcttttttctttttttgggttcgcgaagaggagcgaagcgaagggaagaggagacgcgagttggctttatttagcagcggttggttgctatttatgtgtgggccccacctccctcgcctattttatgccccctccattttttttcttataagtcgcaaaaaagcttggaggagggttgtttttttctttcccaaactttaatttggccatttcttgagttaatttgtatgttttccacggatttttctcctttttgtcctaaatgcatccaagcaactggctttttttcttcacctttcttctagatgtaatcttgtctacgaaatacggattatgtttcagttattataaatatggtttatctctcaacagtttcggcgcataactataataacgacagcgctacgacgatttaactaccgatggctttgtcagataatcataacataagacaaagccaaaagcatatctttttatatgaactaaaattgtgcaagaaatttcattattaaggtttaagttaaaacattatgttactatccatctaaatgaaaaaaaaaagaataggcaagctaatagattgagtggtcgactgaggtttttataaggttgtgctagcacatataattccttattcatttaatggtataaaacatattcatcgacagtaacacatccgtgataattctgtgaatctcaagatatatagatcggtctagtctttggaggtgtttatagaagtaggatatatgcatgtttatatgagcggttgtgttttacattgttttatatatatatatatatatatatatatatatatatatatatatatatatatatatatatatatatataataacttagttttatactagaacacaagataagctaattaaaacaagaaagaaataattataattaaggaggggagagagacgttaagcaaggacatggatactgtttaccagatgtaggggagcacaggatgtcatagggatcaggagtggttcacgtgctatgactagatttagtgggccttaatgcatagttaatagtgtaccagctagtggaggtgagtgcaacatccacctctcaacaaactccatcacataatctagaccttaattaacctttggaaccccttaggtttactctatgtgtgcaagacaagataggtaactggaaattaataatgttagaaattactgggagtaccttcaagtttacacaaaagatataaatgatgttgcatatcttatgcatatctatactactttaaaattaacaatataccaccactatcctttatcactaacatttgagcccctcaatatcgataaaatttttgtgctccctaattcatcccttttccatgacaatacacgggcaaactagttagtatatgaagtatgttccggtggcactataggtttatcaaaatatgccagcttttggctatgaaggtatttgacatgatttacaactaaaaattattatattttgggacgagacgacatgtgtttaggtgtattggcaggcatgccgtgtgtgaatgtattgatgacatcgtgagagagaagaagaaaaagtaactcttgggagaagattgctaaaccataccagtgtaaaaccgtgtatttttagcttcaaatccaagagcacggacagataacaagtgatgtaaaagttgatcaaggttgtgcatacacttataaaaagcacatgagctgcacatgatgacatgaacatatatatgcatagaaaatttcacaactcatgctagctccataattcttgcttaggtactatctccttttgtcccttctgttggacatttccacttcaatttggaaggtctataaaaaaaatgatgcaaatgtttatagcaatgccatgaattttactcagattatatatatacacaacaaattgaccatggatgccattctttttagaaccgttccaaaattaaagggacatatacaggaaagtcggagtcatggatgcatggattgatacaaatgagaaataataaacccatattcttagaatcttaatagcattttcaggtatagttatttttcctagaaatccaaatattaacttttgaagggccctagtacagaaattgctatagagcaacaaattaatacaagtcactttctaagcaatgtttgcttacaagataaactttctcgtcatccattaatttttttttaaaaaaaactactagtataatttatatattgacaattataattggtcaaaatcacggtgtgggggcccactcaacgttggcacgtgtgcttgtcccggtgtggcccgcgtgaccaaccagcctctcttctaggcttacgtggcagcacatatcgttgtcttcccaaccgacccgtcactgacaggtggcccaacaccatgggtcccacatggcatatgttaaaatataatttgtgagggataaaatgcctaaggctacacagattttccatttacaatgttattataatttcatacaactgaagttcatcaacttttctaaaagaaaacaatttacgacactttgttgtatgatattcacccttattttagaccgaatcatattcacttttttttgtactccctctgctccatattattataattaaggtgtcctagtttttgtcttaaagttacttttttctaacaaagactaaatttatagaaacatgcaccaacttctacaacatcaatttagttttattaaatcatcgtgaaatatgtctcagtagtgtatttatttgatattgttgatgttaaatatttctctatcctaaccaaagttagagaacttttaagttaggacaaaactaaaacacctaaaatatacaaggaagagatattataatggtaaattgactatttgagaaatatcttttgtatgtcaataaaaacttacaccctcttaaagagaatacaaacatatttgtctacattgcgagtccaagactaaacataaaaaataacacaaacgcatgatacaatcaatttctaacacataaaattcatgatacaagattatatcatcacacattttcatataatagatagagaaaacgatttgccacttttctttatctcattgaagtatgttaaggagacgtactcattaatgtgtgcatactacctagggaatgcgctcgtagtgatgtgtggtgtgttctctatgtaatcaagaaaaagaaagacaagcgtgaggtatatatattaagaaggcacactcgaggatatgtgttaaggaaatgcattcactgatatatatgtgtggtgtgcgtgcgtaatgccatgtgttcatacatgtgtcttccaagcactcgactaaaaccaaaataaattatgaggtcaaaagcgaggtgagcatagcaatattacaaatcccatggctggcgatgtgccacgtagcttaatatcttgttgatctgtggcccccacgcttggacgagaaaacccaacatcgccaggcgcacccaacttgttgtcactttggttctttctttttgcaaggaatgcaatggaaaaccagcctatccccaatctagcactgtacttacatgcagtagtggcaggttgattgccaatgtataaacaatgcgaaatagtgtatttcaattttagcccaatagtgtgttgattgatatcatttccgtggctagtcaaagctcatttttagctatcattttcacgactgttggtcgcgctttattgattgattctctatggcatgttcgatttttgtgatagattaatagcgtacggtgctttatttagtatgaagatatacactttctttttctttagtgaggagataatatacatattttcttaggtgttagtattaactagctagacatatgtgtataaaatggttatcaatgattgttttgtggatcagggttctctttaccacttgggaaggggttacgacatctcgacggtaagcttgattaccgtaataaatcgagaacaactgaaaaaaaataaatgtttatttcaactttttttaaaaaaaaacttagttgggttaccaggcgttatcacaagtcggattactgcggtaacaccagtaacgggtggcaagagaaacttagtgtggacagcattattgttcttgccagcataatgctttgtttataggctttcaattggagaaaaaaaatgtgactattttacatgggccttctttggattctccgagctattaaatagctctctggaatcttgttatttaggagtattaaacgtagattaccgacaaaaccgattccataacccctaggctattttgcgagacgaatctaacgaggtatattaatcccgagggctattaaatagccctccggatccaaacagggccatggacttggtatagtaaaaatgaatcattaagagcagactataagccagctgcaaacatattttaagaagataaataagaagagagaagagcagcgggctacatatttgtagccagctgtagtatggactccaagacgcagtatgtgtatgacaggtgagaccatatattaatagtgtagtgtctaactattgtatgaatgagctataagattggctatagatgaattagagctagtagttggctacactattaaacttgctctgatacggtactactgttaggcagaggtgagtggtcaagtaacgcttattttatttgttcttggatctgatcacagttgacttaatcaattaggggatggtacggatagctgctaatgtagctttgttaaaaaggaattaagtagacttaggttcacatgtcatgaaagaaaatgactagagaagccatgtcagttttgaataattgtccttcttaagatagcctaaaattgaatccgccgctaccgtaattttcttgatcgagttcaacttcagcctcatttaattttgatttcaaaacagtagctctcttgattctatcatcatgaaaaatctatttccttgaacacggtaatttcacagaattttcatatgaattactttagcttctccataaatcctgtaaaattcctttgtaccaaaagagaccttactatttttatataatagaacgaataccagtctttgcttcaaagaaattataaccacttattagttattacaagcaaatgttcttttagcatagatcaactaaacaattccagcaaacaagaaggcaaagaataccttactggtgctaagtggtgatggttcctattagtgatgaaaacggagcggatagtttccgtctgctctggagaaaaacgaatatggatacctttcggatcggataattctcagattgttcggatacggttacgaatatgaatattttctcctagatacggatatggatatggtatcggggtttccgttgaatacggataataattcggatatccggtgaacagtgctattcgaatatccgcagaagccgtgagacatacccaatttctttataaccctatgatgttcaatatacctttttagattttaatagtagttcatctcttaacactagtacacactattaatattatttaaatttttaaaaatatttataaattatactacattttatataaaatgagctaattatatatgttgatatttgtttctattagaagttgagttggttttcgtgttccaagaaaaaaatgtttcagtagtcatgtccaatcatattcgattcttattcgtatttgtttccgtattcgagctatccatatttgttttcttattcggcaaaaaatatgaagacaaatatggtatgagcattatccgctacgtttttatccctagttcctataaatgcaaatacaaatgtattcgagaagtctcaaacaccaaactaaaacattgtttttcctcacaaccaactcaaagaagagaaaaaaaaaaaccatcaagacattgttttgcttgctttcttgctgcacaaaacataggcacaccatcattcagcagtatctttaccacttgatgcaacctgagaccctcatgattttgtttgtttcagctgttgttctctagggtttcccaaaccgctggggctggggttaccgcgccccggcggtaagcacggttaccgcacggtaaccgcaaaaaaccgtacaaaaccgtgcaaaatttatcaaaaattcaaattattttttaaatttatttgaatttaaggaggttaccgcggtatttatattaccatacccccacggtaagcccggtaaccgcggtaaccgcgcggttaccggcggtaaggtaaaccctgttattctcctattgaaaaatcaaaggaaacaaagcatatgtgagaagataggagaagagaggtaaggtaacatggggcctgagttggggggacaatgcataggtgtatgtgttgggatgatatcaatcaaatcatgtcaccttcgatcgatgcaccagatgttccctcagcatccatcacggctgcatgggccttttagacccaagtgaaacaaagaatcatacattagagcatcatcgacatgattgtgtactactccttcagtacaagcaccacatgattttccttttaggaaagtaacataccacttgatattttttttctcggttacctggatgacacatatgtagacaccactatataagggtttttacagtgtggttaataatatctcagtccgagtgagccagatcggagatttgatgccacgtcaggctctctcgttgtcctgtgaagaacacggagccaagttgagccacacgtttttatcagaatttgcaggtctggcctatagttatgccccacaccactagagaaggaagaggaagtataggtacctcgtcgccatccctgtcctccatgccaaggggaggagggcaatgaggcgctatcctcgtggagcacttgggccgagccggtgacggcaatggcatggccgcagacgaggaggaggggtgcaagctcaatgggggtggcgatggcctcgatacgtccgcaacaacagcccgacggtggccgcctcaaaccctcgtcccatttgcagtatgttgtcatcgtcttgtggatctcgcccttgtcgtcgagtggtaaagaaggggaggaggggagaggggtgccaacggggagttgaggtgctaaatggagatttttttttcagtgagcgatggagatcagggatgggtcaatggagcttgctgggctgccgccggcaacctctcgcccacctcgatctgcactgaagaagcacgtcggctcgatggggaaggcggcagggtcgaagaagctcgccgactcatcctaccgtccctgaccaatgttgttgtgcttgtcgtcaacctccactcgcgtgtcagctaagcttttcaccagtccctcacgctaaactgccgagctcgtctatgcatcggttgggagaagtggagaggggaggcatcggttggggaaggagagggatagtaatctggacaggaggcctgtctagattcgtggtactatgaaatgtctaatcagatattaggcttctatattttgggacgagagagtacatgataaatcttaactatttggtggtttagttgtttaggcatagtcattctctcttttttttttgttttagaaacagaagacaaacacatgcgctcactacacgcacactcacccctataaacgcacacacgcacaccctatctctatgagcacctctaaaagactagactgacatatgttgagattcacgaagtcaccactaaagtctcgctatcgatgaatatgtcgcctaccattgaaaaaataattagctctaaatgtgaatacccgtattaagtctaagacttaaatccaagtgggttgattcgaccacagggaacctaaccagttgagtgacgctcacttcgcattcattctcatttaattgaaacaacgctaattaatcttattttctcaccgttcttgtctatcattttctagaaaaaaaatgacatataagttacttgattattgtttcacatgaataagattcattcgcaagaactaacaaccaaccaatttcacttagctttttgttcccaaaaaaatggaacatagagatgactccaagatattatagttgcatcacactcgtttaattttaatgggttgtgtactgttattctcttggttaacacaaaaatatcgagaaccatgatatgagcagggtgtacacattactcgaattaactagttaactgaactttctgacgcgttagcatctctatgtgcttaggaccaataacataggattattacagtacacatcaacgttgttcgttaccagtaattaatcacattgcacgaataaagaggtatacgctgacgtcaccaaccgtacaaaggcatgcttgcacgcgaggcttgcaaatgatgatgaattttgtttcattgtcacgatgatcacttaactctatagtactactttaatttgagtgtttttcgtcgcaagctttaagatcaaaagccactactcatattgttgcaaaaacacactattccaatatagtattatacgaattcctgagctctcgaataagtaggttcacagtcgttttcagattttaagttgggaaaaagttgcgacgctttaacgtcaagtcgcattcatccaaattctgcctaataatttctagtcattgatcattgaccggtcaacaacaatctgctgaactggaacatgcaaatgtgcagcctgttctcaggaacatggcctgaaaaaacatctcaactaaccaatgggcaccgttgatctaacaaacattgattggagtacacaagaaagggaagcagcatatggcatcgccaaatgcaatctttggatagttttgtcactgcaagtatcaggaggaattgctacagacttttttaactccctgtcaatattgctgtctgtcacaccatactccatacatgtcccccatacatcagatttagggctcctccaagggcgaaaatacggtgtggatcatcagcctccgcgagcctccctcctggtggcatcatggaggatgtcaatgtcgacgccatcctggggaagcagcacgtaccgcaccaccgatcccctgatgaagcagtttcgcacggatagctgccagagcgaaagcttgagtcagcatgctcaaatgaattctttgtaaagtgttagtgcttgattaatgtagttcttccatatagaacagtgaacacaggtgcgttgttgtatttttaacaatagaaattaacaggtgcaagtggtaaagcaatgagagtatgaagattgtttcagcaagcaaagataacaaaaggatatgaatctttccatcactatcatgacctacaaaacacagtatataacattgatctatagctttgctttcctttgggattacttcaggcatcatgtacttgtaacaactaacaagcaatctttagtaacctatgcagtacaaaagtacacccttcatacaatatcattggatggaactgaaggccaaataaatatctaggtacggatactggttgtccctgtcaagtaatgtgcttgcctggttacaacagtatttgcactggaattaccagtgcatcttaagctcctaattctgcaccagtaaggcatgtcacgaactaggtataccactatatgatctactccccattaattcctaaattcatgtcaatgtagcccaaagtttgttctacaaacatttagacataccgccttttatcattagctggtgactacttcaggacatttactacagaaccattgattggagtcaacacaccactgtgttatggattggctaaggtaagggtctgaagaccaggggatagggcactcgccctctaatagcagcggcaggacttctccctgctgagctgaaagactcattgattagaactctaaggcttagcgctaacttcagatattaattgattatagggtatatggggtccctttatatataggaggatagacttgacatccaaggaactaatctctagtactacagaaaccaatccaatatctatctataactttctaataaacatcatctctttcctaactagatactctcctatctttatttgactattcctaaattatcatgcctaaactgctgcatgggcctggcccatgcccaaaacaacagagagtaacaagtgatctaatgaagagtaatatctactatggtttataaagatggttattattatcttccttatgcatactcttggttgtgggatactgggatcctataactgacattttgggcctcactgtatgcccaaagaagaatcagctgctgccataatttgaattttagaactttttttttggagttgattttagggtattttcaacttagtttctttttcaacattggcttttaagttgctaagaagacatataaaagtttacccacaaatcaatttttggatatagtcagctcttggccaactgacggagctcctagttactaacggagagtgttacctgatccatatccatatcgtacttcttttacttatgcaactacatgtcagacgtgcaaccattctgaattgtgatacagcattcagcactaactaaacatgtaaggatcatgctaaaggtactcctttaacagattaataaatcaacagatgacaagtacatgctatgcaaacagaagagaagaaatctgaaatcatgtagaatgaggtgattttgaatgtatccattaatctgacacagaccaatcacaagaagcatcatgatctgcaacactgaatggcatggaagatgtagcacaggcattggggctccttcagaggatagtattctgacaagcccggggttagcaccgtgcatgaaccaatatctatgtataaatccttttgaaagaaggcagtgcgaccccacctccatgaactacattttaatgaatagccccttgaagttcttcaatactactaagtcaaaatatagctacttttggttatgactctggacaagtacttgtccacattcacagccaaaagtagttacatttcaagacggaggtagtacataatagtaattacaaaaaatgttatagtcctatttgaccattttgaccttatcaaattgactgagttgccacatgtacatgtgtgttgttcaagctaatttggaatagaaaaatgtgtaaacacggtaaaaagaagtgaataattaatcaactgaaaaaccatagcaaatgcacaaacgcacatgcatattgaagtacaaaaccatgaaaacttcctaaatctatcttgaacagagaacaaagcatacagagtcaatatatctacagaagaccaccgtaaagaaccaagaaacactgtgtttgctgcagagtcaatatatctacagaagtacccatgcaaacaagcggctaattgctatccatatttcaccaggacagagacagacagatagatagataaccagagcagcatcgcatcgcatcgcataccatgtgcgggtacttgtcctggtcgacaacccgagtgttctcgagcttgatgttgaggtattggtcgacggagtggagcgtgccgcggatggccaggtcgttcttgagctccaccgtcacctccttccccacgagctccttgaagtaggagaagaacagctgcacagcaaccaaatcaacagaacaaaaaataaaaatcaacacaaactaacagaacaaaaaaaatgaagtgggaagagaagaaatcaacgagcagttgaacaaaaaaaactaaaaaaaatattctaccatactggccgcagaaccctccccgccttagctccgaagaatctgcagacgcaagaggcaggattagcacccagtggacgggatccccaaacatttttgaggggcaaataaaaacaaaacttctagtcctattattaaggtttaaggctatcaaattaagagaaaatcagcttctcccagatctagaagagaagatacagttaacgcaggcaagcaaattggacacaaaagcgggtgggttggagagagagagggagatgaatgagaaaagaggatgcggatgctcaccaagaagcagcaggacgacggcggcgagcgcctctccccctcccctggtagcgagatggagatcggcgcaggcgcaaggagcggagaggatagaccggaccgccggagatggaagcgcggcagccggatcgggaggaggcaaaaccctagaagagcgcgagaaggcggaggaggaggagttgggttgggttgggttgggtgttgggtatgagataggaccaaaccatattattatgggccgggttagggtgaaaggcccatatagctttatttattaggaaaaaagtatactctgactccctcaactatcacccgagtatgattcatgtcctccaacttccaactattaaaaccggtgcaaacaaataaacaatatccctcggtggttttggaagtggttttggctgacgtggcggtcttgaccgagtctttatccaacatggcgcttacgtggcattagaacaaaaacaaaattaaaaaatgtggcgcttacgtggcattagaataaaaacaaaaaaaatatgtgggacccatatgtcattcacacaaaaaagtgggactcactgacatgagagaccacatgtcatcctccctctccttcccttcttcctcctatctctctctctcgggactcaggagcggcggtggtggcagtggccgatggggacgaggcggaggggagcgttggtggcggtggtggcaggcatcgccagcgatg

SEQ ID NO: 66435 - DNA, 971 bp, Oryza sativa
cctcctcctctgctctcctccgccacaatcgtccccgtaaaccacctcttccgccttctcctcctcctcccgaccgctaccgtcgccgctcccctccgcctcgtccccaccgccaccgccgtcgctccccaccgccgtcaccgccgccaccgctcccctccgcctcgtccccattggccactgccaccatgagagagagataagggagggagagaggagagagagggggggaggatgacatgtgggtcccacatgtcagtgggtctcactttttgtgtgaatggcatatgggtcccacatgttttttttgtttttattctaatgccacgtaagcgccacgttggacaaagactcgttcaagaccgccacgtaggcaccacgtcagccaaaaccaccaaggggcattttttacaccggttttgatagtttaaggagtcaatatacccggttttgtggttggaggatatgaattatactcgggcaatagttgagggagtcaaagtatattttccctatttattatctcatgtgatttttttctcacacaaataaaaagggagtgagacagggatgcaagtggagcgggtaaacgggatttttccccctccgcttatctcacttctaatttatttttttttccaaaattaacatgtgggatttatttctgacacttatcctacttttaatttattttgcccctaaagaaaaagggagtgagacagggatgcaagagaagctggtaaatgggattatttttcctccccttatcccacttctaatttattttctttctaaaattatcgtgcgggatttatttccttcgcttatcctacttttaatttattttttttccaaattatcatgtgggaaatgaagtaacgagcgggttttattcgtgtagttggattagttgcatctctagagcgagatgaactaaggttacatacccaacttttggattttttatatat

SEQ ID NO: 66436 - DNA, 2950 bp, Oryza sativa
agatgattattaatacaagcagaattagtgtagtctattcgttgctccgacttcaagagagacgtgcattttaacaaagctggagcccaaccgatggtttccttggatggtttttattgctccaaataattctagccccgtcccccgtgcttctctgtcttcttgaaacaaaaggtcgtcacattgttttacaagtgctcaggtgtacgttggattgcgttgttgcacccgactacccgagagtagtcataccaaaatttgaatatcataacagtgctccattccatcgactaggatttgccagccttgagcactataaattgtcctcaaacgttatcatggattatgtactaacataacatgaaaggatcaggaaaaatatctttgatcaaaatttacacctcagcacttcttccattaccagttcgcaagtacatacgcaaacaatgttcccttccgcaaccaaacgaaacctcatggtatatttgagattaattcggtataaaatgaatgtccattcgttctcagcgagctaaaattcctcagcccaaatgcatacagaacttgaggaccgatggcaaaggcaccaacaagtagtaaaagaaaaaaaaagcctacaatgagaatgccgggtgcttccttctttccaggagcaggggacttcaaaaacaaacaccgagctcttcctttcctagctgcaaattagtgtccgggacaaggactggaagctggatcaactttactacaggccggatgaccagtagccaatgctcttgtaccctcttaaaatctgaaatccgggtcgacgtccattgcccacgaaaatttcgcaatgagtgatttgttgaaaatctgtcaaggcgaacagtactgtcagttaatgtaatcggttcaatcatttgatttgatcatatgccaaatgaaaattttactttgttcaggatgcaatgacgacagactattatcatttcaaatatccgggatttcaaatcaaatgtttttttgtatgcacagttatagtttagttgaacagaatcccacccccaatataaaatgaagtgtaatctcgataagaacaatgaggatgtgcctgtcaactttgcataggccaattcatatggaaagaaaaatagagttgtcctaaagcactgttaccttctcgatgggtacttcatggcgtttgcaccatgcaacagtaattctgggatcaaggtaattgatctttgaagttcctagtgccactgtctttaaatcctctttaatcttcttatccatctccatcttctctatcttggtttcaatctgagatatcttcttttcaaacctgcaagcaaatttggtgagatttctcaacattgtttttttgtatatatacaaaatagagatctatctgtgattgagattattacgcttcaggggccaaatttctttttggtttcccatctttgtcattgcctagattctttcctttccttactttgctcaagtctgccttcaattcatccctttgggcctggagaaaagaaaaaaaacaagagagtttaccagaaaaggacaaaagaatgaaatggtacaatgttgggctaatcatttgcagtagaaattcaaccttcaattcatcaatcttctcattcaatctagtcatctgggaatcatgtgattttgagacactacgctgatggttacagattatagcaacctgagtaaacaagaagtatggttgagatcaaaacaggtcaaatataagttttttctatttcttaaagagaaacacaatagacctctttgttggctcgttgataaaccgcaattttttcaagaagagttccatcttctgtttctttgtgcaactgtaaaatcagcaccaatagacatacgttcagaaaacaactattgtgaaataacacgttacacacttgagcttcaagtaaacagaacggaacaacatatatactactaaaatgtcttaaaccattacaaacttcaatcaatcacttcatacagcagtgaaagtttaagaaaaagatgtgaagatctatctgaacttacaatatcatccaaggtgattgaagcattatatgtacggaacacttttgcggtaagcccaggcatcaagtcctttagatgagcatttagcctggttgtatcgagtttgtcaaagagatcttgtgctggttgcttgcctagaataaagattaagaaaacagaagtgattccactagtgcaaggtgaggatcggagggaaagaaatagttgcaaggcacacttaccagcacggaattcctcaattgccttgtatacaagcagttcaacctctacagtattgaagtatcttatagaatctttaccaaggaagtcgaactgtaaaggttatggaacatcagatatcatctaaatcaagttacacatgcagaatttattaataatgaagaccaatacctgcagtttatttggaggaacacaagtaacattatcaaccttcagtgtacagcaaccaacagtttcagcctcatcttcatcctgaaaagaatttgaagtagtggctaagtatacaaactatgtatgtcactgtaattcaaagctatttaataaactatatgtatgtcattgttgaagattgtattctaacaaaaatctatgcgcattatgttgaccattatgcaaaattatgatgagcagccacacagctaatcctagatacagtcttgaaccaaaacgctatgttgcatagtgtaaatatccattcagaagagatgtcagaacagaaggcacatattccttttttttttgttattggttggttggtgggggagattactgtgcaatctgcaccgatagcagaagaaatatatcccaattcataaatgtcagtcagagagctcaggttagaaagtaccttctcattgcctgccctaagggctaacttatctataaggtatgttgccactgc

SEQ ID NO: 66437 - DNA, 1172 bp, Oryza sativa
caataaggaaaatcaagtccatcgaaaacatgtggcttagttgtaaaaatccgaagaagaaaataagactctgataccacttgtaggattgcacagcaagaactaagccaaccaggcgggagggggtgtgaatggttgtagtgccccaaaaccaaaaacttttaacgcaattaaaagttaccctcaaatcgatggagatcggtctgaccgcatatcttgcaccggtctgaccgcgcctgtgccgttggtctgaccggtgtagatcggtcggtctgaccgagtcgcgtctcctcctcctgtcgtcaccgctgccggtccaaccgcagttgtgccgttggtctgaccggtgcgttgccgctggtgtgactgccgtgcactcgccgatgtgaccgccaaaaccccgagcaagcacaaattgaagatctctcaaagtagatcgaactttattacttctattcatgtttacaaagtacaacactccactcgaaaatctcgactaaactcgaagccctaacttttctctaaactcaactctcacacaatcgataccgggaggcctcaccctctctatttatacccgaggtagggagtctaaatccatgaacccaacttgtacaaaaagttctaatcccctaggaaaccttcccgtacaagaaataaactttacaaacttcaatcataaaaaatttggactcctttcaaattcgactccgtatctcatacacacgacatctccattgtatggcatatggaatcttcaccaacactgcattgatctttagcataagcatcccgcatgatatcctgatcgtccaaacgtcatcttctcctaagttgactcccaatccatcaccggcaacactctcccgagacatcaagactcacatacacatgaatcaaccaagaaattatatccgagcaaaagttctctccaacttgactcaacattagcacacaacagtattacgagaagccataaatatgaattaatcacaaatatccaaagaaacaaccagaaaccgaaaccgacacagtgttggtcagtcaaaccgtcgggccagccggtctgaccggctgcacctgcccggtctagccagaccacacagttagcaacatcttgtccatcatctaaaaaccacacatctccaaaaccactttgtcgaatgtctcca

SEQ ID NO: 66438 - DNA, 1303 bp, Oryza sativa
ctagatagctagagaactacaaagtacaaacacagacaggctaagagaagtattctttgaagggaacgagcaaatgctggccagcactgtccgtggctgttgttattattctttggaatagaagactgtggcatggtctggtcctcatcatagaatgtgttcaaacattcggaggaggccagatcttcccgaagagttcctccactcggcgtgcttggttcacatatccttccaacccagaagcaagtagttcttccgcagctggccccattgcagctgctagactcaattggtcccacttcacaagctgcattcgtggtatcatttgaaatatgaacagttagcatgaaggtgccatataaaaaatataatcacttatcttctcttgttttatttttcctcttcttataggatgtcaatgacttgtttgtattgttctagtaactgtttggtgaatcatgattacacctactacgagctttgacatgaccttttaagggtgatctaaacagtccaaatattattttccttccttatttcatctctagtagtgttaaagcacatgacaagtgaagatcctatatattttagataaaacatcacacccctaataggagtctcttatagcgagtagtttggtggagctacagaatgcatgatataagactctgcacaaaatccaggataagtgagcaaacctcctcttcagtgaagttgtacgttttgccaagagcaggagtcagccttgggacataaccatacttcacgtcagtatcagtgacagattcttccaaagactgcaatatcttcagaggtgcaatgatgtagtcaatcctacatttcagaaatattagttctgtacaaactaacatccattgcgatcaatcttgatctgtaataagaaaaataccccaggaggctaaacacatcttgcttgttgcgtatggcagcagccatcaactttgttttatacccatttttgtgaatgtaggcatacactttcttcgcctgcattacaatatagaattatatggagaactaaatacttatgcaactgcagaaaaagtaaggaatgtaaaacatgtagagagtaaacggaaatttagttcagtatcgaattgagaagacgtgaacgcttgataagtataatgttcttcattcatagtccctttattaatgaaaaccttgataattgtcactgattattcagttatatgagttttatcaattacactataacatgggcaacatgccagattaacacatggtttgctcaaaattgttgatgatgagaaccaaatgg

SEQ ID NO: 66439 - DNA, 1015 bp, Oryza sativa
agcttcaaaagctcatgcacctgaacatacgcatatcaaattagtttcatgggactgcaactgcagatcacaattcacggaggattcttttcccctaaggataaatatttcaggcaagcagcatgaaacaacaaacagaaggaagaagctcataccctctggataattccttgggtatcataagccaaccgagcatctatttcagtcgacacccgaccagggactagatgagccatttcagctccaacatttgccagggcctgccaaattcctccatgctcaacttatccaacaaacagactgcttacattgaaactgaaatgcagtatgcaaaccttggttaggaaacaggacatccggtcctcgggcttctccattgtgttacattcaccgtctgccaacgctgtatctatagcactctataagaaacaaaagtctgaaaattagtcaactgtctctcttccacttccagtgctttgattggcttcacatttcaacagcacctcaccttgaactttgtatccgggaggccagcgataccgagcagcagcgacgagctcaccgtggcggcggtcggcgcaaacctgaacccaatcaacagagcagcctatgaactatcattccattaagttggatcggccaactaaattcaatggtgggataacagcaaagaagcaactactagtattacttctcgaagtcatcgaacacgacggtatccggcacgatctcgctgaagctggccacggcatcgagctcagtgaccacctctacaaccaagctgaccaaaatcagtaactcaaatcacacaggaagccatgaaggagacaactgacaagcacaaggccagcatccttaccgtccacggaggaagacggtgcgttgccgccggcggctacacgggccgcaagaaccggcctccggaggctaaaggccacaggcctggccgacatcgccgccgacgagctccacctaccgacctgaagaggaagaagcggcggcggtgaccaagaac

SEQ ID NO: 66440 - DNA, 3752 bp, Oryza sativa
ttttttatctaacgtttgaccgttcgtcttattcaaaaaatttatgtaattatcatttatttcgttgtgacttaattcatcatcaaatgttttttaagcatgacataaatattttcatatttgcacaaaaaatttgaataaaacgaatagtcaaacgttggtcaaaaagtcaacggcgtcatacattaaaatacggagggagtacttaattaattatgtgttaatgagctgctccattttcgtgttggagggaaaggttcccaaccaagactaactctgctaaatttttaagcagcatccatgtctgataggactatacaagttctcattgggcctccttttgggaaaaagtttgaaattttacataaattgaactaattttgagggttttttttctaggaagtccttcatatgtcaaatccaaattttcacaaccatctagcccatcaaatgatcttatgaaattatcaaccatgttatgaaaacatgtttgatgagaaacaaaagctctccaagagtttaaaaaaaagaaattgagtttcctagtttatgcatttggttggctaagcctaagccgagacatataatgaaacccttgaaaaaaaatttatgagtaagaatttaatatttcgttagcaaatactattgaagaaataatacctctaaattcactgtaaggtccaagagcgcttactccggtgatgcaaatgttttatcaaaaatgatattgttctttaaaaaaaaagaaaatgatactaggtgctagtaagggcatattagtcattgcacttgtccagcactaaggttttgttaatttgatcccgaggctcctacgtcgatgtttcgataccaacgaggctcagctccaagggaagcgatattaaacgattttgtgacgtgtacataggagttggcaattggatcgtcttctttttgttttcttccttttgggatatggtcaaactcaaaccatgatgatatatatgaaaactttaactcactcatatttttttgagataatgaactcactcgtataaaaaaaatgcaatgtaaaatggtgtacaattagagggtgacatgtggggcatgggggcaacacgtcggtgatacattggatttttttttgtgttttttaacatagtcaaatatggggttgaagaaaggtagcttgatagcatcctagaagggaaaaagatacttaaaacgaagtaagtttagcatatgattaattaattattttttaaaaaagtttaaaaatagattgatatgatttgttaaagcaacttttctatagaactttagtattagttttacatggtcccaatattttagttgtaggaattcaataataaatcatctcttagaaagatgaatattttcacacttcaaattttatttagggttccaaagatatttttggatggattttttaggtgatactctaaaactaggcatttttcaattaacggttaagggcgatataaattaacatagagcttgtccacattgatgtcattttagacaatattatttaaaaaataaaaaaacatatgaatgtatttattttattatcgaacattggtaacacccacataaatttggtaacatcacaataaaatctggcagcctccaaatgtaacaaaaatttggtagcctatatgtgggtaccaagctaaacacatccaaaaaagaaaccctaccaaaacttgacaatattaccaattactaaaatttttgttattccaaatttcgaaaaaggttattttgtagcaatctaaatatcccataatttcatgtttaagtaccatccaagtttccgatgaaaatatattttgaaatttggttgtgtttcttttactcgaacgcatatacttgccaaatttgtaaccaatcatgtatttggcactgaagccctaactaagtctacgtaatggcatgctagatttagtttagttgcacatgcatttgattaagccatgtctgatatttggaataaaataatctaactttcaggagccaattcgtctcaatttgtaaaacttcgttttcgaaggagagccaagtctcgctttcaattgcaatacacttaatactaaatgataaaagcaatctgctaaaaatagctagtttgcctgacaagtaaaccaaacattagaaatttaggaatgtgaagaatgtaaacatgtattgttaggttgagtgctaagggcatgtacaatatagtgtctaatagcgggctctcttcgttgtcatgcatagaggtgggcattcggtctaaccgaaaatttcggtctcggtctttggtctttcggtcttttcggtctttgaaaagtgaagaccgaatttcagtgaaaaaatatcaggaccgacaaattcggtcttggtcttttcggtctcggtcctgaccgaaattcaacaacattttcatatatgcaaagaaataatggaaattttcaacacaaaaatcacaaaaaaattcgtaagcacttatgagtaaagactcttattaggttgcatgcctagaagaagtagggatgtgaaaattagagtttaatcctattaaatatagtggattgtaggttgtatttagacattttttgataattcggttttttcggtctattcggttacccgaggagactaaccgaattgaccgaacaaaattcggtctttcactacctaggaccgaattgattactgaatttctcggtctcggtctcgatcttttcggttcggtctttttctgcccacccctagtcatgctcatgtaagtaaatttggtgacgtggaagaaagagagggaagaaaggagaaacatcgttcctacgcatgacaactgcttagagtcgactcttagcatttattaacggaaagtttgctgcatgatggtgtataaaaggaaagaagtatagtaaaaaaatatttagtgcattaatgatttacaaatcttattgtgtaacatcccggcctagggcttaataggattaatagaatactcatatcaacaagttgcaacttcttttccggaatccaatctccaaagaactccagggttaagcatgcttggcctagagcaatttgggatgggtgaccgaccgggaaattcttcccgggtgcacacgagtgaggacaaagtgtgcagaaaagacatgtgttggtcggcccggcctgggggaaggcgggacgttacatattgtctctactattgtaggatggtagtctctagtgacattaattaatatagagagctcatattagggcatgttcaatggtagagatgagtatggtctcttaaacaatacaagattattaagagaccatatctttacaatagttgagacgacaaaggctctaatcattaactcaaaaaatattccttttattaatattctttctatctttttaccctcatacaaccatatttccatattatataaccatacttccatattatagtgattaagagtcgttgtcatgcataacaacgatgttttgtctctcccctttctctttcttccatgtcaacaagtatttctaattagcaacgctaagagaccactattgataactattgtacatgcccttgcctaaaaaggctaattcaaagtaggagtagtaataaagcacaaagcacaataattatgaacactaatccacacactccattgattcaagtacacacatgatccacaaactttccgttccaacaaacgtaattttaccggttcatccccaccgctttccaacccccc

SEQ ID NO: 66441 - DNA, 3077 bp, Oryza sativa
cccccccccccccccccaaaaaaaagggcccccaccctaccttatcccaatccgcaagcatcctctctcaccgacatgcgggcccatccccccgtgccgcgtatgacgtcggcttccccttccgttccgttccgtcgccgcaagcccaagccacgcacttccacgtgggccccacacggcccgtgcccctcacgcccggcccacgacgcaccccctctgccacgtgggccccacgcgacctatgctcctctctcactgcgcgtggggcccacacgtagcgttccgagcgctgccagctggggcccgccacgacccgtttacctcactgcgcgcgggacccacgcgggtctctgccagtggggcccacacgcctctcctgtccgcgacgcaacccgtctctctctgtaaggagagggaaaaaaatacaaggcagaaaggggaaaaaaaaggaaaggaaagagaaaaaaaacgcaaggcgagagagggagggagaggagtcggaggcagcggcgcgggcgaggcgaggtgagagcgagcgatagaaatacgagagcgggaggagaggcgaggagagagagacacagataagctcagccctaaccctagctccccgcctcgccgccgccgccgccgccgccgcgcaccgctccccggggagcgggacgtcgccgccgcggcgcctaggtgggtatctcccctcctctctctctctatcccgctccttgcttccttgtttgcctcgcgttgggttgggaagggctcgtgatcggggcgggggtctcctccctagggcttgcggcggtgggggcgatggggggatggtgcggtggatcggggtggggagggggatgaacgggcggtttcgtcttgtccgggcggccgatctgaggggggagcggtggtttggttggttggtctcgtccgtagtgttgattgcggtattgatgtcacaaagggaggaaacctcgtcctgagctggaattggctgtgtttgtggcgggtgcatcggtgtggatgactcaaaggggtgattgcgtgggttgggatgcgatgggaactctgttctggagatggtttactttgaagcaggaattctgttgattagatttgcgcatagattgctttggttgatccattatagtgcacttgtgcattgtgctggaacggtggaatgctatcttcaggttgcttacatgagtttactttgtttgcaggtgtggttgactcagcatatttgttccgtctgccagccgccgcccctagggatcgatggctgttgtcgatcctgttatgtttgacaacgacgacgaggaaggtccgatctccttcaagaggtcgagcacctctgtgaagaacaggcccacccccacaaagcaggagggctcatcagggaatgccggacctattaggagccctaaggctgttgcttccaatcaacagaagaatgggctgactggtgtttcgaggcctttgcaacagaggccgcagtcaagcagtccaaaccctcgacctttgggatcaggtcagccgaacagttccaaagaacatagtagccataatagtaactcagtggataagagtaaattgaaaagacctttcgtggaagataagtcggatgactcagaagatgaccataagccaatcggattaaggagaaaggtcgaggatagaaatttgaagaaacctgctgtaggaagtgggacagcaaatgattcagatgatgataaaccattgagtctcaagataaactcaacaaaaacgccttcgagtagtgcaaataaggctattgtactgaaaactacacctaaaattgagcaacctggtgatgattcagaggacgataaaccactggccagcaggttgccaactaatgctgctctgaaaaggggaggtaatgtttctgatgattcagaggatgagaagccattggctgcccgattttcgaaagttactggcaatgcatctgcaagtatctcaagttcaaaggacaaggtcctgtctgcaagtataaaagcaagttcttccagcaagatgtctaacaatgacgcgagcacatcacgaaattcaattaaaaggccaattgacaataataatcaaacaagttcagctctcaagaaggcgaggccttcagatgtttctgcgtctgcaagtgtcaaaagagaacccaaggcggatgacaatgacaatgtacctctttcacaaagactgaaaatgggtgagtcttcaaaaagcaagccacctgcaaagaatatcgtaaagaagagtccttcatctttaaagaaggacaacaagaaaatgaaaatgaaaatgaaaacaaagaaaacaatgaaaaattctcagttctcaaagacaatgaaggtccctcctggatggggtggtggacagaaatggactaccttggtgcacagtggtgttattttcccccctccatacaagcctcatggtgtcaagatgctttacaacgggcaacctgttgatttgacgccagaacaagaagaggtgagatatataacattagctgatttttactttacttttcatcttttgatttgtaccatgagtgacattttaatcaggttctcctgaatccatatcttgctaccagataattgttcctctactaattatctctgttacaggttgccaccatgtttgctgtgatgaaagacactgattatgcatccaagcaaacattcattgacaacttcttcactgattggagaaaaattcttggtaaaaaccatgtcatcaagaaatttgagctttgtgatttcaccccgatctatgaatggcacctaagagagaaggagaagaagaagcagatgacatctgaggtactgcatgttttgttttgacttattcagcagaatgaatttagtttttgtgctggtaatctataaaaagttgtctacggaagtgaacaatctttaaaattcttcttctgcaggagaagaaagcattgaaggaagagaaattgaaacaagaggagaagtacatgtgggctattgtagatggtgttaaagagaaggtatttttctttgtgctgcaaaaatgtagttacagaaagttatggctag

SEQ ID NO: 66442 - DNA, 884 bp, Oryza sativa
gtaggaattgaggaaaatgctagatgatggtaaggatctcgggataccggatggaattctgatcaatgggaaaggcccttacagctatgacaacacattgattccagaaggccttcaacatgaaactgttggagttgagccaggtaagcacacttagttttcttttccccatcatatttgccttatcattagttttctgcatgacctattaagcctgattcagtttttacagtgatgcaattgcgaaacattatagatatgtagtcaaaatttggaaaaagtaaataatcatacttcctcagatgaaaaaagacatcatatcaattaccacctccatttcatattataagttgccttgaatttttttcctagtcaaacttctttaggtttgaccaagtttatttaatagaaaaatttggcaacatctacaatatcaaattagtttcattaaatgtaacattgaatatattttgatactatgtttgttttgtgttgaaaatattgctatatttttctacaaactttgtcaaacttaaaaaaaaattactaggaaaaaaaatcaaaacaacttataatatgaaatggagggagtagtaatcataaatagttgaagatcagctttcatcaattctgttattttgtagcagcaaaggacagaattttctgtctgaaatgtcttgctgcatttacatacagatatcaggatgtgaataaatgtctatcactgatcagttatcaggattactgcaaaaatctttcagtcatgccaattttaatgatctgaagatttctgactagaacaatatttcatatacttgttacaggcaaaacttatcgcttccgtgttcacaatgtcggcacctcaactagcctcaacttcagaa

SEQ ID NO: 66443 - DNA, 727 bp, Oryza sativa
atccatgtggtggaaatcatgtgagtatcttttcatgaaattttcaagaaataaataatgcattggaccttcagaattacattatcacacacgtgtattatactcattttagtcggaaagtatttcagtgatatcttgaactaagagtctcacctgaaactttgctttcttttcaaattgactgcttttaacatcggaaagttaatttttgaatagaaattttggtgtaagagaatcagtcaggatgttactgtatcattacattgctccgaagaggatgctcatgatggcagctatcgtgccacctcctgttgcctttcggctggttactgcgactgccccaatccaaaccatcagtgcccatgaacagaaggtcacagcttggaacaatcccagtcctatcccttttatcactgcctccttcttacttagtttgtactgattatccatgcaccggacaaaggatctcatggcccgtttctccccaacaaaggagaaaacagtcttaatatgcgacaaagtctgctcagaaaaaggtgtagtaggattaagaatttaaatcttgtaggcaatcgtttatacttccaattaacttggcttgagctgatgtaaatgatttacctgttctacaatagatgttgcttctgagactatagcattacgagataacgatatgccattcatctgtttcgtgtatgttgctccaatgacgaggatcagaggaatg

SEQ ID NO: 66444 - DNA, 5900 bp, Oryza sativa
tatcacctggtgcgctatgcttgtcaaagccacataaaatggaaagagaacggtttacctaaaccagctgctttcttggaccgctcacgctcggccagacttgctgttcattggatgagacttgaactagttgcaagttcattgggtgaaaagttccatggaccagacacccaatcctgaaagatcctatctcgattggtgaataattcagttgattctttgagtccacaaattttcatttatttttcaattacatggaagatgcatcatacacacaaactaccgcacgaacactgttatgcggttcatttctgatactaatgaattaaagatctcgctaaacatcttgaagagagcttcacttggtttttctcatattattggttctatattgagattcatccattaaataattatctaattagattcaaaatgaacacatgaattttgtagaattttcgcgtgagctcatctattccaaggagcccacgaaaggtgtataatatgttgaagacaaagaagctatagctcatggtccattactccattgaacaccgagaaaaaaaaaggcagtgtgtcgcgacgactacggataagaacccacgagcttgtcctggtcataacccacgtgaaaccattggcacgtcgccgtcgatcaatgggagcttatgcgagctcaattgcaacagcatttgttgctgggtcgcaccttcacacagcttcatccaaagataagccaaaaatatttgtttctgtgatccaacgaagtcctctgatcgatcatcatgtattggcgtgtagcttcgcgtgctgatgctctccaagctttgcccagctagtgctaccttccaaaccccaactaggtggcccccttttttttttgtttaatcttaagaaccaataggcaaattgttcgtcaatcgtcagtgctagcaaacaaaactacgatatcgtcatcacgatttcgttttgtttagatcaatttgattgaagttcctgtttggatcttgcaatcgcattgtccaaattttgtacttccaaacccatatcatgggttatggtatgtctattgttgtcgtcgtctatttgttttcttcttcttcttttccggtgaggttagagtaagcccgtgggcacaggaatttttacccaatatttgcaaagaacatatacacacacacacaccatatgccaaaagcttttgactgatttacaccttcagccacacggcttgccgaccgaatcgatcgggaggtaaaggagaaagatcccgggggcgagggcaatgcacaacgctggctcgtgctccacatatgtcgtatccctcccgggccctacaagccttcttatctctacacatgtgtactgaaagctatatatccatggatgaatggatggatggatcaatcctgcattccctgcttcgttttctcgtggatagatcagagatcggcttgtctgtctgaactctgaagagagatgcaggcatcttgggacttgtaatttggattccttggggttgggggtggcattgcagccttttttttttaaagaacattactcttaaatttggtcaggatttaccaaaccatgtaggacgtgggtaccgtcaccccatggtttgacagttaccgcggtaatcgcgaggtatatttcaaaaactgagaagatcaccgcacgtgataaccacgacaacaaccgtacagtttaatttgtaaaccgtgcttcttacatggttggttgatgttatagtacttgtgtcacacttaatttcaaggctttagcaagatcgttgttgaaatgctcctttttaaatacttgtcagcagacactattcgcattcaactttttggacaattttatttgagcaatgcgattcataaaatatttgaaaatacagcatattaacaaagtatgtgtgttcaacaaaatatgaaaatttcttctaaaaatattaacatgggttaagaatgacaagtaaatgaaaacatatctagagttataattaaccttaatttagttgaaggacactaggacagactgtgatttggattaattagattaactttatgcagtgcactgactgtttgacatttcagggatcttttgtaatcatatgatttgtgggggacatggcaattatgttcacacaacattttcactacaaacaataccagactagcacattatgttatactttaaaataggattttatccaccacaaaaattaagaggctaatgagttaaataacaggtgaatgtggcgaccctacaccaccagccttgtgttatctgaaggaaaattctgctgaaagcaactggacaccaccgaataatcctattgtgaaccattttaaagatggaacctatatgtcggctgtcaagtagcgttggcttgagcagaaagttgtttttctttttctttcaagacaagctgtttttctttaaagagaaatatttgttttctaaaaccttcaaaacatctctttctgctctgacacctactagaaataaaaaaactggcagattttttttttctgataatagaaatcaatccagactctgtattcaggatatatccggccaatcaatatctggaagatgatcgtctgatagcattaagcttattagcttaatgtaaaaccaagttagaataatttaggactccagtattactagaaaaaatccatcacatccatctcatcaaagacaactacggctgggaggtacaacaataatgaaagaaaacaataggtggatggcccaaggataagatagttattttcatccgagtcatctgtgatttgattctttcttagctgatgttaccaactactgatgcaaagacccaatttgcttcaatcctcataaaagtcgtagagcactaaagctcactacttctactttatccatcatatagtacgaaagtacttcgaataagcattgccggtacctttgtcaagaaccatcttattactagcacacactcccttttctgcaagacataaacttgttcccctttccgttttactttctttaatgtatataaatactctacatatgtgagtgatcttacatatcttgagatgaaccgaggctagatacaccaaattttgtacttcaaaaaatatgattccttcttataactttcgatgaccgtaaaatttatcatataacaatataaaattgctaagccgttttggtaaaattatcaacatgttctactaattaggaaattcatattatgcatgcatgatgatagaagaggatatataaattgccctttgatcctcataccaagatatgttcagatacagttcacagctgaccaaatgaaaaggggaaagaaaaaagagaaggtggccaagagtacactggtaagctgttgattggagagctctagttaagaatgctaagcctgctttttttgttgctgtggttgttgaggtgtcggcattagggacatccttatcaccacaaaattttcttaagccgcatattggtatatttttatttctctctctctctcattttattggtgatattctttgtccacgttaggagatgtgcgcgagccgctctctccctcactgggcctttgtgccaatgcgttaggtctaagcgctcatgcagcagtccatccagggatagctgacactgagaatgtgatcctgatgaaacgcagtccacaaatcgcagacaatatcaggctatcagccctttgtacgtgtgcgtgtctctgcatccgtcagttgtttcgattcttctcgtaaacctttaagtccaagcttgcgtgatagagcgtgcaataaaacagcaacatcaccatctggaaaacccttctgatcagctgtttacgttcatgcatgagacccacgctgttgaagacggtgtcgtactacagtggtatgagagctacaggagctttggactggcctgtgttcgattcgaaccctctcgtgcacggccgggttgctaagttcctctttagcaatccatatttttctcatttcgaaaaagatgtcttgagttcgaaacatgctccaaaggaagagtttgtaggctaaacaagtgggagcagataagaataatattgttcacctttcctcactagcttaattatatatttatatgggtgaatctgttttaataaagtcagcatgccacatactcgtccaatatagatataatagaaggattcgaagcctaatagcatcctgggtggcatatcaacagttgtaacgttcgagcctggtgtgagatgctggccaacaaaaaagaagtgcccaagaaagacctgcgtgccctgattctcttggttgtttgggatctggaaagagagaaaccagcgagttttcgagcacctagcctactggtgaaaataaaggagaaagcaagaagatggcttcggttggagcaaatcggcttcgggagcttatactaaattctgcataacttactctcaggggttgtatttctcttctactatattaaaaatagcacaatctcatgttgatttcattcaacaaaaatgtttggataagtacccagactaagttcaatgtaaaaaatggtacaaaaagcttgtataatcagaaatgcttatatttaaagtcgaatggaggtagtagatctggttaaccctctcctatgtagccatagacgaaacttttctaatatgaaattatcgaactcttgaaatcgccactttttaactctttaaatcactagtataatgcccatgcattgcaatggtttttttctctaatatattatcattgtgataattttgccatcatttcataaagatgaaaaattctataaatttttattgtcatattttattttcgaccaggtctaacatatgaaggctaagaaaccagtaaagttttatatcatattttatgggttccatatggtagtaggatggtggtagcgccaccaccaccactactactttttacgttagtatagaaattgcatttatactccgatgataatctgcacttctagaagatagtaataagtcagagtgagtgaccctatttttctacccaaactaaagcttaccatccgagcccaagccctactaaacaccggggcccagacctgcccaatcagtaagtaacacaccagacaatgctcgggtagcgcccctcaggccctcacgactggctgcagcgctgcacacgtacgcccctaaaccgtcaacattaccagcattattacagcctcaccccccgtcaacacaacacgaagaaaaaacgcaacgccgtgggcggaaaatgccatcgtttccctgccatttttttccacgatgagtacgagacgcgccgtacgtcccaacgtacgtagtaccaccaccaccggcgcgaaacggtagcgctcgcgctggcgctgcaccgatcgctgtctccccgcgtcgcggaggatgcatacgctacaggacacgggcttggaacctcgtgtcgtgcctctgttccactggctctgcgacgcgtcgccgtgtcgacgcgcgggtggcggcttggggttctctctggcgtggcgtgcgggatttctgacgggacacgggcccaataattggacgacggcacgggtgacgggtgttctcgccggtgagagcatgtatattttagggtctgtttgggaaacaggacttatcatatcggatgtttatacacaaatttagagtattaaacatacactaattataaaacatattctataaccttgggctaattcgcgagacgaatcttttgagtctaattacaccatgatttgacaatgtgatgctacagtaaacttttcataattatagattaattaggattaaaaaattcgtctcgcagattagctttcatttataaaattagtttttttattagtctatgtttaat

SEQ ID NO: 66445 - DNA, 2406 bp, Oryza sativa
tcactcatagtactttaaatgtgatttgtatcttatatatttgcataaaatttttaaataagacgaatggtcaaacatgtgagaaaaagtcagcgacatcatcaattaaaaaacagagggagtaaaagattaaagagaatagcagcatgaactctaagacgcaatatgtgtatgacaggtaggaccatatattaatagtatagtaagcaaatattgtatgaattagttattagattggctatagagctagtaatagggtatactattaaacttgctctgaggaccaaaggactctggctcctcatgacagatcgggtgacgtgagcctctgatctcctgtgcagatattaagtgtccattggactttatttatgcatggcaaggcgttttttttttttgaggctgcggctttgctgcattcagaaaactgtttgaatttcattgcggccgttcccttgttgagttttgaatggaattcatgggatttcacaacattcatcacccccaagagagattgaagatgatgactgcttatcttaatggaagtagtggaaaatagtttggtggtaaaactggattttatgataaactttatactccatgttgttctaacttctagaaccaaagttgagtggcaaaaataataatgaaaagaacttttaagtcatactaaaattcaaaattggttacgggcttatgactgaagatgcctgtgcataatttagatggattaggaggttgcatagtgcacggaacgcgcgatttgagaggctttaacttttgtgcttggacttctctggttagtgggagaagtgtgctgactaggagtgacaaggcattggcacacgtggcccaatgtaaactggaggcaagagctttgcaactggtatcagtagtagtgcaggttagagggccaaaaagtcagcaacaaagggtacaaaagagaggatggagcctccaggaagctctagccttttttgtgcatcctatgtaaaaacatgatggttgaagataagcctcatgatggctgcaagacaaaactggaactaacaaatcaagaacaatatcttgatgggaaaaaaaaggagggggagaattgcagattgcgcatgcgaagatgggagaggaaatcctggtgcatgttgggttgggttgagcatggaaatactttgggtcaactcgtggggttcaggttgaccaacacatctgctcttttgttagtggggaaaccatgaacttctccttctggttgatgctgcaaatattttacagatattcaacgaatgaacgagaaatttcatccaatgcaaagatgttgccagaagtcaaaacccacgatgcaaacttttttcttttcttttttttttgaaaaactataccttagtttgagattcctccctaggttcactttctttttccttctttctgtatgtgttatataacttggccccgtttaattcgtgaaaagaaaatttttggtgtcacatcgaatgtttgcccggatgtcagaagggatttttagacacaaatgaaaattttttttcataactcgcctggaaaccgcgagacaaatcctttgagcctaattaatccgtcattagcacatgtaggttattgtaacacctatagctaatcatggactaattaggctcaaaaaattcgtatcgcaattccctctctaaccgtgcaattagtttttttaatctatatttaatgctccatacatgtctaaagattcgatgtgatgtttttagaaaaaaaaattagggaattaaaccaggccttagcacatctttctcaacaaaacagcttcacaccaaaacttattttcgtcgtctttgctgagaaaccagtcgcccttcctcatgaggcaagcgcaacagcccatcttccgataaccatgatgttcaagcatggagactcatcacactgcccaacaaggtttaattgggagaatctcaaaccaagggaattaggaaggagatatttgcaacaaattgtcttataggagggaatctcaaacctaagataatatttggagtggcttttatatttttcccaacaaaaaacaggagagggattttacagcacgtcctcaaagtgcaaagtgcaaacttccaggtgaactagcaatatatatatacttggcaccaaagtataagacacaaagatcacattccactaacccaaaaaagagaggaacgaatagcttaacgattaagtccaaactatatgcacgtttttaatacgggaaccattattcgacaaaatgaatgattaaggcagtgcttggggtagataagacatcaatcacaagagcttggccaattgcttcatagaggttagactacaaaccgaaattaagctgaagcaaaatcccaagggtacctggtgcacagtgcggtg

SEQ ID NO: 66446 - DNA, 1285 bp, Oryza sativa
agtttaaaatattatagtatcatactgatgaacagtatcacaaagactatagtgatcctaagttatcaggataaaataagattgcaagattaagatagatgctcccgtgttcctgtcccccaatagctactacccaattacttactgtggtttgcacactgcagcatgaaccggcaacaacaaacaaaaatgaaaatggacggtggtgtcacgcaggcagcttgaatggtctgtgatgagtggagggaaatgagaagggaagaaaacgaaaggacagtcagtctattgtcagggtagacgacttatctttactaagtttctccagaatacatacgatgttggagtacatctccaccaacattttgtgacccatctaaacatacccttcggagaaattataacctcatttagaaccgtatcatctttatcattgttagcacctttggtgaaaacaaattcaattttagtaatatggagtatggcctggataggatcagtctgattgaactaccttccaaaagaattagtttagtttggggggcaagtgtgttaaatattaccccagaatatgaacactacgtgctagagattaccaagttgtgatttatggaacaagagccaaaggctgcagatcaccaagtccttctcatcttgattactaagctcattttcttgtttgctccttttcatcttgttccaaatccagcagattaatttgatgagctttaaatctgcaaaataaaggaaagaattcagaaccatcctgtttgtttggctcctaagttaaaagggtagattgaaaaaccttcagcaacagccatattccctttccgttctgaagggtgaaaattcagtgcataagcagtcagcaattaatagtacagcacaaacccaagatcatgcagatgatgcattggatatcttatgcagaataagacggatcaacatcaaatgctccaaaaagcctttagcaagtttgactagattttgccctgatactggaagtgtaatttgtagtcctgcaccagatttgcaaaagttgttcggcatggaccctctgcaaagccaaagaatgaaaaaaggaattatcttggggatcagtttgtatttatagtagttacatttgtttattcgtaaatagattaagcattttaagaaaaggttaagcaggagttactgaccacccagatatgtgtggagcagttgaagatcactttcctcgcagatatcgataagcgaataaaccccaggtctcaaggcctcatcaatttctctgcgatgtaag

SEQ ID NO: 66447 - DNA, 9790 bp, Oryza sativa
aaccaccatgtacttgtacttaactatagagctcaaataaacatcaaattagtactactgtccaatggatgattatataattgttgcaatgctattgaaactgttacatgaactaattagagtgtttttgtcatcaattcttgaacagggtagtacaacaagcttgtgttggagtattatcctcagcaaactgcatggaaaactgatggatggtgtaccagaatcaacaacaaactccattggaactttccattctagcattatagaatatgaaattgagaacaatgggatcataactgcttatactcatagtactcagaaacactctgtactgaagagatactctagtagttactgcttactcatcgtactgagacactccgtactcatcctactcattgtcaggagatacactaataggaacattactgcctactcatcctactcggaaacactctatcctcagtaggtacgctaataggagcggtactacttactcatcttactcagaaatacttacacatagatgatgcaaaaggtcatggggctgtatggggcataacaatttgctcgtcgccacgaacactcaagtcaaatgatggaaaagggcgtcatgggaatgggagtaagatgttggcaaacagtaggttcaggatgactgatgcgaagtcatcgaggagaccctgccgcgccctcaccgaacgaagtcggtccccgatgtggtcagcaagtcggttgagccggagcacgaaggcggcgaagatgtcgacggatggccccccgatctcgccagcgagctcgatgatggtagcgccgcgtccacgaaggagagccacggcctgggcatcgcgcacgtctgacctgatccttggcaagttcacctctgcgatgcggttgacgatgacgtacaggtcggcgagggcacgcagcctggtgaagttggcgacgcgccactggtaggcctcggtcatgtgcctcagtatggccgccatggcgacggcgtcgccgaaggtgcacgaggagacgatgacgttgatctgggaccggtgaggccccgccgatctccttcaccagcacctcgagctgtggcaaactggtgacctcgaaggcggtggtcgccattgcgatggcggaggagggatgggtttagggttttagcagatcggaagagggaggagggggggaggggggggattgcgtgcggattgcggcggtttggaaagggggggtgttatagcgaggggcggaaggggagcgagcgccaaattcaaaatttccgaaggcgcggtctccatataccaaaatggatttgtgccgaggcttgcgggagacgagcagctcggctgggcccgagagaggaggagaaaggaattagagcaaggttaatacagcatatttgttggctataagtcttttttttagctttttttacccacacatacaataattagctattacaattaatatagagcctacttgtctctctcacagaattttttggttcttttgttcaagccggttgtaagtttacatcccgtttctcctctctctctctctcttctcttctctctttcaccttagggtccctttgaatcgtaggaatgaaaaaacagaggaataggaaaaacacaggattctgacaggaatacaattgtaaaacagaggattgcaaaacacaggaaaaacacaggaatggccgtttgattggaccacaggaaaaacgcaggaatcagatgagagagatagactcagaggaaatgttccaagaggttagacctcttgctaactttcctccaaaatgtgcataggattacccattccataggaattttaaaggattggataggattcaatcctttgtctcaaaggccttcataggatttttttccataggattgaaatcctccaaaattcctacatttttcctacaaatcaaaggggcccttagcatttagtcgacttacagcctactattatactttctcttataggggtgtgtttggcgcctctttcccatcccttttcctcgttttccgtgcgcacgcttttcaaattgttaaacgatgcgtttttttttaaaaaaaaatatgaaagttgcttaaaaaatcaaattaatctattttcgaaaaaaaatagctaatacttaattaatcacgtgctaatggaccgctctattttccgtgagtacttttttcgaatgggaacatcaaatggcgaacacatgtgttctttcatatgtttcccaacccctctcgctcatgttccgtgtgcacgcttttcaaactgctaaacggtgcgtttttttacaaaaactttctatacgaaagttgcttaaaaaatcataatgatctatttttgaaaaaaaagctaatacttaattaatcacacgttaatgaaccgctccgttttcgaggatttggttcctagctcaggagaacaaacgcaatctaagtccactttgaatccctcaatatatgtccaaattttattcgcggagaggaagggcggtggccggccggcagaacagccggtgaatccatccttccctccatttctttgctagcttccgccattgtttcttggatttttcccccttttcatttctgcagctcacacccgctcaaattcttcacaatccgtaaagtgtgtgtgaattcttgcatattagatgctgaattgctactaatagcctgcgtcgactcgtaaatttatgttttttttttggaacagatgggccgtggccgcagtacagctatgggatggtcatcctgctgcaggccaaccacattctacgttaacaaggtgccaaccacccatcttatataggggtggccatttggtctaaccgaaaattttggttttgatcttcgtttttttccatttcggtctttgaaaagtgaaactgaatttcaacaaaaaatgtcagcaccgacaaattcggtctcggtctaggtcctgaccgaaatacagcaacattttcataaatgcaaagaaataatggaaattttcaacacgaaaatcacaaaaaaaatcataagcacgtatgagtaaatactcttattagttgtatgtctaaaagaagtaggatgtgaaaattagagtttaatcctattgaacttagtatattgtaggttgcatttagatttttttttaattcggtcttttcggttaaccgaggagactaaccgaattgaccgaacaaaattcaatctttcactgcctacgactgaattaatgaccgaatttatcagtcttagtcttttcggttcggtctttttctgcccaccctagatcttatctttagaattggatattgggatgtggtcattttctcccaattttctagcttcttgctgcaagattggcataccaatttggttgtgtaattagggtgtgtttagttcacgtcaaaattgaaagtttgattgaaattaaaacgatgtgacggaaaatttggaagtttgtgtgtggccggtgtagttcccaactttttcttcaaacttcaacttttccatcacatcaaaattttcctacacacataaacttccaacttttccgtcacatcgttccagttttaattttagagtgaattaaacacacccatgtagaaaagttttgatgtgataaaaaagttaaaagtttgaaaaaaatattaggaactaaaccatgctttatctggttttaccttgtgacagatctcgagattgaagacgatactcgagagtactggccgtccttgtactgcggctctttctcgacctgctttggtgggaaaagatctgttgagatggacgctctgttccaaaacctgctcctcctccctcaaatttagggtgtgtttagttcacgctaaaattaaaagtttggttgaaattggaacgatatggtggaaaagttggaagtttgtgtgtgtagaaaaattttgatgtgatggaaaagttgaaagtttgaagaaaatgtttagaactaaactaggccttacacaattacacctacccctcaaattccaaatccggttgagaacagccggcaaaacttggaggagggggcaaggtggcagaccccaagggcgacctcgccgccaccgacaaggaccgggcctcctctgagaagaaccgccgccgtcatcaccgtgtcgtctccttcgcccccgctggtaaccgcaatgcagaccctctttgacaccagcagggaggtcttccaggattcattgccgggcttcgtgccgccgccctaaaccgttgcgctactcgctgcccttctccttctacgcgcgcacttgccggccagcgagggagatcgaggaggaaggaaggatggctggcaggccgagggagatccaatgcagttatactagagactgcaacttaagcagttggaattatttttcatcgtcggatcgaaatgatcaacggttgtaatctgtgccacgtcagttctaaacagtaatgctacagtgctcgctacaggagacatccagctacagtgttttgccaaatagtgcctaggaaaatcttgacggctactttccaatccaacgatgcctatgtgaccgcttaatatagccactgcaggtgatctcaattccaggccgggaccggagagagagaagaggaggcgccgacgcaccgtggtggagatagagagcagggtaggacccactgatatgtgggtcccactattttttagttttatatgactgacatgtgggcccacattcttttaatttatatattttatttcaagtgccacatcaccgccacgtagaatgatgaccaagtcaaaccagccatgtagacgtcacgtctaccaaaaccgctatccaaactaccatgtatttcttttgcaccagttttgatagttgaaggacccattgtatctggtattgcggttcaaagataaaaattgaatttgctgtcaagttaagggatctcaaatgaacttatttcaaccgcaataccacatatcccgacccctcaactaataaaaccgatacaattgaactccttaaatggtgagattggttttcgtaaacgtggcacgttgacttggtcaatctatgctagtcaccaaaataaaagtgagccccgtatagctaggtgtgtttagttcccgaaaaaagttgaaagtttaaagaaagttgggagtttggaaaaaaaagttgaaagtctatgtgtataggaaaatttttgatgtgatatgatgtgatggaaagttgggaacagatgaaaaactaaacatggccctaagtgactagggaaaaacgtaaagcccacttgtcagtccccttctctcctctctatttttttccctaacaactccacgctcggcgcaactcacgtctcacctcgttggccttgcactggcattgccgcagccggagaagagggagggtctgttgcagcactggacgacgtagttggcgggcaaaaaaccgaatgctatagcaacgacacgaagcagaagagcggacgcgtccgcgcgtgcaaggaggcgtgaggtgggcaattggtcattgggggccgatcgtcttgccatggcaggcgaacatggccgctgctgccatgtgagggagtgcactgtggagagaaaatggaggtaccgagtatgaggatgatatatgggacctgctttagttttgttgccacgtaaacgcttagttagtatgagtgaatcagattaactttgctatgtcagtgaaactaatcacctatactatcggagaacctaatttaacctagctttgtatatgttggggagttaaagatttgtagtatacggtttagagatgtattttaaactcgacgtcaacactagtgatctaaattgtagtactactagtacttatcactagtgatcccatcggtttatgcagcatcgcgcttctgccgctgcccgaccctattacccaagcccatcatagcccaaaaaacccagaacaacatctcctggacggcccatgcccgactggcttagggtttggtacttgtgtcctgcctccacatcagcttcagagaccgcgccggcgccgggatgtattcctcacctcccaagggtttaaagcggcgcagtcgatttctcgctcgttcgatccgagcggggtatcgtcgtggttatggggaagctgctggacctgaagcggctcatgtccgtgccgaaggagcggaatcgtcgtcggcggcagcggcaaatccgagcccgcagtaaggcctccctcagtcgttctgcctctctagtctggcatctgtaatttgtttagaatatcactgctccttccattgtcttgtgccgttgcacagcactcggcatcgctattttgcaattgggatgcttttcagcaattttttagtgttgtttacagtttatttttcggcatacagattattttggatttaactaaaccaatgagctggatacattaatgttcatttcgattgtcagcatccactaaaaacatagacttcggtatccaaagataacatggaagcccatgcatagtttcggcagtataggggtaaatatcgggtaaacgagtgcaaatgtgcaatgtctcaactgggtagaacatatgaagtgcccatatgtacataccctaaatcttaagaaaatttggtcggccgcttctttggtcagcccagccaaaaagaaaaaaaaaagaaaaagaaggaagaagtagtgcgtgcccataaaactatattgcttccaatataagcaggacccctctaacctatcgtctaaagaggtgtaaaacaaaatatggtagacttgcagtattttcctgttgcaaaaggagatcactccctgctttgaaagcaaataaggttttcggcatagaagcaactactgggaacaccggcttacatagagagctcaaacaacgttctcaccctagccaatggacagcagtccaaaaacaaagaggaaaataactaaaatggtaaactaaaagacaagtgagctgaaaagcaagtttagatcttggttatgaactcatccattttagttatctcctctggtctgaacaacacccaccagaactacacgaagaaaagatttatcaactacgggactgtctggaagcactatctgctgaggcgccgtggccgcgctttgctgcagcaacagcggctgcagaagccaatagaaagcacgctgttcccacaatagattatttttttagggaatacgctagaagcatatctttgtattaagaggaataaaaattatttacaagaaagattgaaggggacggggtactggaatgcaacaaggacttaggctacaatctcacaaccaaattgaacgacctagggaccctagaaactagagaccaagcgccggaatcgccgcctttgccaggcaccacagctctgcctccgcggccatagctcttgcaatttccgcccagggctgccgctggagattgaacaccaggttattcctctctttccagatcatccatgctaccaaggtcgcaatggtgtcgaatccccgacaccgatccttcacgactttcttcctgctaaggcagagccactgatggaaggaggcctcttgcaggggtaggcaatccagttgattgattgccgagagtgcccaccaccagagttgacgggattcagagcagccaaccaagatgtgatctatacaatagattattttatacagcagaaattcaacgttgcagccgaacggctgtgcagttcagctgcagcccaaaccgctgcagtttaggtcttccaacggtcaatatgtcagctgaggaagttattagcaatttctaataagccaagaaagctgtaaacagtacaggatcaaagaatataatgatccacacccccagttcaaccaagaagctaagaattcagaaatatttgtaggaatattcaattttgtgccatggtaacgcctctttcaaacagcaccaagagcaacgagcaatgtgacattgaaagaaaacatggtacacactttctacgcaattgcattggatgcaattaacatcccctttccaattttttttcttcagctgtagatctatcttgataaagaagccaaacggagatttttacttcgagaggaatttcgcatttccacaatctgcacatcctccaactgatgacaccccagagaatgatcctatcatataaagacaaggcttagttattttcagattatttacctgattgttgaaacggattatttgccccacgcttcgaaaaatacattttctcgaaaaactttcttctcttgtattgcttcgaccacttttttaaagttatttgttaagtttatttatcagaatatttaatttatccctataatcaagtagataatcctcatcaataatctgtttcaaaatgaccttagtggtgtagacttgctctttttttttcataataagaaccaatgctcaagggaagtttttttaatggagacaaattggatttaaagtcactagagttttttttttcaaaaaaatcagacaaaaggtaaccaaattgatttgtggtgtgcacttgtgtgcttgatttaattgtttgcttgtatttgtgtctgtacataaccatgcatgatctattgtagatggttcaattgattcagtggctaaaagaaagggatcactctgccaacaagttgcaaattctgatggcgagagaagaacaagatattcagggcctaaccttccagaggtatgacaccaaatgctgataatgaagctcttatattagagtaaggtatctacgagtctatgactgctataagtagcctctaactgcgcactctcgtggtcctatggtacctatatcaaattgtatgaacaggtctttagtgctgcaattttctacagttctgcatgaatagcttttctctattctagctgttacaacttaaccactcccatagaaaattgtctgtgatgggtcttagatccccttgatccttgttgaagcagttgaatttttagagcttccctcccttataatctggttccggtacttgtttttctgtgtattctgtggtctaagatccagtttttcgtcatcatccatcaagtgcatgcctacctggttgagtttaaccaacttccgaagctactagctagtcaaatacgctggtatctatgaaggggccttctattgcttttcaggtcaatatgcattccattattatttgttcactcttgctactcccatattctgagtgctcatgtctactgataatgtggttactgtttccgtttcatccaactccttctcatcttcaaagaaaattatatagtaaatatagttaatcttaacctgttaaccgtaatctaaactgtttgtaccatcaattcataaaccacggagatatgtgaatgtgatgttgaataacctttgcagatagagtagaccaatacagtagcagctccatcatagtttcactccaatcagtaactgtattttttttctcaagcataagaattctgagatcatctttggctccaatgcatgataagctttactttaaccactattaggtcacttgcaagcacttgccttcatactggcccttgcttcctatgaaggtacaatctaataatattagttggtttgtaggttagctataatccaaacctggcaaggcaccaaacaagttctattttcctttattttcgaacaacgcaggagagctgcatgccattccattaagtagaaggaaagaaatacaaagttaggacaagccaacgtagcaagtcccattaagtccattttcctcaaagtaacagctttactcaacttcttat

SEQ ID NO: 66448 - DNA, 7284 bp, Oryza sativa
ccagttattaaaccgagtatctgacaaaacggatgttaaaataggaggcgagtgaggggtagtctaaaaatcatgccaggagaggtttaataagctggcatataattcctaaaggcatattccaaattcaaatggagcttttcttatcacaaactagtgcaggattaagcaaatgtctgttcaaacccaaagtagtgtattggaaacatttaaaaaaacagaagaaaaattgggtcatagaactatcagaacaggaaatctgggaataaccaaaccaatacgtgtggtgtctcaattccacatccaagcaacaagtttgaaaagagaaactaaagttactcatggaatctgctgctgccaaaaaacctctgaagagataccaaaagcaagcacagcaagaattcagcgaactgaaaaattgggtcatagctaaatttgtttggtgttctgtaattgaagtaattgagggggttttaattccaacaaacttttgggatagtctaaaagctgtcaaagaaaaactgggggtgaatttaggtcttttcctttgtgccagtctttgctggggtttgcggcttgtgagaaatgacttagtatttgaaaataaattggttaaatcacctttgcaggtggttttcaagtcaatctcattgatgcagagatggaaggtgctgctaagagaaaaagatcacgaggctttgaacgcactgcttgagaagctgaagagtaagatggaggctctgcgtcctgtggatgttttgccggacaatgttattgcctgagttaggtgctgctgttggtggggctgtagttttttagatctgctctatagtctccgggtgctgttaagtttcagttgctgttggttttgggtgttttaagctagcgcgtgatgggtactggtagccccagtttctctgttttctgttttccaatcttttttcctgtaagcagactgtatgttttggctttctcccaaaagcctggtaatcaatttgtctgttataaaaaaaagaatattttttagacgcttataacaatacgattcaaaacgactggaagtagaaactcttcgcaaggctatggaagcaaggaaaaagccttattaggccctgccaatttgatagactccgtgaaccgcatctacgcacaaatcaataaaggaaaagctatacatacaaacttttttcttactaaattattactaacactcatgtgtcatactatgagtgtatctagattttttataacttctatctacttaaatcacacggttgagataattgttagtaaaagtttaataagaaaaatttagtgcgtgtagcagtgctcatcaataaatcatcaggccaatgctcgtgggtttcacaacgaaacaaaaacgaaacggggttatcaaactagtgaatgtctcctcgaaatcccaaccaaagtaagcaacgtttgttcaaaacccaaacaacaactggaaacatttgaaaaaactgactcatacaactgtcagaaatggaaatcctgagaaaccaggccaatacgcgtggtgtctcgactacatgttcaaagcaagcatttcggaagcaaaatgaagttactccctgaacctgctgctcccaaaaactttagaagagataccaaacgcacatgagagttcaacgaactgaacaattcctagatgcttctggcgaaacagttcgaaacaacacgactggaactcgaaattcttcgcaaggatatcgaagccaggggaaaaaaaacttccaatcctgccaatttgatcaactacgcagaccgcggagactatgcgcctacttttccagcacgatgatctacgcacaaatcatcaggccgatgcctgtggctttcacaacgaaaccaaatcgaaacgcgattatcaaaccagcgaatgcctccttgaaatcccaaccaaatcaccacgcgagtagcaaaacaaagcgatgtgatccgttcaacaaaattcatgcagagaatcgcacaaaccagtagaaattccgctcaaaatatccgcgaaattgagcaaacaaaccagagatttttcacgagaacagattaggtgcctcaaatcagagaaacaaaactcacatcgatcaagcagcacggagaaaaaccacacaatcatcatccagtgcgaaaccgaaacggcccaacagttacgcattcaagagacaatgctacacggggaaactagaaaccaactcaaatctgagatacccagaagcttttgaactggctcaactataaccatttggtattgaacgggcggagagcaccagagaaagtgaaacaaaaatcccaggactcatgctccaaaacatgcctaaatccgcacgagaaatcggttaaaatcagcaaaatgtcaatgaaatccacccaaaaacactcgcaaagtgagacgctactgatgcttcgcactggcccaactagcaccatttggtagtgagcggacggagacggagactactagagaaagtgaaaaaccccaaaccccacgattatctccaaacacgccaaaatccgcacgagaaatcggttaaaatcaacaaagcataagcgaaatccgcacaaaagcactcgcaaagtgcgcgggggatccgacacgcgtgatcacaaacactcgaatcaaacccaaatcggacgccagctactgcaaacaccacacgagcgatcaaatccacagcaaaagaaaaaaaactcgatcgggtgaacagatccgatggccggcttgaaccactaagtcgcacgggaatccaacaggagatgggcgaggaaaaaaactcatcagaagcagcgaatcctgctccgtgatgtccgcctccttcgtgttctgagccatcacctgcatcgcaatcacccgctccgatcagcacgcacgcataccagcaatcgcaacgcgaaatagaggcgacaagcaaccatttcgtctctcgcgcgtgtacgcgggcggaggggggaggggagagggagagtgtagtaactgtactagttggagtactagttacccgaatgattttgttttgatgaggaaattaacttgtgatagtcgttaagtttaattgcgcactggcacatcaacgtgctaatggcagaagacaattttcctgcacaagcttaagcctacagctataaatagacgtacccctctccccctccctctcatcatctcccacctcgcctctgcctcccaccatccacgctgcccgtcccacctgggacgcagggcgtctccaccacgcgccaccctgctcgcgtccccgaccatcaccacgccaccccgtctccctcctcccaccactctccaccgccgcgcgacgccgtctccgccgcgccgcgccgtctccgccgcgccacgccgtctccgccgcacgccgtgcccgccgcgccgcgccacgccacgccgtctccgccgcgccacggtgcccgccgcgccacgccgacgccatggtgcggatgaaagcgaaactcgtctacaacatggacgagctgcggactatggtgcgggacgcggttgggcagcgccacgtcgacgtacgctccctcgaggcacttcgagacgcgcccgccgtattcgacatcctccatgacttgtcatcgaccgccggctacgggtggaaagtacggaacatccagcccatgagcgatctctccgagctcgttgggttactccaactgatgaagtgggtgaacattccccagttgctgattcacctctgcaacctcgatcaacgccgagagatgctactggcgttagaggggttccaggtcaggggatcactctccgtgcaggtactcgctcaagacctgatcgaccgagttcctgcctcaaatcctcgtgcgcattggtcgagggagatgtctgcgaccactctcaagtccaggctggaggaagcaactgccaccgcggtgaacacccttcttaacaattcgatccgcgccgagacacttgctcgccagggaggaggcaccgtgatggcacgagttcgtgagcttcggcgactcctgcgccaaatttccaacgcagttctcgccgcggaccatctgccacctacaataggatcagacttggagcaagcgatcgccctcatcagaaacatcctccagctcccggttcaagtccgtgaggctagacggcgagggcgccgagaatcccccagccccatcccctccacctcccggttcaagtacgtacgtctcattcagttcacgccaattgcctctcgcctctcgatcgtaggctctcgatccctgtctggcattcagtttactcctctggatcgcagttttttttatccctctcagtttactcctctatgtagaggctctcgatccctctctggcattcactttactcctctggatcgtagtttttctgttgagttttgcttcccatgcaatatctgttcataaataaattggtgtggcattttgagatacaatatctgttcataaaaaaatcggtgtgacatttcgagatgcaatatttgttcataaagtgtgtgttagtgcaaaatttgagatgcaatatttgttcataaattttggtgtggccttttaagatgtgtctgttcataacactccatgcatctgttcgtgttattaatatggtgtatctgttcgtgttattaatatggtgtggctttgtgagatttggcgtgttttgagatagatatctattcataacactattaatatggtgtggcttgtgaaatttggcgtgttttgagatagatatctattcataacactcggctttgagatgtatctgttcataaactgttattaatatcactcgcgctttgagatgtatctgttcataaactgttattaatatgatgtggcttgttaatttggtgataattttttattaatatgatgtggcttgttaatctggtgaaaatttggtgtagcgttttgagatgtatctgagtgttattaatatgatgtagcttgttaatttggtgtggcgttttaagatgcaatatctgttcataaaatttggtaatgtcagtagtctaaaactctagattgttgattgatacaatataagcattgtgcagcatctcagattggttctgtgaagaagacacttcttctcattccatgaagagtcaaattaatcacgcgacttcacataagaataattgtaaagtacgttgagatccttttcactgaattgggaaaaaagagatcgaacagatgtgactcataattcaattggatgtgactcgtaattcagttgtgtgaagacagaaaacatgatcagttaaaaaactccataatcatctacataggaattatgttaggaaaaaaatagaactaagattcagcaacatggcaacggttgcaaggtttcacaacatttagcatgacagtggagggaacttttggctcgatgtaagtttcaattgccaaaactgctttcttggcttcggtgagcatatccttacccatatggaagcatttgtcgtgtttgcctgtagaacagctaaaaacatcacgagtagtatccagtttaaggtgcttaagcgacgttgtattgtcaagaatatgacatgttagctcgatcaagctctttgtatagcaaaagccaataatctccacgctctggaggttgtcatgacggtgttctagcatttgcctcatatgtgacatatctccaataatcaattcattctccattcggtcctgtgatatctagagatgaaaagccaatatacttgaaattgatggttgtcaccagtcactgataagtttgcagagtgaaaattagcttacctctagacaaaaagtctccaaggaaggagaagcgtcaagaaaagaaatcagagagaaataatcataggctggggaaagtctccaagcaagatcaatagtcaagcacttgagatagaaaaatttgctaggcaacattggtgtatcaaccatctgcataaagaaaatcagactgatgacatttttcgaaggtgcaagtattgttatataaacataagcacgtccataatcatttcatgtttgtggatatacctcgtgatccgagcaaatggtgagaatttcaagatttggcacattggatggaagctctgcacgagcataatagacggcactaggatagtccaaggatagtgttttcatttgcaatgattcaccaagcaagagccgtacctgcctagctccaaggtcaaaactgcaaagatttggagccttattctctatggcttgcagcattctgcattcaaacacttccaggtggctaaggcgttgcaacaggcaaggtatcttcagacaaattattccataacaatatttaagttccaatcgctccaaagcataagaattcgaaagaaggcacccaaactcatctcctgtaatatgtacagtaaccagatgcaacctcgtcaggtttctcaattcaagattaactgtaggatgaaagaaacaactgccaagataaagatgtcgcaatgaacttcctctcccatcagataaaagtgagcacgggaaattgtaatccacattgtatgaagatagcgacagtgtaaggattagttcttcaatccatggtgtaacagcaatctgaagccaattattgagatgatagctgatgctagcgctccttctagcattgcaaaaagtatcatattctaactgtagcgatttgatgccaatgcctgagtggttttttataatacgatcaattttgttgatgaaatccaaccccagtgttccaatacaaaatataagattggggcggtgttgccaggaacgacgaaaagcatgagacacacatgcagcacgggcagcatctttgaatggcatcagggagtgtatatggcaccagatgtcctgcatgcagaagcaaggatataggttagaaaataccgtcaaggtgacagcttgatcaattggaagggaaaacagtactagtagctttgccataacccttcgggtttgtggtagggaaactgaacagcacattttcatttttatccttttccctttcaaagttttattagtggctgtcctaaaaggggtactggactgcagtcagtgactagtaatgattacctaaatatgagacctattcttactgagttaagctacacaaccaataaaggtctatgcgcatatgcataaactaatatgttcatttttgcacaaaagcatcctatagattagtcaaagtagaaaacaaataaaaataaacatgtatattatttataaggtacaattttctatagctttgacggctgggctgtaagagaaaataga

SEQ ID NO: 66449 - DNA, 5848 bp, Oryza sativa
  unsure (1)..(5848): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaggctttggtttggccagctaacaacaccacaactaccgtatcaaaagctaggcatcacgcagatcatcacgttggctccccatcaaggcccccacccacagcccacacaaccactctcacacacagacgcgcaccgtagagcatcctaaaacagtgtcaagattgcccacatcgtctgaaagaaaaaaaaacacgacaatcaaattcagatagtaatgctactccctccatagtccatccacgtgtgtagagcatttctaagattgttatgacattattaagaaggaaaataaaagacttttgatgcctcttattcaagtgcggttgccatcttctgattagacaagatgaaaggctgaagcctgtggttcgacgagaatttagtgataggtggttgaaaggagatagaatactttataaatttcgtgtacaaattttaaaggtacttacatcgttaacggagaccgttcaaaaatatagcagattcttctaaatatatcaaccaattacttataagataaaaaaaattaccacttaacttaattatagtcccaacaagtctcgatctatattcctcacttagagcaaggttaagatagcatgttattagctgaccgtgtcatctatagtaagcatagtaactaatacctataatatgaatattataacataaatattttattgttttatgggatccaccatcttttttcttcctcatacctcatcatttcctgtattattctctttctccttttcttaccttcgattcgtcaacgattttgggcttgagcagtcagcgaggatggacgatgacggtgatctggcggatgcaggtgactacggcggtctggcggacgcaagagacagtggttgtcgtgcaagacaaaggcggctgtgtggtggaggcggaaggtaacggtgcatgtgcggcggacgcaaagacggtgacagctgggctagacgagctcagttgtctggtgaacgcgagagacgatggcggctagggtagatgcgggagtcggcgccggccaagccgagggtgacagtccaatggacacgatggacaagggcgttagccatggagtatcgaggagcagcaccaacgcaaaccatggctgatgtaggaatgcttcttcatctacaggcgagccccacaacttctttaagcagcgcgtgcggcgacaaattagtcgtgggcgctctctcttcccccctctcctccaattcatcacaaaatcctacgtgaaactaataccgttcattattgtacccgctcttattttatagagcaatctttttatccatctcgttttatccgtgtgaaaggctaccaaatttttgagatggcaggtgtaggtaaggttagagcataggaatctctcagcaagaacatacttcctccgtatggaccgtaccaaaaaaaactaacataggattgagatgtaacgtaacctaacataacgaatcttggcagaagactatctagatttgttgtgctaggattgagatgtaacgtaacctaacataacgaatcttggcaaaagactatctagatcttggcaaaagactatctagatttgttgtgctagattatgtccgtccttatattagattggatttttttaagaccgagagagtagtggccaactggggcagacaaagctactggtgactaatcaggttggtacacgtggcgacttgtgatttctctggggggccgtaggctgcggttagatggcagggtcaacctccttatcggcgatataaatggcgataagatgggccatgcatgtcgttgacaatgatttgccatcgcttagctgctaccgctcccacaaccgacgattccttgagacgttttaaccgtacaaaaaatgaagggtaatttctacagcagcagtagaaattactgcctaaataaacattttcaaaaatttatattatcaaaaatttgataaattgacaacattattaagttttgataggataaattaaatatgatgttgctaaattctctatataacaaagtaaatatcgttatatatttgttaataacaaataatgatacgatttaaattaattgaacatattagtactacgaagaaaaaattactgcggctagatattgacaaatgaaacgacaagacgtcaagccgggacaaggaggaagaagaaacaaacaaacgaacccgtgtgcgccgtcgcgaacactcgccgtgagaaggcccacggcgtcgtccatcaatcagaccatcaccaatcggcgagtgaaaaaatacaaagaaaaataattgtatgcacgaagcactccagtaatgtaattttttttccaatagagtaaggtaggtaaaaatcgagcactaatgctacagtacactctcggtcttggcaggtcgcgccgaaatattttctaggcctgagaagaggagggtaaaaatgcagtaaaatccgacgcggtaaaaaaaaaaaaacagtagagggatgcgtgtccccctactgggccacacgtaccgtagccgcagctgcggtggtttttttttttctccttcgttttgactcgtcgctgcggctacgcgcacgcgcggcgcgccccggtggcgtgcggggggcgttggattagtaccgggcgagagcgcggcggagcacctgggcgaggaggctgggggcgctgaggtgggggaggtgaccctcggtctggaggaactcgacggtggtgcggccgccgaggtgggccttgaggtaggcggcgacggaggccgggacggagacgtcgcgggtggtctggacgacgacgcagggggcgcggaccatgccgagcacgccgcggaggtcggtcttgaagacggtctggcagacgtggagggagatgtccgggcgcatgttgaagagggtgcggctgaactcctgcaccgccgccggcacgtcggcgcccaccgccagaggcgcgtaccccgtcgcccacgccgagtagttcgcccccatcgcgtcgaacacctgctgtatctcctccagctcgaacccgccgtggtagtcgctgtcgttcaagaacctgcacacacatgtccgtgctccccgatcgcccccgatcagattcaattttaagagcgagaaaggattcacatcagtggaagcgagcgtaccggggagaggcgccgatgaggacaagcttggcgaagaggtcaggtcgtcgaatgaaggcaagaatcccgatcatggcgaagacggagtggccgacgaaggcgcagcgcggaatgcggagcgcgtcaaggatggcgagcaggtcgtcgacgtaggcgtcgaggttgtcgtagcggcggaagtcgaagtggtccgggttgacgctgccggcgcagacgaggtcgtagagcacgacgcggtggtcgcgggtgaggtacggcagcacgcggctccacgccgactggtccgtcccgaagccatgcgacagcaccaccacccgctcgccgctccccaccacccgcacgttcaggatctgcagcagcttcgccccgctcggcgccgccgacccgctccctcctccccctcctcccccgccgcccaccatcgtcttctccgagctcgacgacgccgacgaccccccgcccccgccgccgccgctgctgctgctgctcgggctactgggcggcggatgcgtcgatcgcagcatcacaccagcgcggcggattggcaagccgtggcgcgctccccttttatatactactactactactactatcaccactggccatgggagatggtcttgactcttgcctcgcttcttctctctctttcttgctttgatttctctctctgctttattccactgtcttaagcttcgttgggtgcggtggtagattgggatttttgcagagaaggtgtgtgattgcttcagttatttaggggggtgtttgggttttgtctccatgtccaattatccaatccacagcagataaaaaggagaggcagtgaggcacctataattctctggatttttttttctcaggagaagtttttttttctcttatcgttttgttttatttttttttgacttcacaatcccaaccagagatgccactgcaattaatattactcgtagttgagagttttgacaagctaagaacgtcgctgttagtgtctgtaatgtagcgtttgattatcagcgttaagggaatttttgcagcaaacgttgtagacatattagatgatgttataaatgatttaaagagtatagaggaaaagatgttaagtgaatatgttagttcttctgttaatcaggtacatacttcaaatgttgatagcgagatattggatgatcaggtggatgataattctctacttcaacatttgtgtggtgaattaatggaggaggtgatggattttagtggtgtggatgataattattcttagaccactttatattctttagatacctctcctaatagtaagaaaaagactaaaaggggaaagaaaaaaaaagaatatttttaaatgaaagggttgttctggaattgtgatgggtttaaggtcccgaaaaaacataagtttatttctgatttaacaaaggaacatcaccttgattttattgctttgtcagagactattaagaaagattttagtccggctgttcttaaaaatctgtgtgctggcaaataatttttgtggcattgcaagcctcatagaggtaggtccggtggtttgcttttgggcatcaatttaattaatgttgatattggtttgattgatgagggagatttctacattaagtttcatttatgtaataaagttgataagtttaagtgggctttagttctggtgtatgggccagtacaaagtgaatttaaggatcaattccttgctgaattagttaatatgtgcagtcatgaaaccttaccaattcttattggtggtgattttaatattctacgtacgtagccctgatgaaaagaataatgataattatgatgatagatggccattcctttttaatgctattattgatgggttatgtctccgggagttacagatgtctggtaggaaatttacttgggcaaacaatttagtgaatccaacatatgagaaacttgatagggttttaatgttcacggagtgggaacataaatttcctttatcttctgtggtggctcttaatagagatatttctgatcatactcctttacttttaaatacaaacacttcttctttgagtaatgctcaacatagtttcaagtttgaatttggttggcttttacgtgatggctttgttgatatggtaaaggagatatggtctagtgttgatgaacgcaattctgccatggagcggtggcaggcgaaaattcgtcgtttaagacagcatcttaggggttggtctaaacatactagtggcttgtacaaaaaagaaaaaaaaggagattttagataagttggatttgctagataaaaaggcagaaactatgcttttgagtcaggaggagttggattttagatggttttgtagaaatagattatctacaattctgagagaagaggaagttaaatggtatca

SEQ ID NO: 66450 - DNA, 4561 bp, Oryza sativa
  unsure (1)..(4561): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggagcaacggaagtgatgatgccaccatcatatcaataggggtacctgtgctaatctctgatgccatcatcggcacttcggcagtgaccttcttcactttctgtctatgacaagggacagtagatagatcatagattaatggatgattttgcgtagctgataattcagttctggatgtcagcattgctctgatccctatatgggccttctttgtagacaattttgtattgtaacattccaggatcttgtgtgatgaaagtagcgtatgtatgcattatttggatatgaatctaaaaagcttaaacaactatagttttgtctgaagtttagaaccggaagaaagtggcgagttgtcaccagcagtagcttcaacgaggctggccaattcagcccatgggctgcagcttgtagcctctttacggcccaaccggagccctcccttgccccaggatttctccgcttccctcgtcccccaccttgccgcgccgtcacaccgccgccgcctcctcgccatggacaccccgccgtccgccgccgccgccaccgccaccgccgttgcgtcagactctgattgcgactccgcgctcgtcgccgacgtggcggaagcgctcgtgtcggcgtcccgcctgccggagccgccgcctatccccgccctcctcgccctctacctcccgcgcctcgccgcctcccaccacccgcgcgtgctctccctcgccgcctcccacccggggctcgcctcgccggacctgctcctcgcctaccgccgccacctctcgccgccctcctgcctcccctccctcgtcccgctcctccccgtcctcccctaccgccacctcctcccgctcctcctctccttcgtcccgctcgacccgcttcgccacctccaccgccacctcctcgcgcacctccccacgagtcccctcgccgatgccgcgctctccgcctacgcccgcctccgcctcccccacctcgccgcccagctcctccactccctccgccgccgccgtggcgttcgcccttccctccaggctgccaacgccgtcctctccgcgctttcgcgcagcccatccaccttgccgcaggcctccctcgatgtcttccgctccctcatcgagctccgcctccaccccaaccactacaccttcaacctcctcgtccacacgcattgctccaagggcaccctcgccgacgctctcgccacgctctccaccatgcaggggttcggcctctcccccgatgccgtcacctacaacacgctcctcaatgcgcactgccggaagggcatgctcggcgaggcccgggcactgctggcgaggatgaagagggacggcatcgcgcccacgcagccaacgtacaataccctcgtgtcggcgtttgctaggcttgggtggattaagcaggcgaccaaggtcgtggagtccatgacagcctacgggttcgagcctgacctgaggacgtacaatgtgctcgccgtggggctgtgccaggcggggaaggtggacgaggcattccggctgaaggatgagatggaacggctcagcaccgcgttgccggatgtagtgacttacaatacacttgttgacgcctgcttcaagtggcggtgctcatcagatgcattgaggctgcttgaggaaatgcgtgacaagggggtgaagccgactttggtcacacataacattgttgtgaagagtctttgcaaggagggtaaattggaggaggcattggggaagctggagaagatagcagaggaggggttggcaccagatgtaatcacgtacaatacgttgattgatgcatactgtaaggctggtaatgtcgcaaaagcattcacattgatggatgagatggtcggaaaggggctcaaaatggacaccttcacacttaacaccgtgctgtacaacctatgcaagatgaagcgttatgaagatgctgaggagcttttgcattcacccccgcagcggggtttcgtgcctgatgaagtcagctatggtactgtaatggctgcgtacttcaaggagtataatccggagcctgctttgcgtctgtgggaccagatgattgagaggaagttgataccaagcatttcaacgtacaacacgttgatcaaggggctttgtaggatggagaggctgaaagaagcaattgacaaattaaatgagctcgtggagaaggggttggttcctgatgaaaccacatataatatcatcattcatgcatactgcaaggaaggggacctagaaaatgcctttcgattccacaacaagatggttgagaattccttcaagccagatgttgttacctgcaacactttgatgaatggcctttgtctgcatgggaagctagataaagcattgaaactctttgaatcatgggtggagaaggggaagaaggttgatgttatcacatataataccctaattcaatcgatgtgcaaagttggggatgttgatactgctttgcacttctttgatgacatggaggtcaagggattgcagcctgatgcatttacttataatgttgtgttatctgcactatctgaagcaggaagatcagaagaagcacataatatgctacataagttagccgatagtggaaaattatctcaaagctttgcttgtcctctgttgaagccttcttctgcggatgaagcagatgtcaaggaacatgagggtaaacctgaggcagaatccagtgaaaaagcacaagacaatgctctggagacatacatggaacgcctaaatgggctatgtaccggtgggcaattgaaagaagctaaagccgttttggatgagatgatgcaaaaggggatgcctgttgacagttcaacatatataactttgatggaagggcttatcaagagacagaaaaggcaaacccatgcagctggacagtccacactatagatttttgctcccgtgggatgcgggcatgtgacatcattagggctttagtcataaatctggaaaactcaagtgcttggctaccaggattaccatcatggacaaaaaaaaaagaagtcggtatgtcaacattttttttctgcagtcagaaccttatatttgtaactttcagtacaaagtaaattcatttttagttttttcactgcacgctatgttaaatgtataaagaataccagcagtgatttgaatctttttttgctcctggtaaaatagtgtagcttctagattccctccaacataaaattgttgagcttctacagaaaaatatataatcatgtgcgagttcttgatcataacctattaaatcctaaccacccatccatcttcaacagataagaattgaaaattgtcgatgactatacttagtaaaacaaagtatcttctgtgatattgtaaaatacatcttgacaatacggtccatgttcaaccaatatatatgtcttaatcaaccttgtaaaccataattccgtgcaatcaggcatttactcttggaccttctctgcttgaagttttcatagctgtcacatatgcttgtgtgattccatcagcatggttgagacttctgttagttttcatgaagtatgtactgggtagttggacattcgggcaatgataagtttactcattatacaatgacatccaacagactatagtttcttttgcagttgaaaaaaaaaagatagttacttgcatctattggctattgatgaagtgatgaaccacagattcttatttgtggtacagtgtgatttttttttgttcttgtttgtgaggaaaaaaactgttgtagaatgatgtgcgtttttgctgttcaatcgtgtttatttgaaatatgtttaaactttttttatattcatttcctactagtgatgccttgcctgaattcagaataatatgtttcgacaatgggtgtctatacacacacatatgaagtatgccttgagaaatgttaaaagttatgtaaatgaattgttttaaagttgtccagaccataatttgtcattgtacttaaatatatttggattgtatgttcttttagtcagtggcggagccaggacccagcaacctgggcaggtgcctgggctccgtccaacgcatgcatgactagtaacctaattaccatgcatgcttagctagtcattgtcccagccatgtgtagcagtagtattatttaattaccatgcttaacaaaatagcaaaacaagtgcttgaggattgtcaattttacttgcgtcattttgtatggatttatttgtactagttattc

SEQ ID NO: 66451 - DNA, 3490 bp, Oryza sativa
aagttcaattgttgctgcctctggagctcctggacgtgttgggcaagcattcataatgtaacaggagagccctggagctcaggtacttccccccaaatttttcattgctaatttcaatagagtcaactgtcgaggcaagctgttcccataatttgccggtttcaatgaggattaaatgtcttttattgacattaaagtttcgtaaaaattgaaccctattattagaaattcatatgcaacttaaattgacattgagcacaaaaattctagtcttcaatgcaacctcttttatgaacagaacaccttgggaaaaacactctcattggatgcttttaaagggaagaaaactccacacaaataattgttcacttaggtgcctaaaaattttgtcccctgagtgcttttaccattttatgttagtttggtccaagtgcaaaatttgttccttaaagtatccttgttgtactgcaaacatttattctactacttaaatttgaggttcttttctctttgaaggcttttgtaacaattaattggaatgaacgtttggagcgttgattgcaggtcgtagaacgtttggaacactgtaacatggaatgaagaagctatgatgttttagaaaacatatgagaagagtaagtatccatcctataattcacctcattcttacacctacaatactcattcatcaaatccaacgactcataatcatcgaatccaacggatcacatcatcccacgtttcccctcatcctcaccttggacccgcacgctccccctcccctaatctctctcgcacaccagacaccaccatcgccgcatcgcatcgccgcacaccagacgttgccgccatcgcctcgcatcgccgaacctccatcgctccccctccctcccactccatcgccggatcggattccctgcccctcaccgatttcattcaaaatgctgacgctggatcggcgggaatccgcccgcgccctctctgccaccggaatgccatcaccacgcctcgccgctctcctccgacaacgtgacgccgctgccgcctcaagcacctccgccagtgatccatactcgcgctgccgatgccggatcggcgggaatcgtgcacgcatgggctaggggaggtgctcgtgtgcgcacgggccgtctccatcgatcgatcgatcaacctgcccgcttgctcaaccaatttgattaacaccaattctgaatctctgatcatgcaagcgcaggctgggatggtggagcagcctccacagatccgttctgtcaggcatcttggcttacgggtgaactacacagcgatggtccacatgttgccccgccagatagagcagatcctgaagagtttcccacgtttaaaatcactgaaaatcctggtaataccaatgaacagccaatcttatccaaatccaatcaattgttgcataattctgaatttgctgcttattaattgctttgcactgatatgtctgaattctgatttttctggttgagtcgtggtctgaattctgaattcgctgtcaattcctctgcacaaaagtgtgtgcattttgattttctgactgagttgtggtctgaattctgaatttgctgctaattagtgatacttctggattctgattattctgattgagttgtggtctgaattctaaatttgctgtcaattgctctgcactaatttgtactatgcattttgattttctgattgagttgtgttgtgccctatttcagagatgcgatgacgttacaggtatgcaaatgaaatcgattgcccgcttgctcaaccaatttgattaacaccaattctgaatctctgatcatgcaacggcagatccgttctgtcaggcatcttggcttacgggtgaactacacagcgatggcatcaatttgcagttgacgtgaacaatcggataagtatatattcttgtgctttctaaattatgaaatggaatatattgttcttttgtgaaatttgatttatctcataaaaaatgtctgtcctcagatatggattggctatttactattgggcaagaagtgtttggtgctttgcatccaacagccatatgaggctcagtctcttggtatgaattcatcagataactcttctcttcgtaatattcatctttcaaaatatcatttcaggatcacgtcaattttttcaccattgatcttggcatagtatgaactggacagactttggtccattcccctggatgtatgcaatatttattccatttcaggaatgtacataagtgcatcatactttgtatttaacagacattgtggctaatggatgatgatataaacacctttgtatgcattttaacgaaaaaccatcctttgaaagctttttaatggaagttctaaaaggttttaattcttgtttattgtttattgatggagagaacaatttctatcttcttaagtagatggctcaggacttggtttccaatgttacttgaaaatgatactgcaagctaatcggatcaagttttgttatattgcaggaggctagcattatccaatctgctgctttgactgcatggcgtgctttatacgacaactgcaggtgaacgcgattcgacttgtacccctgattttgtctggcatcttgttccaccagatcggctgcaatgcctcccgtcaaggagttgaggaagagccacagcaacaccccctaagccggttgccctgattgtgtcccgtccctgcaaagtgctgggtacccattttgctgcttcttttagaagaaaatcgttgtttggtttatagtgtgtcccctttgttcccctttatttcttattgatgaatggaactcattggatttagtttggatgcaactgcttgtcgataatgaggtagcaaactctcctgcatcaatacattggctctctatgtggacctaatgaggtagcaaactctcctgcatcaatacattggctctctatgtggaccgtgcatttgttttacttagtacttacgagatatatgttgttttcttttttaagttgatcttcccattctattacagtaaagtccaagttcttaatttcaaatgagatgtgaccttctgctctgttttatggttgcatgtatttcaactttgtaccaatgcatgctactaaatttttatgctttttctagcagaataaaatcctataaactggtaaataatttatgggcttcttctgcattataatggaatgcctaggctgtaaggaaattaagcactttccagtatttaggcacacatatacggatttttagattaatatatcaatcttccgtgtatctcttatttattaacttctgcacatctctacccaaagatatatcatatatctcatacattgactaatgtgatcattggtgtgtaatgtgatcatttttgtctacttaaaggaagtccaggttcattattccaaattcattctagaactacagaccaatgtttctgaaagtagtttcaaatttaagcttct

SEQ ID NO: 66452 - DNA, 40403 bp, Oryza sativa
  unsure (1)..(40403): unsure at all n locations
ttgaataagacgagtggttaaacgttacaagtaaaaactcaaaatcccttatattataggacagagggagtacaagtgtacgagtatttcaattcgtctgagtggtgaaaggtaacttcggtgaccattttgggatgagatcgggctgtttacattgcatattgcaaaacttggaatatttttatttgcacttgggtatggtgcttccttgctagcccttaactaataattggatgaagggatagattatacatgaacatgtttgtacataccaggagcgaattctgaatttgcgtgtaacttttgttattggtacaagatatccatcgtgttgcaatgccactgtttttctttaaccatttatcatttatgggtcacattctcaaaaatttctttgaatgacctgtccaagtatgattggtgttaacaatttacaaactttgcgtgcatgtctgttgcatacgtacagtggattatcctttggcagtatgacctgtttgtaatacacatcaatcttgaatctcatccgcatgaaccagattatagtttaactaaactatttgcattttaaaaaaaaaaactgcaagggaagactactgtgagtaggctttcttcgtttaagaaatgaaacatcacgtcaagtatatatgtttacccaagtaaagaatgctggaacggcaacaaatgggagagggaattacactcccttttttcgctcatcaaggaacggcaacatgatggagacgataatatgatatcatgatagcaacatgcttgggcccttcatttctccattggtgccatctcctaccaactcgccatgaggttttggccgtttgtacgcgcaagcatttcgatgccgaatcacgagctgatcagcctgggagtacgctttccggcaagcatcagggaaaaccaagccgtataagttaaaaccgagcgcccagctgaacctgacccagagattcacatgacgatcgacgagatccatccatcgctagaacattcgattgcaaatattttgggcggttggtttaagtttacccgtgcacaggcaaggaaagcttgtgggtctcaacttcgacttttgtgtacacacacagccatggatggcacatatactcactctcaacctgttgccaacacaagcacagttccctattatactatattcagtcaagagtgaaggacactcagcccattttagaacctcagagattttaagaagtagctgagacaaatatgaaaaagctgagttctcagcttttaactttcagtttattttctaaaattcatacccataaaggttctaggaatctagactaattcgaagctaaagattttctaaaaaagctacaactgcaagaaattaccatgtaaacaaacaagacgtcactctgcactgtaggctcccagtagatgatacagtccctcatgtgatcgttaaactagttcagagcccagaatccggagttctgggattaataacaacaagccaaaatctcataacacagcaagtgtgcagcgcagctgcaggccatggccatatacaaaaaccaaataccaaagcatcaccagggccggatgcctagctttggcagcagcaagtcacactccgtaggcagcagtagcaaaataaccaatatactagtagtactagtagaaaatgatatgaaacggcaagtgtcttgtgtgggcgatcgccaagtcaagaccctctcttccacgcttgcttggcaatctcgctcgcgtctccctcccgtgcaggcatgcagcaagccagcagttagccggtgagcacaagaaacaagcaaatgcaacggatatcctactaccacctcagttggccttcacctcttcgtttcctatataaatggcacagccacgctaagatcattccagtccaacgtaggaagagcagatgcatatatggtctcttcatctcctcgacctagctagctgcttctgttaactactgagaggagttagcaagctatagctaatcaagagtgtgctggttttgttcgattctgcagggtaatgtgctgctaatgtaatcagtttaagatgctcacatgatgcaccaagacatgacctaagctagctacctttgttgctttgcattctgccgttattttcggcaacttattgacgtggattattaattgcatagaattgtttaagaagttgtgttgttgatgcttaccctgcagtgtcctgggagagacgatagatatgaaggttgatccgatggggaaactgttgttcttgcttgcatggattactctcttgcaaggtaataataccagttcttttaactattcctttgccctgtttaattagcttgcaagtgcagtatcatgtcacaccaattgtagaggttttcatatatgctttggaactttactgagcgtcacggtcatgtacttaaattattatatatcactatactctgttgtaaatcgttactgagatatataaattaagctacttctgaatttgtctgcaggttgctgcatggtgaaatccttttcttacgactactcatcaagcattgaggcaagtcgttctctaatatgatctgtaactgttagtcgtagtacacactgtacactagctagtacttcatctgctacatgttatcgacgaatgtatcgttggccggcctaaggcatcgacagaaattaattatattcctgcttagattagcgagcaattaatctcgcgattaacaattaaaagctagctcgattgggatgacaatagctatatcacgggcgggagtggcggcgcgatatgttaattattacgattatcggcctcacgcaatgcgtttccggtgcgagttagcatggaatttctttcttaatttgcccgtacgtacactatatgcttttcagtaccatgcacgatagcggcggcggcggccggcgcagcgtgtcatgtaagctagctccaaacaaaatgcacacatcattaatcatttatcattatttggtttttttgactataatatatactctctcattccctaaatgtttgacgctgttgacttttttaaacatgtttgaccattcgtcttatttaaaaacttttataaaaatatgtaaaactatatgtatacataaaattatatttaacaatgaattaaatgataggaaaaaaataataattacttaaattttttgaataagacgaacggtcaaacatgtttaaaaaaatcaacggcgtcaaacatttaggaatggaggaagtatatatcaatatatgtagttatatgcaccttttctctttggtccattcttgtgctcttcatcattttattttcttattgtcattagtttgatgatcacgtttaggtatgcttcagatgtgtctgcagagcaagcaaagcatctctatgttgccgagattagagcagcatgcacttttatgcatgcttagacaaattaataaagttaattaattaattatggcgtctgagtgtgtgggcttgttcggtacagtgcttgcctgagccgccggagccccagtacggcggcggcgtcgtccggaacgccgacttcagcgctggcctccatggctggtcggccttcgggtacggcagcctcgccgagggctcgtcgccggcggggaacaggtacgccgtggcgacgaaccggacgcggccgtaccagagcgtcagccagaaggtcctcctccagaacgacacgcactacaccctctcaggtctggtggtcaagaaatcgaacgtgtgaaattaatgtgtagccgtcacgtctcactttgtggttttccatgtgcatgcaatttgggactgagacgtcgcgtactacgtgcgtgtgcggtgcagcgtggttgcaggtgagcgacggtgtcgccgacgtgcgggtggtcgtcaaggccgccggcgacttcatccacgccggcggcgtcgccgccaagtccggctgctggtccatgctcaagggcggcctcaccaccgtctccggcggccgcgccgagatctacttcgaggtaactaattaatcactttcactccgagttgatttaattctttgcaaatactacggagtacatgcgaacgtgacgcgtgcttgcgtgcagagcaacgcgacggcggacatatgggtggacagcgtgtcgctgaagccgttcaccaaggaggagtggagcaaccaccgcgacgcgtcggcgagcacggcgaggaggaagacggtgaggctccaggcgacggactccgccgggaacccgctgccgggcgccgccgtgtcgctggagaacgtccgcaacggcttccccctcggcgccgccatgagcggcgagatcctgcgcaacccgtcgtaccagcggtggttcgcgtcgcggttcacggtgaccacgttcgagaacgagatgaagtggtacagcacggagccggcgccggggagggaggactactcggtgccggacgcgatgctggagttcgccaggagccacggcatcgcggtgcgcgggcacaacgtgttctgggacgacccgaaccagcagccgcggtgggtgcaggggctcccctacccgcagctgctggcggcggcgtcgcggcggatccggtcggtggtggcgaggtacgccgggaagctcatcgcgtgggacgtggtgaacgagaacctgcacttctccttcttcgagcgccgcttcgggtgggacgcttccacggcgttctacgcggcggcgcggatgctggacaccgggtcgacgctcatgttcatgaacgagtacaacacgctggagcagccgggcgacatggcggcgctgccggcgaggtacgtgcagcggctgaagcagatcatcggcgggtacccgcagaacggcgccggcatggccatcggcctcgagggccacttcaccgcgccggtcaacatcccctacatgcgcgccgccctggacaccctcgcgcaggccggcgtccccgtgtggctcaccgaggtcgacgtcggcggcggcgcgtcgcaggcgtactacctggaggagatcctccgggaggcgtacgcgcacccggcggtgcagggcgtcatcctgtgggcggcgtggcggccgcagggctgctacgtcatgtgcctcaccgacaacgacttcaacaacctgccgcagggcgacgtcgtcgaccgcctcatcaccgagtggagcacggcgccgcgcgccggcacgacggacgccgagggcttcttccaggccgagctcgcgcacggcgagtacaaggtcaccgtcacccacccgtcgctcaacacctccgtgtcgcagagcgtcaaggttgaaatgggatcagggagccactacttcatccaggtctaagctctagctcatcactcatcagctagacagctacccgatgatttcattcagggctttggaaatgatcatactggtcattcatgcccgttagctgtatctcttcatagtatcaagatgcatgtgtagtcgaaattctgcagcttaaatagcctaatagtacccatattagccattcatgattcatgtaccaattttactctgaaaaattgcagctgaattgaaatggagctacacaaaagggaaaaatatagcctaatagtacccatattagccattatgctaaacttttggagtctcttgtactcatttccagttattctttctttctcgctgaaggatttcagcaggtttgctgtagcttggacggccgatccttttcccatggccattagcgtatgattgtttttctatcgagatgacatcatctccggtcatgattctgacttctgttacatttaatcaccaacaaagagtatactatttcaaattgaatcatgatcctataaaaaaaatagaaaaatgatgtcatccggaagcaaacaagcgaagtcacgagcagaacacggacaaaacaaaaggcacagcacacccaaacttccaaactgagttgccatgtcgcgttcaatccacacaccacaactacgggagacatgacgtaaacacaatatatactggagataatctagtgatttttatattaaaatccattacaatcaatatttcttttagcttgcataggcatgctagtgtaatctaccatagaatgaactgtagtgtagcaatcgaagttcacgtgatactgtaagggcattgacattgaaacaggaagctgacaccttctgattcagaatatgaaaaagaaaagcacaaacaacaacctatattctggtacagcacctaactaagcaagaagccagatagataacaaagggactagtatttgatggtaccaattttatgaggtcaacaagttgtcaccaagcttcaacaaagccaaacttgccgagcaccgctgtcgtttcctgccttgaactgcatttgaataatgtgtaaaacatcccatcagtacattgtgtaaaaaaacagacccatctctcgattttccaagggattcaaacggagttttgaataattggcatcactgttattgctcttaccttccatctctcaatatcttgtagactcctggtgttattaggtccacaattgttgaaccagcacgcccagaagggaggattccaccatcaaagacatatgaacaatgtggccacagatcctcaaaatctttgacgttgacactactaggatgcccgcttaagttggcgcttgtaagtgcaagcgcacttccagcaccacgggaaatggctcgaatgaaatcaaaatctggcacacgaactccaatgctttccaaaccaggattaagagatctctccaatatactgttgttacctaaatgtaaatgaatgaagagttttattagacacattatgctgcttaagaaaggtgcaagatagaagttttgaagcataggctggtgtccacacctcgttttaaaacaactgtgacaggcccaggaagtagactatcaagcaggccatgaggtaggtgatccacaacagcaaaccgtgatatgtctgggacatcagcaacacagattgcaagaggccgtgtctgtacgcgtcctttgatctcatatatacgattaactgcttctgcagagctgtcatgaagattgagagacccattttaaaaataaccaatggatgaatgcagccaaccagtcagagaatctccaaaaaagtaaacctagcttaaaatgaacaaagtcacgaaacattgcttccaaatctaaatgaaagtgagattcaatagtaactaatgaaagtttctgaactgtttgtgaatattttttgtacatgactaatttagatatgagcacacaaactcctcataactagaatctggatttactgatcagagtttcttttcaggggttggccttgttagacatctactcacatcattgcagaaggtgttaaattggagttaacatgagaacaataggacaacaaagcaaatgagaagaataaaattcttggcacaaaatgtacttttagtaaaactaaccatgcatcacaagcaaagccataaatcgtatcggtgggcaccgcaatcacttgccccctgttaattgagtcaattgctttcatgacatgatcatttgttgctggaaggatgtgttctgccgtggcttctattcggtgtgtcttgtcatctgacacccttaccgagcaggataccacagacttcgtctcatgttgagatgataatctgttgaccttaacaaaactgagaaaaacaagtgtgtcagtgcagtaatctgaataaacattttaaccaaagaaatacacagttctcccatgtgccaaaagagatttccatacagtatgaaattttacatagcaattaacaagtgtgctgaacaagataatatatacatcaagtctcaaggaaccatgtcaaattgagagcatcactcaattgcattaacatatatatgaaaaatttgggagaaccacggatggaatttgtgtataaaccccaaagttcctcattactattgcaccacagtccttagcaaaccaagaaagccccaaatttgttgaagaaaaataaaaaatcttatgtgcagatacaatttacagtaagtagcattgtgaagtcggtactctgattatagcaaattcaatcatcaaaacatcctagatgttcacttcttaccattagtattaaaagacaattcgcggggattatcccacatgaaaaggtattatacaagataattcaattaaatatacaaacactatctccttttgaatgaattggatgaaaaacaagagtacaaacacaagtcgtttgggcgaagtaaataagtagtagccagtaattcaacgtccgtggaacaatgtcaagattctagaattagaattactagcatgagaagtgcaaattctagcctttttcacaaataaataaaagatgtttgaacaaacgaaagcttagtatatttctagggagcgagcaaacaagaacccagagtaacgaagaggggatacctccgagccaggggttgcctggcgggagcaccgaccagggggagcctctcccccgctgccctcgcgcacgccttcatctccctcctcctcctcctcctcctctcccccgccgccggccaccgcgaaagattacgagccgcggagcgcgacgccgaggcggccggagcaaaatttctcccggagagagaggactagtcaaaccactaaacaaaaagacggttttactgtatatcatccgagcccgacgcggggaaagggtctctgcctcagtgtctcacagacaggtgggccccaccccgctcctgccttctaggaggggctgttccgcgaggaggcgtaaagtggaggggctcttttgcaaaaagataacggaattgctatccttccgtcgatagaaaatactacatccccaaatcttcgggattttggatcactgaatgtgcttcgtgattcgtgctcagttgtttcttttccaactccggcgtcctcctcttcttctccggcaccggcgacagggaagacagctgcgcgggacagctcgccgccactggcttgaggaaaaggagaggagagggagggggagggggactcgccggcaccgttgacagttgacacctttcggccagccggcgaggccggggtggcggcacggtggggcgtcggcggcgcaggaagcgcgcggtgtcgagactcgagaggaggagcgctcgagcgctttgtgcggcggcagggaggaaaaaggaaaagtggtttagggttttgtggattttgcacgaatctcaaaccaattcaatggtctaaaatttgcaagatattaggaggggttttctatcaaagattaaaaaataaactcccccttcgcttctcgctagggtttaagccggcggcggcggcgaggttgtgcagatggcggaggcggccgtgaggtgcctccgggacgggcgcctcgacggggagcacgctccggcacttgccgtggcgagtaatatccagtgcggcccgctcgccgccggcgccatgctccacctcgcggccgccgtggcctccaacgccgccgcggggaaggcgcaggcgaggtattattgttgggcttcttcgatggtttgctgctttagctcggggtggtatgggcgatgacgtgagttggctccgttgcgacttgttgtggcgcaggggactggtgatcgtggcgttcgatcggagcccggaggtgtatctcgacttcatgcggcgccgcggccttgatccaaatgctttgaatcgatggtaatggtcttaacatttcagagcttacaatttgaacacaactgccacttaacaattatgatcttaactgcaaaaccagagctttgcgtatctgaagaaatttattatgctagtgcgacctctttggcaaatctaaaatttaaataggctaagttggcacctcacactcacagccacctatagggaaatgcttgagtcacagtattcactcatattgtcaacatagcttattgatggtggaaanccctaccaataaaatactgagtgctcagtaagttttagaatctttttacattgttccaacagtgtacggatattggattgctattcagacccaattggatggaatcagaagattagaagtcagcagcaacaagaaagtggtgcagatctctgctcagcgaacaaagagaatgttacaattttcagaaatgtgaaggatcttgataaattgatgtgctccactattgatcttggaagaggtagaagctttttgactagctacttgtctctctttgtgatcttaaagcttatgctgttgctatgaataccagggtttgcaggagaaggcaaaatctatttttcaattgctgttgactcagtaagtaccttctcggagacgtctctatcttatagtttacttggagtttggatctcccatcaataaaattttaccccatatgttgcaattatgccaaagcttgcttcatgtttttctagacatgttcctcttataatgctgtatcaattgttgtcaagctgttctaatttggttgctgtggctggtgagtttattgaatcttgagctactggattagaaatgttccatctcaacaacaaaaaaaattgtttgttggactgtcttgcttagatctggaaataaagttaagcttgcacttttccagaaaccaagtttagtgttttctgtattgtattgtagctattgttcagcaagctgtcatttcagtacgtttggatggtatctgaaagccaaagcatgatctcacttttctccccatctgtataacaccaatatttcacacacaagtcacaagctttccaccatttgtgtcttaccatatgataagttgacattgattactctttgaaacaaaatcatctttactttaattctgaagttactttcactttcgtgatactgttttagcttttgttaatgttaacagcaagatcgtgtatgatatttcagattagttctatgttaaggcgtgcttcagtgtcatcaatttcaagcttcctcagtaatcttcggagccatggtatttactttctttccttctatttgcgtattcatggcagttggaagttggaactcaatgccaatcatttgtattaatgatgttttgcttgtacgtaacaatgatgtgttgttattcacttgatccttgaagtataaatttgtgttctcatattgcagatcaaatatcatcaatattttggctaatacattctgatctccatgaacccaaattttcccgagcctttgaatgtctctctaccatggttgcttcattagagccagctgtggttgattctgtttatgaggaagaaattccagggaatatttctttcctggaggaaaattattctaaagcaaagttttatttacgcctaaaacggcggaatggacgggtcaagcaccttgtaaggttttgacttcaatgttcaaatcattctgaatttcacgtcatgaagagtgtacactgataaatattattcctacattttcagtacgaggagttacatgttgagggaaatgatgttagatttgtttctgctccttctgtaagtacagaagtgagccaaagtctgttgcctaaggttgggctatacatttcttactcaagttaaaatactcttctgtcttcactgccaactaatctagtcttctcaacattgactgtattgcaacatgtggatttaacaggttcagttcaatcttgagctgtcagagaaggagtgcagtgacaaggcaaatgttgttcttccttttgaacatcaaggtacttaccttaccggaagttatttgccaaaagttagcttatgtttcaggtctccttgtcagctgcattctgactgcatgagctacatggatgatatatctgcaactaaattcttttaacaccctaatctcaggaaagggtgagcctatccatatatacgacggacggagatctctcccagaggctcaacaagatagcaatttaactgcatccgctctcctggatgaagtaaaatttcctaaatctgcagctccaaagggtgaaattcattactttcgtgattctgatgatgagcaacctgactccgatgaagacccagatgacgatttggatatttgagttccacccatggtgtgagcaccttatctgcatacagaatgccttgatcgtacttgcgaggtaaccgatagccccgatcagaacttataatcatgagtagtattagtatttgttacacctctgttttctgttctttacactgatggtagtgtttttgtgacaagataatagaatgatagtccgtccgtgctacacactaccttgtactgttagtgcatgcattcagttatccccaaaatgtttaaaaagtgtttacatatgcaaaacagcaacaaactacaatttcttggggaaactaaaatggaagcaggcgaccttttttttccctttattaaaggatggtagacaaggaaagtttttatgagaactatgtaccgtgctgattaaattctctcatcacagagtccttacaagttacaaatgaaatgtaagcattggatctacgtatatatataaaaaagttactagaatcactaaaaaaaatggaaggaaatgaagtgacaatgcaattagcctagaactagaaaaaatagcaacattgtgaccaaggaaacgactgctgatccagtgggcagcaaagtctagggcgctcctacaattcaaactaaatcatatcatattaattagtacgtaccggatctgagctcgattttggcctctgccttggagtcgaggtcgagggtcatgcagttctccttgaactccttgtgcttgacggtggcattgtactcgccgtggaagatctccacctcgaggacgcccttggagtcggtcttgccggtgtggccggccgtccactccttgaggagcttgtcgatggcgtcgccgacggggaggttcttgaagctgttgtctgtgaagcacatgacgtagcatcccttggcgtgccacgccccccagagcacgatgcccttgacggccgggtgcgcgaacccttcgcgcatcacctcatccaggtactccacctggttcttgcagggcttgacgtccacctcggtgagccagatgggcaccttggcctgcgccagcgtgtcgatggagccacgcatgtaggggatgttcggcgcggcgaagtggctctcgaggccgatgccgtacttgaggtcggcgttgcccgggaactcgcggatctgcttgagcttggccacgtacttggtcggcagcggcgccgcgtcgttgggctcctcgatggtgttgaactcgttcatgaagaggatgggcttgctgtcgagcttgcccacgtccctgaagatctccgccgacgcgtccttgccgagcttgccctcgaaaaagttgaagtggaggttctcgttgacgacgtcccagtggatcaccttgccggcgtagcgggtgacgatgtccttgagccgattcgccatggcctccttgagctccggcacgcccagcttctccacccagtccatctgcttgtcctggtcgtcccagaacacgttgtggccgcgcagcgtgatgttgtgcttctccgcgagctccaccatcttgtccgaaaccttgtagtcctcctcgttctggtggaactccgtgctgtaccacttcatctcgttctccagggtcgcgtaccggaaccgcgccgcgaaccacttctcgtactccggcatgtccaggatctccttggtcatcgcgttccccagcgggaaccccttccccacccgctccaggctcacgtccgcttccggcaccggcttgccgtcggggcccaccaccgtgatcttcaccttcttcatcctctcctgtgtcaattgccaattaattccaccatcagtcaatgttactcttctccagctctctgattaattcttcagcatcagcagcaacgacatgatgcaatcgagttcatggtgcatatatatgcaccttcttgacggactccgcgcgatggcccttccattcgtcgaagctgaagggctgcagcgccatcccttccgccatcacctccgccgtcacgttggtctgcatgcacacaaaatacgctgttcattcccgttcattcctctatccgacttaaacagctagctgctcccttcgtcccaaaatataattgattttcggcagatgtgatatatcttaatactataaatctgaataagctctctcatcagatttacagtatagaatgtgtcacatccaacaaaaacctcttatattttagaacggagggagtatgatctactctcgtcgcgtggctgatgacctcgaagaagatgtcgcccttgccgtcgtcgtaggaggtggcgccgcccttgagcatggtccagcagccgcacttggccgcgatcatgccggcggtgttgaacttgccgtcgggggtcaccagcacggccctgatgtcgccttcccccttggagagctgcagccacactgcgtatgcatgcgcacgacgatcaagatcagagcgaaagagatcatcggtctaggagtcggctagccggcggccgttaccggacaaggcgtagtggtggtccttcttgaggtcgaccttgagggcggagcccttcaccggagcggcgctcttgctattctccgacagaagcttcttgccgctggcataccccttagcctcggtctccttcaggataccgccgccgtacagaggcttctccggctccttcacgcactgcacgcaaatatttgcacttcaagaatcgatctcgtcctttctcattgcatatcatagtgtacataagtgaggacgaagaatgtaacccggcaaaaagaggacgaagaatgtatgtgtcacttgcctcaatgtttgctgagtagtcatatggaacactttgagatctgaccaagcatcctgcattcgttgacaagagaggcgattaggcattagcatcttgatcttgatcatatatatatatacgcaggcgtatacggatttgacaacggcaaaaaaaattaaatgctaactgaagttctctgaaactgaaacggctggaagtctgaaacatgtttctagtcacatggccaagtgccaagtctgtgtgattacgacaactgatggatttcaataaaacagtaatttaaacagtagcacatcacattgtttgcaattgaaaggaaaatgcaaattgaagcgatctaattgaaagacccctaaccttcgaagaggataatggccaagaaaaagaccaacttccctgtgaaaaccttcatatatatttctctatcactgactacgattaatccgtgacataatgttgacatttctgcttatatagctatgggatgagagaacatcggagatttaacagtctataaataggaggaagacagtttcacatgtagggaggtaattaatccacaatgtttagtgccttaaaaatacattcagtttagaggatcaccattgatttccctagctttagctgcactccaactagtggttctgctttgtacttgatactccatagaaaccactagagtttaacagtttaatcgttggctttagcaacaaaaaaaaaattataggtaaggactcttatatcaagtatccttagctctttaaaagctaatgttagaaaataaactatgataataaaaactcaaattaactctagtttcgaaatttaaattttggctgataagccgattggaaaacgatggtgcggcaaaaatggactctcttaagttttaggatgagcctaaaatccatttagcatttctcgtcgtctttctatacgatgatgggaaacaagaacatgcagggtagactagtctcaatcaagagaagtatgtatataaagaagaacaaatggaatttcttcttccttttaatatgaacatccaatcaatcgcctctccaggaatgataaatcaatccatgggcgcatatgaaatcacacacaacaatcatgcacatggatacgtatacattgagctaataaattgagctaatagctagctagacgtgtatggtgaactcgttgtcggactccctgtcgacgctgaggctctgcgccacggtggagttcgccgccgggtgggtgacggtgaccttgtagtccccgtggaacagctcggtctcgtagtagccgtcggcgtcggcgacgccgacgtgggagcgcgtcttccactcccagatgagcttgtcgacgacgtcgccggcggggaggttcttgaagttgttgtcggtgaggcacatgacgtagcatccctgcgggtgccacgccgtccagaggatgatgccgtgcaccgccgggtgggcgtacacctcccggaggatctgctcgaggtggcgcgcctggtcgggccccggcgcgacgtcgatctcggtgagccagatgggcgcgttggcctgcgccatggtgtcgagcgcggcgcggatgtaagggatgttgggttgcgcgctgaagtggccctcgaggccgatgcccatccgggcggcgttgccgttccccgggaacgccttgatctgccacagcttgcggaggtacttgccggggagcaccgtcaggtcgcccggctgctccagcgtgttgaactcgttcatggacatgagcgcgccgccgtccatctggtgcgccttgcggtagaacgccgccgacgcctcccacccgaaccggccctcgaagaagtcgaagtggaggttctcgttcaccacgtcccacgcgatcacctgcccggagtaccgcgacatcaccgacttgatccgcttctccgtggcgcggcggagctgctcgccggagagcgccttcacccaccccatctgcgtgctcgggtcgtcccagaagatgttgtgcccgcgcaccgcgatgccgtggctcttggcgaaccggagcatcgcgtcgggcaccgagtagtcctcccgccccgggatcgcctccgtgctgtaccacttcatctcgttctcgaacgtggtcaccgtgaaccgcgacgtgaaccaccgctggtaccccgggttggtcaggatctccttgctcatcgccgaccccagagggaagccgttgcggacgtgctcgatgtgcatccgcgcgccggcgaccgggttgcctgcggcgtccctcgcctggagccgcaccgtcttcttcctcgccttcttgatggccgccccgtggtgcgcgctccactcctccctcgagaacggctgcagcgacacgttgtccacccatatgtccaccgtcgcgttgctctgccatggcatcacaccattgcatccccgtctcgtcagaaacagagtaatcttgaattcttgattgctatggcgatgagatcgatcgattcgtttacctcgaagtagagttcagcctgcccggcggcggcggcggtgagcccgcccttgagaatggaccagcacccggacctcgcctcgacgccgccggagtggatgaagtcgccgccggccgtcttcacaacggctctcacgtcggcgatcccgtcactaacctgcaaccaagctgcacacgagaccgagcacaaagcttccatgagctaccggaaacaacacggcgaaggaagaacaagacggcggtggttcttgtcgccggacggacctgagagggtgtagtgcgtgtcgtcctggaggagcaccttctggctgacgctctggtacggccgcgtccggttcgttgccacggcgtacctgttccccgccggcgacgagcccacggcgaggctgccgtacccgaaggccgaccagccctggagtccggcgctgaagtcgccgttgcggatgatgccgccaccgtagtgagcgtccatcggctcaggcaagcactgcagtccatagcttcattgttcagctaaacaaattttaccgaaggtaacaaaatagtaatagttgttcactgtggggaaactattctaatctctcgaggggatgttccctcgtttgcttaaaaaccatctaaacggttatgaaaaattctgaaaaaatttgacaacattcatacaacgcatatatgcaactctacaaaatcttaagtccaaactcaactcacacgtcgagatataaaaaagacaaattcagcgtatgaatagtagcgtactgtttatatctaaatttgtcttttttgtttctcgatgtgtagatcgaatttgaacatgaattttggtggactagtaggtatcattatactctatattgttaattttttttcagaatttttcacaattatttgcatcgaatttgaaagaaaaaggtatatgaggggatatcccctcgagggattagaatccactcccgttcactgtgataaaggaaatttgtacagtaatcaagattaacgaaatacactgttcataaatcatttgcacaagaaaatgtaaaaacttcagagaaatgttacagaagcagtggtggtttacactttacagcgtggtaataaccgtcaaaactaccaaaggatcctgtcaagatcacagtaaaaggtaatactaccaaaaggttatgtacggttcagacttcagaactgtacctatcaagatattagtagcagtaaccgtcgaccaaactagcatgagaacggtatggacatgccagattttgtttggtacggtatcacccaggccaaagccaaaacctacacatatttggtcttccacttgggtgcggtaactaattctgaccacaagctgaacctatcacaacaaaattctttgacctgccttcaaaagtcccaagtgacggcacctatatgtctaaccctgcagctaacataagactacccaaagaaaaaagttcagaaaagacaatggttaaagctaattactcgggaacagtacaaagctacttgtttggaagcatttgactttcctatcctggccgggcagtttcactgtgcagggtgatgagacagtcagaacagaggacaacacagacaacatcttcaccaaccaactaatcaagtaccaggagaaaagttagcatcagcgcatgatttgcccaatacagcgtgtggcggacaatggggtacacacgccctcctgctcgccgttcgccggaaaaaagctacccctgcaaactccggcacgctttgaccggctccatgatcaagctgctcctggtgctcataacgattctttccaataaaaaagatcgtgttcacaacaagcacagataggtgcgtgattgggtcgggtgcgttgcacgatgggttctcagttaggctaactgcagcatgtacagttcaaagacgggagttttgttaggctcgaattgaagtggtaaagaagaccgatttggaagtttggattggatggtgaagggttgaaacgatcgagccagaccgatagatggacgtgtgtggtgaggttctccaagttcggtgtacgaggaactaacttttggtttttttctgtggcaactggctcggttttgggaggcttttgaagaggctttcggttcttggtgtgctcctcacagattttttttttcttttgttaagtgaggtatcttgcagctgaaacatgcaagatttcatctccctcatgcttgtttggtctgtttccaccatctaccagatgatcaatggttaattaaacttcagtcatattcttgctcctaattgtagcttcgttcacattagcactaaacatgtcagggaggccctgcctacgcaaacccaacatgcagaaggtctcgatggtgactggtgagtggggtgaggccggcaaagatcacacaaaggcaactgcaacaacaagaaggaaaaaaatattccggcatatgtatgcatggcccgcatagcgcgcccacacttgtgtcacctgtcagtaacaaatcggctcgcccaactaacgacggccggtgttagctgcacatactacgcttgcatgatcaaaaggcaggtcgatcgaattagtgcaatctgatctctgctggctcagccaactagggaagcaactaagcaatcttaatcatagtattaatttgttgcactggtctgagcagatcgaggttgtgtgcaagcagcagtcaacagcagctggtggtaccatgttccagtggggtccaataactatgtgaccaacagaggttctgcatgacgcatgagctgtgggagagtgcgacgcaaagaacgaccatgctcacattggtaccatgaagcatggatttgacgatgataatggtgagagagaacgagagagagaggctgcatacctcagagcttgacgagtagtcgtaagcaagcggtcgcgccatgccagaagccgcctcagcagctggtgaaatgaaagaaacgcgagcttctttaacttaactatcctaagaacaagattgcaagaacatgcaaagaaggagagatcgagctccatgaccatgaatctgctacgtacccttcaccacgccggcgacgagccacgccaacaagaacacagcgcttgccctcctcctcatggctgaatcccgcccggctccctcccctgcccctcctccggcaagaaaaaaacccacgatgtttcgcacaagcgagagggaaagagagagaggtgcagcgagcgcgcgagagatgttgtaagctaagctaggcaggcgcgccaactgcaccgtcgtctgtgcatgccacggcgtctgcgtgggctcccacatttataggcgaggcagagagaactaccggtgtttgcctgtggctacatgctcccgcccgcgtcgcgtctcgcgttgcttgttggttgatgttggaacggaaaacgactcgatggcctcacccacgatgggatcgatcgatcgctgacgcgagcgcggctgcaatgccgtgccgtacgtgcatatggggttgcgacggcgggcgggcgggcgcggcagtttcgctgcggctgcgagagcgggcgagccatatgccagtggctgcgcactaacgaactcactctgactcgcttctgcggttcgctcgcctttttgaccatccacggctcgaccgagttcaacggacgcgcgctgtgtgtctactgtctctgtctagctccacttatctcgaccgcggccatccatgcggtcgacttggtgcaaagctagtagtgttcggttcaacgttcggtatactagggacgaagaacatgggagtgttaattaaacggtttgctaaaaatatgacggcacaattttcattcaatttcggtcactttttttcttcatatttgattgttctccattctatatgtatgcttctggtatctctcgtatatgctcttccaagcatataataaactaatacatccatcttaaaatgtaaaaaacttgagttagacacgtgtattaaggaaatatgtggagttaaataggaaaaggttgtgattgattgaaaataaaatgtaggtggagaaattaaattggacaaaattgtgattgattgagaatataatatagataaaaaagttataatattttagaataaattttaaatgctaaagttgtattttcaaatagatggagtacttttaatcctaacctttatgtatacataatttattagaaaagttacaatgtaaatatcatttacaatataattataatataaatgtaagtattttacaatataagaatggtttaactatttcttagaaatgtggtgtaataaatatactccctaattaatttgtttgaaagaggggtaattttaatcggaaaaatcaattgcaaaaggaaaaacacatcagaagaagaagaaaaaaacacatcgtaaacgtacaagcacataaaaaacctaatgtgctattggatgttttaaagagttacttccttgtttattgtcggtaagttttccaaactgctaagtttgatttgaaaataaggtacgataggttatgtttatcttgttttttataagatggtctatatatatgattggcataagggatgaaatggttgtattttttgataaatgagagggtgtggctcatatgtccatgagagaaagtgggttggattggtatattaattttgaggtatgaagctgacccgaatctaaagagaatatttattttatgggccatttcatttcatgtgtccttaactaaacatcccgaggaatatattcgctccaacctgattgatcccatccctccaaccaaacatgagcttaacgtctttttaacgtcttttgtgaaaacttcatacatcaaagttagttttctaaatttgtaataattactattcaattagttatgctctaatgactcatattgttttgcgtgtaagcgataagcctcagcccatccctccatctcgaacggagccttgtcacaggtgagatccgacggcatggggtgtgctgtaaatggacttctcccacaactcgaggctaaagagggcgccccggtggttaacaaacggccgggccggttgccgatgtgcgcaagcgctcatcatgcaaagctcccgtcgtgtggcacgcgatgccacgagacgaggacgaggccacgaggggcgttgcgcgatgacgcgcggctgctggctctcgcgcgcgtacgttggtgttccgtgggggcagctgcaacgacgtacggctggcccaggcctcggctacgtgccacggtgccagttgccacacagtagccgatctggttgataaacaaccatttgcgttccgagattagttcggcttagctccaatcaccgagttgatccggttgattaagccttttttgcgtcccgtgaacaaactgcctttgctatactaaataaatgatgagcagtggccgtatggacacacatgatagcttcagtgccactcttttgaaacggtgcgaaattttgagaaattttcacctttgtatagctactagtgtttgacactagttcagttggggcgaacaggggcaacatcagaacagagtacaatggccacgttaatgaccgagggtaatgtgtggggtgttcgatctccgacgtccatatcaccgtacgaaaccgcgcctgaagagagagagagagagagagatcaccaaaatcatcctgcggatcgtgccatgacgcgcgcgtggatacctgcgcttttgtcaacgcaacagcgacgtccccctccccgtccccggcatcccaccgatccagcagcgcacgccgccgcatcgatcgcccaataatctcctctgcttcacttcactcctacgcctctcatctcatctccttgccaatatgcaaatccctcagctcgcaacccgtacgcgcggttcacacttcacatgcaggtctgctccacgaaacacgcgaagaagaaaaagaaaagaagaggatttcctcgccgtttgtgccgtggaggcttttcgcgaccggattagtttctctctctctctctctctctctctctctctctctctctctctgtttttttttcttttttccgtgtcgtgttcgtgcgggcgagcgagcgagcgagcgggtgcgcccgtgccgttgcgaaatcttggacgaatgcacgcgtgagtcgctgaaaatggttgattggttgcaaacgccgcgcacgtaagggagactacacatggcggtgagctattggttggcttctgtggctaccagactgctgctgggattcgtggccatggattcgttcctcgtctgcagcccagacctgccgttaagttcggtacaggcgttgtcgcgttgaacggagggaagcagtttacagaaagtttctacgcgtagtagtgctcgagtcgaagtctagttgagtccgaccgactcgagatgtaagtcgaagaattcgacaagcttgggttcgaccgtcaggccgtgaaaaaaaaaacgatcgaaaaccgcaagatttcaaagtttagatgtgtgatgaaagcagatcccgagtaaaactgtaaatagtattcgaaaattcaaatttgaaacagcaaattcgaccaaaacctgatcaaaatttggtgaaaaaattataccaacatgggttgggaattcggacctggtgctaaatcgaaaagatgaacctggccggatgtacttccttcgccccataaaaaactaatctaataccggatatgaaatattctagtactacgaatcttcgtattactcccttcatctcaaaataagcaaaaccatgagtttttgtgtccaactttgatcgtccgtcttatttgaaatttttttataattagtatttttattgttagtagattataaaacatgaatagtattttatgtgtgatttatgttttttagtattttttttaaaaaataaataagacgggtgattaaaattggacatggaaacttatggttgcgcttattttaagacggagagagtatgtcacgttcattctagattcgttttttatgtaactgaggggtagcttggaataatatagctgacttgacaggattaattagaaacagtgacattgtaggattaattgtctcgtccacgggtgttaactacatgtacacagtgacggagcctccgccggtgacccaggcagcttggaataatagctaacttgacaggattaattagaaacagtgacattgcatgattaattgtctcgtccacgggtgtttactacatgtatgcagtgacggagcctccgccggtgaccccaggcaatggtatgggctcgtcgcaatgaacacgctgtaaaatttgttatattatagaattgaatacaaaattttcgtagtaaataattgttgtaattccgttgtgggctctctcaaaattttacttaacatttggcgtgatttgcgattgatccggcaaaaatttcttctgctggatgaacatggtcacgtgcgtgcatgctttaattactcgactgttagtgcggatttaacgtaaaaatgttaggtcaattggtttgaatcgttctttgtttctctctttctttttgtccttttattaattcgtttttggtttgctactttgacttggacgtatggcaggcagtgatcaacggcgtagaacacagctccagagctagctccttagttgacttgatatttcctgccttgtttaatcacagccgctatatgtttacgttatatatactgccattggtgtataccaacataagaggtagtagaattcaaaggaaataaaagagttagaatggtttgcttgtttgtttctgttagttaggtaatttggctggacttggtgtaatgtgatttctgccccaaccctttatcactagtcactgaaacattttttttcatcagctgaacctttcttcctgatagggaaaggtggttagaaccccagaaattcagagaatgtatgcccaagactacagacaatcaaacttcagagagaatccgacgtcactgtggctgaatggggagcccactaatcactgggataagcaaagaaaggcattgcaacttggctagggatcatacactgtccaaatgaatgtaacagctctccaagcccggtcaaaccataatcagatgctggtcggctacattggcacctgatgtgagacgttcatttcctgattgctttgcggctcgttgtctcagactgtgagtgctctttctgctttgatgctcatgattgcaactagagttcatgataattcatcacacagagagtttgtacacttgaaaaatagcagcagcaagatcaaaagaagatagccaaatgctcgaaatatcttatgaatatgacagtcactgagacactgactaccatattggtgtaaaaaaagacttccatttactctgttcccatacgatcagcatctggaaggtctttgaaacgataacttgaaggaaactgtgccacaattttttccttggaagtttaaacagtgagagcttaaactgcacaatttattccaaataattgggatccagtatcaaattatacattactaagaataaatacatctcacacatttttaaccggaatgtgcatgcggagtcaacaaattacagctatgctagaacagtacacaactacacaagagcgagtaacccatgatgataggccacatgtattgattgcaaattgatgcatcttattctggatcaaatggatcacactagtgtccacgagtggaggacactcaggaatcaaatcaatcttcacaaatatatgctaagcttgcaaatatccgttctcttcaaggtagcacagaacatgctgggccattgctttgggtgaaggacattccccatctaccatcttaattactatctgtggaaggccagaaaaaaatctattcagctatgttcaacaagcagataactttgcattttacatgtgggtaatgtcattcaatgtaatagataaatgatgaccctagttctttttgtctaaagtaaatgatcaaatcagaattcagattcatttatgtttggcaacatgtatgtcagattcaaaaaataaattaataagaaactccgacacttgtttagttgttttatccagctttaatcaaaccagccaaagcagagaaatcggaattgtgtatcccatcacaagtctgagatcaaaactaaatatattttttcctcatgccatcaattaaagcaagctacaatatgtgcatcaataaatgataacactactttttggttaaatattgccaattcttccgtgaatgaggttgctggatctaatagtgatagatatgtacacatataaacattaggaaggactataaatgaataaatgttcatagtcttatttctatggcaggagcatacaatgtaaatagttatagctaacagcggaatgatgatagtcagcactcggcagtaaagcactttttcagtagtgaataccctacacttagacttttagtttaccgtagtccgtatggaatggtaaggtgtggcccagtatgaatgcaaggcatgatctgcaagctcacctcactattcactggtgattcatatggatcatcaattccagtgaagcctgtttgtcaaaaaggaaaatttcaaaataaaaataccattaggcgttcaatccgtacgctcttttagtatactgaatgaactaaatataaaagttaattgtcccacaatgactcaaaaggtatcctgtacctttaatctttccagagcgtgcaagcttgtatagacctttaggatcacgagcttcacaaatttctagtggcaaatccataaatacctacaacgcttgtttctgttagatgcttaacagtaacgagatgataaaagaaacataacagaagcatacttcaataaatctagactctggaagcagcacacggcacgcatcacggtctctcctatatggagatatcaaactagcaatgcatatgattccagcatctgcgaatagctttgccacttctcctgcataagaatttaagttgtagtgaaaccatttctaacaaatggacctgttgtttttgagaacttaccaactcttcgtatattttctgcacggtcttctgccttgaagcttagatctcgatttaggccatgccttaggttgtcaccatcaaggacataagtaaggtggccgctgcaatgcaactcccgattcagtgcacatgcaagagtgcttttccctgaaatatgaaaaggtggtaagatcctcatgataacttccatgtatacagataattacacagctactggagattcaagagatccttagttctggtatgatactatgaactgaaatgtgcctcaggctcatacagagttatactttcaacgtggatgaaggtggtaatgaagcatgcaaatatgtgataaattctagtctaaatggagaaaattacattttgtgtgatccatgatcaactagatgtcagctacctacagagcatctactgaactaaatttgagcatattgagtattgactcaactggatttacaaaaatcctctcccgccgcctagcccctcttctagattccctggtcgcaccaaatcaaagcgcgttcatcaagaaacgatgcattcaagacaattttatgcttgtccgtcagtctgcaaagaaactccaccaaaagaagcggtcgtctcttctcctcaaattagacattgcacaagcatttgactcgatttcctggcctttcatcttggaggtgctggagcacaggggcttcggtggaagatggagagcttgggtcgcattgctgttccgcaccgcaacaactcgaattctaattaatggtgccccgggagagctggtgcaacacaggcgaggagtccggcagggtgacccgatttcaccgatgatcttcatcttagcgatggactttctgacattgctctttcatcaagccgaagacaccggtctgctgaatgggttggaaattcctcatcgtatctccttatatgccgatgacgtggtcgttttcatcaaacctgagattgagatagcggcagcaactgagatcttgaacatctttggtgaagcctccgggctgcgaacgaacttcgccaagtgctcagctatgcccattcaatgcacggatgagcaaatcgccttaatacaactggtgctaccctgtgctattgcgcccttcccgtgcaaatatctgggtctgcccttatccatcttcaagctgaagaaagaggacctgcagcctcttgttgataagattgcccgacggctgcccacatggaaatccaatcagatgccgccgatcggtcgtgtaaccatggccaatgctgttttgagcgccataccaatctatctactggtcgcaattgatgcacccaagtgggtgatcaaaggtattgataaggtacggcgtggttttctttgggcgggcaaggcgcaagcgaatggtggatgctgccaagtagcctggaccaaagtatgctcccccaaggattatgggggtcttggagtgccgaacttggagctcatgggcattgtactacgttcccgctggacgtggatgcaaaggatttctctggccaagccttggcagggattagcaatcccctgcacacagaaagagcgtaacttcgtcgccgcctccaccgtctgtcagttaggtaacaggtgaacaatcctttttttgggaggacagttggttacaaggaggaaacatccgagctattgcgccctcgatctacgagcatgcctctgctcgcatccaaaagtgccggatggtggctgaagcgctgattaaccgtagatggatcagagacataagcggcgcgcttaggactcaggcaatacttgaatacctcaagctttggtcgttgattcagtcagttgtttgttcatcctcagaaccagactcactctcctggaagtgggaaagctcaggcaagtacacctcaaaatctgcctaccgagctttgttctttggacgaattgcctttgaatccacaccgatctggaattcgttggcgccacctcgctattgtttcttcctctggctggtcactttgaacagatgttggacagccgaccgactgcggagtcggggattgccacatcccgactgttgcattctctgtgatcagcaggaagagagcattgatcatatcttagtcggttttccggaatcaaggcagctatggtggtgggctttgagagcaatcgggcaccccaactgcctaccggtgaatgaagcttcctttcaccaatggatgtgtgacagcagaatggtgttaagtgagtcacatcgtcgaggcttcgatacggtggtgacattggtagcgtggacaatctagaaggaacggaatggtcggatcttcaatcagcagcacagatcatgggtagatgtggcgagagggatggctgacgaggcttctctttggcgtaaagcaaacccggcgatccctgcgctgcaattcaggagggagtttggtcgccaaacctagcgcgagagatagatataggattaattgtcaatgtcctgtatcagtcccatgttgtttttcctttcaaatgtaaataacttttatttctcttaacggaaaaaatgcgctccttgcgtattcccgaaaaaagtattgactcaactactaatcatcatatggatctataatgatcgatgttcatttcaacctttatgtggttaatcacgaccaattatgttatctgatggaaggaaacgaactacacattgatcaagactaaacattccaatttaaatgataaaatcatatttctctagcacagagctaacaaatcaagtggagttattgaaaaaatagtagccaaaaaacatatcttacaacgtagaaaagcaattattattaaactttatcagggaagtaaaaggggaccaggctgtaaatcaagggagttctgaactgaaaataacctgagccgctgagtcctgtgatccaaatgacacatcctttttgccccaacaagttctgcctctcagattgtccaattgggcaattgtgccacagtatattggttgatttcccaatggttgacactagaggcttctctttaactgcaatgggaaccaagacatggttagtggcttagcgcaactctgttcctgttgttgaacaaacatatttgcatatagtacaaacaacatgaaaaaggataatctatataaaatataagggagagattatctttgacaccttttccttcacattattacttgtataatacaaaaagggaatatctactctgattaaatgcacatgaattccagagttctcaatgctcccgaaagaacactgaaaagtactactatgattttctcataacattctcttcttgttgctaatcatatcatccatcaaccagacaagtatgtgttctctttatcataacttcttaagagggttcgcaaattgtgtactcacgttcaaagtatatttgaaaacatcaccaacgtcattccattgccccgtcaccaacttagtatgtaaataaactactcccaaagtcccaatatagtagaagattctacctatgatggtaaaaaaaaaaaaaaagaaaagctctaacttctccaccatgtagcaaaaacatccaatattctctcagattcgtcacaaaaaaaaaagaagcaaaaccattcaacattgtgccaaaatagagtattccatcaaacttcaaccagcaattcaccacccaaaggccccatacacagcaaaaaggacaaaaagaaagagcatcaggcataaaaaccatatgcccaaacacatcacggtcaagtgtcccatttgttgaattctgttacagcacgtatttgttctcaccaaaaagtcgtgatcactaaatatgtggaggtcaccaacagaagcagcatccaagcagcgggaacaaaccaatgcattatctaccacgccattcccctcgagagattctggacccatcgagacgccgacccacggccaactaaccaccgagctggaagtaggagaggagtagaccgacgacgacgacgaacctgggctgcgggagccgtccccggcgagctgctgctgctgctccatccctctcccggccgggccgcctccgcccaatgccgccaccacacgcgacggggccctcctcccggtcgccgcggccgccgccgccgagggtgccgggggccgcgctcgcagaagcggggaggggatcgcgtgcgagggcatgggtcacgagcggggcattgcagggggggaggaggaggcggcggcgggatcccgtcggtggcggctgcggagtgcggaggcagagccgcagaggcgctgcgttgcgggagagcggaggtgggagggagggaaggattgttgttgattggagagggagggcgacgtcacccgcgtggggatgaattcgatgagctgccgtgtcggtctgccttgccagttgccactgtgagtctgcgaggggcgaggctaggggtggccggccatttatgcatttgacacgctgtggcaatttttagtgccacatcagcgagctcgatgttaaggtggtataggtcgcagggctgggaggagaatgatctatctcaaaacatatatagtgcagaaatactacgtaacgatatacggtttcaataggaaatatcagatccgatatctatcataccattttgatgttaatatggttactagatatctgatatctacgaagtatcatgttttgataccttagatattagattcagtacttacaatatcatactaatgttacgctgacacaaacacacattagctatttacacattagctattttgtttgaacattatactgttatgtagtctctcttaaatatatatagctattttaatctaaattcacaaacaaaaaataaccatatttttaaaacgaagagagtatattattatcatgatcggaatcgatgatcagtgacatccatcgcagttgagagactttgttagcttattagccacaaatataatttcaattttaaaacttaattttagaattgtctttaggttttcttttatcgtagaatgctttttttgtttttaaatagttaatagcacaagtataaagactatctacaaatattctttttgaaaggaatttagaaattaaattcggttgcttcattcttttcttttatgacttagcaatcgagactcgaacgatcggagcctcaggagggcaaaagcttaaaagatgggtttaaatttgtacagaaaaatttactccatttcgaaaggtgtaaatctcaaacttgcaccgtaatgatcatgttggctgcactttgaaagaatacatgtccattgtccaaccatttcgacacaacaacagtaagtttgcgggttgttttttctggcaaattagcgtcacaattggctttcgcaataaataaacgaagcactcaatcaaccaatccttatcacctaattatttatttgtcatatcaaaacaataattatttatttagtagtcccctgattttccatattgaattttatttgattgggacccctcctctgctgggaaaatgacttttagtaaggaagaaaaccgacgatattttagaaagagacttttcaggatacgtgagcagaagaaatgagcttcaaacaggtaaatcccagatttatcaaatcaatgaacacggcaagaaaaaactcacgtaccttgtgcaaggaatatcaatatagactactggtggcatggcacctcagtagtacatagaaagtgagctttaagctaagaaagagaggaaaacagcatacatctaacaatgactagatgctttcatcaacagaagtagcggataaaatcatgtaaaacacccattggctcctgcccacagagcagcaaaactttaaaagattgaagtaacaggtctgcggaacaaattattggccattgctttgcaaaacaaccaaagaattcgaaatttaacagccatcaaccacagacgatgttatcagggcctgagtgcaagcgctagaccaaacttggggggtctgtccaaggccttggtgtcgaattcaccagagattgtcaaaaccgacttgggtttaacctcatgctggagaagagcagcaagctttccagtgttgttgagccttgccttcacagctgtctcggggtcaaccttgtacaggccaccaacagtgagagtgttctcatttgttgagagcctgcgggttaattcagcaacaacagaggatttctgcttatcatcaaggtgatatacacctgacactttaacggtgtcacctttgtccgccctgcacatgtttgtgtaatgtatcagtactaacattacaacccaggtcatgacaagttacaatgaagcatgtacttacagaacgattgcagcatgataatctggcttggttacacctatcgcagcactgtacttggtaaattttcctgtagcagtgtcaaacccagcttctgcaccaaaggcaagtccttgagcaccagctgttccagaaaattcaaccacaggagatggcttcatgccaacagcagtggcaaaacttgcattctcatggaagtattgcatctccacctgtcattgaaaactcagctatggatcgttttcaatttaaaaacataagttgagacgataaaattacctttccagaattgtagtcaggcagcttgacacttgtcacaagctttgtggatggaaggacatcaaacacagtcaaagtagtagagatctgcagaaatcatatatttgtgttacagctagacagatgttatggagaggaaaaaatataaatctgagtattccatatcacgaacattagattctgtgtccactttgacatcgacgagagtactcttgtacttgtaaactgagctgacatcaagagtataaagcccccctttcttcacagctgtggaagtgaggccctgacaaataaaggacaaaatacatgagaaccacagcatgcaagtttataaagggcaaacaagcatacataataagttaatattactgaaaagatagggcagtattatcatagcaagtaagatcattatacatgtgacaaaattttgcaacaatggtcattgtgtatgttgaccattcattgtatgaaaatggtggatgggcacatgggggcaaaaaattatatgagaagtaatttacacagcaccatatgcaaaggagttaaatgcaatgcttgtcgtagcttcaagcccacaacaagtaatagcatcatacatgcatgtatgtatggaatgtaactcatctatattccaaaatcaaatatgaaattcattttttccagttaacagtgtctatttcaatgcacccagataaaattataggatgtatagtttctatcaggagagaagggactatggttggcaggtttttacaatatttaccctatcaccaccaatttgcattgatatattcttaacagccttaattacttgaaaataaaaggaagaactggagaagtaaacctttttcaattcaacaagcatttcatactgaacagaatatgcatgtgtgatagcacaatccagctagtcaactgttgcataaacagaatgaatatatagctaccttattttttgggggaggaatttatttagataggcttaaagaatggaaactcagtaatatcacatctcatgagagtggaaggataggcttaaagaatggaaactcagtaatatcacatctcatgagagcggaaggatcttggtagtataacatggtaagcacaacatgacctaaaataataaatccagatcctcatagcagccatatgcttgaaaagaaatgctagcgcaaatgaacactagaaggacaactgcagttacataatttgttatttgttacattgatacatccaatgaaagcatctagtgattgcaatttataacccatcctagaagaagcctgcaactacaaccagaatccttcaaaacggcaatataagaaatgaagttctaaaataaaagaagaaaagcaaacgcattgtgcagaactgttatattcaaccttgaatatcagaatatatcaactagcaagtagaaacacttcttatgttttactatatgtctatatcataccagaagagtgtttgtactggtccactgatacagatgagtttggcaacaatggtaagtggaaatgaggaataaccaaacaaaaattgctgtggcggaaacaaatcatgataacattttacacattcaatgtttccaagagtactggttggcaatgatacaggtggctaaccataacttcaactctctagtttctccaaatcgtagctacaacttatgtttctcctattactccaatcacagcctacacactcctacagaaatactaaaagttctaacgacactgccaccaagatgtcatattacagatcaagcatttatacttcgtaactgttcatcatagacaaacccccaatgatatctctattgcttcagacacatgcagaatcttcattgagtcaggaggggagcagcagcgcctcgaacaccggtgctgactacactacctcctgtagcagaattgaactttatacgatctagctcccccaattaattccctcaaatatacaagtcactgaattgctctacaaaatgaacgatttcccatttcctatcaggctatcacgcagctaacgggcattagcactacatccattcacatgaaaaaacagcaaacacgccgaggaattgcagccacggaaagacctgacaaacccgaaacctaaatagcagcaattaaacaggccatgagcccatgactacagcacgcatcctacccgtcaacaaatcaagactacgcacaaccacaaccacgactagatggcaaagctcgcgggtcaaccacgaacaagcgcaacacggaactcagcgccagatcacacgagcgcgatcggatcggatggggaacccttaccactccggaggagctgacggtggagacggtcagcttctggtcataggtgtagtccttggtgagcagatctgcagatcaccaaaccccaacaacaacgagaaacgaaaacaaacgaattagggaacggaaagcgagcgagcgagcgagagagaggatgagatgggaggaggggtaagatgcgggttacccttggccctcttgccaatgtcggagaagaggccgggtcccttcatggccatggcggcggcggcggcttggggaagggggggaggggggaggcggccgccgaagaggagggagagagaaaggagaggtcagagaggttccgccactagtagaagggaatggtggggcgccacgagaaatactagcacgggcagttgcaacctggagtaaccccaacactgcagtcacggcacatgccgccgccgccggtatttcccgggcgacgaattcgacgttccagatttgtttccaagagacgagcaacagttgcaatgccgaacatctggcagagcacgtacgaatcgcaaagacgcaggaagcggcacagctcatgtgcctgagaatgtcttttttttatttcttttaaaccctttcaccttttaattttaaaataaacccttccaaaaacatactcactccatttacttttgatagtcatatttccaaatctgaaaattttatttttgataggcatatttcaatccaacaacctatcctcttaataactttcttggatttaatgcatgactatccattcttacacacatgattggctacatgggcattgagaaatgtaaatattaataaatcgtttgtttacgaggaatgactagtagcatgtttaaatggatgataagtagaattacttatcattggtctgtgtgccaagatgaaatatgactatcaaaagtagatggagggagtaatttcaaatacgaactttttgccacgccaattaatttagtgtggcaaaataacaccgcagtcgatagaaggataatttcaaataagaactttttgccacaccagttaatttagtgtggcaaaataacaccgcagttgttagaaggttcgtatttagaaataagtttataatggattgttcttaaaattaaaaatttataaggttaaacagtaacaaaaatttatgcctgagagcttcttcacgccctcacccaacatgatccccacctacttgccagctccacgcaacagacacgctgtgcgcatgtgccatcacacttccagcaacaccaggtcgcaatacccaccgacaaagcggcgcagttaaccgaagtaaccaaactcaagcagcaaagaaaattctggcgcgtccagttacagtcagatatgcaaggcaaagcgatttttcacagttcattgcaaggatgggttgctgagataacattaccccatctacaataacagggtttgttgcgcagactttcgcgtagatagttgcctatacacaaaagctggggccttttgccaatgtgtagcaaacaaaattgtgcctcccaaatatgaagggaaacacaccacaccggccaaaatcaactttccatattttaaacctgcattgaaactataatgctagttacaggtatcttgtgaggatttcatctttgatgaggtcagatcctgatgtcttcaatgtctgagagaagggtggcaccacccgctgatctttcatcggggaggctaaccactagctggccacaggcgccagctatgtcttgacccatttgctggcgaatagtggttctgatgttgtaaattcctcttaggatcttctggaacttcttcacattatgttcgctgctagtcttgaaattgtttgatgagccaatgggattgaatggtatcagattaacaacctgttagtgatcaagagaggaagcaatcaagagagaattgattcaaaggttccaatatgaggatataacacatattatgaagacaataacaggcaaaccaactgaagatgttaatatatgaaaagtcaaaccactaaaaggaaattctccaaacaaatacaccgtgacccaacagaaagaccatgggtcataaatcataatacaagtgggcagaaattagaatatcaaacaattgaacatccagggtaagtataccgcaaagatgatcaggaaggttttccaaccatttaaaagaatcattaataagataatcaggatgaaatgaagcagaaagaacagaaagtttcttaccgctttaaacatttcaagtaatttaccaagctggtgggcatgctgctcctgatcgttaactccatcaagcatgatgtactcaataaagatggtctgcttgctgtgatcgaacattcaggtgtttattgaaactcaaagctatcggttcttatatttggcactgatggtgatatttagtaatcttattcttacctctcattttgatatgattgcagtgcattcattagctttactaaaggaaaggcccgggcagcaggcattatatgacagcgtatgtcttggtcaggagcgtgcaaggacacagctagatttatattgggaagatcattattgaacttattgatggaatggataatcccaacctgcagtacacaatattaagattcaaagtcacaattactgctgtttcagtcctaacaaaagttcaatctttcagctgcatcaatcccaaggaaaattcaattgctaaactaaatattagcaggatttacaacttaatggatcatatagggacatgcatcataatcacaacgatttactaatgtcaaaacacgagcataaaactgtaaaagatcaagtaaatcagcagcaaagctttcaccagacagaatgataagaaccatgctatactgaaaagtaaatctgaggagtaaatactagaaaggactcaataataggtgggtggaaatatatttttgattcctaagaaatgtatgataatagaaacctgatagaacatctgaaattcattattcatttagaaaggcattgtacaatattaaaacaggatatccttagaatatccaaaagccaactgcaatacttgcaaagttggtgaaactcttttccgtattttccaaaatgtgtttagcatggcacaggagcaagtactaggttgttcagaaggttaaattgaacttttaaaaggttaaatgcaaacacaagatagccttccaacagccatctcaagaacaattattccacatgcaaaatgaggtacttgtgcagttatactcacagtagatacagtaattctcttaggtgaaagctggaatggagagcctatcaagacttggatagcttcaaccaaagcagtatagttgtttaatggctcccccattccctgcatataaagcagaactataaggtaaaactcctctgcaaggtaccaataagcaattcttaaaaacacaaattcaaaattgttatctgctaatttctgtcaaatggaatggcatgactatagaactgggagaacagttcattaataagaacaatttaaactcacaaatatgcaccaaaacaagctgatgtaccatgcattcatgcagtgtggtggttttctaatttctcagatgggaagccatctaagcatctaacccatgtaatggaatacaatacatatcctttctaccttaatgaagtaaagtgggaaaactcacacagcaagcccgtttttcctatggaagacataaaatctagcaaaaacagtacagaataaatatatatatacataggcaatacttcataagcatagcatggcttgccttgccatggcctgtatgaaatccagtgggcagtacaaataaaaccaagcaaacaactgaatgaacagtgtgaggccactaggtctggatgatgaaaacatgatggcactcattgttgcctttttgcacatccagtggactgtgcacgatttccttttgaaaagaaaattcaggcaaattccaacagcttgaaattttatattaccatgaaaacaacattccgaatctgagaataacgggatgcatgaaccaactgctccacaatttctcctgaagacagattgcttttgaagcccatcgttcctgtagcacagaatctacagcccatcttgcatcctacctgtgt

SEQ ID NO: 66453 - DNA, 4515 bp, Oryza sativa
attcctgcagcccgagacacagagggttgagcgcacgccaccaggccgaggcttcccgtcatacttccccaatcgcgtgtcataccgcatgatcactgcttctacagattccccattctaggtcatgaaattgaagaggaataagttgatattagcagaaaaggatcaacgaaaaaaaaatcagacaacagcagtaacaagacaacaaccaaacggaagggcaactgacagttgacaacttgacatgcatttacatgtttgttatcagacaaaagagtaaccaagttcaagtcaaactggagctgcaaaatatactcagagtttaatttatggttggattaaaatttgaaaataacctacctaatacaggacacgaactcattaggtcataacccttacattgaatcttccaagctttgcatcgagagcgcaatgataacctaggaaactataaatggcttcccaagggagagataaaagtgaaaacacatgctagaccaaatccttcgtttctaatgtacagcttacttgagatactcatttaaattcagtccctaaaagagtggcgtgccaattgtgcaagtatgcgtgaggccttctgttcatatccacatgcattcaaatggatttaaaatcaatagagcggacgtttcggaaatacccagagcaaactgcccacatacatcgatgctattaggtgataagtgctagcaggttaacagcggtaaaaaaattacaaaccctaaaacatcttgcagacttctcctgatcccataatcaccattagtactgcatgttcaaaccaccgaaatgtgcaatctacaaaatcccccaagtttgagcatacagcacgaaagtggcacaatctaattcaattcaccttgagtcggataaggagcttggtagtggtgcggtccttggactccgcggcggtggtgagcgtcgacgtggtcggctggaacttctgccgaaggagcgcgtacgcggccgccgggagcgacgggacggcgtccaggtcgccgcacctggggttctgcaacacatacctgcacgcgaagaggaaatcaccccttcagaccaagacgaggtttctatctctcggatgacaaaaaaaaatcgagaggcacagagacggcgagcgcgtagggttcgaggggggcggcggaagggcgcgtacttccagatgagagggatgaagtgaggggagatgccggccgccgcgaactccgcgcggatgtaggcggcgtcgaacacggagcggcgcggcggaggcggcggcggcgacgacgaagaagacgacgacgacgacgccattgggattcgggaggagtggagtggggggaggggatgcggcgggggggttggaacttggaaggctggggcggacgatgcgctgcctccagcagcgtgggttttgggggtttcttgcagttggaaatgcttcgaaatgaaatgctgcccagtaataatatgggctgccaactgaacagctgttgatagttgataagagataaaataaaaaagataaaagataagagtagcggactacagatttatagccagctacagcacagactctaaaacacaatatgtatatgataagtgggataatatattttttttgcggggaaagtaggataatatattaatagtgtagtatgtatttgtagataattattatatgaattgactataatttagagttagtcgttatctatactattaaatttgctcttagtgaagcggagaattaaaaacctgaatataagaagcagtgtaatatataaaaaaaagtatcgactgattgctacatttgcagcgtaaattataatttatttcttcattttattatatttgttgcgttcaactttaatttttttttatcaattaattatatatttgtgcattataatgggccatacaattgaaaataggttaacgcctgaaacatggataaagcataaagcggagtttttttttctgaattgctaaccacttttccttttctttttctttaccgaattttctttttttaggagcagagcaatagctgcttctcttttctcttttcttgtgcgctgcgcgtgaggaagatggagtgggaaggaggacgactattcttctatgttatgagacaaaacacattcaactttaaaaatcacaaatatttaaatataccatgtaatcgaaagatgtgttattgtgggatagatatattcatattaaccaatgctgacaaatatttagaaacatttcctaaaagagacacatgttttgtattacaaaattttaagtattacaactctcaatatcgcatgttaatttatcagccactaaaatttaaattatacaacttaatttatacaattgagtttaagtagttttatttgtcggtctatttttgtgcattgggttttaaactacaaataatatatagagtgaattgcacccacggtacaacaacttagcaggtgggtgcgatatagtgtaagaacttgagaattaaacgtccgagtacaacaacttgacaagtagttgtgttctactacaagaacataacattttttttgagaatttaacaatttattattttggtgcatcaacttggtaagtatatgctagatgagtttttttttacgatgtcaatataccattagatagtaatcttatggatattaccttataatattaaaattaatttttatgaattatattgcacatagtagcacaatttatatccaattacctttaagattttttttttgttttcttcaccttctcaaatatcaatcgaaatataataatttctacatccagtttaattattttaaaatatgataacttgttttaaaatatataacaattaccccattaattattttaactttttttgtttacatttctacaacttatcatatctaccaatcagagttacttgttgggttagtatagaggtgcatgtaaccaatgtgaatccttttgatcatggtggcattttccattcaaatgaacatcgaagctatttgtatgacaagttgaaagccacctttcgctgaagagataagctaatgttttgtataccaaccaaacacactaaagataaagattaaatgtttacgtaaaacgatgtggtattaatatatgattaatttagttttaattattacaaatttaaaaaacagatcaatttaatattttagagcaacttttatatagaaagttttcacacgaaaccgtttagtattcaaaattttatccaacttttgttggagaaaagaacatacctaacacgttgcaaagagaaagaaatggcgaatatgcatatgtatatacgtgggcgcatgtaccatttcaatcgcccagattgcttcaaagtccataaatgatagagagatatctatgtcagactcacagggcatatgtaactaactctatggattttactttttggctcaacaccctgctctcgacgtttgctcgggacgggaggctatgaaatagttgaaagcagatgcaacattaaagaaagtaaatccagtagccttaagtcataccgaacactatgtcctaatagtaagggatttctttcaacccggtggtaagccggtggtacccggagaaaacgttgcccgaaggaagggactaaacccatctgttcaagtagtagccaagtagtaccgaaggagtatctccgagttaaggagtaccaaatacgagaatttccaccttgttgaagatatggtggtgctacccgaagacttaaatgaatagccatcgctgttaagaacaaccgagatccaatgagaatttgcgatcgagctttaagcagtgttttagatgaaaatgaggtactattgagagaattgtcgagcttggctgatcataacactcccaaaagtagtggaaatgacactaaccctagcccgaaggaaccgtagaaaaataaactacgataagtatcgagagtagaagtcgagaacaactgtgtggagtagaagctgggatagaaagggttggaattctcagcaatcagtggttgatctgatcagtaaacttttggtgagttcattggtatcgggtggtccatttcatcctctttcggcaaaggaagttggactttagttagctaaaaaaacaataccagcagcctgtctgtgccctttgagtctatagccgccaaatctaaagattccttaagttgtcgtacggcttctttttcttcttttgtcaatgatcggtgacaatgaatgctatgaatgttcgcttccactaatgtcgtctaagaattgtgaggtgcccatagcttcccggaaagaagaagagtcattgtcgtttcctgaccgatatgaatgcacatatttaccctcgcctcggggaataccaccagtagagtctgcagaaggtgtcgtttaggagagatgctgggctctagatatgcgagggagatacccaccctcggtcatgacctgagttgaagaaggaatctattttcttggaagcaacaaaagaactccg

SEQ ID NO: 66454 - DNA, 8362 bp, Oryza sativa
tagcaggaagcagggtttaatgtccttggaagatgcattagtagctgacaaagcaaatatcattaaccataattttacaaggtcccgccccatgaccttgtattcaatatctaacaaatgaccaactgcatcgacaatctcagcaaacattaaaggtagcatcttcttaacgtttgcatcttccaaatgcacagctgacacccagaattcatacattttttcggccattgagactaagaccctgtaaatatcttgcaagaactcaaagtaagatccttccgatgtgtcctctgtaggtacatagattttctcttcaataactgttgtcaataccttgttgatggacttcaacatacaatgaacttctactagctttgtgacccctaaattagaaaagttcttctccgaatatgacttacactctaaaatcaatggttccataaactgcataaacacttcaaaaagtgattccctgtgatgatgaggttcttcagagccctcactacttttctgcaagcttgtttccctgggtcctagagaggctctctgatttccagatcttctaacaaacaactgaagcaagtagccaaacccagccagcatcactgacttgttttctgcttttattgctttgaatctctcaaatagatgcctatggtagcttcctatgacatccctggaagtagatgatttattcaaattcttgaggccaaaatatccactgagatgttgggggtgaaacaatccattggacaaaatttcttcaacaaccttcaacatggttctgtcctgcttgtgcgtgagggaattcacttgtgaattaagcaaaaccaacaactccaacagagggtcaagaatcctatcaacaaaagtgcggaaaatattcttaggatttgcatagaatctcagaaagcttgaaaattgctcaaacagacaatttccaaggttccaaagaacagtacagccattcctctcattatgtgaaaccttctgggcaaggctgataacatctatggcacaagaagcccacgaatcaacacctgcattgaagaaggttcttgtattgatggagaacaccgaggacatgcaccctaaaacgtgtccaaagagatcaaaagattccttgtcatcatataaagcaccagtatcaactctgctcaaaccattccttgcaacacgaccaagcgatttaagtacgtttggggaaatggagatggatggcttcttttcaatgcaaactcttaaaatggcccagcatctataatctagcacaggatcaaaaggttctgacgttttcttactgttctcaggcaaaattaagatagactgcacccagtttccaataaatgatacagctcgtagtaactgcacgatgtctagtctacggccatggtttgaccaatttgactctgtgcttgtaaaattgaaggttagctcaatctttctgcgtgatgtaacaacaaactgtcaagttcccaaactggacaagcataataactttcatccataaatggtttaacaagcatgcccatccaccaataaaagaggaactggaatacataagctaagcagattctgttgatgatttgaggtcataaaaatatacagtacaaaaagttcgtccagttttatttgcgctaattcttttgaaacataagaaaatgactataaactgtcattttgacctaaatcaaagcgcacatttttctatgttactaggtcaagtcaacattgatccaatgaggagacatgtaaacaactaacaccttgaaatccaagctacaatggaacagcatctcttatgagttacgcaatcctatatgaactaaatcaggtatatgtgctcgtccagacacttgcagcagtaaacaaacacttccagcccacatcaaccgagttatctacataatcagactagaatcatagaaattaccaactaattcctgcaatccggatcataatagagttacatgagcactatgttgcatcgactcgcaagcgggaggagcaagagaacgacctttcgagggagagctccttgccctggagcgagagcacgaggtcgaggttttcccagccactcctcgtgccgccgccgccgccgccgccgccgccgcaaccgaaacgaagcttggataacttgggctcgctcggcccctctccggcgggaggcggcgactggctccgccgccgccgccgccgccgcttcctcgccgcgcctggggtcgcggtcgccgtctccatgggagcgcgaggagagcggcgaaggaggaggctagggttctgggttttgcctgcgtcgctgagccccgttttgacgcgacggatttcgtgctgtctccgaccggtgcacgaatcttaaagccacccggtccagagccgctcgccgctggcgcggtcgggtggtcgagcccgaccggtttctccgcatctggttcagggtaaaaaccctagctcgcgcaccgcaagcggctagggaggctagcctgtgtgggtggagaaggcggtgggaaaggggagaagaggaagaagaagaagaaggcgcaaatggcgacgggggagtcgcagcaggcgtctcggcgggaggggcgagagcgcgacgagcacgacgcgtctcggcgggagcgggagcgcgaccacacgcacgggaggcgcccccactcctcgtccaggtcgcggcgggacgatcccaggtagtaccaaccaatcccgcagcgaatcccccgccgctctctcgatctggtcgggttccggttcgagctaggagaattgggggtttgggatttgttgattgcagtgtccaatttgcgttccatacttgttggacgatgcaatctgtgcgcttactaacccatttttttcatcggggattcctgttggtagtccgaggaggagaagagaggacaggaggcatcatgaatcagacagaagtcatcgccacaggagtcgagctgaagaaagtgctaaggcagttgaccgtgaccagaagagggataggccattgcaagatgccgcgcagcccgatgatcctttgcgagcggagacgaagcccctagatgatgccagaaatggctctcctgccaggcatgagagatctcctaggggaaccaaacggtttcctgaatcaagagatgctaggcggcctcgatcgttctttcaggttcttgtctttttctcaaatgtgcatcaagggactacactctttgcttccaattgtttggtagctgttaaccgtgtgcttggtagctactttcagtgtaagcaggatggttcttggttctgcaaccctactagctttgccgaatgtagcatttgtagctagctttagttaaaagccatgaatccattggtcccagctgctggtgctacaatgtgcaaacaatagtgtatatgatatgtcgggtttcttctgagaaaccatgggaaattgtgaaaaatgtggtgtttcttggctctcgagtgcttcattgcgacatattcacacaggataccaatgatcgaaaatgagatatgggtgggaaagagacaaaatggaagttctagtagaccaaactagcctggctttgtatgtttgcatacgtatgcccagacagtaacaattataaatgctggttctacttatataatatctttctgttgcccttttaaaaaatatgcaagcttgcacaatagccaattcatttaatttctatatttagttcacatatccaatatagtattgtctaaacaagtgatcaccactcactgaaatattgggtgtcacaagttacttcctgtgtgtgtttgtagagtatgtagccatatgcccatatatatatatatatatatatatatatatatatatatatatatatatattgttcttctatttcaatgttacatttttcttctattagagtcaagtgtatatattagttagatccatggtctgctagctgttcctccatattgtgatttaggtttacacagaatgagcttaaacagatgttctttcctaagtagtaagtaattcctctagaaaaagcaacaactaatttatctctaaatcatatatttcttttttgggtagtggtggtggtagctaacattgtaattgatcttgtattgttgtactaaaacgaattgacatcttgatctccttctttatacattttgtaggctgtggggagtactttcttgtaatattttccaattttaagtagttgcatatgattttggttaaatttactgtttcctgggtcctttttttatttattattgcaatggctgtcatgttaatgtttgttttctcatagtgttgcgaagttcaaaaatatgcagcgaggatattggtttgttgttatgtctttggcgtcagctcaatatgcatgagtaatatataccttgtgttgttgtgggactttgtttatggcatatacctacaagtgcccactgtatttgacaacattaggctacttatgcttgtatgtacagcacgatgaacgtggcagtgctgggcaaggtggtcggtgctattaccgccaggctagtggtgagttgcctacttggtttttatgttctgcccttatttatttttcagcttccctcatttgcgtttgcttattattgttttttaaagaccggggaagacaaagggatgaaaaggagcatgttggagatagagagaaaaacaaagatgaaggaaaggctatgcaggatgaacaacaaaatgatggtgaatctacatggaagcatgatgggttcttccagttggaggaagaagctcaccctgccaaaagaaggccaccatttaatgagatgggcatgccactggaggggaaagaatctgtgctttctgttacagaaccagattcaaggtcacataaacatgatcaagctgggcctacctctgcaataggagaagaaaggagaaattatcacccacggggatttgataggcatgagggacctttcgtaaggccagatggtcaaggtatgaggaggggattttctgatcacaggaatgctggccaaagaaatggctatgattcatgggggcgttttgctggtagaggaaggggcagatacaggtttaacaactcatatgatgggcgaaacagcatgcaccaggctgctggtgatcaagcagaaaaatggaagcatgacctttatgaacaaacaaatagaagccctactcctaagaccgaagaagagcagattgcaaaaattgaagcattgttggcgctgtagctactgcttgggattgctttctggtcatatttgcaatggctagataggtgatcatctacttggtgtcattggtgttgaatgctgtcagaccgtctatcctgatgctgcgtcactcaaatgcagctggctgaattttggggttgacaatgttttcttcttccatttaagaaaatgtgcctgatattctcggtttacttgatgtaggatccatgaactaagaacaagagtaaacaatttgcctcccattaaaatgcctatcgaaggccgaagtgttcttgtaagatgatgtctactcaaattttgtgtttgttctggctgcttgttctagacagatgctttggcacggctggtcgctatacacctgctaattccgtaacggaatcatgaattaataaccctcctcctcctacccacacaggttttctccctttttaaccctcctacccatacaggttttctcccttttttggatttttgctggcacgttactttgtatggagcagtgctcctggattgggcgaggggaaccggctcctgcataacgttgttcctcttgcgaacacggtcccctcgtgtccggttttatcaactgggtatgagtggcaaggccaaccggctccccttgcgaacacggtcccctcgtgtccggttttgtcaactgggtatgagtggcaagggcaaccggctccccttgcgaacacggtcccctcgtgtctggttttatcaactgggtatgagtggcaagggcaaccggctccccttgcgaacacggtcccctcgtgtccggttttgtcaactgggtatgagtggcaagggcaaccggctcctgcatgacgttgtttcccttgcgaacacggtcccctcatgtccggttttgtcaactaggtatgggcgatgagggtatacatgtaggacacgcaactcctacacgtttttcataaacgcccctaatacttgtgggcggtgagggcagtttatcagttatctcaccttaagctttactctcttcgtccaaaaaaaaaaaagacaaactctaggctctagctccagatacatagcgagagtttgccttctctttttttttttttttgactgagaaagtacgtttgtctctgattttaccagattcggactcctgtatggctccgaatcgtcagtcagtctgtgggtagtaggggatcaggtttccgttatacctcgcgcacgcttgttggagtcctgcttgggtcccttatccaccgtggaagctccctgctcgctctgcatggacaagttttgctgcggctccggaagctcccgggtgcgggtgaggtcagatccgacggactggaggcaacccatcgttgagccatctctcatttcatggcctataaagagagacattggacaatgtcatgttagtactatagcagagacagatgccaagtccatggagatgaggattattgttgccattaccactcaggtggttctttgcgctcaggctcgccagcttcagcattggtatcaatggcctaaatgatgaagcagagtttcagattaaccatgaataaaatgactgttgtggaatggacagaattagtagataaatatttggtgctgttagaaatgattatggggcttgtttggttctttaccctaccaattcattggtagtgccaaaagtctaggccaattttggcactatcaaaatattggtagggtaaaattatttagctaacatttggattgctaccaatttaaagccaaattcttatagcatagtgaagaaacttctagaatatgacctaatatttgaggggcactaccaaatatttggtcacaatccaaactaacacacaaactattcaattcgccaataaattggtagggtatgctttgggcatcaaaccaaaacggccaatggtaccatttgttcagctatatcgatttccagaatcctttttatctcaaggagctttctgttggtgacttcagaatgaatgacaactttgcctgtaaaatagagtgacatatgccataagatggtagtgcacagtagtagtgaatcagtcatttgctcaaagattagtattagttctattagcacaatacatggcgacaacggtcaatctgaaaatataagagtgaggtatctgaagttcctaaaatcattagttttcatctaaagtagcaacagtttcagtatatgtatattgttcaagagaagttgttgacagttcttcatataataagtgaacatgacaaaaggtaatcacttgagttccagttgcacaatccatgtagaaaataacactcagttggcaggttgattcagttatctactttcacagttgtaacagaattgagcaaacaatacataacttgctcctggctaacagactaaaccagaaagtaaataatgtaccatagagttcgagaggctagagattaggtgttacctagtcttcggttggctgaattcttgacatatccgtcttgcaccatttttttcaattaacttacaaaccatgttctggctggcctccccatctagcttgccatgaagcttgcctactgacacgtaatccattggaagtgcatggtacagtgcctgtagcaacgatatttatgaggagaaatgacatgatgaccttcatattgccaagggtaagcgacagagatacaccttcatatacatgagatcaccattgctatttttagttccttcgagaaaggcccggggtcttcccagctagcaacgcaagctgcgagctagcccgtccgggttcaagccacaccccctccttaattcaaaatcaatctagtccttcctaaattggtcccatttttagttccttcagtaggtgagacattttgcatgatgacctctttctttatgtggtgttgtaggatcagcaatctgaaaccactctatgattttagtgatggacagcaggggtggaggcaagcctaggacagcttgggcttaagccctaggcttgcctccataaacttgcctaaatccttttaaatcaccatgtattttttttgagaaagccaatatgagctctacttaagctttaggcgtagaaaatttctggctccgtcactaatagacagtacaatatgccacagggtaaaattaaaataa

SEQ ID NO: 66455 - DNA, 3012 bp, Oryza sativa
cagccatttcttgcaaagcattcaacaagacagtgttaacagccggccatacagtttatattatatcaagatactgtttgatttataaacattgttgacctaaaagttggtaaaagtttgtgacctgcttgtaagtctagcacaaaacagtaaataaactctaaaccgcaattttattatagaaatgaaatagcagtaggcattacaattgatatgtcagggaaattaataaggacgtccgaaacctcaagactttcagtgtctcttgagcatatccactctcttaattgagctgttagctcttcctcatgagcaggatcttgagtttcatctgcaaacataaaaagtcagagaaatgtatgaaattttcatgtactaccgtcgagagtgaggttcttcatatggattgcccttaaggaccggtgcctaacggcggacaatctcgcaaaacgtggatggcctcacggcgacctctgctcactttgccaaagggacagcgaagactgccattacctgtttgtcgtctgccctttcacggatgcagtttggcaaatcctcagaagctggatgaatgtgagtttctctacgcctggcgagaaaaccctgcacctgtctgacaggtggctgcaggagaggctctgttgtcggctgcgctacaggaacaattttgatagcctattattcttggtttgttggtttctttggaaggaaaggaatgctagaattttcgatcaatgcttcaagcctgctgttacaatagccgatgacatcaaagaggagttcatctgctggaagaaagcggggatagttgcagaaattagagagtagtcggcttcttatttcggttcagagcgacccttcctctggttactctgccctcctctcccttcctggggataagcccttggcttgttcccgctcggctctcttagccaatgtaaaccaactttgtatttgctcttttcttctcaaattttaatgaaattggttggcctccttcggctgacctggcaaaaaattttcatgtactacaaagtcagagaatgtcgaacatgtattgcacacttcataaaaaattaaatgagcatccaaacatttgaataacttaataatgttaatgaccaaatttggtaatccaaggatcggagataaagaagaaatcgagatggaattcgagatggaaatcgtcccggaaacaaagtgagaatcggctgaagtccgaatcggctacgactgagatcggcagagttagagtcggacgggattagccgattgaatcgaatctgacaatatgacacggcatatgttgtcgggttaggttgacgtgcttcatgatgattgccacgcatggatagagtcctgagaaaacaattgtatctattaattaagatattttatataatttccttagagatatgtttgggcaaaagtctgccgcaaagacttatggtatcttagagtttgttagagataagagtcgtgtccgatatggacatattttgtaattttcgggtataaatagacccgagccccatgtaatcaaactaacacacgttcaatacaatctcggcgcatcgccactctttttactttcgttttgtttcgacgagttcttgctttcgggttgagctgcatcggtttcgatcttcaactagaggtaaaacctgttatggcggcttgcgttctcgggattagtgcttccatctttatgatactctaatcttgtttatgtaattcgtcgagttatcatatatcttacataatctccggcaatatcattatctaacctctagtcggctaacatctgttaatagaaagcagccgattaggttaaatattgacgttgacttagattatataagatatctaccactctatgacacatccaacggcttgattgtctatatattgtttctcttttcatacttatagctgcatcagttgagtttgatcttatgaagtcgtgattagaatctcaatctctagcctgtttttggttgccgattagggtagtatcggggtttcagccgatctcacctgatttagctttatatttcatgtgcttaattgatatgttagatctgccctttatgttaagatttcattacaataaagtatgttaggctcctgtttgatgtattttacttgtcttaatatcttaatatagagtggtgtcggagtattagccgatacatgctagatctatctgatcggctatgctatgaacatgtatagttttgttgttaatatatatttcgatctaagtgatttatactgtctcggcatggcgaccgatctatcccaatcacttgatttaagtatatatcgacatgaggattatatattgttaatatctacagccgatcgagtagatttagttctttctcatttagtcatgactgccgatcgatgcatatatgacatcggctcaaagataaatgatatgtcatcggcacttagccgatcggctatcgtttatgaatttaaccgcggtttctttgtatttgtttcttgttgattgtaggatcaaatcaactggcacgctcgcatacccaaaggcaagttttgaacctgcactggagttaagcagatctcccaggcctcgtgtttttacatcaacaaatagttgacataaaattcatttgtatggaaaagaaagcacagatgaagctctcagatcaaattaactgaccatctgagattgtactattttgacctttgcaattcccatctattttgataagtatgttagcaccaacaacagaaaatacaacaagaatacaaacaaagaaactttaccatttggagcaacaatgtaacactcagacgggcgaacctaatagaattagcgattcagtctatactattaggtaaaaagaaaacaaaaatatgcatatacatcgatgtgtgcataaaaaggtagcatcacagcacactaaggatcaaactaagagaatctcactaacaaaaatgtcaattatatggtctcttaggtcacctcattgtcagaaa

SEQ ID NO: 66456 - DNA, 816 bp, Oryza sativa
ttttagaaaggttaatggacttttagtatataatagaagataggtaaagaaaagataaagattaggaaaggagatgaaaattatattgaatacaaaaatttagggacggaatattcagtttttgttagcaataaataaataaataaattcctcaataagaagggggtttctcttttctttgccgcgtgcgttcctctcctcaggtggtgactcggtcaccccttgcctccttcggccaccctctcctcctctcctctcctctcctcttcctcttcctccctctcctcgtcgcccttccaccaaagcgagagatcgaccgactcctctccctccgccgccgacccccctaggtgagcgatccagcctagatcctttcctcctcctcgcgttgctcgatccccactccgttgttgtttcctacctgtactgtatcgcgcgcggttcttggggggaaaaaatcctttctgattaagatacagaattgttttaaaatatcaattaattcttttttttcaagtctctctcgctctcgctccggcgtgtgcggcgcgtgtaatgggggattggtcatactgtaatgggggattaattagttacaatgtgttttcttggtgcctgaaactctgaattctttaaacattattgtcattgtcctagtaaattatatatttcatcgaagatatatagtagattctaggacgaattcgatttggacatagcaattttctgatatctctagtaaattacaatttaattccgaaatgttgggtgatacaggtatttgtctttcaccttgagtcggccccaatttccaat

SEQ ID NO: 66457 - DNA, 2259 bp, Oryza sativa
attaaaaaaaaatagttcggttaaatgtaacattgaatatgttttttttaaatgttgctatattcttttattatttgatcaaacttaaaactagaaaaaaaatcaagcaactaaagtcttttttatatgaggggaaaagagagaattgagaagatacgcaaaacaaggtgagcattagcgaataattaattgagtattaattattttaaattttaaaaaatagattaatatgatattttaaagcaatttttctatagattttttttataaaataaacatcatttagtagttcagaaaatatgcgcgtaaaatacgagggagtttttctgtttctacctaatcaatttctctcaatcagttttatgatatgaaacggagggagtagatcgctaattactggtcaggcttgggtgactggtactttttgcaaatactggtttcctaggttttatcctaacaaataatctggagatcttttacggtgtttgcattttaaaaagggtaaaagtctatcgctgcacaatgaaaggtaccacttaaatggttgatatagttacttactacctccgtcccacgaaaaatccaatcatagcatcccaagatagaattagtggaggatagaaatgactaaaatgcccttaatcattgaaaaaagtagtaagagtattaataggtaggtaaaaggtattaaagggagttttatctgtaaagagtaggtaggatggtaggatggtataggatggtagaagttggtttttttatgggacaaaattcaaactctagaagttgagtttttcttttgacggagggagtaggtggtaaaagtaaaatgataattttcgtaggagatagagaatggcataattgttttcgatattagttctaggtacataggtgcatacaatacctcactaactgtgtgcccggtaatttacatgatatgttttttagatttacattttttcctgcaaatatggtcacgcagtaatcctctgttacattatttacgtgtttgttttagatttatatttacgtgatattttctagattttcattttgttctaggagcacgattggttaaaatatgaccgaatgtttgccaggttattttgatatttacattttatcacaaagaacatctaaccttggtaaaaagatcagtggttagtaggttcatgtgtaattcatcctcaatacgatatatttatgttgtttccacgtgtttgcgtcatctccccgatgaaatttaactaaaatgtcttaagcaattaaatagcttatttccttacagttattttgtaatgtatcgggtaaaatggaaatcacatgcatgcttggatagcatgtattgttcggaagtgctaatgggcgatcgatcgcccggcgacaagggttgccatcgatcccccttccccctccctccctccctccacctggttttcttttttggcaccgtattactttcctattttagtaaatttatgcacctaaagtttatacatctcaagtttacacatctaaagtttatacacctcaagtttacacatctaaaatttagagaccaaaagtttataagtcaaaagtttatatatccgattcaaatttgaatttgaatttaaatatttttttatatatagtatttctatatatacatctaaagtttatagacccaaagtttataagtcaaaaagtttacataccccattcaaatttgaatttgaattatatcgggattcaaatttgaatttgaattcaaatattttctatatatagtatttttatgcatctaaagtttatacacctaaagtttatagacccaaagtttataagtcaaaagtttacatacccgattcaaatttgaatttgaattatatccgttcaaatttgaatttgaattatatccttcaaatttgaatttgaattcaaatattttctatatatagtatttctgtacatctaaagtttgtacacctaaagtttatagacccaaagtttataagtcaaaagtttacatacccgattcaaatttgaatttaaattcaaatattagtttatagacccaaagtttataggtcaaaagtttacatacccgtttcaaatttgaatttgaatttgaatttgaattcaaatattagtttatagatccaaagtttataagtaaaaagtttacataccaatttcaaatttgaatttttatttaaatttgtatggtgtagtagtaagagaagaaggggaggtaaagtagtaggggcaggggcg

SEQ ID NO: 66458 - DNA, 1009 bp, Oryza sativa
aaaaagaaaataactttaatgaatgtgtcaacgggggatacccgtagaccggatatagagggtattggggtctgttggtacgaggatctacgtagtatgacatcaagcagacaaaagacaaggattatactagttcaggccccttagcaggtaatagccctaatccagttggtatgggattatatggtggaaaccacagattacaaagggaataaaagaactcggtgatatcgacgagaccgtagtcgagttggcccgactagatctcccggtgacttggctcctgtaagctccggcttcgtaggctgtggtgggtgtgttggcggtgagatttgatgccttagatcctgccagggggtcccttttataccgcgggtcagtcgatctccaagtagaactcggagatatcggacccctcacaatatggtaaagatccagtttcgtccgagtaggactctttccatccatagattctgttcctatcacgggatagatttccttaatgtatacggaaactattcgtacacgcacgggtatactatatcggtacgcatcgtatatccaaggatagagggcataccttatgcgtaaccctgacagaatgtctttttaattggatgtgactacacagctagtggtagctactttgtactccatctagtatctcctttcaacttaaaaaatacaacagtatcttcttttctcattctacatgaaaacaaaaatgaaagggaaaaaaacaatcgatgattaaacagatttatagagagttacttttgaaccatgcaaaagttactaccaattaacattgaagttacttttaaaaattgttaaacttatgtgtgttgatccgtgctgattaaatttaatttttagataaagtcatatttttatccgtacaacgaatttacttctattatcgtgacaaaattacttccgttttgttttatgttacttttataatatatgtaaattacttttagactctattaaatttacttttatatat

SEQ ID NO: 66459 - DNA, 4315 bp, Oryza sativa
gtcttcaacacctcgaaattctgaaaaacaattctatattgacatttgccaacatgtcaatttaaggtttacacaaacacatgattttctacgtaaagtggcacacggattaaataaataaccaggaaaattcatagtagtttggagtatgtttcctagaatgatttacaataaaaatcggttgacaacttatttttcttaaaacccatccaacaacgggttagagaaccttcatgcaccagaattttggcattatcatcaccaactttaaatacagaagcaacttgtcacgtagactcttgacaagttcacttgagtcggcatcaattttgggtcatgttttaggatcaattctgaacatcagatcagaggtgtactttccagttgaaattctacagtaacagaagttgtctgcactacactggaaacaccattgctactgctgtagtgatttactacaattaactgtagcacaagactcatttcagtattgatgcacctctgcagtaaggatcagtttccgttgacactgcttcctctttttttccctcaaaaacgcatgagagcattgctcccatttttatcaaggtaataagctgcatatggtgtcacttcagctaacaagaccaacctttgcagatcaaccagtccaattaatcaggaaatgggccatgctaacattgaggtccaaaaaaatctcatatgactgcctgctacatcatctcaatggctaatgatcatattgttctgctaacactacagatataaattaagtgaaaagattcaggactgaattttacagctgcagaggggcacttgtatgtcttaccagccagggtcagatgcctcccagctgccatcccatggataactgctagaaaataaaatgtacaactctgattccttatccgtttgtgctacaaatagatgtcaagtcaaaggagtaaaattataaacacataaccatggaaaaatcaggggaaaacacagcagtccaacaggaaaaaaaaaatgagtttaactacagccctcagaacaaacaatggcacaagatatgatggaaatatagaggcaacacatggtcttcaggagaagttaagtgcagttcaacccagggtataaatgatccacatatttctcataatataaaaactaaacaggaataacatagctcctgaagaaaacgatttcagaatttcaggctatctgaacagtataggatatagtaaaatctcatagatcaccaaaaaatccaaataaagcaatagcagatgttctcatggatagtggtaatcttggacaaaattgaagatcattacagcatgactccaagcatatatacacaaagagacatgcacagaacacagaagatccaggatattatattctaactcagaacacacatagtttgtctaactaaagaaagcatcaacggattagatagacacactagtgggaggtttctgatgtcaaagggtggttcactgaactttacaatctgcaatcaactgtagaacgaaattgctagaattaatctcttctacatttgaacatacctggcatcaagtgtgacatgtgcagtagtatagcccttcatggaatccaaatagaaaaacactaaaaaggggaagagcttagacatagtcaatcaagaggacaaggccattggattgtgaatgtgattcatccatgcaaacaagatttgctatggtcagtactcagtaaacactaaacaatatggaaataatgtaggctaagcaagttgttaacattgtgaagacgtgtgacatccaaaacctgaaaaatcatgatggatttaaggcaacaggaatatatgctgtacagataatctgacagcatgctttatgaacattcgaaatacaacatcaccagtggcggattcactgttggggctggttggtgtgccagccccacctctaatccctgctcttaattagttattaacaaatctaattagtcattagtgaagaaatttcccgaatagcacaggctaccttagttcttctactgcccaaactgataaaacagaacatcctccaagtataaataacaatatattcacatatatttgtgaatattttaatatagccacaaatcaaaatagagagtttttttttatcatatgcacatttggttttcattggaaaatactttagttgatatacctttatttgttttaatcatactccctccatccctaaatatttatgccgttgacttttttaaatatatttgaccgttcgtcttattaaaaattttaagtaattattaattcttttcctatcatttgattcattgttaaatatacttttatgtatacatatagttttatatgtttcacaaaagttttcaataagatgaacggtcaaacatgtttaaaaaagtcaacggcgtcaaatatttagggacggagggagtataatattttttacactagcacctcctcaatttacaccctggattcgccactgaacatcactgaaactatagtcttatgttatgtccaaagcattttgtggattcaacaaacatcacatttgtgaggcatctagtcaaatattttttaaaacttcaaaatcatgtgcatagaaaatatgagttttcagatactgacagttgctgaaaggagaagcactctaatcaagaataaatttaacaatcagtctagcgctggcaaggggacaaagaaaacggaatccatgcgaggatagtaatgggactgggttcgcccagggagatggctagagagtaggcagaattttctgggagcaaagtcattaaaaagactttgttaaacgcattaaattgatggacttctgatcaaatcacgaatggccatgatgtcctgtatcatctagcaatcatatatcagaaaattttaaattgatgcctttaaagcacaaattatttgttttggggagacttggaggtaaggatccaacttcaaatatgaggtgtttgatcaaatcaagcgctagctaggactacttgtatcaacgctccatgtatagccaaactgatgctggtgctgttataataaagtatagatacacatctaaattttggtcaaaaaattggaatatccatgatggcatgatgttcatgttgctaatatccttttctaactttgcacaacgatagaagaaatgaaaggttttaagccatgataaataatcaaagctgtagaagcttctgttcaatgaagcatccatgtaactcaaaattatttatcatggagctaattagatagatgcatagaaggacagtaaacaagacttaagaaatgatgacatgtcattgcccaatgccctagacaggtctatgcaccttgttagcattttactaaacacatgcttgtattcatatgggtactataagtataagtatatacattcatatgggtactataagatgtaatttaaggcatatatgtacattttgataatatatttaagaactccaaggcaagcattccatcaagcaggtcacaagcagtggcgacgtaaagccagttcccgtgtgttggccgggatgataatctattattctattgttcatcatgcctaaagcacaagggatgaagcaagcacaaaaggctaacattgtgctaagtactttacttatgttggtaattgcaagagatgagtagctatttaatgtgtagccatcctcaattagtgcacagattactcatgatgcaccaaaagttcagaaattcagagattactcatgatgcaccacaaattcaaagattactcatggtgcactaaaaattcagaaatggtcgtgtgtttgagtgcatttgtgcataccgggtcagtaagccagtgcatccggggcacgaagcccaccatggcagagagcgcactctgccacacggcgaaggcaaaccgcagcgtggagcacggcacgatgaggtcgtcgtcaacggagaagacggcgtcggtggtgagcccctggatgggcctgaacctgttgttgaggctgtcctccgcgttgatcgcgaaccgcacccgtgagcaattggtggagggagcaagggggggcgggcgctcaccgtggcgaggcggcggagaggtcagggcggtggagggtgagggcgagggcgaagatggtggtgatggcggcgacggcgagcaggcaggcggtgaatctgccggggggcgacgtgtggtgggtggcggagggggaggtacccgcagcggccggagccgtaccacctcctgtcagcaagttccagccgcggcgtcccccgcgtctcccgtcggctgtctcccccgccaaacgccgccgt

SEQ ID NO: 66460 - DNA, 19435 bp, Oryza sativa
catcggcgtcagcctccttgttcttcttcttcctcctcgggctcctccttcgcgtcaggcgcaatgagggcgcggtggagagcgatgggcggccagtgacgatggtgggcgctggcgcggcgttttttcgcggtagggagaggcgcgcggcacgatggtggtgcggactgcggaggaggagcgcgtcgattctgtgaaaaatccggcgcacgagtgcacgacggtgagggggcgagagagcgcgaggaggaaatgcgtgggagatgcgggagaaagaggagggaagagcgagacacaggacggtggatgcggcgtgatttcaccatttcaggtgcggggaggagaggagggggagaggtggggtaatctgaggcgttggattggatgattttagaccattggatatgtgatatgatgaatgatgaatgagtaaaaggatttgttgaactatagggtagatccatgatggcatgatggcatatgtgtataacatgacatatgtgtgggtgcacatgacaatcaaattctcaaattggcatagaaggttctccactataagttattttatgagacaactacaaatgataaaaaaaatactgaacgtacataaaaatgatatgatgataatgaggtttattttaatcaccgatatcttcttatatagttttaataatctactgaaatgctcacatttgctgaaaaaagggaattactaatgaaaaataaattaaaaatatattaaagagcttttacaaacacatggtcggtgggttgtaaatattccatccagatcaagcattttaagtgaaatatggtttgtgattttaaaaaaatgtaacatgcatctatactacacaacagacttaaatcatagtatacattaagtgttatctccaaacaagatggttagcggtctcagtggcagagtaagatgcagagcaaggttatagctccttcaaaaagactatctatacaaaaaagaatcacaaatttcagatgtgcatattcatattgtccactaaattttttgcttacaactatgattcttccgtcaccatcgcattggagcagaaaagaaagtgcagcatatgcctaaaaccttgttgtactacttcatcaaaagttattgttggtgacttcgataattcagagttcccatcttctccccttcttgtattgcattgcataatctcgcatatactatagtagatatgttccgtcttcttccattcttgtgccaactcctaaattttcaacaaaccttgctgtaacactttgctctagaagtccttctaaagactcatcttttttgtcactgggaacccacaacagctctttgattggcacacttttctattatcactttctacctgcatacttacaacacccaactaagtaccacttatcagaacagctggtaatagcagtgtactgttagtttattaaccaattatttttctgcaaatggtagcacagtgcttaaaatactgaaaatttagcatattgtgtatataggattaattagaagcacattagatttaatagacaatactgaaacctgtagcaaaaaggagttaatttgacaaacccttttctttttatgtgcataaaagatatctgtgaaagacaatttgttctggtttgtcctcttactttatatcagattattactaatttgtctctgcaataatatagtagccagattttagagatatacaggcagggtgctgaaatggcacaaatctctaaatagagcaatcatattgtatacacctgataaatttgtcctcaatattctttacataaattttattcagtttcagggacatgttcaagttcagagaatcattaagagcttgttttcagccgtaaattcagatttcagacacatccaaaatgatctgattttattcttttacttaaaaattcactttggaagcatattttgtgctataaaaatcaattaaaaggttgaaggacaacgagcgaggacagctagcaaacctcagctcaattgaccctacttcatgcatcaacggccaagcaattaactctgtacatgaacctgcttgttctgatgaggagtaggctccatgaaagctgaacttgatgcccacctatctgagacctatccagcacatggatggtatcttgatcttcaccagatgacctgaaaaaacaataatacaaccaaagcaacaaaagatcaggacaaatatgtattaggtaaagatggttagcaaagaaaccatgaaggatttattaaccagctgttcaagcacaacttcatacaaaattgtaatataaaaagcatgaacttcctaaatactcttctttgtaccaagcagtcctgaaagttccaaattgactggtctctatctaagagatggaagggcagagcttttttatggttttcatcttttcataagatcagctaaaaaagctcagtgttgcatagatatataaagataacctaaagagatacaaataattcttggtcatgagggcacgagtctaccatcataggcagtagtccatagagatgatcatttagataaataattcattggaataaataaaaatacaaaatcataaatcaagcctgctctccagggacaaataatctggtaaatttataagacgtaaagaagcatgtgcattgcacaaacttattgtgccatgcaaaccatatacttcctccgtcccaaaatgtagctacctagtacaggatgtgacattatctagtactacgaatctagacagcccccaaaaataggaagtgcatttcatatcaaccaagaaaatagttcgcctataataatgactcaactcatatattctatttatatacaaatcaaaaagagaatttaaagaaaaagtatatatacaactcatgtactctctaaatttctacatctcttctatgacaggacctgataggttaggggaaaaatgcaacatgctggataaataattacatgctggattgaaaccatttaaaatcaagcaacttgttgatttttatcttattgcagcagctacattttacaactcgcgaatggaaaacctcgaaatcattagaaaaactatttttattgagaaaatgattacctaaacaaccaacagaaatcaggaaatggacctaataaagtggatacccaggcagaatgtttccattcaaataaaaaaagaaatatcttgtacttatagagcataaaaaaacccaactattaccgagcaagcacctgaacagctccccttccatcagtcccagcacctcctttgctcccctcctagcttctgtaaaaaacaattttgccaatcagaactgatgttagaacagcaaaagaaaaaaaaactgagagaaggtcatggacccatccaaaaataataataatatatgatttgatgcttccaaatggttagccttggatcaatcataaggttgaaaccgtaatggtatggttgaaagcacaacaataggatcaaattattttaccgtatccctacgaaatctggaagggaacgcaaattagctggtggactaacagaggtagatcaggctcgctaacatctaatagtttgctcttgcatcgtagtcaaaatcaaataggcacaagaaaaataatgaactgggatggagaagaatcaaacttgccgtagagctctagacaccggacgtcagggcccggagaggatcggtgttggcgtgaaggcgagttgacgtgatggagaccgagcgcgctacagagactggcggggatagttgtcaggcggcacggcggcgatttgatgaagtcccgatggagagcggtcggcgatgggatcggcgaccacttgatgcggtgcaccggcgaccggcagagatggcgcgaggcggcgagacggcgctagggcgagttggcgcgatgggcagaggggccagatagggtggcgatgaatgcgcgagggcgagcatcgggtcggcggcggtgtcgatctgtgcaacggcgagggcgagcgtggactggcggctgctggggataggcggcgacctggcggaggtgaatcggcgacggcgcgacggcaggggagagatgagggcgtcctgtgtcggggcgatggagagcgtggcgagccggcgcccttgacgatggaggattgaaggcctcggtggcggcggcggcgcacttgacgacggagcgggaggggagagagaggcgcggatgcggtatgggagggaggtgcgggggagtcgcggcgaatgcggaagagagggagatgcgggagaggatgcgcggtcgcgccgatgcggcgtcgattgcggcagagagagacgggggtgcgggagaggaggaggagcgacacgcgcgcatctgggacgtctgatctaactcatcagacgattttacaccattggatgtgtgatatgatgaatgatgaatgagtaaaaccatttgttcaactatagggtgtactcacaaactagaggtaaggaaattgtttttattctaaattccagcacatgcaaaaaaacaggaaaaataatatcttctaatatcaatcaatcaaggaaaataggaaaaaaagagagaagaaactgcttttaccttcaattgaggtatgaaccaaggatgtctactggaaacaacaggatatgggcacaggagagctctgatcggcggggttacgcatggcaatctgctaaacttgttcaaattagcgaaatttctgagaattgaaaagaagctaagacatctattttcagttatttacttagagggtagagaagggcaatgcaaataaaaaactatatgtgcctaaaacatttcatcccaaaatacaccactgaatcttgtctagtaatttgttttctcatccttctccaattcatggcattactaaatgaagtttatcttccaaaaaaaatattgatcagtggttaattgggttagcttgttaacatgaaatcaacaataaaatgatatgattgggccagccctactattgaaaccaagaataaaatgatatgattggtgaaatggtctatttcctatgacatttctcaataatactaatctacaatttggctgccattccatgaaagattggaagtgagaaagcacctggaaagagaaaaaccaaatcatgcgaactcttagttccaaaaatgcatggttgtacctttctgatagtgtttttattttctggcagggctcttaataggatttgaacaattgaaaatggccatgcgtgtgcaacaggaaatgtaaattcagtatgaaccccacaatagatacaaaggaagaatctgtacagcaacacttctgaacatttttgaagatacaaacaaaaatataaattcagtacgaacccaataatagatcataggttagctcttgcaaagtacaagtacaaagaaaatcaaaggaacaaagatccctcttggaattcagaagatctactccaatattcagaatgaccaataataattcaaacagtagatctcagaatcagcttttgtacaatacataatatcattaggtttcaataataaattatcagaagaacattttttttcaaactaaacagtagaccaccatatttttatcctaactgaacagtagaccacaatatttccatttcatctttccccgggacagcacatgctttctctgatacggcatgaaaagaagaggactaatggtaaaatctaaaatttgcactggaaaatagaagtgaatttgacaattggcatcacacggaaacactttattcaatcatccagatccatttcaccccaaatccaatcattttacttttctatcaaccaacaaaacggtcgcagtgcacggcttcatatggcacaactacattatctagaaacatcataactcaaggaaacgtctatcaccttgagaagaggttgacggtgctgcataaatcaaaatatacatgtcacatttcagttaaaaaaagtgttctttcagtccaagttgcataaacacaaagtcaggaattgtaggattttgtaggtacagtttaatgtttcttaaagatgaacttacattcatctactcaaatcgtaggtaaaatctgaccccgacgcaagcacaattcacatgctatcttgcgtgcaaaatggaaaccttggcatggtagtgctcacatgctgttgacatcaataggaggaatagagagcaggagatagagtaggtagtgttttacctgtttagtaaatagtcttagggaggtgagtgcgccatggacgaggttgccggtggtgtagtctgtgccacgtgaaggattatcccgtgccagggcaaggcacagagtatcttggcaacagatgcagtttcagagtcttgacggcaaatgcagttacaaatcgcggatcaacagatgcagtttatatagtcaccttgatatgccttaggagatctttcttcaaagcctaaatcccagtgacgctgacctatttttaacatttacctcatgaggaaaacaggaatccacaaatcaatgcatacataaagcgaaagtcaagaccaaggacaacactttaggttttacatcaacttattaactcgcaaataactacaaaaggtgcatgcatgcatgtagattttactctaatctagataccaaagtgttgcatctgcattttctgtcttaaaatgctttctttttcgctgaaatagtagccactgatgcaatacaaggatcatagtggctccctggttctcacttcctagtggggccctgcatttcaacaacgtcatgtcctaactcctgatcttaacaattgtctaaaccatcttatcttgactgctgggatcttacattgtgacacaaaagagagatatcattatattttctttaaatagcaaatatggggtaaataaatgaataaagttcagaagtgacactgccatggcacaacccacagcagacggtcgcccgctcgagggccgcctcgcactccatgacgaggaaccactactacggaaatcagtataggtgccggttaggaaccggctatagatgacggtttccccgccggcaccaattggtgggcacctatgccggttttagaatcggcacctacagagattatagatgccggttattacccccaaccggcatctatgggttagggattttttttttaaaaaaaagcgtctccaaggaatataggaactgaagcatcccggtgatctcaccacaatcagaagcaaaaacttactccaaggaagcagaaacttgtaccatctcacaacaatctcgaacccaaccatacatacgaagtagaaacataccactaatcatcaatctgatgagctgctgctcctcatgaacatcccgcgcttacgagacgaagccctcctcgcctaccagggaaccccacctccagatcgatcgacagggcgtctagacgtctgtcgctagcggcacgcaccctgaatgaaaagaaaccaaatcagagaaaaatgaatccgcacctccgccgctagcagcacaaaccatgaacgaacaaaaaccaaatcagaaaaaaaaaagaagaaatcccttgatcataagggtgcacgcaccttcgtccctggaagcacacctccaccaattcgcctcgcccatgcatcaatcgatcagcctcgccctgagcgaatcccacgagtcaagagatgcggcagaggagggattgctacgaggaaaataggagtaccttcgattcgactcgaactgagacggagggcagaggcgggaggggctcgtcgctggccgtgcgtgggcgtgcatgacgcgggaaatttaactatttgccactcttgtgacatggcaattaacgatttgcctcaccctgtcaatgacatgtgggccctcatgtgtctatgacatgtgggcctagtggcaaatcgttaagcaacatccgtaagagtggcaaatagttaaaagccccgcgtgacgcgaggaggccgcacagatgggaggagaggagtccgtcgaacacctcgcccgcgaagggagaagggaatggggccgcctcgccggcgacgagcgcgaggggaggaggccggaaggggaggggagccggagggggaggaggaggggagggcggtgacggaggaggcgagggggagggagccggaggggaggggagggtgcggcggaggagacgaggggcgaagcgaggaagagtggaggtgcggcctggcggtgatctgacgacgggaggagccagaatgggcggcgtggcttcggcggcggtggcgacctggcgacgggaggaacgagaatggcgagtttttttttccgggataatcgcgagatttagggcgaccgtggggacgggagttgcggggagaggagcgcatgggtgggtgcgggagggaggagagggatctggttcgttggattccgcgcgcgacgggaagacgacggaggacaggctcgcccttaacgggcgtttaccccatcgccagctaccggcgaggcgttcctcctcgcaggcggattattttcctcccgcaggcacagaccggcgacgtggaggcgagggattcgggtggagggcgcggtgggaggggaggcggcgctcgatcgtgacgcggaggggagggatgcggaggaggtgcggcgaatgcggaagagagggagatgcgggagaggatgcgcgatcgcgccgatgcggaggaggcgcggcgattgcgtcgattgcggcagagagagagagagaggggggtgtgcgggagaggatgaggagcgacacgcgcgcatctgggacgtccgatcttaactcatcagatgatttttgcaccgttagatgtgtgatatgatgaatgatgaatgagtaaaaccatttgttcaactatagggtagctttaaatggttttactcattcattatgctttaaatggttttactcattcatcattcatcattcatcatgtcacacatccaacgatccaaatccatcatatcctatagttgtcaaattaatgagtaatgagtaaaactaagatataatgagtaaaactaagatatataataaattaactataaattagatataatatgcccgtgctaacgctacgtgtatgtttagtaatagaaatcatgacacatggtttggtatcaagtatctaatatgataaatttaatatttaggaaaaaagaactacggagagagtttttatattgttgctaattatatagcctccaaaatataaaatcacaacttttgtatcttaggaatacaaacaaaacatattgcctacaaataatacaaaccaaacttcattttacaaggagaagtgttttgattattttataaattatattaatcaccgagacaaatttcacctaaatggaaggatataatcatacagaaatgaccttccaaagtttgaggagtcattgtctagctcaagtataatcataagtaacaagaaccctatctgaaccaatccacgtgccttcgcaaagcatgttagatagtgcaaaagcattttttgtcattctgcataataaattgaaatttgtcatttatgaattagtttatagaacatgctgtaaatttgaaccgcaaatgtatagagtataaggatataccaactatcctgaattctttcaagtgcatgcaatcctataataaaccagatattaagagagttagtatttcatcaagtatttgctactatgattatcttttaaaaaataaattgttataaaatggcagcaaacctttagcagtactacttcatgctttgtaaaattagaatatacttgaatcaattcagatgcttcaatggctgatgaatttttcatgcaaaattctacttactttcggttatgaagaatatagatagcacttaccatcaccaactggcttgccatcccatttgacaatgggcagaaaaggatctgactgctgcatcccagcacacttccttgctcgctggtcatattaaacacaccggcatccaccatcctgggcaccggtgctgcagccacttagccatttacctagtcacccacagcgttgaacgccagcaccaccagatcaccatcgcccgtgtcgaacaccacgttcatcatcggtccctcgtccatatccctggcctcgatgaaccacaccaacacgcacacaccgtggacctctaccaaatgtgattctacctgaccaaatcaagaacccacttcgagtctaaattcagtaccaacaagctcatgcagttgtatggcatccacaaatgattggctcccttccatcgatgtcaacacggttgttcccctcctagcttctgtaaaaaagataagaaccaatgttgaaattcaatcatcagaacaacaaaaaccatggagtacaatataacagtggaagtacagtaaatatatatatgcttaattctctgatcccatacttcccctgttgtcacatcaataaagtacacttgatgatttgaaattcaaatcgtcatatactgctatacatgtggcaaatgtgaaaaaatcactgaaagatcaaaaatctgtttttggagatcttaacaaatgtataatcacacataaatgttgaattgtctcaaataccctagaaagaaaaagatgctcccacaatcacaggcaacttgtccaatctgaaatctacttaaatcggtcaccaaaaagaacatggcaatatgttcagatcaacctaactttaaatgttccacttaatatgttcagatcgaacatcacagtcagtatgaaatgttctattgtgggagtgagaagattctgaaaccggacagcagaagaagcgagcttgccatagagctttggaaaccggcagaagaaaggtaatattacaaacttgccttcgccgtcaacctttccacaggcaccaagctccctgaacccaccatacacacctgtctccaatctgtttcagaacagagaagatggaaaacacataatcccgttctctctcatgagtgcatttaaattcttattagtgcaggaccaataggctcacaaaaaaagagggatcccacaattcgagctggattgcaagaaggaaggaagaggattgcgtcggatcggatcgaaccagaatttgaactccgggaggcgacggacgaaagggcggaactcgtcagatgtgctgatggggagcacgggccccccctcgccgagctcctcggcgacctcggggtcgtcctggggcgagaggaaggcgatgaggaggttgaggatgtagatgccgagggcgtaggtcacgatgtagcaccctcccgcgaaccaggcacgcagcacgtacgcggtcgccaagccagcgaaggccagccaccgtcgcgcccgcggaggagatggcggccagcacggcggcggcggaggaggaggggtccatcatggcgtcgggcggggcagaggcggcggcgtcgggtgagtgcgacagagatgcgggaagagcgagagagagagagagagagagagaggagggcggaggcggcggcgtctgcgcgtgaggggatggatgcggccgtgcagggagggaggggagggtgagggggagacatgggccgatcggaaccggcatattcaagggatttggaccgtcggatgtgtgacatgatgaatgatgaatgagtaaaaccatttgttcaactatagggtagataaccattattccatcgtgacagtgacataatcccaacggaacgggatcacggagtctaactggtctacatccgcaatgtttgtttggaggaaatgcaagtagtagttgtttcccatccttagtgctatatatttaacgtataatgtgtttatgtggttatgcaaatgtatgacaatattttgcgatatttaaaggtgcatgggaatggttttcgataccaatgacggttcaatgaggaggatcacacatttgtgtttaatgtgtaactttcatgtttgatggaatggttatagattggcttgagtatattttatatgcgacatgaattgaattataaatcatttggattgattatgcaaaaattacttttgctaagagcctatgatggaattttattactttataaatataatggcgctgtagcgttagcacgggcttattactagttataggtaggtagatagatattattgcaaaaggaaggtaaaattgttgctcctagatgcggcaaacctcttgtccacacaccatcttctcgtgcattccatttctcttcgagtaagtgttgaagtccttatgtagattcagcaaccatagcttctttaaggagcgaagaaactcgatgccttccgatacttttttcacaatgtgcaaaccttcaatgtgtggaagggcttcagcttcgacctccaccttgttgacatccgacatatgcatcagcacgagtgtcttcagcactggaaaacaccctgcagaaagaatcaatgtctttgcagtattcgccttgtttagttttagaaaagtgaggtatggcacatgttatgctagcagcaatagtagatcttcccaagccgacaccggcctagagctaaatatttgagatttctccgacaaccctttagaaaaattcaatgtcttcctacaatagagagaactgttcccatggaatatattatcgattagttgtctctgatatgctaaaaaggttttgaattgacagtatttcataaacaacatcgttagtcgacatgatttagaattttagggatgtatcggagtatgtgacaggaagagagttgatcatgtcgacattgcttcaaacatatacatggtttatccattttgagaaacaaaaagatagtaataaaccctctagaaagctaaacaatatgatgagatggtatgtcagtactgattcttatattgaaaggtacatgcatgtatggattatagcatgtagtttacagccttatacaattcaattggtagatccagcatattacatgaaaatattatatatcttccaatatactcccaagagggactttctcagaggagaaagccaatgtttcaggattatttaaaaaataaaaaaatagcatagcacattaccaaatactccacaaatctattgatagcacattagctaaggattaattgggcaggacaagatgcgttatttagtactgtgcagaggcatcttggcacgagtacgtgttatgcagaaggaagagtaaaatatgtcactcctagatgcggtagagctcctgtacatgcgccattttctcgtgcattccattgctctcccagtaagtgttgaagtccttatgtagatgcagcagccatagcttcttcaaggagcgaagaaactcgatgccttcaggtacctttttcacattgtacaaagacacaatgtgcaaaccttcaatccgtggaagggcacggtcttcgatctccaccttgttgacatccggcatgtgtttcaaaacgagtgtctttagctctggaaaacaccctgcagaaagaactaatgtctttgtagtatacaccctgtttagtcttagaaaggtgaggtatggcacatgtgatgctaacagtgacaggggatcttccccaagatgacaccagcttagagctaagtacttgagatttctcccacagtcctgaaatattgggcattgcagtgtcccattggcccagtgccctctgacaattagcttgtggagcctccctgaaataggctcgagggttttgaaacaaagcgtctcagttttactacttgcggaaagaagcagggttgaaagaagtggcatatttgatagtgtagaaaaaagaactgcacaatcaacatcagttatgttgtcaatccacacgcttcacagttgcgtaagtttcttcagctgctcggccaaatctttgctggcttccacagtttcgagtgtctgcaactcttctaagttggatagctctttcggaggttgaactccagtgaagtaccggaaatctgaatgcttctcatcagcacatttgtcagctaaaaggtgtcgtagcttcctgaccttgacaatccctcgtggtagcttctctatttttgtctgcttgatgtctagagtgtggagattatagagtttctcaattgtctctggaaatgacttgactttggtgcgccttaagccgatatatcttaggttaaacagattccctatacttgttggcacttcagtgatttcagaatcttgcagctcaaggacagtgaggtaggtggattcagagaaaattgaggacaacatgttagaggaggatgaaattgtttgaactgatattaatgttcgaaggcgaggaaatttagctttatagacacctttgtcctcccaacgacacattgacaagcggcggacttcattatccatcagcatcattgtgccagaatcatttgctgaaccaaatctctcatctttagccacaaaaagagctagatcacgcataatgtcatgcatcttacaggtactaaccctaccaagttcatctgtctctaccacttccagcatattccggttgatcagttcattgagatttccttcagccacgtcttctggcgtgttgttttcttttcttgcagcaaatccttcagcaacccaaagtcgtacaaggttgtctcgtggcatggggcaatcctcagggaacatgctgcaatacaaaaagcagttactgaggtctcctggtaagtcatagtagcttaggttcagaattgcttgtacatgatcactctttgctagctcgctctgtagctgattgtatgtttgcttccaagcatgctgtatcggctgctttgaggacaacaggctcccaatagatacgatagctagaggtaggccttgacacctatcgacgattgaattagccaactctagaagttctgaggggcaatcgtagtccttcctgctataaaaagcccttctgcagaagagactgaatgcatcgaccttgtccaaaggttggagtttaaggtgacgtgttggtagagctagtgctgccacatgcttactccgtgtagtgatgatgatgcggcttgcctggagattttggaaggcatcatgtatttggttgtatgcttctctatcccagacatcatccaacactatcaaacaccttctatcacttatgttttctttgaacttctcttttaagtcatgaacatccataccatccaagtgtgcttgatctgcatatccaatcttcctgagtaccttcctcagcaattcttctacgtcataggtctgtgacacgacaatccaagcatgagcatggaacctgatcttcccacgctcatacacattggcaacaatggtagtttttcctaatccacccatgccagatactattatcactgtgctatctagttcatttgagtacaaccatccagtcaataacatcctgttgccttcgatccccacaagatcttcatcctttacgagctctggcaagcagccttgtgaccgctttctttcaaaatcagaatgtttattacggataagctgggatggttgcagccatttatctttcagctttataactctttggatttcctgctcaatctggactatctcagcaacaattccatcgaaaacaatggcataatgtgatcctttgacaacgtactttttcaggaacccttcttcctccatttgaagagcatgatatgagtatttgtccattacatcctcaacatggtaggccagctttcgtacctccgcaatccaacccttgataactttgtcagtgagatgtgctgtatctagttgttctatgacattttccattgttgttagttccattcttatttcttcaaccttccccggtaactccgccaaactctttcctttctgatatagcttggatactgcagatttggcaatatttgtgggatccaatccaaaagtactattaatctttgatagagcaagaataattgcttctgccatttgtgctgaggaaaaaaaaagttcatgttacacagtgcaggaacaagattcaggactcagtaaaactccatccagccttcttgcgttacctaattattaatttcaataagtagaaaatcaaaccatcatatagcaaatcaaatatatatatatatatatatatatatatatatatatatatatatatatatatatattaaaggaaaatatccgatctaatgcgaattaaaaaaaatcaatttggtaatttgttgtgtttcagacaagaaacagaccaaatttgcagtttcggcgaatgaaagctaattaacaagccagataatatctttaatacaacatttagattacaaatatgaaataataattttggatttgaaatccaatagaacccaactgcaatgaaggtgtcagctttatgtttacaaaacaacaattttcccaccaatcaaagtaacataggagatcaatctttctccagtaccttttcttttgttataaagctttaaatctgtttggaaatttattattttcctgcatgttcgataaatcaattggacattggacttttgatactcctaaggacgttattagagatactgatagtatgcttccaaagttattttatttgccagatgacgtgcaggctatctattttgcatttctagcaggctgtggaaacaatggaataaatgatgcaaattagaaatgggttttcattttcttggatgtctcaacaactagagttgcattttttataaggaattgtataaagaagttgtacttgctatgggcctatgggtcttacgtctaagatcagctactgtagcactactagttatactcatccgccatactaagcaccagggaattagcctaagaaattaggtcagattggttaatgttatagtatcgtttgtttccatgatgttagggcatacattgttatactcactacaacaaaaacctcgtatagaggcacttttgtagaggcattttgtaaattgcttctacaatcagaagttttatagtgtagagacactttaaaaattgcctagaaaacttttactctagagacatttttatatcagtttgttagattttatcttgtagaggcattctttcggcactatgaaatgcgtctaatatgtaaaggcattttgttgagacattttaaactatgtagagacactttttagaatgataatgtgtactaaacgactaaatataagtaattaaaggaacaagtatacaagtaatgacatggagttgagttggttagtgtatcgaagattaaaatgatttaaccaaaagatcatgagttcaagacttatcaaaagcaaggaaactattttattctcttttttggactggttttatatgtttgcggtacaatttagtgtctctaaaaaatgcctctaccatcttatagacattttataaaatgtctcttcgtttgtagagacaattcaccataagacacttattagacattttttaaaatgcctctacattgttgtaaaggcatttgataagtgcctctacagtactagaaaaatgtctatacagagtatttttcttgtagtgtactatttattagttgggcgtgctaagtagagcccatggtgctacgtccttacatggggccccatcctcacacaaccatatattgtcttgtcatgccccagcaaacaataaggctgtaaatgactaaatacccatctatgtaaataagaatagttgaatgcatcacacaagtgtaaatcctcattgcttttcgaagggcaattattggtcctgaattggtagcttggcaagatctactgcccaaagtagctacgataaatcttcaacaacatggacggtttaaactattcaacgcgttgagctttgatgtactgcaaaaattccatattacatcgaacaactttgtgatactttatgaaacttgcaaagtagagttgttttttatggtacttgtgaaaaggtgttactccaaccaaggatagttgagtgaaaaggagatgacgaggtagtaaaatatgttgttttcatggtgctgatgaggctacacaacactctttcattgactgtaacagtttgctactagttttatttggcagactattcatatagtttatggtttacagccacccaaaaacattgatcatattttaggaactggattttgggtttggataaaaaaaacaagatctaaggtttcagcatgtgctaatgatatgttgggtaatctggttaagttgtaatcgcaacgattcaatcttgtatgcaggatatctatagtggacatattggctttgttattggtcattgctaaaaaatgaggatgagaaagcagaaatcaacatgggcttgtggggacatatatttgctaattaacactctaccggaagattaaaacaaaactttgaataagaaaaaaatttcgctgcatccaagagcaataccccgaatgaagctggtgccagaggaaggaaaaggacgaatgagttaggtatctgcagccattggcgccaggtgcggcggacgctcatccggctaaccccgaactccaataccccgccactgcaccgagagtgtgcataagaaacatcgccgcgagccaggagggctcggcacttgctacggctgggccgagaggaaggggggcacagctgattcaccgtgggggacggcagcagcaccaacgcgtgatggggtgtccaggtgagcgccgccggtaggcgctattttagctcgaggagaggagacgacgatgcggaacatggtttttgactaatttccaccaaataactgatatttttttatgagtggatgactacggggaccccaagaactgaactagtggaagtttctgaaattgcagggtgaaatttgaaatcaattatgaggtgcatctcaatactgctgcaaagtttagaatcctaaagctttggattttttttttaattttcactgaaaaaggagagcaggaaacgtcaaatgctagaaatgtcctggccacactagttatattatcctcttcctcatgcttgctttccattttcttgtgagcaatgatttgatattccgtggagtcttgtcgcgtgcccgtggtgccaacgttacagcgatgaaggccggtggctgacgaggagggtggaaaaggatgcagttgcatggcacagtcaccgtggggaagctgggttggtagcggtggctaggtagggtaacgaggatgtgggtgctgtggctgcttaactgttactcaggtgtaccgagacgatatccatggaccaactaccataggtgcaggacctgcttctggagattgcctaggtgtcccggtttaggtcatcatctgagaatgtcacagcctacttggggatgaattgtgcgcacgtgggctaaactcatgctaggggcctactcgccgattgcgctccaactgcttgccgtcatgcacagccactgcacctccggagcacattccatgcatacaacgcactctcgccgcttgtcaagttatagtatgctt

SEQ ID NO: 66461 - DNA, 10035 bp, Oryza sativa
tgtggtcaccacctcactacttcactgtctctctcggtctaccctttgatttttggcccatcaagggctagatcgggcatgacgctgatgctgctgtgctcctcggcctgcaccaccatggagagaaagggaaagtagagcggaactgaaataatctgatccaattgggccagtgccatttctaacatttcaaattatttccataaacctaaataaatattttattagatgtggtgtctagcagcaaattgacaaattttgatagtgttttcctccaaaaattaacttttgtcgtgcccacgaactaagatcctcaggacaataaattttgccatttttctgatgtcttcatttgggttcatttggttagatttattgggctatttattaattagatcaggatcaacgatagttgacgtattcaccgtacattcaatttgatactaaccaaagatctagatcaaggagatgatatctgtaatttgtatttgcaactaattgttgttccaagctatttgcattttgttatgaccatattttcctctctttatctataaatataaccaaataattcagtactttgtcatcataaatttaagacttagttgttcgacaatatttgcagagctcctggtctcataataaatgcagctcagagcgctaatttgatttattagtcttgattatacttatattacttttcaataagttcaattcctcgctcaccaggatgcatgtgacttttaatgttatatttgttgagacttgagaaccctcctttatatctatcccttctctcttcttatctaacctagtagttatctctggcacctttgtaatatacctcattctatttagtctgttttgctccatgtgtgtttctgtttcaatttaaatccactagacactagtgtttgtttaatgggaatagtcccacatgaagagtttagattagtctggagctgcttgtatacccacctcactccaaccataatacatgcgggttaacccttttatatgaactgaggatgaaagtgtaagtggagtgctatatgaacatggacccacgtaacgtgtagagaagactaatgtaattattatttggggctaggatgtaccatggtgcttgggaagtacatataattttctcaagttatttgcatacatgtttaatcagggagactggaataagtgagatgtatatactccctccaatcccaaatgatacttcctccgtccttaaaaaaaactctacttctagagtttgaattttgtcccataaaaaccaacttctaccatcctacctaccctcacaaataaaacaagaacttttatcccctttacctacctatcattacttttttaaataatgagggacattttggtcatttttctctccattaattttaccttggcatgttaggaatgctctttttgtgggatagagggagtacttgtcacctgacatcatttataactaaatcacttctgtttcttttgaaaaaaaataagctgttgcattctataaataaacattaagattccgttaatcataatctaaccataccatttaaaatatattaatattcaaagattaaataaacaatgacaaatatttggaataacaagtatgaaacagagggagtatattttaggatgaattccgatttacctctaaactattgcgtttgtccaatttacacccctaaactacaataccagatacttttaatcgtgatctatccaaaccggacgaattacccccctaagtccatccgagggggttttagtcgtaagtgcacacatggcatcggccccgcttgtcagcctccacttcatttgccctcccctatcaggctagtgggaccctcctatcagcgtcgactcatctcatcttcttcctttggccatgagggcaataaaagggcagggcaggtagtcgggctagagcttgagccctcccatcccctccgctctgcaatcctccttgtgaccttttcaccgctcgatgccgctctccttcctccgtacttacttccctcatttctccgtcaggtctgatcacggtgagccaggcaagcctagatctatctggtcaagctaatatggtcccatggagtggtgtgcccctagtgatgccggtgcccggtggtgcgaagaggagggacaatggggctgatggagaggagggggaaagggccctcgtgcaaaaactggaggcttgctgccggtggagttcctacttcctagaagggtttcatggtagacctgcagcgaagctgatggcgagacaattctctggaacatgcagctagtggtagatcaaagattgagacgaccagcccgagaggagatggcaacaggcatggtgatggctgtggtggtgggagaccaggacagattaaagtacgcgagcagttgtacccacctagcgtgggtgaggttttcggtatggccgacggcagcgcctgcatctgtgcctcctgcttgcaggagaagctcgggatgctcgactcttcgtcccagtcaaacccttcccacccactgtctgtgtgtcgtccaccttctcttcctattctttgaccagcaacctcaccgctgagaatggttgttggtgagctcactgagagaaaagcaggttgaatggtgaggaatagggatgaagatatatttttatctcagaatggttgttggtgagccgacgccgctcttccccctcgtaggcttgccgttagcgccgtgcgtcctcgtctgccatctaggagggcaagtgtagagtcccggagcaaatacacaagcacgccgtcctcgtcggcagcggcagcagcacgaacaagcagggccctgctgcaggagcttgcgactccactgctggcgccaggagatccaaatcaagagcaaaagttcaagcttgttgtcctcgtcgccgtcggcagttcgtcagttcggcaagttgatctgcttaattttggttggcctaggattcactaggaagaatataggatgtctgcttggttttttgtttggttccaatataacgaagctttcagatctataagctcggttctgttgatgggtgcaatattccaaattgatgtgtacaaaaattttgtggcaagactttgtgatttgtcggttgtttgatctattatgcaattacaaaaaatattgttcgcagccacaatcttcgatattttctttgaagcaaaagatttttgttgagtcactggtgtctattgactcgcaagctaaacgagctagctcgagctaccaaccgagccgagccgagctaggattttagcacgttaggataacgagctgagccgatcctaacgagctagaccgagctaagccgacccgagccgagtcagctcagtatccacctctaattatgtaggaccattaatgtctcgaaatatattagagggtaatttgtctgctttaaaaagtttgagacttgaaacgtccggtattgaaaatgagggggtaaaacaaactatgtcagaggttgagggggataattaagactttttcctatattttattgacaaatactggctagatatatcacacctaattcttttttattctgttttattatttagagcaaagatatttcaatctagctttataaaaatgctacatacggtacatacattcatgtctataatgtgaaagtgttgcatgacaagtatacgctataacataacatagggtgttaaaagcaaaatatattaatgaccggggtgagtataggttataagcactacccagaaaaaaaaacatggaaaccgacaggagtcttttccgccttggaagaaattttaaatatgaatgaaaaattgcaggtctatgagtaaatttcaagaaagggaataatcaagggggaacaaaattgccacagaatgacagaaacttcagcaacaatgaaatcaatacagttttgtaaaatttctttcagctagcgtagatatgatgctgtaaaacagtagtaaaattggtaccttgagttgtagatcaagatagctaactcaaactagctcatgcatggaagaacagccggttgatgttggtagcaaggaaaatatggacccgaacttcagatcgtgatgcaacaagccttctaaatatatctacttttctcgttttgccccctctcaattattatgaaatattcgttgaaggcttcaggcctacggctgtgttgtatctagtgggcaagtttcattgagaataataaacgcataatcaacattattggtacactttgggtcatcaacattctattcttcatcatattcttctctatcagattcatccttactagctagcatccacttttgttttagtgtgtaataggtccccacttcccaggatgcatgacatgcatgccttcattgaattgatggcattttctacattactataaatatctacatctatatattgcttaaaaaaccagtggggtgagttctgtcactaggggcggatcagaaaggactaacaggaggggctgaacaaactatacaaaactatagcctcatcttctaatggatgcatgacagaaaattttagtggtgacttcatggggactcccgtggttacaacgtacgccggtagtgggggctcaagaccccatagctcccgttgtagatcggctcctgtctgcactcctaccaccaactcccctaaactgaaatgtgagagtgagacctgattgaaaggcctttttcattcaaatatcttgtacctctaacctctacctttaatagtacaaaagtaatgctttttatgctggtggtagtgagtttgtcactcccaccataactttctctaaactgattttgtgggactgcttgaaaggcatttttcattcaaatattttataccttaacatctacctttaatggtccaaaagcaatggttgaaaactgaaaaaaaaagataaaacctaattaattttaaaaataagttctcgctctctcagtcagatctagatccgcccacctctctctctctctcccctcatcgtcgacgccgagtgccgcctccccgctgttgactactggttaccgtctccttgccctcgacaactaccgccgccttctccttggcctcgacgacgatggctgcctccttggtctccacgacaatggccgcctccccgatgctgagcacctcctgtccgccccctatgaccgccggctacctcctccttggcctccacgaggacggccgcctccccgccctccttgataccgagcgcctcctcccctccctcaacgacaactgccgccaactcctcggtctccacgacgacggccgcctccttgccctcctcgatgctgagcacctcctccttgccctctacgaccgttggccaccgccgacccgccatccactaccaccggccgccgcctccaccaggttttcggcgaaatttttcaataatgtcttaggaatttgtaggaaatgttttagaaatttatagataatgctttaggaatgtgtaggaattcgtaggaaatgttttagaaatttttaggaaatgctttagaaatgtgtaggaatttgtaggaaatgttttagtaatttttaggaaatgctttaggaatttgtaggaaatgttttaggaattttttatgaaattatttgggaaatttttggaacttttaggaaattatttgggaatttttaggattttgtaggaaatgctttaggaatgtgtaggaatttgtaggagatgcgtaggattgttttggaaaatgtttaggaaatgctataggaaattttaggacatgccataggaaatgatatgggacatgttagaaaatgcgtaggaaatttcagtagtttcttcgctgcagaaatgtctaagcaacatgatatgtccatatcgggcggtacaagtggagctacatctgggcagaaccctcggacgcaaaaccacctaccgaccacccggcaagttatcaccgttgtggatgaaagtggtaagcctacagcgtcgaggagtgtcatctccaaatggtcgaacagttgcaggcgtgtagcacttgatcattttggtatccttcataaaggtattaacaaggtgcagctggtcgagaaagagcgagctttgacaacattagtcacatggttcaactatcctgctgaagcagaaactagacggcactacagaagatgggcaaagcatggaagaattttaagtggaagcttttctccgaatatttcatcccgcccagtaatcggaccccttcaacgattacctacaaataatagagaaggtgtgggaggagttcttcgggctcaaaagcattcaagagttcgggaatgagcacccacaccgacccggcacaacggggtacatcgagaaggaggaaatatgggctcaagaggatgatgctactgctgcagcaaatgtccctatccctttcactgacatctctgaagtactagctcgaaactgggctagacccagtggtaaggtcaaccaggacgacaccattacatttccaaaacaaaatgatgccactgtctatcagcaactagtgagttcccttttaacttaagtaatgctgtactcgcaagctcctttcatacttcctacatgtcattaacgattgacccttataatatatagatggggttgattgctgaagaaacttcacaatgcgaggttgagtctgcatcgaggaggccgaagatgacgttttcacgagggcgctcggaaatccagaacatcctagacgaactcggggaataggctgcgacgtgccatggaggcatggcttgccccaatatgttgcgcattgtcagaaaaggaaaatctcaatagaagagatggatgcttgcatgaaggagccgttcaaggaggtcattcaagagctgaagcaggacatggacgctagggtggaataaagggtggcaaaggtcctcggcgatatgaacataactcgagggcatgaacaagcgacacaccatctcctcatccacacgttgacgtgggaaaatcacaacgaaggagtagttgtgtgtccatagagttgcatcatcttccggtccaactactggctatggtggacagcatagaggtagctgattttttatgcctcatctcatttcaaatgcctcacccttgacacgtttaattaagaaattttcattgcaatgcaggacgtagcactgtgtatcctagtggttagggtcacaccaacctttttgtctgaagtcgcaagggcatggcttacataccctctagcatagaaagggtgcccacggtagacctcatggctggatatgcgaagctggtaatcaattcggttatgcccaaccagctttcatatccaatacctgcgccatcaaatgatggaattctaactttgggcgatgcacgtcaaacgtacatacaatggttcaaggcagatattatcataaaaggtggttcctcgtccaaaacacccggtagaatctgaacctcctatggctcaactatcaattaaggcttgtcatgaacctgatttgacgaaaccacattcaccccgggaaaccatgcatgggtttgactgatgtagcagccaccatgactccagttaagaccacatggaaggccgatagctctccaccacctgtcaagagaccaaaaggtgactggagtcattagtgaccactaatatctgatcagggccaaatccatcaaaggtgagggttagggtccgttagagatggcctgattcgggtatccggcgtagtgcgggctacagagcacatattcgatccatacattttttagataatagattcgatccaacattcgatccatacatgaaagcatggacagctgcgcctgcgacagcgagcatcagaatgttgaggaggttttcttcttaggtaatggaactagagtatatatggagaagatatgttgatatgggtatatgatccataattgataattattttgaaccgtgaattgcattgcatatgattaactggttcaatcgttcggattactactattaattaataaccccccttcctttgtgtagcttttaattgatgtgtgaaacacaagtgtatgcagactttacactcttgaaattggctgaaatttcggttgttttggaacctctttatggaattatttcaaaatttaacaaatattgactgaatttgaataatttttaccaaattcacaaaaaatcgataatttcaaaccgaaatttcaattcccgatcagagcaagccaattggagacgagcatcgattggacacttgccatgatctagggtcgtttttatgataatagggttttcatgaagcatataaaatgaaagcatccgtctttaacatgaaagtgcactagctccattagatgggcctagttggccggggtctacaagggtcctcacttatattcttttcattacacgggaaactctattcattgctcgaggaaatgttcacttgtttttatgtcactcagaaggtcatcaattttttttcaaaaaaataataagatatatcaatatgtgataagtcgctacacaaatatataggtttaacttcaatttatataagtagaaacaaaatttacaaatctaacactaaatagaacgtgtaattcgcaatcaaatttgtttatttagtttctaattatataagatgaattcgaacttgcatataatgagatatcacatatcgatcaattttgctaaatggttttaaattattttgtaactttctaagcgccatgcataaaataaagggatgtctctcaggggaaaaaaaaactcccattatattgctctgcactccacctgaaggacgtacgcgcacagctgttcatacgactatacgaagccctgtctagctaaaagtctcctcggtctcgatcctcaccttgcccctgcagctgcatacccggccctttcgatctggttatcaatcgatccggtcgccatgaacgacggtcaaggtcctctcttttctagcttcatgctgtctatacttccctttctcagagatattgcaacgatagcacagtctgttaattactaacattttcttggcgatatcatatcggcagctcgattgatcgctctgtaataatttggctgtcgttactgctttgcttaattagtgcgtgagtagcatgtaacaccgtaccacttcatggtcactactagggtactttgctggcaaaccagcgaaacccaacgacaaagaacaacaggccggtgatgaggagacgcaagctgttgatgcacaaacacctggcggtacgtaacgcttaattaatcatatatgcgtgtattgcttcactacttcttaatttgagttactaattatcagccaaagcatttgtttttctcttttcaaagggtttaagaccgaaagtgcaaattttacattgttttccttgttcgcaattgtgttagtgaatttgtgtatgaagacacttaatttctgatgcttttttatctcaaccgatcacaacttctcgaatcatttccgtatgcgctcttaatacgcgtgtctacctaaaagatgcttacattctgggacagaggaagtagcagatttttagtattatgatttgtcatatctgctaatatgttgctatatttttgagatttagctagtagtatgtattacattcctcaccaatcttagtttgcatatgagagcacgtacgggacagtagattttaatctcatatatcttaatttcttgagaaataaactaatcaattttggtggcatacaagattacttcttgggccctccagcaaaccttcaacagcagccagcagcgaagcaatccgccgatcagaacagatcaagcactacactggtcaaggtcacctgtgacgggcccaaaccctcacctttgacggttttgggcttggtcagtgatcagtggtcactggtaagtccagtcacctttgacgggtggccggccgtcagtggtgacatccacctctgacgggcaagttaataaaaggccgtcagaggtgttggtctaagctag

SEQ ID NO: 66462 - DNA, 1460 bp, Oryza sativa
  unsure (1)..(1460): unsure at all n locations
ggttcggaagaaacattcgtcacaaggtacctcacctgtgacggtccgacgtttgcgagtccgtcacaggtgaggttacctgtgacgaatgtttcttccgaaccgtcactgatgagttaattccagaaaaaaaataaatgctaaatatggctagcccaggaattgcagccatgcgtttgnctttgaaaaaacaagaaacatcacaggtgccagtcacccccctccatatcacatattccccaactgcccaacatcacagatgcatcacatatcacagatccatcacaaagcaacaatttacaacatcacatatgcaacaatttaatttattatagcacacaattcataccccatgaaagtcctcaaatgattaccaaaatttcttgtattctgttcgttgtgaacctacacaacctgtcaataagggaaaaaaaaaaggagaaaacagatgaatagtacaacataaatcgtagttgatcaaatgtgatgacaatttagtaaagtaccataaatattgcacatatgaaagtaaattacattgcactctataaaaacataattttttacatcgccagaaattataaaaacatcttttttacatcacaataaattatctagccaagttcatgagtctatttggcatgaaaacgtcctttcttattcattatttctgcaagaataaaggcgcacacttcgcctctgatagcgggggggttgatgggtgagatcttgaagccagctctacctttctgtttaataaataagaggttaattagcacgttttgaatagcaatgtagatattgaaatgagcttattcgccattagcaacaacctcagggtcgaaatctttcacctctcttagaagtgttgacatgttgtggcacacgtggaaaccacattggtctccgatctgttgtgcgcatgcaaacttggtgtcatgataaagttcgttcttgccctccttgtgcctaccacccttttccacatatgggccccaagccatatttaaggccttggtgatttcactgaaatcataatcaaaggacttattggaattaaggtaggtaaccctactccacttaggtacgatgactaggagaatccaatgtcgcctgcgtagtggttatgtagcgttagtactaagaaccttaacttcaaaaacaatatacacgaagggtattgtcctcttactcttggttgtgtgcgcacatgatgtactccttgtcttgatgggcccataaacaccggttgacatagtcaaccacctcagtgaagctctgtcgtaaattaacctcattcaccatggatggatcaaggaacccaacctgattaccatggcgacgactctcgatccaacacaaccttaaaatatttacgtattagaactaatttaattaggagatatagtccagtcatatcacaagtataaaggtatgcacttacaaggagtagcatttta

SEQ ID NO: 66463 - DNA, 5297 bp, Oryza sativa
cgcttggcattgcttagctccatgtattgcttatgtagctctcggcaagcaatacccatcacagctaacacattgtcctccaccaatggcatgcctagctcaaattgggctggcgccctcacgaccttccccgatttgctcaccagcatcgacgtcgcagccttgcccctttttggctccggcgccaactccccgaccttccccttgccgtgttcacgcttctggcccttgacaagtggtggggagctatcggcctttcttgtggtctttattggagccaagctttgagctatatctgccaagtccatatcagctccaccgggagaatgaggtactgacaatgccggtccacggggagcctcaattgatagcttagacttgggaggtgtaagctccgtcggtcgacttggacgaggagtcatcttcacaactatgtcttctttgggccattgtatgaacgtcttgcgcgcatcgcccaaagtcatgatttcatcatttgggggcacgggcagcggatagcctgaccaggtgtcctttactgtatcgatggacaccttggcatacccagctagcaggtctgcgccgtggaccttgtctgtaaccgagggcttgaaagccatgccctcagcgacttcaggagcgaaagttgggtggactctcgctagtaggacacactgtgctgcgccctgcataaggtgaaagtttgaatttaatattggaatgtgtaaatgtcttttattagatatggatcggataacaacaattacctcgatgtggtccactgcagctagtggtgcgatcgggagactaggggccggcacctctgtggatgcacaactactcctatgctgtgagggactcgcgtcgtgttgtacacgaggagttggttgcacagcaggtgttgtgactcggggtatattcatgtcggcgaggaccttgttaaccctttcttccacccttgcattcatgctagcttctagttcttgaatgacctcaaccttaagttcggccttcaaacgagcgtccctctcttccttggagactttccgtttcctgtattgggagctgtactgagggagtccatgcttctagggcacatcgctaccaattccccgagttcggccaggatgttctttggttccgagcgcctttgtgaggatgtcatcttcgcgcctcttcggcgcggactcaacctcgctttgtgaagcttgttcagcaaccaagcccaactagaaaagaagatagtcgtttatacgaacttgtactttatacgaacggaaattagttaggttgagtagtgaactcaccagttcctgatagacgacggcatcacttttgttcttaaatgtgacagagccgtccgggttgaccttaccccttgcccgcgcccagttgcgagctctttgttcagggatgtctgaaaacggggcagggacattcgctgctgcagcggctgcatcttcttgggcccatattgcctccttgccgatgtaccctgcggtgcccagccgatgcgggtgctcattccgctgttgcagtacgcgatgtgcctcgcttgattccctaaactcttgggtggtcttgagagagcagaattcctcccacaccgcttcggttatttgagggtattcatcgaacggcgtatgattgccgggcgggttgacaaactcggtgaagagcttcgacttccaattcttccaagctttgcccatcttttggaatgccttccgcttgagcctatcctttgcttcggctggaaatgtgaaccatttctccattgccgtccaagctcgctctttctcggcttctgtgaccttcccgatatctttatggaggatcccgaagttctcacgtgccgctagcccgcagcagttagaccatcttccaatgacagtcctgggcgccgtgggcctaccactagcgtcaacctctcttataacttgcactgtggtcggtcatatattttgtgaccgcggatttctactagacctacttgcacttgtcccgcccgacatcgacgtatgttgttcctgcggcaattctgcagcacaaacagaaggcaatatttgctaaggggtgctagctaaaatttatgtggtcatgtggtgaaaatttatcctataaattaccatgaatttcgggttgttggaccgccgttgtcgcgggatgaccttcggcaactgcctctgtggctggtgttggggagggcgggtttgcgccgagcgttgacatggtttaactttcgcgaaaaagattataaatttcctaccattagactaaatagcattagagccaatgtaatacggggtaaactatgaaagatatggcctcagttttgctgagaaatatgcatcaattacaatcatttgcatgaagggataaaaagaggaaatcataacatcaaaagagcaagtgcagaaaatctgttcttatgcataaaaaaagaacaagtgtagaggtatataaccactgaatcaatcatgcaaatttaaaaaacagcagcagcaagggtacaaaatttgcatgattgacataaaacagcagcaggaggagtatatatgccacaggggtagcaatagcaggggcaaattaactaaaacaacatgtctagatatactcctcttatcaatccagaagaaaagagcaagtgcagaaaatctgttcttatgcataaaaacagagcaagtgcacaaaatctgttcttatgcataaaaaaagaacaagtgtagaggtatataaccactctacactggccatttaataaggaacaagtgaacaagtgtaggggcaaaaaaatgaacaagtgtagataatctgttcttattgagcaattcatcactggctatttaataaggaacacattgggcagcagcagcaagggtatataaatcatcaaagaatgacagaaaacaaaatgcatggagaactttggtgtctaggtcggttccgtccatggactacactgacctatcctttttcggctaaatgtaaacatgatccacaaaattcaataggtctagcaacatatatagcagtacacactccatgaatggttatatgtccaaatggcacttaaatccacattcaagttgcacttaactaacagttgcaaccataggcagcagcatgggcaaacatagacagcaagggcaaacatagacagcagcagttgcacttaaatccacattcaagattcactgcaccaaaatcatgtaatacgaggtatactatgaaagatatggcctcagttttgctcagaaatatgcatcaattatattcatttgcatgaagggataaaaagaggaaatcataacatcaaaagagcaagtgcagaaaatctgttcttatgcataaaaaaagaacaagtgtagatactctattcttatccataaagaacaagagtagaggtatataaccactgagtcaatcatgcaaatttaaaaaacagcccacaataagggtacagataaactgttcttattgagcaattcattacttattgagccacaacaggggcaaaaagaagaatagataaaaaaatgaacaagtgtagataatctgttcttattgagcaattcatcactggccatttaacaaggaacacattgggtagcagaagcaggggcaaagatactccacaggggcagcaacaacataaaacaaggaacaggtgtattaacaagtagcccacaataacagcagtagcaggggtgtagataaaaaaggagacagtactactaacttcatgtaaacagcaattcatccattcaattcaagcaagtgtaaataataaaacagcccacaatcatttatgtggcagcagcagcaagggtatataaatcatgtatataaacaacaattcatgcaattgacctattcatagacaaaaagggtatataaatcaacaagtttagataatctgcaaagttccttaatcatcaaataatgacagaaaacaaaatgcatggagaattttggtgtctaggtcggttccgtccatggactacactggcctatccaccaaaattccccatgcattttgtattttgtgatggtttgataacccctaactagctagcttaataaactatttctagctagctaccctacctacctagaaacactattgccaatctatcaatccatcctttttcagctaaatgtaaacatgatctacaaaattttaactggctacacattcaagttttaactaacagttgcaaccataggcagcagcatgggcaaacatagacagcaaggggcaagtgtagataataaaacagcccacaataatttatgtggcagcagcagcaggggtatataaatcatgtatataaacaacaattcaattattcatagacaacacgggtatataaatcaataagtgtagataatctattcttatccataaagaaaagaacatccactgctgcaaaattcatgctaagatcctctattgatgctaagattcactgcaccaaaatcatgtatataaaatctagcctctacattcatccaaaacatccacagacaacaaatcacatttaattcatctatacagcagcaccaacaatcgaaacaacaaatcacatttcattcatctaaacaatgcaattcatccatcgaaaaaaggaggaatgggggagggtggcggcgtacttggagaagcggcgtacttggagacggcggcgcaggccgtagttgtcctggatcctggtggcggcggcggagaggcagcggcgaagaggtcgaggcggtcgacggtggtcggggatcccggcgtcggggaggtcggggaagtcgatggacggacggcggagaggacgatcggcggcgagggcggcggtggagagggcgacggaaagggcggagatggcggcagagagggcggtggagatggcggcggagagggcggcggagaggttgaggcggtgacggtggagatggtggtggagaggacggcagcggtcgagagagtgagtgaggaggcggtggtgaagagggaggcggcgatggcggtgaagagggcgaagatggcggcagatagggcggcagagatggcggaggagagggtggcggagaggttgaggcggcgatggtggagatggcggcagagaggacggcggcggtcaagagagtggcggcgagaaggcggtggagaggtcgaggcggcggtggagagggcggcggcgaggagggcggtggagaggtcgaggcggcggtggagagggcggcggtggggagggcggcggagatggtggagagggcggcggtgaagaggtcgacgcggcggtgga

SEQ ID NO: 66464 - DNA, 9647 bp, Oryza sativa
ttctagaggtatttcttgacctatgccgtggacgtgctggttgtaatcatcctcgtctgcaatgttgtccaatccaacaattctccttttcccttcacgaacaacatgtagtttcttgttacacgggtcaactatgtagaacacttgaacaacttgtttggcgagaacgaacggttcatcattgtacgcgttgttagccaagttgacagtggtgaaaccttcattgtcaacttttacattgcgaagatcgacccatcgacaacgaaacaacgggactttgaacttcaagtaatctagctccaatatttgctcaactttaccatagtattgatcacgacgaccaccgtcactagcagcctcgatgcgtaacccactgttctgcactgtgcatttgctgtcttgctttaccgtgtgaaagatgtatccatttatgtcatatccttgccaggtggtggcactccattcaggaccctgtgacaaccactaaagtgtttcactagacaacttaagctttctggccaaatggtacttcaagtagcactaccgtaccacacactaacaatactagccgtcaacccgtgcgttgcacgtgctctatctatataatataaataagtatggaagttttaatcagatgccgaaacgttgattatttatttttcaaaatatttctaaaaggcaattagcaggattgcccctacaactttaccttatttggatttttgattttcccacacaactctttaatagatagatagataataataaaaatatcaagtaatttaattatcttattgagaataattaaatttttttattagaacaataaaatcttagcccacgttgaacttcgtgtgtggcaggcaatgcttgcagtgcaagatttttgtaattattgaattgctaaagaagtcacccttttgattatctatttaaattagtaatacaaaggtttactggtgtcgtaattttagattttttttgattaagtaaattcaaactgtagaattaatcaatgcaaaagtactggggcatcaactgttctttgggtatataatctataatttcaaattttgaaaataataagtatcatgatgtacttgtctaaatatctattttgtacgtattttttttgttaatgtaatagttgtcaaaatttagaaaaaaactatattagtgagtcataactaatgtgacccatagttaacatgattatgttggtcgccaacctgtgcatcacatgtgctattatataattattataaatattaaaaagttaatatgctaaatgttacttttctaattaaatctatttaaccaaaaagggtccacatcaaggactgcatacaaattattaattttaaacttctgaattaaactaataaaatattataaaacaggagtcaacttcatatttatccattcaaattttggaattagcattttttaagaaaaaactgaaactaaagagtgtatgatatttattaattcaaattttggaatttttaggaaaaaaactgaaactaaggagtggatgatatttatgtaatattctattgctcaagaatatttcaattgaaacataatctgttgtgttttacttgaaattatacttacaatgaatagattaacaaaaactaattaatacaaccgagagttaaaatactaagttatttataattcatgcaaaatcttaaatcgagaattgatatttattaatatatgcatgtttgtaaataatgaaatctaattgaaactgcaatgaagttgtttttatatttgcatcatatgtgcaacaaagttgttctattttgtggatcaatacctaaattttatagtatcagacgttatgatggtgtggttgagttctgatctcatttcagatgagaaacatgtaaataaaacaaccaagatgaaaaaaaaagatcaactcaaaatctggatggagaaaatagtctgaacctacagagtctgaggttgtgtgtatccaattgacgtcgtcagttaagcagtgtatgcacacgccggcacgctgctgatcttcatgtgcaagacgaaggaggtcgatgtggcctccatcatgccgtactccagcgttgtgaagagtaggttattggctttgtctctgagtaatctgcgggcaaagattgatgaaaagtaaaatcgtaattacctgtggatgacacaatggatataagatcctcatagttaaaaattgccccataacatagattagttaaatttaataatatcttgaaaattgaacgtgaaccatatatatatgtcggtccaacgattaaattgcatcttgtctggcaaataaaattagtaatgaaataaccaagcaaaatggttgaagcgtagccaatcttttggaatgatacaaaaggagcagtacatcgtaaaaggtgtgggaaaaaaaagaactaaccttaaatgaatctgcatgatatgcatgataaagatagctataacaattatagtcattaaacttttgctctaagaaacatagcaaagtaattagcttggctaaaaacaataatatgtaactcaaagataaacatttgcatgtaccattgtttactggaaagtaatttgcaagtagcaaagtaattagctttcagttgaatctgatgcagatgccattgtcttgctgattggttacctctgcagatctatttaatatatacgtacgaaaaataatgatatatttgtaattaccggcacatgatgttcaaagagcagcttttctatttccatcactgttattttggctgcaagaagcaagatcatgttatcggtcaaatttgtgtacgcaaatataccgtgtggccacttgaaccaagcaatccgtattatgaattagtaacggcagaaaataaaatcaaacagtgcaagcagttatataatcccctctcctgttgtgctttctcttcataattgttctctctccttattgaggatctgcctgctcctgcagcagcgctgcatatatacacgcatgcgcttcttgttaaacacagataaagacggttagggaaataaaattagcattactttttacctaattttgaagcagaaagattgaagggcgatgtccatctcctcgcgtggaacgaagttgtcagtattctgggtttgatcggattaacgttgatggccagccggcgaatgcatctgcctggtttacgctctcgtcgttcccatctacgttccgctcgtataattgactggctattggagatgggatcgatggggtaggctactacggagagatatgatacagtgcgttacatgtaccgcaaggtggaagggctttaacgtgggccataacattaagtgtagagattggattttagatcaacggttacaatggtacgatatatctaaacaacggctagatctttctggttaacgtgagacctcgtagaaagtgcccaattagtataggtatagataattaagcttcctgatcacccaaattcacatctgactaaactgtctttcatctctagttggtgatttccttttcttttttcttgtaccatatcaccagctgtccatgcctcgcgggcgttggaggagcagcaagcaagaagaagtctggccgtgttctgtatgcatataactcagctgaatcattcaagtaaattgcatggagggagttgccatggatcagcatctctgtgttgcaagttgtaaacatctccggaaccttcgtgctcaaatttatcgatgttcgatatatacgttggtttcattaattggtatagtgggtatgttgaaattcaatggaactatcaactatggttgattatcaaccatgcaccgcaaatattataatgttgacctctctaagagcatccccagcgctcatccaaatatcatcctccatatacccatatggatggccatccaaaaaatattcctcattcatatctcttcccactctaacagatcatccatattacatcatctatatcacatcctcctatatgttactaatatctcccaactaaccttacacttgtatttttaagggatatattttgaacaactaaattttaacggtattatttatcacgataaaattttgaaatgagtaaattttaacgggtaattttttaattgatatatttgatttgggtgaatgatagcaagaaatatcataccaacacaaataaaataaacatactactactgtcttttctctcctcagtttttctactcttctcttcttctttacaggagtactactactcttttctcacagagaagagggcgaggggcgagcgaggagggggggggggcgactgaggggcggcagcggacgtgggcgaggaagggcgggcgggcgcgcgggcgagctggtgaggggtgggggaggggcggcggatggaggtaggcggcggtgggcaaggggagcggatggaggcaggcggcggcaggcaaggggagcagatggaggcaagcggcggcgggcagatgggcgaggtgcaggtagcggtgggcggacgggcgaggcgtgggcggcggggtcgccgggcagagggcggtggcgggtggacagacaaggcgcgggcggcggggtcacgggcacgggccgcggtgtcgcggcggaggaacgacaggcggcggcgggcgggcctctgcctctactccgaacctccaccgccagatccagtaggtctctcctctctacctccatgccttcacctctacccttgcacggcacccatggagcgacgcgatccggatggtggcgtgagtttatccagagacgggcagttgctggatggcatgaggagagagaaacgccaaatttggagccccctatggcgtatctgttggagcccccttttctctcctcatgcgctattttcaggatggagcatgtgatacaggaggtgctggggatgctctaacccgagtcaccacaagctactccctctgtctgtcgctttagggtttaaattttgttacaaaatacttgtcactttagagcaccttttgtaacatcaatcatttggaggcatgtcacaagggctttcgaccgaacctgccgaaaccacaaagaaccccacacccgcgaggcgccagttgaagcccaatgggttagcactcgggcgaaacacctaggcgaagtcgaaggacagcgtctagagggttcaccaccgagcctatgggactcatcgttggatcttcactttgggtgaagccatggggcgaagcaggaaagattcgcccgaagaggaatcatcttcgccaggaagcccaaaggacggaacgatccaggaaggctattcaccattagcgggctggcccaagaagcccatataggggcccatagctagggtagacactatatgcccttactaatgcccctatcataaaggtatccatataaattcctctgtatatatattaaaccctagaggatttgagcctgtactgagactataaatagccatctaggaccatgtaatgagggatcccaaaagtttttaccaattaatatattgtctttactacacatccaatcctctaagagtgccacgcctttcgacgtggcatggttgtcttcccgacaacaatttccaattcaaaattttctccatcctacccccaactaccttctcacttccatccgtacattattgaataaagggcattatgtttattcttcgtaaaccttaaattttgctaaacaacctgtacagaggtagtattagataagtgcaatccatacgcgcaatgtagccacccatcctcatcatgtatatgatgaaattagacctattttttgtatagtaattacaatgtcgaactaggaagaaaggagatgtttaataacaaatagcacacgccagtccactaccaaggcatgtaccgtttgatcatccgcttgttagcgatgacccaacgctcgtacaccaagagacccttctcatactatcttgcaaaaatctcaattatatatttcaagcgtatactcatgcacatctaacccataggacggttgttacctatgcaccttcatctcaattaatgacataaagtaatatggataatattctaaacatagtcaagggtactaacatcgttagagttgcaggagaaaaacaaaacatggatcatggtatgcccgtattaacggcaaaatttgttaatgttctttagtggattcagttttggaaagaggtcgatcaaccaatgaaagtttatcaataagagaccgagttcaaggaggaatcgtgaagaccacgtcatggcagtctaattctatctattaattaggcaagatttagtaactttccttttatctttaggaagtatttatctagtgtctgaacatgacttgtagttttccttttatcgttaggaaacttgtaccatgtccaatcaggactagtatcaacccgtgagtataaatatgtcaaccaaggtcattgtaatctatctccacatatcaatacatttacttccgatgcatctgttgatgaaaaatccgcgctcggccaatagtgccaggtctgtgttggcgcaaactaagtcaatgaacacaacgacctgggagaactgcttagctccaatgcaggtctaaatcttggtgagatgcgggcgtgccagttagtttgatcctgcaactgacaaggtataaaattgcagatcaatgagccaatcggctaataagtcgaaggagtaatttcatccgatgctgatgccagccgatagcaatagggttttgagcaatcggctaaatatccaacgtagaatctaacactcgacgtataaaggcgatcagctgatgataatatagtaataatataatctagtagaagtcaattagctaacaatgatatgatagaataagcactgatccgaatgttaaagaatacatcagctggagtcccaatgtcataaaatccacaagattagattaaacagtgaaatctttgttgcgatcggctaaatccaacttgtatgtaatccttataagctgatgcaacgtctagataactcatcggctgaaaccccgatgaaacccttattggcaatcaattagcaggctagagattatggttctaagctcgacttagtagatcaaacctaattgatgcaacactaagtatgaaaagaaacataatatctagacaacttagtagatcaagcccttgactgatttttagggtggtagatgccttagctaatctaatccagtaaaacaatttagtcgatatcagcagaaaccctaaagcgagagacaaccgatagagctaaattgagattctaagactagattaacaaagacatatgataaataggcaagcaaatatatcaaccaaaccagagcaatcctagaggtcgaatgtactgatgcagccttgaacgacactattgtagccagtacaattgcctgggccagcagaacattggacttaccccttcgccggagatcgaagacccatgcagccccgcgtcagttgccaagttcgccgtgataaataaaaagtagaaaaggtaaaaggtggcgatgcaccgatttgtattgatcgtgagatggtttacaatgacctcagatgtacatatttatacccatggggagatactagtccttacaggacactaaacacactttcctaaagataaaaggaaactaacgaactattcctcattaatacataacttgccatgccacatcctccttgaactcggtcacttctggataagcttcctttaatagagtaatttccttaaccgaataaagcaggaattcaactattagcggcatgataattctcatcagctaattctaggattctgaagccaatactgactctaggccgatgatatcttcggggcttaccaaatttcactgttaacagcactatcaccctcttttacaatgtttttactaccgacagaatttggcacctgaatcacctgaatcggggctacatcggcttcgatctccagcgaaggggtaagtcctaagttttgctggccctggcaattgtatcggtatattttgcctacatgatatttcaattgtatctctaattgcactatgtttagagatgaatcggtttacttaggactgtctcagttagatctgttattctgatttaggccctgtttgattcagcttagaattattataatctggattattaggagtaagctgaaacaaacaagtagattattatgctagattattataatctataagccagattactataatccaataatctcctctagaggagctttttccagattattgagtggctaaagacccactacccttagatgcctcttataatccagagaaacaatcaactcggagcttattttatattagcttactataatccagcttagagtaatccgatttaataatgtagattacaataatcttaagctgaaacaaacatggccttagttgagatatctctacaatcacaatattgttttagataaatttgttatatccatcacattaaatagatttcattggctcattgaatattagattattatatacaaatcccatgctgcatcagttaggttcgagctgctaaattgtcattgataatctaagtcttgttaagccgataggtttcatgccagtgttttatcagagcgctagccgatatgttatctttgcatcggacttccagccaatgtatgttttaaccactgagcctacatttattattttgtatcaatattgaccggttgcttcattggacttatatttcatcatattatcaccgaccgattggattgtttgttcaaaccgattgttgaaaaccctatcgacatcggcttgttagcccatcggctttttgatcgtcaacatatttatctatcttgtcagtgcaagatcaaattgattgacatgcccacatcttatcaagatttaggacctgcactaaagttaagcagatctcccatgccttcgtgtttttcgcgtcaatagcctgtccaaccctcgtacatgcaactgactagttataatcatcatgaaaattggtgtcactctgcacattaaagtattcatcacctacatcaaattctaaatgcaactaccattaatacaaagcaagagttagtaaaaaaaaatggaaatgcaagacctaaatacatgcaagctgagattaggagggccatttgtggtcacaattttcagcgtaaagcaaattttgctgtggtatatttttaaacctttaaagtaagtacaagtaaattattgtagaaacatcatcatgcttgctgccctccacggcaggaagccaccacatgtcagccactaaacccttcatttgtaacccctccaggaaggtactgctatgaaaaaaaatgccggctccatgtacgtagcacgtggtgtcagtataccttgcatccgcagctagggtacattgcggtagtgcatgtggatgacctagtcatcaagaccagggagaaccagcccacaatgatcaatgaccaggaggaaacatatccagaaaaatgtgcatttggggttctagcaggatagccgactgggctagatttggaccacggctacgcagcctctagaattagtgcctttgccttgtttcaatgcacttcgccatggttcgcttggcttagcccttcac

SEQ ID NO: 66465 - DNA, 14555 bp, Oryza sativa
aacatattttatgtaattgatacttatgaattttgagcctaaaaattgagattgcatggttttatgagagaagaaagaagagactatgtgtaccatagatctatcatccaaaggctagaaataattgtgatgtggcttcatgagagaagagagaaatagcattaactacacttagtggggatgaactataagtatataggattaggatgatccaaactatgatgtgataatatcttggtttttgggttaagggtggttgagccttatattttggaatgtagggaataatttataatattgaccaaccatcccaaattgtcttattggtttacatgatggtttttatggaatacagaaagctccagtaaaatataagaaaatgtggatgatttacatgatactacttttggtttcaaaaaagaaacaacttgtgtttcttagttttcattaagtcaaatcttacatagatattgcagcctacagagtaatagtcatgaaggactttttgtctattggatccaaccataaaacctatctaattttattatgtcactgtgggatgcatcctgccattagcttctgttcctatagttcaaggtaaggtctaaaggagccaggtgtctatacccttagttagcactatgaattcccgtagtctctcgagaaaacaatgtgctgaagattaaggttaggtcttacagacacttcacacaaatgaaaattgtgtgttactaaagcagcaagtgcaacagcaccatttaatcaaagctttcactctttcagcatatatcagctataacatttcacattatcatagtgcaatgcagaaactagaaaggcggtagaagtacattggaaagaaaaaaactacatgcctcaaagtttgaagaaaccgttggagtagaagccaaactacttttcagagcatctgaatcagcagagctaattaatgatttagtaaaatccctgtaaaataagaaggtgtttcagatagcagtgcttgcatgtaggtgtgcgcacacatgtctgtacagcaacctgcacaaacacataatctgtccgaaaaataatctaggacagcacagagcttagtataaaaaaaataattgatatgcagttgaatgttgaacaaggaactggcacctttcatttgtaagttggaggattggataaaatggcccagcaagcagagccaaaaagtgtacactgctgtctggagtgtctgtgacactagcgaggtcagcctgcactcagatagacagcggcgattaaagggaaacaacaaaggcacaacataccatacatggacatggggagatgcatgctagtcggaaagcttacctcaatctggggcagaaatggtggtagcctgcttgcaatgtctttgagtaactaatatcaaaaaaattgcatgattagaagaaacttatatgttgccaagacacagacagaagtaagaagaagaagaagaaacaaacctggaggtggatattttgagaggattgtttgtgtgcagtgatatgtggcaataggtagttgactagaggctggaggtcaggttccagtccaggtatagggattccaatgagctgaagaagaagagtgacttattactcggaatatatccggaggaagagtaaaagttatactagtagttactcctacctggatgaagaagatggcgatagggttgccgcgcatacaagagatgcggacgtagcggcaaggggtgtggttggcaggatagagtatgtcgcgcttgggagcctcgcagcgcgggcgaaccttgacgaaggtatctggcttgttgtagcgcaggccggcagtgatctcccactcgaggacggacttgttgtagatgcggatgtgggagaggaggcacggctcctgcagcagcaaattcagcaattcattcagggctagagaaggagactcctagttagagagggggaagaaacaacaagtcgctagtacgcacgctgagctcgagcaggatccactccttggtgttggtggcggtggaccagtgggagcgcaggtctggctacagcacattggccgccttctgcgccgccggctcgcacgaagacgccttcacccggaaacccagcaccccgacaccatctccccactccgacgatgcctccctctccggttccatcgcgcagcgcagcccagccggcctcctcctgcggctgcccacacagaggtagaggtagagaggaggaggaggaaggggagagtccgagtcctagtcctagtccgaggaggaggagggttgaagacgacgacggcccacacagataagagtcgagtcgatatcggatgggccttgggccttacttcctacactacgggcccctttgaatcgtaggattgaaaaaacggaggaataggaaaaacacaggattttggtaggaatgcaagtgtaaaaacagaggattgcaaaacacaggaaaaatataggaatgaccgtttgattagaccacaggaaaaatgcaggaattagatgagagagatagactctgggaaagttttccaagaggttagagtggatgttaaatttcctacgtttttgctctagaattgtaggaatagaaaagtttcctacatttttccttttctcattcctacgaatcaaaggcatgaatagtgtaggatttcaattcctttgtttttcctccattttccctccaattcaaagggggcctacattttttagcccacaccacacatttcgccccgccgcagacggcagaccacaccttacaacttcttcttcagttgccttccttttggatcctctcctctcctcctctcccgcaggcgcaaggtgtttgatgaaacgcctccatgcatgcatgtacacgagctgtgtgtctacatctctgtctcctttaatttcaatctcaccaacctggttgttaactgtgagtctgaaattctgcaggaagcagtttgttcattcaaaaataggttcaagaattagatactgtagtttcatctatctagatctggactagatatatacaccctgtcacactgaagccggcctgatcgaactcactggtttgtgtgccttcacactgcaatcctaaagggtcttcgccattcacactcctgcacactgctcttcgtatggtgcatatatattatctgctgactcgatccattgtcgcgtgcctatctctaagtgtggtactttctctaacctgcaaatatattgcattctagctagcctttctgcctgaaaatatatattgtattaactgattcaagtactgattgcattgactgcacctttttgggatagtttaacagtgtagcatggacttgattggggttatattaggtgcatgtgtgtgtatacaccaatacaccatggtatcgtacataccatggtcgcattcgtacggtgtctcctgtggactttgttgagtacccaccttgcttacagatggacctataagttccatagcttgcattgactgcacctttcttgacttacaagcacaaaggctcatttttttaagacatcatccctagattaaattaaaactttacatgaagcttgaaaacatagccaacgtgcttctgttttttttttacttttattttcgctcccaattcattgattttgtcaaaagcagattaattcatctcttggtgaatcctttcaaaaaaattcatctcttggtgaacaaagaatcattatataccatttccattatctaaaaaaccaaagaattatcaagtttaattactgaactgatatagagttctagacttcttttgagacagctgtgcttttcaaattgcagatcatgtactctaatccacacacaaaataatctgttagctcttttttttttgaacgaaaaacagtactatagtgccttttcattgaatagagcaggagaaaatacaacccctaggggcaaaagaaaaaaaaatctggagcctgcagctatacactatacaaagtgcgggattaactcgcgcagccgctttacccccgctaaagcccaaaggttagcttattctttgattctcgacatgaggaaacttgttgccacctctttgtggtcaaagattcgccgatttctctctttccatatttctcatacaactagcattatgagtgatcggagcccttttttcggagcatttggcatgtttgcaaggttctcccaccactgttgcactgacagtgcctcctcccattgagccggctcaatctgctggtagccgacccgtccagcaacgaggccctatatccttttagtgtatctacaagtggcaatgagatgcagcgccgtctcagcctcgcagtggcagaggacaaacacccattgttttgccatccccttgtcgcaagtcgatctgaagtccatactctattttgaatgatgagccaagcatgaaatttgcatttccccggcgcccaggctttccagattaaggagttgaaacttgtgctcggtgttccttgacattgcgcatggtaggccgaggaggtcgtgtagcgtccgctacttgtgaatttccaagtaatttggtccggttctccaatgcctaagtggacattccggaccgcttcccacagggcaaccagttgtcaactagttctactataataggcgagtgtgattctagagccaggtcctgaacccaggcgtcctcctcctttccatttcgaagagacctccctctgtttttagagatcgcatagaccagtggcatgaggtctttgggtctttgtccctcgatccaggcggaatcccataagcgcgtcatgttcccatctccaattgttatctttgttgaggcggcgaaaagactcctgtcaatttcatcgcagggcgtttccagtcccacccaaggcttggtcggatccttccactcgtgccataaccatcgcagcctcaagaccctcgtgaatttctctagatctaggactcccaatcctccctgactggttggcaagcacgtctttttccaattgactttacattttcctccggtgatatctcccgttccggcctagagaaagcgacggcgctgcttgtctatttgctcaagggattccttcgtggttttcaaggcagtcaggagatagataggttgtgccgtaagcatagatttgacaagcgtggttcttctagctgctgccatgttcttccctgtccagtttgttatccttcctgagattttgtcaaagataggttgcaaatccgcctttcgtaatctacccagtaccaaggggaggcccaagtactttatggggaagtttgctcttatcgccggaacgccctcaagaacctccgtcaactcaatggtgtcacatctgatggccgccacttgggatttttgaaggttggtgacgagtcctatggcaatgccaaagcgatgtaggatgtctgcaaaagccgtgacatcgcctcgagtggggttaatgaagatgactgcgtcgtccgcatacatcgaggtcctcagacgggtcgttctccctcacaacttcgagattgcaccgagctctgttgcctttgagaggattcgttgcagggagtcaattgcaagtatgaatatcagtggtgaaagggggtccccttgtctaaggcctctgccatgcttaattcgctgccctggcgaaccattgaggagtacttgcgaagttgacgttgagaaaatagcccccaaccaatctctccatcttgttgggaaacccctttgctatagcaaggcaagaaggtagtcccagcgaatggaatcgaaggccttagttatgtctagcttgaatagcagcattgctcgcttcaagcggtggtatcttctagccttgtttcttacgaaaaggaagttgccatgaatgcttcttccttttatgaaggcactttgattgaccgaaatcaacgtatgcatgtgtggccttagccgcagcgcaagcatcttggagaagatcttggcgataccgtgaatgaggctaattggcctgtagtccgcgaccccctcagccccttctttcttaggtattaggacgatgttcgcggagttgagcagatttagatgtgcacatatgagattatagattgagtctaagactagaagaatgtcttctttgatgatttcccagcagactttgaagaagatcccagtgaagccatctggccttggggctttgtcggtgggcatctccttaatggccctatgcactagggctgtcaacgagccgagctcgagcgagctcgtcagcctaggctcgagctcgatacaagctcgagccgagctcgagccgagcctataaaatgttcgagctttccgacaggctcggctcgagctcgattaccgagcttgatttttaagtaaaatatatatatatttcaaagataatctttaaaaaaataattaatttctagtttatcatactaatagaagaggaaaaaagaataaaataaatatattatgtcaatataagacatacaaataacatatttgatctcctaagttattaagtaacaataaaaatgatatattactaggctcgttagaagctcgagctcggctcgacaaagctcgcgagcttagggagaggctcggctcggctcgtctggagctcgagccgagctcgaatcgagcctaggacgagccgagctcgagcagctcgcgagcctcgagcttttttgacagccctactatgcacctcttgctccgagaagggctccccttttagttttctttggcttacaatttgatattatcagatgtagtgtcactgaaaagtatgccaaagcaagtgctgctggttgtgcatggtggtagtgtactgatgtgcctcagaaaaacagtgcttcgtcatgcttgttagggcaatttgattgcacatggtaatagtattgttttttattgaataatggtaatagtattgttactcgttatatactcttccttcatcgatcgtgatttgcaaaagcaaaacccacagccaactcttgttaatttgaggaacatataccaacaacaatatcttactcctgtaaacattcaattaaaataaatatatagccgttcctattgttacaatcgtagaaacaagctatggctaatacaaatgaacacgctatatagtagtataaaagtaacttacagttgtccattctaaaaaaaaaaagtaataacttacagctgcctcttggtggtattaattaattggtcccctagtaactgtaaaaaataattgtgtgataactggcagagagtaggaagtattggatcctatattggagtattgctcattttatttaatttaatcattatacgaatgttcttgtatcagagtgtgaagtctagtgggagggtgaagtgccttaggttgagcaatggcttgaaatcgttgagcagatttacattgtgatccctccaggttcgattaaggtgaggctatcaagttattgatttatttttttcaatgctgggtgttctttcctgaccaaagctttttctggcagatgaggaccttctccttgtctgccttgtattcggtatcatgcttgtcacagttccatctcattcctttgacaatgatggctacagaatccagaaagtaggcgttctcgcggattatggcataaccagtgggacgaaggatacggtccatctcaagaagtacaaacttcatctcgcacctgcaattgcaacgtacggtaagtacgtgttaattgtaactggatggagtatttcttacttgctttcttgtgaatttgaagttagaaatgctgatttgcaagtgtacgtacctatgagactctgcagtaaacaagccatcaagatgcaatagatcgtacgtcctggggtatgtagagaatgcctcacacctacagtagagttgattggaaggacaatgagtagttgaataattaagctatgatatagtagaagaatgaattaaatgcaaatagtcaccagtcgtggttggtgccgatgaggcctctgtcgaagacgacgccgagggagttgggtccgtaggaggagacgacgttcatgacccagacggggtccttgatgaggctggcggcgaagcctccgtagacggtgttcatgtccatcacgttcctgatcttgtcgctccccagcgccgggagcagagccttgtagtgcttggtccggagcttccacttgccatcgtcgtgcttgaaggcggcggcactgctcccggggacggtggcgatgcgctctggggcgacggccaggcgctgcggccacttgggggtggcgtcgagcgccagcttcttgtagcgcgaggaagtggaagaaggcgaggtgaggcaggagcgcatgggcacgtaccaggcggcgtccgggtcgacgctgtcgtcgcacttgggcggcgaggagacgggcgtgagcttgtcgtagcaggcagggtcggtggacttctgccacacggccgtcgcgacagccacagcttactagtaatatgccaaatggtttataaccctatggatataagcgttggctaaaccttcgagcgttagtaatatgccatgactacaggtattgctccacacttgctacagtcactgctctttttttcccttcttttatatctgaaagccaccgaaataagccggaaacaaaccagataatatttgcattcctcggggatataaagaactaaaattcacaaccaattttcagacaaatgatttttcagtttttctctaaggtccttctctgttaatgcataccaacaaaatgcatacttcctatagcaaacaagaacaggccgatgaacatataaaaaacaatacatttcgagctgcatcgtatatttttacacagagaaaagaggaaggaagattaaaaaagataagggccaaaaaaacaaccccacgtatatattgtttgaagcaccattcgagatagaaattgaatctgttactatgctcgaggtaaatatataatatacacggtgcaagtaagagtatattatgtttttctaccggaatccattttgtcatgcattctgtaagaccccaacgatccccacgcatgcaagagacaaggttgcactaaaacctaaactcaatttattcatccaaaaccacgatctgaaaccatacatacatccctagtaaatctgaaaccatacataagatgccactggtgccggtcctcagtaccgatcttcctcatcatcgctacatgaagagaaaagtatgtatattccctccacatctaaactgagtataagggttgttaattagaaaaaggtgatctcagtcatagaagtaaaaggatggctcagattaggtgaaattcacccaggaaaaaggatgtctctatgatgtacagatgctcatcatgttaacacttcactgaccgtaacatgtcaatcatgaattccgtgttgtcatctgaagaagcctaaaagagataaggtcttttaaaatggtaaaaagaacaataattgagagagtgaaggctagagtagacgctacacaccattttggaaaatgataactgatgttccaaacaaagttgcctcgcaatttccttaaaagcaaagtaacagaagcattagcatggctgcattggagttgataaagcatagaaacaactatggagttaactgaattggtggacaggagttaagagagagggagatctggttcagagagcatgtggaatacagaaattgaaccaaaaaagctggcatcagaaagctctaaccttcgtggcacagttgtcatcactatgtagcatcccattcagcctgatctgaaaaaagtttgcacaatgatccaactggactacaagttaacaaagtctaactaattgtgcattatgatatattgtccttttggctaggccatgcatttgagaatataaaaatatgaaaggaatttctacatttagccttgtccccttccgccctaaagcgccctgaaacaaactattttctcgtaacctgtgtttatttcacggccaacgtaggtaaatcattggtcgtgtattacgcaaatacatggatacatttctagcaacaagtaaagtcaggatattgcattaggatgctccttcttcagatcgtctagaaccatgtcgacccctgcgaagaattgaaatatcagtccaggccaaaacaacagatagcataaagtcgtagaccgcccactggcacatttcgtcgaacaccacccctgcattccagaaaactgctgaaaggggaagcagaaggaaaacctcacagccgcaggggccgaggagcaggacggagttgttgcaggcctcggagacggagctggcgacgaggtacttcagcttactgtgcccaacccagaacaaagcgcgtcaatcatgagggaggcgtctcgcgacgcggtcggcaggagggactgggcgccggctgcgcggtcagcggcgaggggcggcgccgccgtcgctggaggggggcacgagcgtcggaggcatatcgcgagttcgcgacgcggtcggtggggaggggagccgtcgcgctggtggcgaaacggaagggtggcagcaggggagagaggaggaggcgattagggtttgccggggggagtgcggcggcgcttgtggtggcaggggatgcgacggcgctgtaggttgggagagggaggcggagcgatttaggttggggaaggagagcgcgttgaagatggcaggaggagcgatctgagcggcgtgattttcggttgaggggagttggggaaatgcgcgcggaggttgagggggtacgtggaacgattctgtggcgttggattggatgattctcgtccgtagtatttgatgaatgagtatgtaggtgtaagaatgagttggtgaattatagggtagactagtaatttgcccgtgctaacgctacggttgcaatagtcaacccggcggcacaacgctactatagctgcacgcttgcctccatggagaaaataccctcaaattttcaatgcaaacgtaagcagcaataccaatatcaatatgtcatgtctcattgtattcacaaagtctcttttatataaaaaataattattttcgtgaatgcctttgaattttcaaatgtcttttgagttttggtagataatccagaaaagaaatgcattgctttctttcttaacaattgcatctacgaacttaacaaaaccagaggcatatttcaaggtcgcgtgcataccatccaccatgctcttcaggtgcttgggtttcgccacacaaacattatggtgcttacatgctgttaactttcctttcgatccgatggcatgaaaaattcagcaccagtaatcggtggtaaacagcagtcacaccggcacaagacaggcaagatgaaactcaaaacaatcgccatcctcaatattaattaatttgttcatttccattctgcttgcattacaccataatatggaacaaaatgaacagaaaagtcattggtcagacactcagacctatagtacaattgttgcactcaagaaaacgcctaaaactgctaaccaattaaataagaagaataaaatataacgaactgaaattctacccgggagcgctgatgccttcatgccgctggttttcagacttcatgatgttaagggagcagaaggaaacatagagtagccttgtctgatctataaactgagtgctttggtactttttaattagggctgaaaacgatgcctataaatgtgagttgtgacccaagatatgagatatatagaaaaatattaatacctgaagacgccaactattggaagacccttttgcattgcaatgtcacgtctcattagtaagacagctcgagcaccatcacttacttggctagcgtttcctatgggttaaaacaaacactaatcttgagaggtgaatacaactaatcaacagttgtgcctaacaaactttcattacacattaccagcagtaggggtgccatctttagagaatgcatgtttgagttttgactggactgccaatgaagtgcctggtctagatatattgactcaggactaaagtgtcttcaaatattctcagtaatacgcccagccttcaaattcagtagttttatttatggtgtaacatatatgctaggagtaaaatttttcatggttaaatgcatggtaattgtaatgttaagttggagtggcaatgttgagatcagccaaatggggaaaatgaacatcagtacccttcattggccatttgacattgagaagaatatgtgcaaaatatctggtcatatcaatcacacaaggaaaacagaaataccatatactgctacagtggtcagtcattatatttgtgttagatgtatttttcactaaataactaaatattgcatcttagagatactgcttttgctattgatccgaccactattttgttaatttcattgcattttaggcatggtatctcaattagcagaaaaagaaagatgttataacgcatcaatgagatcttctagagatgatatgatttttaattttgtactgatcatcatcaacatataaaatatattccccatcagttaaaattttccagactgctctattgatagaaccgcttagcaatttttaaatggtacgatacatagcttgcgtacgtagttcatgcacaggtaagtccaggcaatatcaatcaaatgcgcacaggaccaaatcaaggaaatactaagccaaacatcatggtaaaggagccaagaataccttgagctagcaaggtccgagcttcccttcgtgcatccctggcggtggacagtaagccgaggtggacaggtgaaaaaacagccaggagtcccacaggtcaggtgacctctgaaggagacaagggatatgttgattgtttctattattcatatgacaaatgttgaaaaaattcactcaaaggtaatattctaaatttggaggtaccgatgcaagaaaaaccactacttatgtggcataaaataaatttgtagaagctagaaggttaatttcagagcgaacaagatccgttcttgtaaacttgtactgatgcagtgatataaactctacgtccaatcaataatttaagtaacatgatggagaccatgtagatatcactcaaaatacaagacaagtatttcacaatagacaatcatatgcagacattcacgcacgacccaatcatccttttctaactttgcacaacgatagaagaaatgaaaggttttaagccatgataaataatcaaagctgtagaagcttccgttcaatgaagcatccatgtaactcaaaattatttatcatggagctaattagatagatgcatagaaggacagtaaacaagacttaagaaatgatgacatgtcattgcccaatgccctagacaggtctatgcaccttgttagcattttactaaacacatgcttgtattcataagggtactataagtataagtatatacattcatatgggtactataagatgtaatttaaggcatatatgtacattttcataatatatttaagaactccaaggcaagcattccatcaagcaggtcacaagcagtggcgcgtaaagccagttcccgtgtgttggccgggatgataatctattattctattgttcatcatgcctaaagcacaagggatgaagcaagcacaaaaggctaacattgtgctaagtactttacttatgttggtaattgcaagagatgagtagctatttaatgtgtagccatcctcaattagtgcacagattactcatgatgcaccaaaagttcagaaattcagagattactcatgatgcaccacaaattcaaagattactcatggtgcactaaaaattcagaaatggtcgtgagtttgaatgcatttgtgcataccgggtcagcaagccagtgcatccggggcacgaagcccaccatggcagagagcgcactctgccacacggcgaaggcggcgtcggtggtgagcccctggatgggcctgaacctgttgttgaggctgtcctccgcgttgatcgcgaaccgcacccgcgagcaattggtggagggagcaagggggggcgggcgctcaccgtggcgaggcggcggagaggtcagggcggtggagggtgagggcgagggcgaagatggtggtgatggcggcgacggcgagcaggcaggcggtgaatctgccggggggcgacgtgtggtgggtggcggagggggaggtacccgcagcggccggagccgtaccacctcctgtcagcaagttccagccgtggcgtcgcccgcgtctcccgtcggccgtctcccccgccaaacgccgccgtcctcacgccacctgccgccgtcgcccgctccgtcagctcaccggtcagttccggtgatgacgggccggatccagccacggaagggccagatccggcggcggcggatccgcagccacgcgccgcgaggccttcgcggcgcgctgtgccgcctccttgcgccggagacgagccgccgtcgggggttttggccccgccgccgccatcccagcgtccgcgtggtttccggcggcggcgaggcggtgagaggaggggtgggtggcggcggccgggggctag

SEQ ID NO: 66466 - DNA, 4453 bp, Oryza sativa
aggtggggtaatctgaggcgttggattggatgattttagaccattggatatgtgatatgatgaatgatgagtgagtaaaaggatttgttgaactatagggtactcacaaataataaaaaattctttaattgagtaccttatagttcaacaaatggttttactccttcatcattcatcgtatcacacatccaacgcacctcctcgctcaacacttatccaacggtcagactcatcgacgcgctcagcccctctatccccaaacgcgcgattctcctcattctcgcgattctcccaaaaaaaaaattccatcctcaccctcctcccgtctccaggtcgccgcccgcgccgatctgctctgtaccgatctctcccactggcattgccttcctcaccgatcttctccgctccgccaccgttcctcgccgccggaagccctcaccaccatcgcactccgtcgccttcgcgattcccaaccctaaccgccgtctccccgcaggtcgccgtcaatcgccgtcgccccgcaggtcaccatcgcaccgccgccacccggtcaccgtcgcgcctccttcggtctctctacatcgcgccgcagacggatttccccgccgacggggcgccgcccatgccatccggtctagcgcgacctccgccaaggagttcggtatgtccctctcaccactgatctgtacgtactctgtactaactaatgcagggaagagttttcatattattcgttttttttatttcagtttttactattagttgtcagtcaaattctgctttgtgcagactaataattttttccttgaaaatgtaatttgaaaatgagatggtatgatgtcatgatgatgggatttacaataaattgagcttcatgtttcatgggtttttatttatttgtatatttgcaatggagaagagaacatcgttgttaaattattttacaagcagttcgagtatatatatgaaaagagtattcactacaataactatatcataataatgttacttttatttgcagatgtgtgcccatattatttactcaatcatatgtagtcatttgtttactgaaatctaaatcaggtactagactttatacattggatgagctgcagttcaatggtatcgtcactgctgcttttctgactcctgtggatctgaatttgggtgtcagacgcccacccaaacggcatctgaatttgggtgtcggacgcccaaacagccagaccctaacaacagctgctagaaaggtctttgtttctcctcaactctcatcgtgtatatatgtttccctacctgattccatgttaaaaatgttactaagtctgaaccattaattttggtatgaatcgtgtgaattttgaagagaatagcatgtgcactgttaattctgttggacagaataaaacctagacttggttggtactataatctatccaacatattcagttattatgctctgtattgtagtgtagccaatttattcaattattcttctttgtactgtagtctagccaatttattcagttgtactatttccagaataggggtatctagggtatcaaattatttgattattctatgagctacatgctagaaccattatgttaagtggtatctctacatcgcgccgcagactgattccatcaccggccggtcgccgcccaatggttcacaaactctcaaaacatgctctcagatacgttgtacttattgtccttcaatatataaactcacaatggttgagtgctcaatatatcttatctaatttgggaacatactatttgattatcattcatataaagctggtagtatccccaggtatactaattgactttgttgtggatgggtgaataactgcagatcatcagcagatgtatcaacatggggaatctcgcctaatttctaccctggcacctcaagctgcatatcaatggcctttgataactatcaaggataagaatgtagtttagttttttgtgttcaggtatgaccaccctcgaaaaaaaaggtatcacaaatggttatgagatagtagagatttatgctcccatgagactaaatctctcataaggatgccgatttactgtaagtgaaaacaagctaaagtgcatggagagtatctatggaagtaatatgagcactgagtaggcgtctgcatcaaatcttacatttatttctatctacagttaaagaatgctaattaatctgtaatttgtcaacctcctaagctatatctcgtattattccttcctgtcattttactctgccaattacatttgcttttaccaattttttaaatcttccaacatgcacaatataggccctggtattttgctttttttacaggattcctgtaagataacatgattgcaatataccttgatcccgagagatgatttttgcaatgtttacccaactttatttgctgacactattaatatccttctggtaatggttaggtttcctgttattcattcgatgttataaaatttgtaacaaaagtgcataccaaaaggttattgttgctaatatatcctcaagaattagtgtgttacagacatctgtagatcattttttcttcgtggtctttgacgagcagatcatagtactcattatcggttatcaatggtttggcaattgcatatcaaacaagtatcctgtttacgattaaacatatggttgccactgaaatttcttcctaacattttagagggaacctgatcatgctatctcatcagaggatagagaagcggtcatgggcaattatgtgtttgccatttagcttatataactgctgtgtgtgcagtattgggtatttatcctttttatgtcttttgtgctgcagaatgagagcagctcagcaagcgattgttagagaagaataggatcgagccccgcaccaagtagaggtgtttgtaaaaagtggctagcagaataggaaaagaagattacaaagctgcttgacttgaatagccttgacttgtgaaaatttttcatgcttgatacataggaggcggcaaaagcgagtgcaaaaggaacctcgacaatacgggtgaaatggtgggctgcagctcttcaatttgttcatccaattaatatacataagcctgttctgtagcttcgatgaaattcgacggatccatatgtttcaatgtttcctcccctctgaattgattccgagaggtaattttcttaattcgccgatgtggtgcttttcaaaatacattatactcatacatatgaaaaattaaattggtctgcccatttaaatatgaatacaaataaatccttaaatacactaactatcgaatgcacgccataaaaaggattgtgaaaaaaactatttaattactgcatggaaaaaaagttctcacgtgacatgaatcacattgtagtgctttaaaataggggaattcgattaatgagaaacaaaatatattttttgtctgtcaaatatgtaaaaggaaaacgtgaaaatccatcttttaatataggcattggcgatagttattaaagataaatagagttacaccgtagcgtttagcacacgtaaaatagcaaggatacaaaaaatttaagtaattattaattcttttcgtatcatttgatttattgttaaatatacttttatgtatacatatagttttatatatttcacaaaagtttttgaataagatgaacggtcaaacatgtttaaaaaagttatcggcatcaaatatttagagatggatggagtataaaaatcctgtgacactaatatactccatggagtgacaacggtcctctttattacagaaccatcccacaccgttcatatcatgccaagttgacgacaaacgagagctggcactatcattcatcaattttgtaatagggcccgtgcacatctatctgacaaccattcaatattttgggctgttcaaatggtagacaaaataaaccaaattttgacaatttgataatattgttaaaattttagtaggatttcgtatgtactaaagtttggcaaaaactctaccaaaaagtgatatgatttgaaataacatcaatataaacaagcctttcaacgtattttttctcataaaaaactaatctaaaataaaatatgctatttttttaatatacttaaatttattgtactagtaaacgtcatatttcatcatagatcgttcttttatgggacggagggaataggagccgcctaaccaccaaccgacgtcccaccacatgttggaatgcatatgacagttgatcacaccgccgaagttgtacgtacggcggtagacaacgttgcgtgggggtcggccactcggctggacctatccgcgccgtcgatcgatcgtgtacgtacggcgccccactactcaccgcgcatagtactgtacacgtacgacgtatactactcctacctaagaccggtcgaactaatcggcaaaatacgacggcggcg

SEQ ID NO: 66467 - DNA, 6572 bp, Oryza sativa
  unsure (1)..(6572): unsure at all n locations
tcttgtagtttagaatgaacataatgctacagtatgccttgctgctcatgaactgattgacaaaatgtctctcaaggttatatctgaaattctgagcatgttaatttgtgtctcccagtaaggttctgtcatcttctgtcatccattagtgcccaatcaaagaacttgcatataataacatatattctattcttttaaaaaagcagaagctattatctgaagttcagctctcagtttcacagtaaatttacataattaacagtgcatgtaatttgtgggtactcttatataggaaaggaagatcagcacaatactgacgggtttctcttcaagatgatcccgtggttctcagttttctgctttctacactgtctacatcttatatgtgttcattgaagctacagattgatggacatagctgtcaaacctgaacctaccaggcctcctggtcatgtttctcctcagctctcatcacatttatatgttttcttacccaattccatacaaaaaattttaccaaggcagacccgttaattttggtatggatcatgtgaattttgaagagaatacgtacaccgttaatttattcatgcattctgctttatactatagtctacccaatttattcaattattctgctttgtactgtggtctagccattttattcatttttttcgcgttgccctccgctgtcgtccaggaccgtcgcccacggcgctggcgacgattcaccgccgacgtcatcgtccaacaccgtgacttggcccttcgtcctccatgtccaccgcgccctcgccgccattcataagaacaacattgcagcacccaatctgtggcaccccatcgacacatacgaccgcgtcgccctggctcatcgtggctaaccccaccgacgaggtaactagatttaccttttgcttttgttcgattgtttgacggccgagcaacagggatcgcgaccagtcggcaagctgactgttttggttaactgataagtgataactgaggaatttaaagctgtgtgtgcttgtcatgtgctttcgggtagctgttcttaaccactgccaaaagtttcggaaggtgatagaaccaaacaggtagttccttagctgcctgtgcagtgtgcagtgtgtctctggaccaaaggttgtaaatgttgcataaatgtttttttttaaaaaaaaatccagttgaggtactcttgggtccaaagccataaatgcataaataaggtccaaaggcactaatttccattgctagctttcttgtcacttagtttcattacatttgacatatacccagatgatttttgttcttgtttgtgtacaggttcagagttttttatgtaataattactctctttccatatatgcagtacatttttattacacgataacatcagtgttaatgttctatatggcattactatcattatttttcaacttatgtcatgcatatcattccatatcttttacttctcttttattatgaaaatgacatctttctgattcgttgagggcatgcggggtagtatatctgttattttaatatattcagtgttttcatcaatatattgaccaaatattcggtttatatcagtaaagggccatgttcttttcacaagatctgtttctgaatatacagactgtgttgcaacatttatagaattcaagttgtccgtagtcctgctttgcatgagtaaatgccaatcttatgtgtctgaactcttttcttctgtgtctgaactctcaagtgatgatctatgtttcccaaaaaatcttatgtctagcaaacttagtttctgtttccaaatgaaaaatcaagtagtgaataatgtacctgtattaaatgcactggtctcttatttagtaatgtatctagatacatatgctgaatttttatatatagaagcatatgttgcttttacacatgaaggtgtatatgctatcaggtttctataatatggttcataagtgaacagcatcaaatgtctacgttactttagtttgaatgtacacgctgatataaaatttagagagcattcttggaatgtacatactgttaagaaaatttagatgaattaaatccttatgccttatatgttttttctcacacagttgtaagtttgtttggagaaggggacattcacaaactgcttgaaagaggtgttttggtatctcaatatatggtggaatatttactactgcttttagtaactcctagataatctttttttacatacatgcataactaaatttgcatatatcttcatgtgcaattgcgctctctgatattacaatggtaggatttgtctttgaattggtatagtgacgtatttctgattcattaagggcaaactggggagtagaactgttatgtgcgagatattcagtttatatttctaaacttgggtgcactttgaatcaggacgaataggctcagttgaatctgtttttaggatgatgcttactggattgccaattttgaagttccattcagatcaaatattaatgatttatagattcaggtttgtctgaaaacgatataaaacaatatgctttgctgaacttaatactgggagatcactagggtggggtagacggccttcatggcgtctaggttctattgtggtccaacacatactctttttaccgatcctaatagatttggcataggtttatctacatctgactatgactactgtatattcctcaaaaatcctattagtatatgttttctgttctgactcgtctggttgtctcttatattaaaggtaaggaaattgaaggagttgtagctatccaaatacatcagcttctcaaaatagaagagctaaatatactagtaatatgcccgtgctaacgctacgtgtatgtttagtaatagaaatcatgacacatagtaaagaaaagataaagattaggaaaggagatgaaaattagattgaatacaaaaatttagggacggaatattcagtttttgttagcaataaataaataaattatgggccgtacgtgtggcttcagattgggccgctccaaaacccagactctggacggctccgtcacaagtcacgccgccgccgccgccgccgccgccgccgccctgcagctccgctcccccggtctctgcgcgtctgccccgacgctccgctggcccttccctcgcttgctcgacgccattgccttccggccactgcctcgtgccttggcctgttgcggctcgtcggcgccctccgccgtccgccacctccgtgcctgcggctccaacgccttcttcttgcgtgcggacgcctggagggcaggtaataacaaagctcttccttctcccagctcctctccaactccagtggtgctggtgctggtgctgtggcggtggctctcccacatgtgctccatttgatcttcttctcctctttttttttttttttgtcattgaaacatatagcttactgtatttaaagaaaatctctatacattgtagtgggacgggttcagcatcggcaattaatcgtgtctgatagaaattgaaggatgatgaagtttcatggttactttcctttattcatgttttcttctttggcaattatacattgccgactcccactgcttccagtgttgatagttacgccatataccgcttaagcccaacaaaaaaatgaaatcattatttatgttgtcaattaattttgaaaaactgttactatgaattattatgccagatttagattttattgctcaaaataaatgcttatggttaatcaatagtacagaccacagatagagagtagtacaagcaaatccaattatcaaaggtttccttaaaaagtggatttcagttgttctaaattgaaacaaggggacttgtaccaggacttcaagatttagatcgtaagaagtggaaccattcatgtttttatcttctttttttttccattgtgttctggttgttgtaaggttttcaaagaattgaatcaaaatggatgggacatggtatagtgagaaaagttgacacccttcaatggcttcgatttgtcttattagttgtagtattgaacttcgaattttttccacatactcctcatagatttaggaggcgttgatatgatataaagaacaatttagtttgcattcctggttgatttgaaatcattccactgttgcttctcatggttgatttgaactgcagtgtttgtgaatacaaaaggtacaaacagttgctcctttgttattattcttcctttctcattctctcgtgcgttctgacaatttggtaaacctatagtcatgtctatgtgtgcatctgttgcagctcaaactattttcatgttatacccccttatcacacataaatagtcaaaattttcctactagggctagtatttccgctgttgtcctgagattgacatttgaagtgaaatgatgaaatggacattcacagtcacatgctcaggtggataatttgtaagcatcgcaatgctttagtgctacatagaacaagctttgggcatgaatattgtcactgggagttgacaattgatcttgcatgatgttaggttgttaaaaccccaataatccagataagaaggattttacaggatggtaggatactacaaactacctttgattctgcaaccctgatggatagcatgcctattcccctttgtgatctttgacttattcttcctttacattacattggtttgcatgagattgatgtaatatgtatgatggcttttgctaattcagttatttttggtcatacagtgatgcaatggctgtttctttgaggattcattatgcataatggtattctactgcagctatgcttttgaacttgcctaaggcggtaaaaccaattggagaatggttcctttcaggtgcaagggcagcatgcattggtgtagatgtttatcctagtcactttgcatccctattgaaggaatgcaagtctgcaaatacagttcatcaaattcaccaacagataattgcttctggtcttctttctttgcccacaccattattgtcagtctcactaccagcattgccatccgaaccatttatatctccaagatctctgggtactggtgtcgtagcttcttatcttgcttgtggtgctaccgactatgctctcttggtgttggaacgtgttacaccgtcaccagctgtgtggtggaatctacttatccgagaacacatcaaacaaggccgccttgacagtgcaattaatgtctcttgccgcatgctgcgtgctggaactaggccggaccattttactctaccacatgtattaaaagcatgtggagagctaccttcataccgttgtggtagtgcattccatggattgatatgctgcaatggctttgagtccaatgtcttcatatgcaatgcgttggtggcaatgtattcccgttgtggttctttggaggaagccagcatgatctttgatgaaataactcagaggggtattgatgatgttatctcatggaactctattgtttcagcccatgttaaaagtagtaatgcttggactgcattggatctgttttcaaagatgacattgattgtccatgagaagcctacaaatgaaaggtcagacatcattagcattgtcaacatactccctgcatgtggttctctaaaggcagtacctcaaactaaagaagtccatggtaatgctattcgtaatggcacatttccagatgtttttgttggtaatgccctgattgatgcttacgctaagtgtggtttgatggaaaacgcggtaaaggttttcaacatgatggaattcaaagatgtggtttcttggaacgcaatggtggctgggtactcccaaagtggcaactttgaggcagcctttgagcttttcaagaacatgcgcaaggaaaatatcccattagatgtggtaacatggactgctgtaattgcaggctattctcagaggggatgcagccatgaagcactcaatttattccgtcaaatgatattttctgggtccttgccaaattgtgtcacaatcatctctgtgttgtctgcctgcgcttctttgggagcattttctcagggtacggaaattcatgcctactctctaaagaactgtcttctaaccttggataatgattttggtggtgaggatgaggatcttatggtgtacaacgcgctaatagatatgtactcaaagtgcagaagcttcaaagctgcacgctccatatttgatgatatacctctagaggaacgcaatgttgtcacctggactgtcatgatcggggggcatgcacaatatggggactcaaatgatgccctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 66468 - DNA, 2295 bp, Oryza sativa
catatgcgcgggcttcctttctagttataaaaattagagatgattatgtactcacaccctcttcttccatcctcttcgtccatcattcaagtcaccattggatcgggcgatacaaaataaactgagtgatttattggtacatcatctgactcccctgcttgccctcgtcgttagctttcgcttttgcaccgttaggcgttgcacacatccaattcaagagtgtgttcgtcttcgcgtccgcctgtggttctcacatgttcacgtccgtggtccgcctacgaatcgttcgtatgtgtcgccttggaaaaggaggggaacttcaatttctcagcaaactttatagatggaagaggtgcccggctgccaacacaagtgggctggttgaggcggcagcatcctcactgatggttgttcccataggcggagacagagaggcaaacggtggcgtgtaagcgtagtctgcggtggctgtgcgcgagagatcgggagctacagggtgaaccaaataagaccaaatccaagcagtagaaaggaggaagagctagatccaacaaaaccaacctcatctagctgcaccaagctcattgaccaagacctcattgaatggatggtggtggattttgccggacaacaactcatgatgtcgttaacccggagcaccgcgcccatcttccccctcttttgtttctggccttcaactagggaaaacgatgaacagttgtcgatggggaatacccacagaccgtattctgaaggtattagggcatgttgattcgaggatccacacaataccacatcaaacacatattcccaacttctctccctcattttccgcgcgcacacttttcaaactgctaaacggtgtgttgtttgcaaaaaaaaaaaaattctatacgaaagtttcttaaaaaaatcatattaatccttttttaaaaaaaagcaaatacttaattaatcacctgctaatcgctgctccgttttccgtgcctcccgaacgcaaccataggttatactaattcaagcccctcgtaaggtaatagccctaacccagtttatagaggattacgaagaaaaccacatagtacaattgtcacgtacagaaattcatgaaccataattctaatgtgcattaaaacccttgtctagaaccggccaaggtacacacaacaaagttgatatacaaattcacatcttacaaacatattgaagtcttacatatgcaatgaaactaaaagcgagctaaactttgtgatcacaaatcacaataactctgattttaggaaatcacttgaaaatgataaacataacactctcaaaaccatatcaccactgacttagttaagcttttcaataacacgcaaaatgagataaatcattagcacatgaataattaagtattaattattaaaaagttctaaaataattaagtgcacactactttcatcaccatccttttagttgaacaaatgaccatgtgtttgtggtctccctatagttcaacaaatccttttactcattcatcattcatcatatcacatatccaatggtctaaaatcatccaatccaacgcctcagattaccccacctctccccctcctctccttcccgcacctgaaatggcgaaatcacgccgcatccaccgtcctgtgtctcgctcttccctcctctttctcccgcatctcccacgcatttcctcctcgcgctctctcgcccccgcaccgtcgtgcactcgtgcgccggatttttcacagaatcgacgcgctcctcctccgcagtccgcaccaccatcgtgccgcgcgcctctccctaccgcgaaaaaacgccgcgctggtgcccaccatcgtcaccgccgcccatcgctctccaccgcgcccccattgcgcctgacgcgaaggaggagcccgaggaggaagaagaagaacaatgaggctgacgccgacgcctgcaggcaaagaagacgaccgagaccttcttgtataagggaacaccgaagaagtcgtccacgcgcgggcgaccgggggcgaaccctagtggtctccctatagttgaacaaatggttttattcgttcatcattcatcatatcacacatccaacgatggaaaacgatcagatgagcggcatccgacggctccccactgcctcatcctgatcgcgtctctcccccacgccactcccggatcagcctccacagatcgcgcctctacgccccctcctctcccatccgaggaaccgccgcgagcccgcgatcccgtttccccgccctctgtcggcagcacccccctcccccccggggc

SEQ ID NO: 66469 - DNA, 4670 bp, Oryza sativa
ataaaaaaaagttattatctgcgcgtgtgagaaagagatagcaggcctgatctttgtcaagtagaaaaatgctaactgtctcaccattagtgcagagtgtttgatctgcaactaattcttgaagtacggtgattctcagaccttcgagctaaactactgaagaaccgaactctaattgtgagtacctgtttaatttttgtctgaagatacaaatttgttcgaaagtgactgaaagagacataaaattcaaaataaaaatgaatctaatctttttgatatattttcctctgttgcactatagcatccatcagtgccattgagttcagtttcatgttaaaattaattagtatatagtgttgttggttcagctgaattgccaaaatataggatgccatcagtattttattttttaagctctcccgctgatttggtttcatttcatttaggtcgatactgtgctaaatttattccaaatcaaaattagatcttccccatcaccaccactctccatcagtctcatcctgctctctgctctctccaaggtgagtattggaaaccttgtcccgtggttatttcagaaatggagaatttcgttcagctgatgaattatcccttgatcatggccattataaatgaaataaatgcttaattgcactatctacatgatataacttctataattggattttgcttttctgaatttccattatgacacaaaaggtatgccagtataaaggctgtctgtttcagtggaagaaacagagaatgattaggatgggtgcaatggttatgtttgctttttgctaaacgtctgaggtttgcaacaatagcaattcttggctcatacttttttccctcacaatattccaaactgttaatattgcatgacggattcatttgttttgagttctaattagtgaactgtacttgaatagtttatactactgagaaattaaggtacgggcatgaatgataagtagttgtgagttgtgaattgaagaggtgaagtggagaccatcagatttattttggtcctttatatttttaatattgtcatgcatctgtgatcagtttccggggtttagattcattatgttctatatcatggttaattattctatgggtcttccgaaacatggcacattgccacacatcctatgttgtgttctatatgttatcaatgagcactgtggatatactattttggaaactgctttgtgattttcacttctatatatgtgtgatatctatactgattcgtttagttgtctcctacatacaagggacaaggtggacggggagctgaagctgtgtcaccttctctccagttgcatcggcggataaaattgtgagggcaagaaaaatatttgtactcttttcaaattagtaaattaatgcttgcaggaataattttgaaaatttaggagtactacttgtaaataaatggaatagcaaaaaaatggtagataacccttttaaatgatagaagagtattaccacgcaggtcgtcactacgacacaattagcaatataagatcattttcggcctcttctaatttgcagaagagatgacatttagcccattcacacctttgcatttgtgaccaaataattaagaggcctgaagcataggaagatttcaatagttgcattgcgtaaaactctcctgaaactaaaagtgatgtgttgctgatctcgctttatatgccgtgcagatcctactgaatccattgatttccaagagttctgcaataagaggtaaaaagaaaagttattatcagaggcatgagtataataaataaagctcctcaacaaaactggaatgaacaatctgtgctatttatctcgtaaatttctgaacttgctatgagtagtagctgtggatgccattcatttttacatctctctttgaatatgctgtgtattttcgtggaaacataatattatagacttttgtactcctcaacttcacttcgttagtgattcatggtaaaatcttggtatcattagagctgcttatggttacagcatcaagttatgattttctccgttgtcaaattgattgcacagtgattttgactacaaccatagctgatgcaattaatgggtataacaacgtagtataatctctgaggaaaagtaatgcagtttgttgtcagtatatgcactactgaatttgggattatgcagcacgtcaacagcaggtattcttattggtcgatttaatttgttatagcaaggcaaggagtcgcggacctgaccatgaccattttttaagtacatttgcacaaaattgagaagcacatgtacccattgatgtataaataagaggttcgtagctcaatccatatgaatatactttcttgaagaagtttcataagtataacgatttttcttccaccaaggagatttataatgtaaatctaatttgcatcttctgctagagagcttcctccagtagatgagatttacagaatgtccagcacagcgagcctgtcatgggtcgacgagctgcttcagtgcttctatccttcagcatgcagcaagttagatgtcgatccttggtgagcattgaccatgcttcttttttcttgttttggttagattaattcaaattgttggtactcatatatatagcattttgttctggtggacgtgtgcaggcaagctatttgttgtagtccttgcaagataaatttattactgtgtgttttctattcctgttattgaacatggtggaatcaatggtaatttcagactcagtactatgctggtgctcagcaatcaaaatcattgccacgattaagtgcgtatgttattttctgctggagattaatatgttttaaactaggaatgtttaatatgtctaccatgattaatatgtctgccttccaaataatttactctacgagctccaaacaaataactttgcatgataaaattgctatagtcatcatttcttatattttgtttactcaagtatggaagtgcttccatatcatacttatgaaatgtttatctcatgaataacttgaaagaatcttatggcatgacagtttctaagctatttattgtattttgttatttgtccagctgagtcgaaaagcatgatcaaggaacatctacagaatcaattgtattatgcagtttaaacataatattttgtcctgtgatatagaggaacatttttctcctctaagggctctatgtatttggtcttctattttgactaattggagatccttttgcatttcctttagggcacaataaaatcacatgacataagcaccagagagatgatgacctttttggcacgggggtaccaaccaaaaagtgttgggttgattgtcgaagctgtccagtgtctctataccataggtgagaaagaaatatggatttgcccttttgcatggtttcgaaagatggaaaatttgggatgttatttttagccatgtggctatgtaattaataatgtaataactcgtgatatcattcttttctttaatattaatcatatctcattttatttttgattgttgaaacatatatattctttttattgtttactttacattattaaatgatttcgttgtgttagcacgggcaaatgattcagtttcatgcatagacggtagacctattaatttctaattttctattttgcttaatacaagttatttttaaatcagctccaaattcatagtatagtgtacaataatatgtaatattttaacttgtacttcataccatgatgtactcacgtaaataaagacactcttcctgtcgatatgaatgcagtccggtcatcaagaagttccaaatgtaagggcagtacgcagtcgtcattgcgtttcaatttatttagatctgtcaaccgcttaaccataataatttctttggataattattattttgtcatatgtaaaattatgaaaataaatgatgtgagttggcgtggaactggatgtcaatttaatttagttaattctggtcaagatttattatgcccatgcaatatcatatttttgaactttgtgtggaatatatttgatgtacgacataaattgaactaaagcttaatgacatagatcatataatttttttttgctaaaatgaaatttcaagttactaaagacaatagaattgcaccgtagcgtttagcacgggcatattactagtaaaaaaaagacaccgtttatcggttcgacaaatatccgtgaagaaaacgagcgatgaaaaagaacaccgaagccaccgatcgaaatagccattttcattagccgctccgcgtacacatacataatagagaaaagtacagtacagggcaaccaggagataatcgatacagttcgttcgtactggcagccaatttgaccacaacctgctcaagaatgcttcctctcccatttcccttctcgacgctccctgcgttctactacaacctgccttgaggttgaggttgaggttgaggacgacgacttgctgccccgagaaggagtatgcctcgtgccagcttccaaagccgccgctgattctggatctccgacgctgctggcgtcaccacttccctcagcattctcctcataataatttcctcctgtgctagtacgctcgtcactcgtagtacgctctcgaggttgctgcagtattgtgggaaggttgcctgaaaa

SEQ ID NO: 66470 - DNA, 1473 bp, Oryza sativa
gggttaacagccaacccagtaagtaaagaaagagccaatgggtcctgatcataaccatgaaggatatcttgcaaccagactggagaacaagttgagattcctaaaaattcagaggtttcctcaggaacatgtcgagacaatgcatcagcagcagcattatgtttacccttcctgtaaacaatctgaaattgtaatcccgaaagcttggtaaatgctttctgctgccaaggggtgtggagccgctgttcagtgaggtgcatcaagctatgatggtctgtaatgatcaagaattcttgaaactgcaaatatggccgccaatgatcaactgccatcatgattgctaaacattctttctcataagtggaaagaccttgagttctaggaccaagagccttactaacaaaagcaacagggtgctgattttgagataaaacagcccctatgccaatgtcactagcatctgtttcaatggtgaaaccttgctggaagttagggagagccaatactggagttgaagtaagggcatgttttaaagcttgaaaagcttggttcacttcagctgaccaaacaaaaggggcatccttcttgagcaactgtgtcaagggtttgctgagagtaccaaaatctttaacaaatttcctataatatccggccaaccccaaaaaacccctgagtttcttgagtgtagtaggtactgcccaatcaacaatgctttgtatcttagaaggatcagttgagactccttgaccactgataatatgccccaaataagaaatctgagtttgagcaaagtcacacttactcagtttaaccttccactgatgagtgtctaacaactgcagaacttgtttgaggtggtctagatgagaattcatatcagggctatatatcaaaatatcatcaaaaaagaccagggcacatttccttaacaagggtctcaaggtatcattcatagcaccttgaaacgtagcaggggctccagtgagaccgaatgacatgactttatactcatagtgaccactgtgtgtttgaaaggcagttttaaattcttcaccctcagccattctaatttggtgatatccagctcgtaaatccaatttagaaaaaatcttagctccagctaattcatccagtaactcatcaattattggcattgggtaggttcccttcttagtaatggcattcaactgtctgtaatcgatacatactctccaagagccatccttctttttaaccaatagggcaggagaagagaagggactggaactatgttgtataatgccattctgcaacatttctttaacttgtctttcgatttcatccttttgagctggggtatgacgatatggacgaatgaacactgccttggatccaggaagtaaggaatcttgtgatcacacaacctcttaggtggtaattcagtaggttcctgaaagacagactgaaactcatccagtagtggctgcacatgtg

SEQ ID NO: 66471 - DNA, 1672 bp, Oryza sativa
gtttcgctacttgggtttgtagcatatccacagtggactgaaggacatccaccttcttctccaccgcagggatccacgattctaccgcctccttgaagaccctcatctccaaactctgcttcttctcaccctcctctcgcttgcgctctgtctcctccattttcttcaacagaaggtcaagcttagcctcattctccatgattttggccgtctgcttcgtcacaaatcgtggtttctccagggtttcagatcaagtgatcaactcttcccgaattccaccaactcaagcaaggcaaggctgggtagccttttcgcggattcactcaagagcgatccaatccttgcccaagaattttacagcggaatcaaggatttccgaggatcacgaagctctgataccaagttgttaggattctctcgcaatctctcgatcagctcactcaagaacaagaattatcgatacgatcaacgagatcgcatcgcctccgccgccaacgccgccgttcgattgatctccaaagatacctttctgttcttacaagttttgtttatattcaacacactctctctcactggttgctgggtcccagccaggctgtcgacagagccatagccagctattacttacaagcccattcaggcccactcagacgaacattagacttcttaattctagtagctcgcttcagcggcctagtaattgtgttctcctgtgcttagtcagacaacggcaactccctggaagcagtattgctgctgacagacatgtacaaaattctactgaagctacttccctttgtcgtgctatggtatcaactcaaccacagaactgatttttaagatattaaaataacttttaggtatgagagagagagagagagagcactacacttttagcatcagattcccttcttagttgacacagtgctcggcagagatctttctccatatcaccaaagcatcctagtaacacatacaaaagttatatgcatggttaattggtcgaaaggcgaggcggcaggagcgatagaaagaggagccagtgcgcggtgattttgcccgggggaggggaagcgatccgcgatctggatcggatcgggagggagcaggggagccgtcggatttaagtcatcagatggattttggatcgttggatgtgtgacatgatgaatgatgaatgagtaaaattttgataactttactttaaaaaaaatagtatggttaaaaatgatatcaaagtggacagaccataaatttacgatatacttgtactcagtacaaagtagtactattatacttgctgtgggtgatgtagcgcgtcacccgcccgcccacccgaccggaagaacccacttgggaatagcgaaaacgaaaattccgtggtcgctgatactaccacatcttgccgaactcgagcgcgtgcgttcccaccaccacacctgggcgatcgatcgatcgctacagcgatccacgcagcacagccagccgcctgagccgcggacgcacgcaggcgcaggacgtacgggtagtggtccgctcgatcggtcccgcgagtcgcggcgcatcgctggtcgcggtcggcgagtacgaacgtactccgtatacgtacgggtacgcccgcgggggcaaggagtctcggctgtcacacacacccggtctccaattctatggt

SEQ ID NO: 66472 - DNA, 849 bp, Oryza sativa
cccacaaacatggtttgaaacagcaggagcatgatctcaaatggaacaaacatggtagaatacctccttaagatataagtatccataaatcaaagcaaacatggtaatttgtgaatactagatatcactcaatcttaataaacaccctacccaacatttacatctaaacatgttatggatcacaacctccatgacacaaattttggtcctgtgaacatatatttttcctccttttttcctaatagagtcaaaatgccacgtttcaatctggaaagctccactcctacatccaccacacaaacggttcacagtccataaaagaagtttctaatctggtggcagtgctggaaacttgcatatgatgccaatcttatgatctgcattgtgctgtacttcatactcgataacccctatctacattcatcgccgtccagaaagctaacctatggcgcaaaactgtggcacttttttgtacaattgtgccgagagaaattgaacaaccattaaagcacattatgcacatacaaacatctattcctaatttaagagggttgtggtatccaggagtttcacattttgcagcgcaatgctcattccacaaaccttaaaacctaacatcagagcaacaaatataaagcggaagtgagacacagggcaaaggcgagacgcaccatggagggtcgtgcgggccggcgccgcactggtggaaggcgaggatggcgcgcacgcggaggccgtagcggcgcgccatggcggcgagctcgaggtaccccgcccagtcgtacaccccgggcccctgccgctccacgaccccccaccacagctcgaccgccaccccggccacccctg

SEQ ID NO: 66473 - DNA, 2079 bp, Oryza sativa
ccgccattggtggtggtgagctttgcttctcctccgctgttctctcagctctgctgctgaattactactttctctgaattgagaaaaatggacggtcacaagcttctctgaactcgcgtagcagtgtcaccgtccatcgcagaaaactcagttggatgtacgcgcagcagcagggattcaccggccccatctttacgctaattcttatacatatcagccaaaattttaatttttaatttttaatttagagctgattttaggtttttttaatcaaagtttattttccagcttttacttttagagtaataaaaacatgtatattttttttagataatagaaatgtgttacatctccggcctctgcccgtaggcacgtgaatagaaaagagcttaaaaaaaggcgagatgggacaaacccccaacttctgccaataatatgatctactaaaatcatgtttttttaaaatcatatagattctatcacgaaattctgtagttactacaccatccaaactggagtaaaaattccttggctaccaattccaagtgtgtagcaccattgcgcgtagtatcctgttattccggtgaaagcatcatacaccaagagtggagccaattggaacacatgaagataacctgcatgatgttaggcatttttttatggttaaaaaccatatcattacggcaacgccaaattgaccaacatagagcactagctccaaataaaatcattttttttgtgggtctaggcactccccttagccagttaccaaaaatatcttttgcattgtggggagggggaatattgaaggcaaagaagacacatcgccaagcaaaacgtgcaacatgacagtcaaagaaaagatgttggatgatctcttgtgtattacaaaaacaatattgcttgtttcccctctattttctctttatgaggtcatctttcatcaagattactttttttgaagaaaccacataaatacttttatttttagtagtacctttacctcccataagatcctcttgtggattcttacattggaattgatgatcgcattatacatggatttgaccgaaaaatagccatttttatgtagcgaccaaataaagcaatctttttcatttgacagggttatattagctagtcgagaaatcaaatcattccactcaactaactttggtcctacaattgatcatcggaatgaaacatttaacggtgttgtgctcataacctctgccaaagtagaatgtctctttcgaaccacattgtacagagaaggatattgatatttgagtggttgcaagcctaaccatgtgtcttcccaaaatcttatttccatcccattaccaggtttaaaagatccatactgaaaaaattgatcttttcctttcattaagccagcccaaatttggaatgttcctggtttgtgtgacatgtgggagaggggtttaccttttaagtacttgttgcgtaaaaggttttgccatatgccatcaccattaagaagcttgaatagccatttgctcaacatacatctattcatgatatcaagatttaggatacccagtccaccttgatcttttggccggcatatataatcccattttgttaacctatatttctttttctggctatcacttctccataaaaagctcgatcggtagtaatccagtctttgaagtacacctcgaggtatttcaaaaaaaggataacatgaacatgggaaggctcgaaagaatcgagtaagaagaaccaatctcccaccataggagtatgtatataaagttttattcataaattaatttccattcgagaatatgccgtttggcttattccaccaaacaaccaaacgatggggctgcacgttttccgaccaaaaccagctgaaaaccatgagatttcgaggttctgatgcggaacgaatttaaatgtatgataaaaccactctgtaccgagttaggggataattcgtttgggttgaagggtctgatgtttaaaatatctggctttatagtttatgggtgtaattagtactgttacagtaatttagagagataattcacacttttgggctgcaggaat

SEQ ID NO: 66474 - DNA, 1129 bp, Oryza sativa
  unsure (1)..(1129): unsure at all n locations
ataagtcatgcttaaagttccttaacggtaaaataggtcacagcaaaataaacgatatttacaaaaatgttttgaatacgacgaatggtcaaacgtcatgtcaaaagtcaaaggtgtcttctattaaaaaacggagggagtatgtgtttaccttgctttgtttgacaatttggctgggaaccaaatttggttacccatgagtgtgacattccacaagatctgttcttgccttcttggttttcggtgccatatgtgtcacccctttttctgagaataagtaatttaaagttggtgtcagaagtgttttatagtcaccactagagtaggaaaattgttgatggttgaagatatgtcatgatgcattggtattgtaacatggtaaacaagtatgattgggaagaaaatagcttgtatactactatatacaagttttatgattttccttaccattgtggtctttactttgtagggcatgcaggttgttggtgatccaatttcattgcctgatatcccaggaatggcgcatagaggaatgggtggatttcctgggtttgtttcttgtcttggcttgaatatgtttatctgttgatcaacagcaatgaaaacatcatgtttttgattgtattgcaggcctggtcagccatctatcgtatcaaccataactgcagatgtcatggtcccaaaattagttttaccttctctatgtggggaagatggaggctgtttaaacagaattcgtgaggtttgtattcggctagtgcattttgtagcatatccagtaaatggttggatgtatcatctgacataattaaggccatgtgcagttttcaggggctaagataactgtcgncagnaaatcccgnaantgggtanantngnccanantggngggnaaaccnaactgctattttgatatccggcacaccagaccagatgcatgcagcccgaagtcttattcaagcatttgtcctaagtgaaccactanccccctgatnttnnnnnntncctgggnggnnngggggggnagctggnngagnnnctnntgatnatnattgtntctgcaatcaaactagtgaccttatgtgttcatatttatgaatatgcgtgccctgtttgcagacttgcatat

SEQ ID NO: 66475 - DNA, 910 bp, Oryza sativa
acagtggtgcatgggtccagacacatcagttcaggttgtgcttcacatgacattcatgttgggttattgatgtcactgctttggtatctttgatcttttgtcagtcaaacgaagtacttttactgtctggtccaagccattgtgagtcaatcaccatgcgtgatacctatgaatacatgactgcagtaaatcaattgttgccagttgcctgattgatgtaatttgtaaaagcgaaacttagctgaaatatgtggttttcttaacctctgggccacattttgccaagaattttgatcaacagttgatttggatgcttagttcgcacacttggtggtaatattgaactcagaactagtatatattgtctactaagacaaaagctattacatatagactgtgaagccaccgtgatcatgtcagaattttgttacatgttcgcttcataattgttttcaaatctttccatgttagccttttgcatttgctatgtagtatatacagccaagctactcatcgttccttgttcccagatagttatatacaagtgtgggcttgatggctattgtattcatgcaaaagatcttcccattgctcattgttgaaatttcacttcacctgctttcaggatccctctacctcaatgggtacttgaggagatggataagttgccagacttgtcatatatggatagataccaacgaagaaataaagaatacatctcactcgggtgtgatattcttccgattctgaagggaagatcaccaatgcaggcttattcagacttcatgaggagctttcgagatgcttttaaagagtaccttggggctatagtgacagtttgtgctctttcttggtatttaagcatgtcatgttaaatttacagcaccagtaggttgtaagccttatataa

SEQ ID NO: 66476 - DNA, 2332 bp, Oryza sativa
ccaatactcttttgccatctagcatcaaaagataggactgatcaccatattctgttttatgtggacagttcatgcaagcatccctgagtgctcgtgcacaacttattggcatgcaagattggggaaacggtggtccagccggcacagatggctcacgacagaaccctgaagaaactagttttttccgtgctgatggtggatgctggaatactccttatggtcggtttttccttgagtggtattcaggaatgctgcttcttcatggagagagattatgtatggttgctgatgctgtcttctctggttccggtgtgaccatcgccggaaaggtttctggaatacattggcactactatacatgttcgcacccatcggaactgactgctggttactacaacacattgttgaggaacggttatcttcctatcacccaaatgtttgctagatacaaggctgccttgtgctgcagttgctttgacctgagggatgaggagagaaataactccaagagcagcccagaaggtactctccggcaacttatggtcgccgccaagatgtgcaatctacctctgaacggcgaaaactccgtgacaaggctcgacgatacgtcgctgaatcaagtcatcagaagctcaaggctctactcaggtggcacctcagggacatctttctccttcaactatgtcagaatgaacaagagcctgtttgagtttcacaactggaacaggttcaccaagttcgtcaggcagatgtcggatgccaggacatttctagccaggctcgagttcaggagagggcagcattacctctcctcgatgtcggttgtctgggtcgtcagccgggcctgtgcatagacatgaatcagaattggcaaagtgactgctagaaatgtagtgttgttcgtgtatctgtaacttggatcatgaatgtgattcgacagaattggaagagaactttgtgctcagccataccgtgatgatctggtttctacatgtgtgcttgtgatctgttgttagcttaacagctgttcaaggtcgagcagctgggctgggctgggctggatgtaaaatccacccacaaggccacaaggccacaggtcggatggcccagccataacccgagatgcgaagcccaacaggaaaaggataagggtgtggcatgtggcccatccaaattgggttgggagagggttccggcctacgtgcggcccgtataggttgggctggaactgtagagcgggccctggaagtgatgagactaacagctgccatttgttccaatgtgaaattccctgatgcaatcatgcaacaatggaactgccgctcgtaaatctaaatgaactgagatgtttgcatttgattgcttgtctagctgtaccgaaaattctgtatttgcagtattgcacagcatatgtgaactccttgggctgatacatcatacatgtagttgataggttacacaactacggttgagtgctagtagtacccaataagtatggccgtatgcatcaatgtacgacttaacatttccaccagatcccaaaccttttttaaagaaattggtccaaggttccatagcgcttacagggtagatcattataattcacatgcggcattagcattgggccacagatgatgccactgctaccgatatcttagttcctcatggtggtacaaaacattgtctggcccaagcaatttttggtagatgaatatggtgaatactgaagctctttttttttccacgaatactgaagctcattgatcgtacatataccggtaatctactcttcaatattcctatcttttttcttaccagacatgtgggcgacttgcatttatgcaaaagatgtcaaaaccatgatggttatttgagatggttaacgatgacaggcttatcatcgagggaaagataccaatgaagaaactagagattcatctcactagagttttatcagtaatatggctgaacatccaaaaaaaaaaaactattctactggagaagtcattcatctctactctgtatccctgaatgtgactaaatattttaccggataatgtacaactgtaattgaattttggacggcaactactctctgacaatagtttaaaaattgggggaaaaagttcatataatgctcttagttttttcctagagaaaatgcagctgcaaataaaatgaataacccaactgagcctccaaaatcttaaaaacttgggaaattaaaactgaaaaagaaataatgtgcctccaaactaatcgacttctggacagcgaagatattagtattacaccaattaacctttgtaacttgaacatcagaattttccag

SEQ ID NO: 66477 - DNA, 1029 bp, Oryza sativa
aaagtttgcagagctcagtgaatatacaaccataaaagcacctagtgatggcatcaaggttattaacaaaataaaaacaaaaataagatcccgaatgtcaactatatcaaaaacatagttccataataaataaaacaaaaaagcagatgcattatgcatacaaaatagaagcgcatatctgcaagctacatttcagtctaaaatgaataaatacaggtagatagcaaaataacattctcctttcaagggtacacagggaattttctcttttcatttccatgtgcatacttcactggttcactagatacaagtatacaaccccacgcataccacataaacagattcattgacccatgcacatatgcgtgagccagtactatttgcagcatgtcatgcatcgctcctacaaaattgagaaaacagtggtgtgccacaaacccattccttgacctaatcaaaccgtgttcttagtaactatgttcctgcactagccaggactaaattgtcatgtattggaagcaaacattaattcatgcgtttaatgtggcaatagtagagtgggaaatatgtcagaaagagtgggacataaaaggaagagaaatatgagctcaaatactagtcataccaccaaggctttttgctgcattttttaggcttcctgagaaatattgctgaagaacatctaagctgattgttttttcagcttttcctcgtctcctttcagggggtttattacttttgtgaagcgaatcagaagcaccactaccatttggcctgccaacagatgccccattgttttgagagttgtcatcagctagcaaatgtctctctgacatgattgaaactttgttgccatcattatcaacctcgtggactctttggcttccattactttcaggcgattcacgaaagcaaccttcagaattctcaaagtgcacatttgtcttcaaatcttcagtctcaattattagccattacttatttgcagacaaacttcattggtgtctccgttgccaactacctttaggg

SEQ ID NO: 66478 - DNA, 5011 bp, Oryza sativa
attcctgcagcccggatggtccaatatctcagtgcttttgagatttactgcctgcaggtagcacaagaaaatgtaagatataactagattagaaaaaacttatgctacagatggttaatacagctgctagttaacgatataatgtccacatatccaaccagacaaccagtatccaagcaaaaatgtatacagcaggcagacaaaagactaacctcaagagctttgcagactttatcaacctcaccagcatagttgatcttctttgatgtcattataagttcaacaaccgcaatacaattttgaacagaaggatcaaaaacaggcaaggctacagtaccatgaacattgtaactgattgcatggttaaggcgtgggtactcagtactgctataatactgcacattcggtgtccactcaggaaccttttgtttgtacacacgcccaggtagccccagctctccagcattttctccatccaccgagaacatgtacatcatggatacagccctgtactgaagaagcccaatactctgctggtcaagtacaaagggctgtcctgaagtagtaagcacataccggtctccactcttaaccggtgcccaaacttgaaccagcagatgctgatctgtggactccttgaagtatctaagagcctgtgtaagcctctccttaaacaagcatgagctgtccgtgttatcatcaatagataggtgaaactgccatttgctattaatctgatcaaccctcttactagtcgtgtcagaattccctaaataacagaaaagcatgcaatactatcaggaaaagaaggcaaaaagtatataaaagaagaagggataataacattgctaattgaatggataataagcttcactacgcctgaccattcgttccaaacctagagctattgcgacaaacaaatccatgtttcagtaatgatacactatgtttcttatcaagtttgataactgtaattgcttcatgttatttttcaatgaagtgaagcgaatcaacaatgctgcaaatcccatcaccgatccaaaaccatttcttgagtcaccaattaatgaaatggagtagtcctaaattgtcctggtattaaatactagtataatataatgagacaagcaaagcgttatccaactgcttcaactatacaatctagctagtactgtccatggcgtcataatccaccacttaatccacgctttagaggcaccacaccattagagacacacaggaaagcagtgctatgcattgctataaagtaaaatgagtcaggcaacaatagcacttcaaaagggtcatcttttttttgtatgcacagttaatttagtacagcaaatactccccctacctcctatagtggaatccaattaaccatcaaccgatcttggcaatcatttgcattaaaaaaacgcgcactaccaccacgaagtcagacagaaagaaacataaaaattaacacataaaaactagtagatagaaagaaagcacacaaattaaacaaaacgagcatatcattgaaacaaaacacataccaactaactttacaacattttatccattctgttgcaagagcgagtgcaaagattctgtcttgttccataaatcaacagggcaaatctttatacagccaagaaatatgccaaaaagaaggcaaggaagtcaaacataaagctcggaaacttcatggatcatgcactggaggtaaaaggttagcgtcccaacgacaggaataacagcaagattccagctgcccctctgcttcaactttggagcagccagaaagattcccaaggaacgaacaaatctacaaacccgagccaaagatgagaacaaaatcccagtgaaggtcaatttcgatctttcttttttctcccttattcgttccaaattgtatgatccagcaacaagaaaagaaacgcacgaccaatacgaagcaaggaggctcaccggagcgggtccgatggacttcctcgaccacggcggcggcctcggcgggcggagcggtggcgggggcagcgggggcgcccatgtcgagcgggagcagctggcgctcgtcgaacagccacagcggcgagggcggcgtgagccacgacgacgacgaggccggcagcggctgcggtgaggccgacaccgacgagaacagcagcgacgtggtgagcgagtcgaacggccacaaatccccacccccgccgccgattcctcctcctcctccttcccccgcgcccggcaaagacgacgatgggtcaacctccatccttaatcctctctctctctctctctctctctctatctatctatcttctccttcgcttccacccaagaacctcacttcactcagaccgcgctgcggcggcggcggcggcggtggaggaggaggcgacgcggcggctgaggaggaggaggaggaggagaggcgggagcaggagtggggagcgggaggggagcttggccattatggtgggagaggaggaggagagaatggagtggagggggatcaaatgtggctggtggtggtgtggcgggtagtggaccggaataacaataagataatggcgacgattgcgtggacatgtgggggcagatccgatccgctcatgtcgctgccatgtggggcccaccaccctcacctggtgtgtttgggtctgattggaggaggttaaagatcgtgagaagcaattgatttgcagccatctttcggaaatcttctcatttcacgtaatctagacgagaagttggattgtatgaagtagtttcgaattatgagagaaaatgtgtagctgccagaaactcccgcccttttttgcctctttccctttttcctgccaaataattggaggagccttggagttggagctggtgttgcattattgtttgcttggcggttttctgaatctacacgaattatgagggtacccgtggttatcgtcttaccgaaatgaaatctctcggcaaatcggtaactgaattttaaaaaataagtttatttgaatttcactagttttcgtcgtaattgaataataaccacggtttatcaataaaaatgctcatctaggtattaagtgatatataaagtcttatcaagcgtgtatgaataaagaacggataagtcatttcacaattcgcacaagttcaaaaagaaagtcaaactaaacctcaaattttaagaaaatttgtctaagtttcactcattttcatcaataaatgaatggcactcacggttattgataaaatcgcttagtagtggcgttcaatgactaagcatttttataaacctgagaggtggacactatataccactattttgcccttttatctatactttctataaatttataatacactaaatacctaaaactacacatacaagcatagtatttgttaatacttctaagttattaaaccattcaacgaccaacaacaaagttgaatctgtgcattcatccatagcaagactattaaatatattcatgttgaaaggcactttatatacttttttttaacccactgatgatgtcaaggttccattttcgtaggagagggactcaaatagtatgtaaatgcaactgccataatcgaacaaccccagttaatcacacataacacatacacacaacttttattacaaaagtcgcaagtggccgatgccatcatttgtttacaaagttacaaaacaattttataaaaaaccatgttagattcatttgtacatgtgtacatgtacgtagtgagaaaatctttaacaagcacaagtgtgtaatgtaatataatcgtaccggatagaatcacggcaccctcatgaaaaccgcgagcactaggttggctcacagcacgggagagttaggtcttgtttagtttctaactttttctttaaacttctaattttttccatcacatcaaaattttcctacacacatgaacttttaactttttttctttgaactttcaattttagcgtgcaactaaacctacccttagtattataataagagcaaagttgtcgccactgcacgaaactcgaccgcgcaccacgccgccccctcctccaccagatgcaaccccaacacaggcacataataaatttataaataaacaagggtggcagccaactccccgggtggtgcactccagcgtggcaataatcgatcgcgctgcgctgcgcacccccgagaccgagaccaccaccaccaccaacaacgacgacaacgtgcgcgtccacactccacgggcaacgcagccacaccacgtgtagcgccatcagtgggtgggcgtgcccgcgcgcggggagttgcaaactgcaagcaaacgcgggcgttttctcgcggcaaccgcgtccggaggccggcggccgcgtcgcccaccaggtgagctctcgcgagtcgcgatcggtgcagcgcatgcacgcacgcagcggtagcgcggcgtttttgcggtattctagcgggcaatcagcgggggggaaataaaccgggggtgcagcgcagcgcgtgcgatcccgcggcgcgcgggcgggcgggcggagacggggatgcatcgaagagggtttgattttagagcatcacttgcgacttgcgaggggtcgcggcgtgagcacatgcgggatgcgtggacgctgcctgccctgcccaggcgcgctcgggtggcacggggaccacctgggctggatggatggccgattggttggcggccaggacggccgggatccgagactgccaggtcggctggagatcgcatctgcctgcctggagtagtggtgggaagtggctactggttagctcccctccagtccctgctgcacggaattgcacggagcctctcttaccaacataccgagatcatcgcgtgctccctctgtcctaacatatagcaacatatttaagacatatcgtttgagctactgtgcaaaagtaaacgaataaaataaataaaaatatttatatgtaaaacttttatattctgccgttagtggcaccaaaaccattattactaaataatgaaatatgat

SEQ ID NO: 66479 - DNA, 4373 bp, Oryza sativa
aagacccatttacccccttataatagtcatgggtcatcaaaattatatataataaggtgtgaacatctaacatattatggcagctatgcgaatggactattaatataatatgtgatgtgtttgattgctcttattgagtaaaaatctccgttctccgtctgtcggatatatgggcccgggggtatgcgaagtgaggggaatctaccttcccatcctgccacgtgtccctacaacctggtcctgcccccgcattccgcaaaccgcaggagcggccggggggtcggggcctcggggtaccacgtcatacccctcgggcccttgcactgctttgccccgaggccctcgcccagccgctgtttggcgggaggagcaagcgaggagggggcccaggctgaacttcctttaatgcgcgcagcgccccaactgccccctgtcgcatttaatgcagtggggcggacgtgcggcgtgctgaactgacgcgcaatggtcaagaatgaccggtctgcgaccggcctgacgccggtcacgtccgactggacggacaaccgtgctcccacgttgcatctgcttccggcggagtggaggtaggtatgacccgtctcatcggggagtcattcggacggtggccaccacaagtcttcacctattaatgagggaatgacagggttgtcccccgtgtcaggcaagggacggcgctgggccccgcttaaggacaagctgtggtttagcttccaggtgaaggcacgggtcgagttccagtcaagatagggtgggtccccacccgaaagaagagtaggtagaggcggtgcatgtggtatccccttgaggtataaaaggaggaccttgcccaccgagaagaggaggactctgagaaaacatgaactcgtggaggagggaacaaagagtgttctcccgagtttaggaacccttgtaactctcagtctaaatcccacaggagtaggatattacgcttcatagcggcccgaacctgtataatttggtggtttgcgagctagctgggagccttgggaacggatacgtaatttctagaggcgagctttttcccccggccgaactcacgaaaggggggtctcacgatctcccgctagagaggatcactcctcgacaccatcccatctatattttaaagctgcgttcgtcagttaatcaataacctagagatgtagtcttcgactgaaatccgtgatcaaatattatctcgggtctcagagtcgtcatcagttttatatctcccatagtgtttcttccatgattggatcttgatgtactatcggggcctttttttaccacactcagccattgtttgcccggtgttttaggtagtacgtgtacgtactaataccctaccaatctaccatacatccaatacccttactgtggccgcgctgcgtccatccaccgatgactgatccacggcgtctctggtttggccacatggcgacgatcccgcaaacactgcttgccctgattgatactcctcttgctacagtaatatactccctccgttttaaaatatttgacgccgttgactttttaagtacgtgtttgaccattcgtcttattaaaaaaattaagtaattatttattttttttcatataatttgattcattgttaaatatactttcatgtatatatatagttttacatatttcataaatttttttaataagacgaacagtcaaacatgtgctaaaaaatcaatggtgtcaaacatttggaaacggagggagtactcagcaattcaccatataaacaaatcacaacatgggccatcaaccttgcctaacaaaggtgcgtacggaatcgggacgcctcttgccgcctcccatccgatacgcaccagggggtactctgcttctactactcttacgcgaggctgcgacgtggtgactcgaacagttctggggccttgttgtcgcctgcccgcgacttgacactttgcctcaccatttttgattaattattaatggctacgagaaaaaaaataaggcaaagggagaaaacgaacgaacaaacaaacaatatatatccagacactgcttgtatgtttgcgtatataattgcgtgtgccacattatatcaggattgatggatgagatcttcgcgacaggtactttgacagggaaatcatgctgatcaacgggaataggtgattttttctgtgctcatgtttagcttcttctcgatttttctgcagtcaaatccaattgtatatatatgcagctactattacacaagtccatgtcgacctcgatcggtcgacctgcaactgcaacttagctaaaaaagaaaaaaaaaagaagaggaccacgagattgaatgaccgattattggttgcatgccgaccacggaattatgagaaaacgacggtgaaattatatggtacgttctcatctcatctccttccttaccttcgatagggagcggaatttaaagtggcggagcttactggttgtctagtggcggagcttcaacaagagccaggagaggcttcagcttatgctgaatccgaatggctttggatacgatttgcggaaggcggtgtgtatatgctctgtagatactcaattagatccctttgtttcaaagaaaaattatagaaattttagaggattccattcatataggattttttccctatagccctttaaattaaagtaatgaacctcatgacctatgaaaaattaacataaggtggaatctcatgtctcaaattattgtgttttttttgtattttgtaattttctgttatacacttgtatttctgtcaaaatcttgtgtttttttctattcatctatttttccactctattttagaaattagggatcaattggtcgtcaacaagtattgcacaatctattgttaatggtattactagcaatgaaaatagtcacggaaattcctgatggccgaggtattatttctgtgtaagtcatatcggttttttcaaaatgtaaaatttgattactttttttagtttcttacagcatcatattgatgccaacattaagtagttaaattgataaatatgattaattactgaccaaccaatcatcatttttgaagagatgctactgattttgactatttctgatcgtttcatcgctaggtaatactacctctattttaaactataaggaattttctttctattttgagacggaggtagcataatattacaattttaaccatatgttaattttgttggtttttcaattcaatttttgttgaaatgtgcaagtgaaattgttttaaagttctaaagataaaacaattttgttccattcatacttcaaaaataatatcaataattacaatccaatctatactccgtatttcttatattactttctattttcttatgtttaataacttcaaatttcaaaattgatatgtatctatctgtatgttaatgtctcaattcggtaatgttgctataatttagtctagaggtttaaaactaataagtatagtttttatatacagttatgtatactatttatctgccaacgtatttatacgcgcttgaggtatctcatatttagcataccaacataatatcaattatagattttcataataattaattttagatttacatgaatttagttagttcttgtgaaaaaattgtaatattcatgtgttccaacggagagggaacaaaaaaaatgcatactcaaagattccgaagcataaatctgaaacactttttttttcacaatttccctttcgaattcactagtggatttacagtgccaaacgtgacctgatatatgctgttgcatatccgatatttgttccatttttttgggtggaatcatgagcatcttccatcgctttcccaaccaacgcccaacttgcccacagaaaaacactaaccaatggtcgatgggaatttgaaacgactacagcacctctcggacaaaagaatcgcatccacaagccagagcactatggacatggacatctactgcttctttattttatttatttgttttgactaacaggtctactactactaatcaacaggactaataaagcattaccaactcgtagtaagtatacttaatggtgatgataaccatcattgattggcgtatagctcatgaatgatggatccatgcatgtcgatggtcagagagttgcaagtgctgaattttgtgtcgaccatcttcttgtcaagcaatatcagcaactagcaagtggtttgcttccagggagatggacagcaaaggtttgttttatctaaaataacctatgttcaagggagagggacatcaaggttaattagtctacgattctatgaacatgtgttatgtaatcatgtttgtgaagctaatccattggttc

SEQ ID NO: 66480 - DNA, 7820 bp, Oryza sativa
attcctgcagcccgcatggtaggatggctagttgggagatctagataaaagaagaaaatgatgaatgtctgacatgatatgtcggtatcattggtatatatgctgggttattcgtgtttgtttagtgttttgtgtaatacgggactaacatatataattatatggcgtgagcctcctatctattctgttggtatgtgatatgggtggttttatttatgtaataatgacaaaattttatgtcaagtgaggtaggagccccaaaataataaagatgtttattttatataattatagaaacaagaatggacatattaatctatagcaataaaaatagaacctttctttttttgcaaatgcatttattcccaaccttttggagtcatatttaataacagaatgtactactataatcggtaaggatttccataagtaaactgcaaagtgcacacactgtgcaaatcactgcgccgcagccgtaaaaatggccggctgcaagagcttgagccagcagacataattagtgcgagttcaaacgagagattagcttatgattacctctatccatgtgccatgtcattctttttgatttttaggccaggtgcacctagcctctttgcatgaaatttgctatggagacacaacatgtgagttcactctttgctagagttcaaccaactctttgctagagtccaaacttttttttcaaacttccaacttttccatcacatcaaaacttttctacacacataaactttcaacttttccatcacatcgttccaatttcaagcaaactttcaattttagcgtgaactaaacacacccttatatgagcttctttcttccgaactacatatgccattgggctaaaaggtgaaaagtaatgtgcaacaacatatttaattagttttgcattttgtttgactgagactaaaatcagacgcacacacagacacattacatgagcttcctttatgacccttataaaattatcagcgacacctatatatacatgtgtgcatgtaatgtacaacgtctctattattagttattatgtgtgcatcaaattgtacatttctgaaaaaagcgggtatagaaataccaattaagtctaggactcgaattagcctcgtagctaggctaactacatgcacgtacattcatatatacacatagtcatttattagtatatctaacttcgtctagttcaatagttttatttgatctttaaaaatatacaaatacaaggcaacaataaatgttggaccagtaaaactagatataaatgtttcttcagagcagtatgtataaaaatatcgttgtaaccaataaaccatgaagtgtatataaattcactcagccgtgtgtctatatagccgtttgaacttgttagtaaagaagttaatgttcatatctaaacatttaaaaaaatttcatactcattcaaattgggtatatactcaatttgaatcttggagcccatactccatgtagcaccagttaatttatctatatatatatggcttttggttcccacatggaggcgggcgcttgcgagtgcatataagaattttggggccattggcaccaacaaatcatatatacctgggtatgcgcgtgagagagagaaatatacgtatagaggggggccacaatgcaaagggtggtgaaaaagttagcatgcacaaccctaccactacacatctaccagtatgcttaacccatatgcaagaaaagctatatctgattttaattaatctctgaagggattgatcattgattccataatattaaactaatcacacttcgaatttcgtaggccccttttacaggcttgcaaaagcattgcatatgtttaatggagtctcactagagtcactacgaatattccccacccagcaacaagagattagtactacataacaaagcgagaaatcactaatgacaggagaaaaaaaagattattattattattgatatttattaagtatagttaaagtacgaggaggctgcgaatgattgagcccttgttgtagtagagggcagctggcattgcaatatctttttgccgatgaggacgtcgggttctgatagatattgcaaggatttttttttgaggtattatatttgatgatcgtgcattgtatttcttcaattggtataccacttccattattatttaaaatggtacttatatttcttcgaatgctacgtgacaaattaatgcgtccaacttaaattggagacatcgttcaattggtaagccaaggcactaatcccccaggtctttcggagtaattataaatttggtagaatttttctaatctcaagtcgctcaattggaattcgacacgcgcacaattgaaggttaattgtcgttgaagtagcatgctctaaaattgtgtttttttcaatatcatatatggaccctcttcaaagatatttaaaggtgtaaagatcttcctgtaaatgttgggagtgagccatagactacaactttgaatgaaaatgaagaacttttgccaattttccaatcgttattcattattggcactacatattctccctctcaatatttctgatttaaattagaagatcagtttatagactatagacacataaaaaaaatgaaaaaaaacattattcacgcccgataattaactttacctttgattgacatgattctacactcgtagagtccaaactagcatacgtgtgtcgacattgataagttcgtgagggaccaacgttcgctcaataagctatggtggaaacatagtttcattacaacaaaaatgtctttatgtagatatatttttctattgttatagagacacttttcaaatattacaatgttgtagagacatattcaaaaatatgtcataaatgtcttatggtaaattatctctgtaaataaagaggcattttaaaaaatgtctctatgtcttgtggcattttaatagaggcatttttttatatcataacagagtataggcattctctagagacactgaccaaactactataatatacatcataacaccactatgcctcgcaccatgcactctaccaacttgttgggtttgccatctccgatatgctccacggtgaccccttgagacgtgtgggacatgatgcctactttccccccggtaatacggggttgtagtgagagggggtgaggttgatgtgctgaaccattgatattacatgggtgtaactgactgtgcgagcacacgaatgaaatgagtcttgacgatgtgaacaaagaggaatgacagactataatgcgcgcgtttactacatgtatgtgcacactgtccaataccttgcatcacattgagaccgatcatgaccaaaggacttctatgcctctcttttcagtggtcgcgggccaaccaactagtggccacgggaccaccctactggaggaccaccgcgccacgtcgcatggtgccgcatgcctgtcctactcagtggtcgttcaccatgatgtcacctagctgctacacgcataccctgctcaggggtcaccgtgccatcgtctcctggtggtcatgggcccaccctgtataggggttgccgcactctgttgactggtaggagcaggcccaccatgtcaagggctgttgcaccacgtgacgtgctctgtctattttaggactaacccctgtctatttcgaataattataagtgtggatgggaacatgtaattgtaatactgacaacatgcttttattttttaaaaaataagagaagttgtgactctttaacataaacgaggaatgcacacaaccattacatcacttaacaggctaacaatagactaaaaaagagactaaaaaggcaaaaaataatatgaaaaataaactatcatgttagggttaatatagaaaggcttcgtcccgcaactcagaccactgtaagatcatcttcgtgaactctatggttgcaggaaaatatgttctgggatttttagttttcatggaaatgccgtagaaaaacaggtatgactcgtcgatatcgctagattcaatcgcggtcaatgttacatagagggattaatttacaccccggatctcaaaataccaattctcgatggtgatacttcaagatgggaacacggctgatcgatcacttgatcagatcaatagagtcactttcttgaggcaaatttaaataagattaatttacttgctcacttttcttactgtgagagcagctaagctagcgaagttgacacatggagattccagattcttgcacttgatcgctcctttaatttggaatcttcgctaaaaaaacaccacctttttcttacatccatcagaagaagatcaattcgtttatgttgtgtccaatcctatgcttaattatatgcttttcaaaagttaaacgtactccacatatgtatcctgtatatatacttatatagttcatccccactaaatatagttaatattatttctctcttctcttattaagtcacattaccttaattatttctagtcttttaatgatagatatatagttcaaattgtcttttctttcttctctcttaaaaacatgcaatctcaattacttttagctcaaaattatatcaaattgttttaattttgtacgtattatgtaacttaattttctacagcaacgcgaccagatgttcatatagtatcttataaaagtatgagcagtactagaatactaaaactggagaataccgaatgtacttacttataaactgtaggggaaattaaagcacttaaaaaatgtcctgaatttaatcatattaaacatttatataagcatctacgtctagttcataaaaaacgcgttcgcgaaaatagttcatataaaaagacctatccccaaatttatttattctttttaagtttttctcccattaagataataattggatgtaacttatttgaatcaaagatagctagtaatgaattctattatcaagaaaaaatatacacaccaagattagggactaattactactcctatcaactatatattaacggacatgattaaccaaaatgagagcgttcattagttaattattatattaattaaccgctcatccacatcatgcgtgcatgtatatatggtgtttatttttaatcagtaactgaagttatcatgacttttaactttttgcctagaaagaagtcggttaattactttacttacatggacaagtacgtatgtactgtactgccgtacacgtacgtattttggaatataagatacagggagtacgtattcttgtacgcacacaacacaagactcgcatgtatatatatattgcattggcgttgagtgcacgaacacgcagttggagcacaaaaatggcgtgagtgcaatggtcttcttgtaagaaaaataaaagggtccaaatcctggaaaaaagagaaactgatttccaaaaaactttaaccgttgttgaactgaactgtcaataggattaaaaaataacagaaataactagaacacgatttccgtctaaaagaggggaaaaaaaggtaagtacgtttgtgacagaaaagtagggtgcatttttacatattcacccaccatgttttcatcttttcatgatgatgattggattttggtttagtcccaaaatcacctggtactttaccataattcgttttcatttatagagctatgttgttatgtcgtaattgattagtagagcatttgcatgattgacgataatctttttaattatgagataaaattttgtaatgtttgattatattgagtctaatggtagagatagaacacatggatctaagaaatggaagctgttgaagacgcccgatcacgactaagtgactaactagctattgatggagagcgagttagaggggcagctgatctagtatggtggtcgaagaaagtgatgatatgcatcgcggtgtctaaggcatggccttgagtggataagcctagtatttgcgctgaggatcatcctgtcgctaaacatctcctttggcctgcacgattttttttcttctcaaggcgttgtacaacaccacctcttcatccacatggaagaaccatcgtccagatctacgtagggttgcccttgaccttgctggctttgcttttcctcccaatgaccatcgtgcccatagccaatcaagagttggattttaatagagaatacctgtagcacctactccccccatataaaaagaacaacttctaaaaatgaatttggataaacatctatccatattcatttatatatagtaatcgattttttttcttggacgagggatgtatacacaaagatgctagcttccaaggatgcacagtaaaaccgctcttatgactttatatatattttttaagatcacaacttacattttaacccgatgtcatgaccaactagcggcttataaatttatacatcaagaattagtcttataattcacaacaaaatatgtatcacacaatttttttaaaaaaacgatgacatatacggacaaccttaaattccatatgtgcatattacacaataattattcctttctcctttccacttggtgttaatttgcaccgcacattttcttcgctgcacagaaaggtcagcactacgttcagagaatgtgtatgctacacacaccggccagaaccagagcgtgtgcttatgaatcacacaaacttaaacctcacacagtacgtagtccctgcagggaaattattgggtgtggctgggtggtgggccatgtacacacagattgcatctcactgttggctctagcttgaccggtctaagctagattggcagcaatgtcatctcatctctcatctcatctcatcaggtggtggccctggacttaaaagggctgtgtttagttcacactgaagtatgaaagtttggttgaaattggtataatgtgataaaaaaatttatgtgcgtatgaaatgtttaatgtgatgaaaagttgaaaatttagaaaaaaaaactttggaactaggcctttggccatccatggagcccatgggcaggacaggagatcgatcggcagatcgtccggcccccacggcatccgctgctgctgctgcacgtgtagcatgtaatcctctgcgtccttttcgccgtgcacagcttaattttggctttcagatcgatcgatcgatctccaagctaaacccgtgcatgcatgtcgtcgcatggccaaatggactttgctgctggctgcatgattgctttgtgcgtcgctccatcaaagttcttcgtagggagaagaaaagaaagagggttcatgcatgcatgacgcgttggctgatctgcagtaggttccagttagggcataataatcccgtgttttatgcatgtatgcgtgtttgtttttttagaatttttcgttttacggaaaaagattttatcgctctatcgtcgcgtcaaagatttgattgctccatctctaagagcgtattctcgcttagaatcctgggtgagatcatcttgtcgtgttagtttttgattgaataggtcaacctccacacgatcttctcgtgtaccatgccatcgctaagttagcctcaatctctctaatatgagaacactgtccaatcagacatcccatctctactcaatcatttctctagcaaggaagtgagaaaacatgtgactacatcggtaatggtttctaatatgaaatatatataggggcttcaacgcggtcgagactttcattgttccaaatttacgaaggaaaggttccgaggtaagcacaagcaagaacacatgatttcttattgtgatggtggatgaattgatgttttttttatcaagggaa

SEQ ID NO: 66481 - DNA, 4111 bp, Oryza sativa
attcctgcagccctataataattacattttatatatggatctatttggtatgcaataacttgaaatatgtcacaatattaagttggtgggtcaaagatttgatcactctatctccagcaattaattatcacttgcaactccggtgaaatcatcatctcattatttggacttcactatgctacccccatgtctttaagctaggaagcggccctactgaagtgtcctatttctacacaaccatttctctagctagggaagaaagcatagcaactcacacaaccatttctctagcaattgtagagaaagtgtacaaacaccagggatggtttataacttctgttgggacaatgatttagtttttaccagagaacttgcacaactggtgtactatctattattatttttcgggtagacgattgcggtgataatgggatgatgaatacataggttacataagtgagaatgtattgttaaaaatggagtgtcaaatatctttgactccgcgatagagtgaccaagtctttgacccgactttgctaccgtgaaatatgtttaggtagtcacatactaaatagctccatctctaaaacttaatttttatctcatatttgtctctctacctttagcaactcttctgccgcttcagcctaatcacctcctttctctcctctatccctttgcaccaccgcggctttctttaatggggtgagcctaacaaacactctgacacaagaaagcaccaaccgtggcagaccaaataccagtcaagaccacctccacctcctccctccttactcggtgcttgcttcttctcctcactttgctcgttttcctagagaggccaaatgttattctatctattactttgcaggtggacatagttgcattgacaaaagtcatagcaacaaatatgacaaataacaattaagttttagagatggagctatttagtatgtgaccaccgaaaagacgtcacggtaacgagttgggttcagcgattcagtcactctatcttcgagtcaaagatttgatcacttcatctctaacaattaaaacttacatcaccggcaaaatcatcatcccattacaccccctctttgccttctctaccactctaccaccgtgactttttttaaacgggtgagcctaacaaacgctttgacacgggaaagcaccacccgatgactagaccagagaccagccaaagaccacctccacctcatccctcctcacttggccctcgcttcttctcctcacgaataggccaaccgtcacacggtgttctcacttaggcgtgctaacactatgtttcccctatctatctctatctaaggcaaagactcagccatttcacataaaaaaatttcagccataccaagagcatccaatttatagaatatacgggggctctctatagaaaatgtgtagccatacacagagaaaatgtataggagacacacacaaccactcttctagcaagtgatgagaaagtgtaccaaacacaaagtatgacctccaattcatagaatatacagggggctcctctgcaaaaaaaaaaggagcaccaaagaaggggaggacaaaaatgtgaaataggaagaaaggcaagggggtgaggcaaagagtgtttaaagccataaagcgcagccctgtaattgtaacgccgccgttatgcttcctccctccctcctcttctgccttcgctctctcttgctctccaccaccgcggctttctttaatgggggtgacacgagagagagcctaaccaacgccccctaacctgacacgagagagagcagagcagcaccacccggtgaccacaccaaaccaccccaaacaccaccacccccacctccctccctcctcactcttgccgcctctcttcttcttcttcttctctcctcacttcgctcgctccctcggtcgctcggccgccatgtcgtcgcaaggtgacgcgctgcctctggttcttgttttgttcttgttcttgtttttgttttgttttgtttgccgggaggtttgatggggggggggggggggcgcatgcaggagcaggaggaggggtaggggacccggagctgttcgcggagctgtggcgggcctgcgcggggccgctggtggaggtgccgcagcgggacgagcgggtgttctacttcctccagggccacctcgagcaggttcttgccttgcctctcgccgccgccgaattctttggtttctgtccttccattctcgccgggagcgagcgagtgatgatgacgcgcttcttgttgttgttgttgttgtttgtgcagctgcaagagccgacggacccggcgctgctggcggagcaaatcaagatgttccaggtgccgtacaagatcctctgcaaggtcgtcaacgtcgagctcaaggtaatctctctctctctctctccggtgtgggggagcaaagagaggaggaaaaagaaaaggaaaaggcccccgtgaaattctcttacgtttccttgtttgtttgtggctgcaggccgagacggaaaccgacgaggtgttcgcgcagattaccctgcagcctgacccggatgtgagtggtgaccaccaccgtttttttttcttcttttttgttgtgctcttgtcgcctcctctgatggttttggaatgtactttgtgctgctgccctgttctacaatcgtggtgatccttttgggttccccttaattttgattctgctttctttttttttagataatggattaaaaacccggcctctacatccaacgggatgtacacagccatgattctgctttcatgtcctgaattttggcatgttttaacagcggtctttttttactgaaagtaaatttacttgatgtgtactttggatcacattgtgttatatgccgaattggcccggaaaaggcagcaattttgggtttggtgtgtgaaaaaagggggagtgatttggggctccactgtttttcagcaagagaatctgccaacattacctgacccgcccctgccggagcagccgaggcctgtggtgcactccttctgcaagatcctgaccccatccgacaccagcacccatggcgggttctccgtgctccgacggcatgccaacgagtgcctcccgccactggtatgcgtaattctcatggtttttggtgatagtagtatgttcccggctatgtatgtcaaaatcatatatcttgtttgttgctaatcaggatatgtccatggcgacaccaacccaagagctcatcacaaaggaccttcatggatctgagtggaggtttaagcacatctacaggggtatgcaaatttttgtttttattctcttggttatcagctcgatcgttatctaatcatttgaccaccacaccatgatcaagattgtagtagctttatgtgcatgctggcgcttattcgtgcaattctcggttccctaggccaaccccgtaggcatcttctgactactggatggagcacgtttgtgacatcgaagaagctgatttctggcgacgcgtttgtctacttgaggttagatccccacttaccttcagtgcttgttattcttcagacctgtacaagtttatgcagatgttcacaagatttatgtatcaaaagggatcatgcatattttgcttttgtaggagtgagacaggagagcagcgtgtcggagtgaggcgtcttgtgcagaaacagagcacaatgccggcatctgttatatcaagccaaagcatgcatcttggtgtgcttgcaagtgcatctcatgctatcaagactaattcaattttcctagtgtactacaggccaaggttgggccatttctgccatcatttgttatgatacaactgtagttattctctgctaatgggtgctgttgtttgtttgttttaaaggttaagccaaagccaatatattgttagtgtgaataagtaccttgcggctagtaaggttggatttaatgtgggcatgaggttcaagatgagttttgaaggggaagacgtcccggttaaaaagtaatggttttacctctggtttcatgtgtttctatttcactttcttcttgatatgttgtagcatctcatgttcaaatggtcgatgtaattttctgtaggttttctggaact

SEQ ID NO: 66482 - DNA, 11126 bp, Oryza sativa
caagaattgctacatggcctgcacgttctgcttaccaagctgaggagcccacttccaagttgtcttcgaacaccgctgcctgtggttaccgaactgaagaagttgctccaaatgcgtccaaggttgttgaaggaaaaaaggaacctgccatgtttcgtctgtttggtgtggatttgatgaaatgtaccagcatatctactaccactgatgacaagtcaagtgtgggagcaggagaagcttcagccaaaggtactggttctcacgaagactctggtcagctgtcagcattctcaaaagtgacaaaagagcatattgctgcggatgaaagcccccaagagatccaaagccatcagaattacaccgctagaactcgcataaaggtataaatttatctgtctccccctcgagaccttttatggtgcttgggaggtacccagggtacctctcaaactattgagtatcaaccgttgattgctaaagggtagatttgggatagagataatttaatttgcacagattgttttaagtcataagaaccatgactttttcctgatcatttgctgctagccccgaactttcttgtctgccattgatatgctcgtcttatacttcattattctttacgtaattcatcttcacttgtagcgtatcacatctctgttgcctagcctttcaaaggcatgtttgttctctgttctctctggctgaccatggcggtggctcgcattttataattgatttatcgatgaactctcaaagcatcaaagtttaaaatagtagtactccgtattacactacctatcatataaaataataactcagtagtctatcacagattccatgtaatctgtattaggatcttcatactacgaacagtttttgaaaaagaactgtactacgagcagtttgatcgagaagaaccaaaactttcttcaccgatttgccttatctgatagtaaattgatataataccaaggacaaaattacctatctaacctcccacttaatctttaaattaatacctggcccacttcttaagtaccttttcagaggtatcttttgatgtaaaccattagattggggtggatcaacggatgttatggtttcaaagtaccggagaaagtctcctcctgcttcttaaactgtaactgactcaacatttctactaggttcaaatgcatggaaatgctgtgggcagagctgtggatctagctaatctagacggatatgagcaactgatgaatgagctggaagagatgttcaatataaaggacctcaaacaaaaatggaaggtggctttcactgatgatgagggtgacacaatggaagttggagatgatccttggctgtaagcttctgcatatttttaatagagtggcagattattgttcatccgacaaaaacttatgattgtgtatatttgcgattcctgcagggaattttgccagatggtcagaaagattgtgctctatcccattgaagacgagaagaagatcgagcctcacccgaagttactgtcttcagctaatccagagcaggatcagaagactgggttttaggagggaggctagggctgaaaggtggattttttagcctttcaccattgaagcgttggtggctatcgttttgtcgttggagatggtcgtagctgaaaaaatggtggctactggctagttcatcgtattgatgcaacagatttgttgctggtgtcaaaactgtttcttcacaagcattttgaagaacaaattgatgtaacataggtttcaagaaaaaaaaagatttgacaatgtctctttagtagtttgctcaagtttagtcaaaaccttaatggtgcttaaggaataacgtgaagctataaaactggtgtgtaagttctgtaaatattataagggagattataattttgtgatattagctttcaccctttaatttattggtatatattgacatgtagatttcattgttcttgatcagtctgatcgtctgaccttgctatcagatgtactgaaccatgtttctcaatattttcactattgcgatttaacattctaaaattcaaggcgaatgtggctattccacttctgaattctgttctctttggatttgtttgttgactgaacatccttgtcaatagagaaagaaacttcctgcataatggttccagatattcaatttggaaaaaaaaaacgatgcctaacatgcttatgatccaaacggagggaaggcttgaagaaacgagctgggatatagatttggaagtttgttttaactttgattttcagatttttttttatcatagtatatttcttattgattttgaaatcgctataagaacgtagacctagagaattcaagattttggccaacagaacgtcaagacgttcattcgaaacgcatgaaattttcctcaatagccttcgaaacgcatgaaattttccagtatcttcgtagtaggtttgatcagttcctaggaaaaatatctcccttaaaaaaaagaagaagaaaatcctcgcgtgcaaggagatgcacggcatggacggacgcgtgatcgccgtcgacagggttagcaccgggtgattacgtacgcctccgtgcagatctgcgcgcgcgccgtgcgtgcgtgcgtgcggtgcgggggcggcagggaggggtcgccgtccggcgccggccttgtcccctgtcggatcctgccccggcaacgcaaccaccaccaccgcgcacgcacgcacgcacgcgcgatgccaacgtcgtctgcctccctcgatcgtttgtggagcaaaaattaacgggcaggccgagctcgcctgcatgtagctcgatcatctgcggaaagcccaaccaaccaaccaaccatgcgttgtacgtccatcgacgtggttgccgggcctcctatagaaacccggaagaaaaaggtcgactatgagccggggttttgattcgcgcgcgttcctcgattgcaaaattggtttgtgcaagacaagtcaggtgttccccctggcacaccgcacagttcagctgtgacatcttgcacattgtaagatcaattgcttgctttgatgcgtgagtttcaacattcctttagtgattagtagtatcttgcaactatttagaagctccctctctcagttgttcggagagcaattttagttggcgcggtgtctatatggcgcttacgtgacaaggacgagggaggacaaattgacacggttttaaccatcaggaaataaaatgatttattagggaataaaaattagtttataggttaaacttttgtatatactagaaaaaatacctgtgcgttgcaacgggtaattctattttaaatttattgttgttatacggtttaactagggtaaaattcactgtgagaattcgcttataaattttttttagaaaatcataagctgcaattaggagtccatattttatctcaagttagcatacggatttctttaaatagatttcttatacgactcctttttattttcaaaaacaaatgagcttaaaatccaactcaaacacgaatctgtatttttaaagcgaacgaacttaaaaacttactcaaacccgtatggcgtaccagaataccggcaaaaaacatcttcaatttttataatagtagagatgtttgtagctatttaaaagtcaatactaaaagaaaactaagttgaaaatatctttaaatcaacttcaatattaagttctaaaatttaaattttggcttttgcttattagtacaaccaatgaggctcgaagtctatgtccgatttacaggtacgcgaaccaaattcggcctataaggatatgaaacagaccttttcctaaaaaaacacacgtgcttttggcaggcctgatcagtagtactgctccgattcaggcattcaggcccatctgccaatgccaaaaaaccaccgcggccgcgccgcactgccgccgccgttggcggttgccgttgccgctaagagcaagttaaatagtataatcaactactaactttaaatcatctatagccagtgtaatagtgaattcatacaataattgtttactatactattaatacatggtcccatatatcatacacccattacgttttaaagtccgtgctgtagctggctacatgcagcgctgttcttctctctcttccttaatctcttgtgtacctgctctaaccggaagcacaaaccgggggggtgcatgcatatttactcctcctccccattgatggcggggcggccggcacggcggcctgcgtgcggtgtaccagcaagctactactagtcctcccgtagtccggtgcccacgcgagggggaggccacgcgagacgcaacgcaacgcagcaaccacaaccacgggcggtcccggcggatttgacagtgcaaactgctgcaaagtatggtggtctcctcccaatcttgtaggtggtcgggccctgcacctgctgctgctgggctcggttgaagtggcgcagcaactggaacccgtgtttgcctcgaaaggttggtcagcctgttcaatgttcggggggtagtagttggcaggtttcgcagttaacggtaaccatattttttttaacttttttttgggactgaaatggtaaccattccggtttctaatcggcgaaattaaaaaaaaaacattcgaaaatttgttaggttccttactgtgacatctgcccatctgagttcgggtcttcgactcggcgtttgtaggaacgagtgtgagcatttgtatacgagtgtctacgtttgtttgtgttgtataaaaaaacaaattgagatatatctttttagcttttttttaagattttattggttttctttgtttttcgagttgctattgcgatcagtgatgaaaccgctttggaacatgtatttaattgatgaatggtttgactaatatttgtagttattagaggtgtatggatggcgtgactgtatcctcgtaggtgagtcatgccctttttatcctgcgttttttactccgatcatagccttagaggtgtatggatggcgtgactgtatcctcttagatgagtcatgccgtttttaccatgcgttttttactcttctacatttaggggtatttaacaatattttcgtaaggtaaaatttgcttctatcgtgagataaggagactattaattacgaataatttttaataaaaaaacacttctactttacccgtctcgtcgtgtattttgtagttatttttttcaaactgttaataataacatagtactagtaaatataaagcttttagtcataaagtatttttatttgcttagctcattgtagcttcaaccgatcacatctttctcacccacacatgatacataggatcacgtgagccacgaagtagcagtattaaaaacctcatctcaagatcctgtgcatttatccctttagagcaagtttcaatagtatagccatctgctggctccaaatcatctatagtcaatctaatagcccatttatacaatagttacctataaaaatatactacatcattaatacccggtcctacctctcatacactcataacgtattggagtccgtgttgcagccgactataaatctgtagcccgctttcttctctcttctcttttcttctcgatgtgtggttatagctggtttatagcctgctattatacatgctcttagccaaccatatgatctcaccggtccattacacaaccctactattactgtacaatcctacacgatccatgctgtccttccttcacttcacttcacctacatgcacggttgcccctgggccccacccccctaaccattgctctgcttgtgggccccacacatcagcctcacattgcaagggtacactagccgaagccaaggaaggagcaataaacatttaataggggttgttcaaattgatcttgtttcaaactatacaatttttaaataaagtagtcaaagatatgcatccatttagttttttattaaactttgataaatacataagaaatcctgtcaaaacatggtaatattgtcaaattttcaaaattttggcattactcaaaatttgataaggtttattttagttacaatctaaacagcccccttagagcatccctagcagatgttccatccaatcctccatctgagaaatagcggatgggggtgaaaaatcggccaccagcggatgcgctaaaacaggagagaggaatgccaatttttgcgttcttctctcctcacgccaaatcgcaaccgcctctcagggtcgagctcccgcccccatccggaattcatagaggtggcaggcaaagcaggcagaggaagagagatatggaggatgaggcgcggcaactggatcgaaggaagaaggaagaagggaggtagagaggtggcaccaaccggatctgggctagggaggtttattggagaagaagcgccgccgcggctcctccgcccggcgaccgaccgcccacgccgctccccgcccgcgaccccgccgtcggtgccgcggctcctccgcttggtgaccgccgcgccgccggtcctcctccgcccggtgaccgcctacaaccccaccgttcctctgcccgacgaccacccatcaccctcccttgtcctccccgtcgaagcaacggtagaatagaagagaggatgagggaaagatataaatgtaaatgtttggtagttgaaatatacattaaaatatatatggatgatgtaatatggatggtctgttggagtgaagaaaaatacggagtgagaatctttttggatgaccatctaggcccctttgattcaaaggaaattcatagaaaatttagaggatctcattcctataggaattttttctatatagctctttgaattaaaggaatagatcttatggaatcctatgaaattcttatagaatacctaggaccatgcaagttattccatagtaccatgcaagttttggaggaattctaacatgaggtagaaccgcatggaaactttccttctagtctttacctcttctctaattcctgcgtttttcatgtggtccaatcaaacggtcattcttgtgttttccctgtgttttgcaatcctttgttttacacttacatttctatcaaaatctcatgtttttcttattcctacgttttttcaatcatacgatttaaaggggcccctaaatgtgaaaatggaggataaaatttagatgagctccgggatgctcttagctagtactagtactaaaatttagtagtactagtaccagactaccaccaatggtgtcacttgtgtgaatgaatggccctctgccacaggcaaacctttgcctgctggctgctgccgcccctctcatttctcatttgctctttgctccccccaccaacatttttgtagcagaaaaggagccaattttttttcactcctagtagtcctactcctatccccttccttcccccaaccccttcacacttccatcaccatttcttccttcttcccctagctagctgctggctgctgctgcttctctgggccctcgtgctgctcttctcatgtcaccaccgccggccgctagtgcctttctgggagccaaccaggaggccccgaatcagatcttggcgtaggtttgctcgactcgctgttgttgacggtgaggagggcgcttgcctcgtctttctttcttccaaagagcctgctcttttcttgggtttggcctaggaggaggggtttttggtgttcttggtagggaggaggattcttggcatttggcgagagaggggggaaatcttttgtttccttgtctgattctgctcggtcggtgagtggtgcggcggcggcggcggccatggaggcaatcacgatgtcgccgtcctccgtctcctcacaccacctcgacgtcgacgctgcctccaccagcgaggacatgtcgtcgttgcaggaaggcctcctcttctcggacagcctcaaggtatggtgatgaatgcgatgtgtcacaccgtgtgtgtgtgtgtcttggcctcctcaagccgtcaagatgccgcaatctttgcttcttgccttcttcttctcccacctccttttgccatggatctaggtagaaatcgggctgcgatttgttgatttcttggcgaggtttaagaaaagtaaaaacctgatgatgatgatgggtcttgttctgggggtcacactcagttgtgtctcgtgtgccgttttgtccatgtcaatcacaagattttgtccctagtttggtagcaaaacatgataggctctctctacttgtacacctttccaagcttcactgtagttgtaatgtttgaaagttcttactatgccttctacttttactatgtggttataaatttctgatcttgtagtgtactacactattactctctgtaatgtagataatcatctgtttcttgcataattggctgtgcaactctgcactggctgaatctttttaattgatttctccctaattgagcaaatggagcctagaagacagaaacccagttccaagggcttttactagaaagcagcaaaattacttgtaaattcatggtctccttgtccattttgaattttggacggcttaatttcctttagcaagttgatcagtctattggtgtgaaccaatggcgtgcacagttgcattcctttgtcaaaattttcggtgctcaggataaagaagttaggatccttgttcacaacgaaaccccacatgccttcgcatgagttaattagtaatgtttctcccatatgtagctgagctggcatttcttatagtactgtatctcctgtgctgggcttaaattatatttctttgtaggacctgaggaatctgcgttcacagctatactcagcggcggaatattttgaagtattctacagaaacaattctcagaaatctacgtaagatcttttgttttatttggatctctgtttctttgtttaccttgctgcattaaattaagggtaaaacaaatctacactgatctgctgctgtagggtgatgacaagtctgaaagattacacagttgaggcccttgttagcactgtcgaccatctgggctttgtgtcatacaaggtggataaccttgtcaaggaaagatccgatgaggttaatgagacagaatttcgagtatcctcagttgagcaggtacaaaattcatatgtgcactgagtttaaaggtcattttgtatgtggtccgttaactaccttgtaattttcttaacatggagtgaatatcacatacattatttatattctagtacttgagtatggcctcatttattacagaatgcttggtttaatgtctgctaaccttcggaacattgctcaatatgattacagagagtacggatttgccaacagacaatcgaccaggagggaagatctcaacaatctcttctcattagagcaccaaaataccacaggcgttacatattgccaggcaaattcctactcagttttgttatgctttttatatgatgccttcttgtaaaatcacttatcaccgtggttatgttgtataggcacagatatagtggaatcagccattcatccagtttcagaacctccacggtatagcaggcaacatatgagccgtaaaatgcacaagtcacaatctagtaagtttactgcatttctgaatttttagagagaaaactgtcattgattttgaaactgcttttcttcctgcagtctctacgccagttggcaggcaatctacaatgaggtaaacagatagctctcagaaccctgttttatatttgctcctgagtcaaattgtttataagcttatccactgattgttctgtatttttaaagatatactgtgggatttgattttaatacatcttatgtcacaggagcgcgcgttcaccatctccttcagctcgtggcacacatcatcgatcacggtccttgtcaccttctcgaaaagcacgagctaaatccccatctccccaaatcatcagcacacaaacaaaaggcatgttatcttcactagatggtttacacttgtttctgaatgagaaaatgtcatatgttctttgaatgttaagctttcagaaaacataagtctaaactattttaattccttctgctgtgcagaaacaagagcaggttcaccaataccgaattccaatccccttgcacgatctgccacggttgcaagaaggccacctgttcatccaaagcattttgtatgtttactatagtaccaaattatatatttacattaaggagataacattatcctactagatcctaagaaagcctacatcatttgttttcctggagttcaatcatattcagaagaaatttttatttattgcttctgatgtagtatttcttgcagagacaaacttcaatgcagttacactctgactggagcaatcacaaagagcaggagaaaagctcaagcaagggcagggggttcctcaaatcattgctcacaaggcgtcggtggaggaacgatgagtcattgtacagctacttggacgaatattgatttcttaaatgttactgttaaccaactctcacttgttcacttatctgatatttgagattttagcttttttgtccaaatggaggcattttcgccttatctttctatcattttcatgtgtgtatacaatgagggcctatcatcagtgttgctaatggcattgcgcaagtgtatccatcagcaactactaagctgttcagataagctttcccaattccattttcacttttcagtactcgtatgctctccaagtctccatttctcctgataccaaggtacaatcacaagcagaataatgacaatttcactagagatgaatcataaaccatcttatgccctctcagatgctgtgaacttgtctcatatggtggtccattgatgtttttctaccttgtgactgttagcaatcttgtcatacatggagctggttggcagtttctgttgaggggatccctgagggctgtggttgcaatagctaggagctagtgctagaaaatggcagatgacaaacatggccctggtttttttttgtcataatctgtttgtaaataattggattattatgcttatcaactaaaatttgaattgtaatcttaaatttggagttgattttgggattttattcatcatagtttagtttccagt

SEQ ID NO: 66483 - DNA, 3982 bp, Oryza sativa
atgacttgacaatctgaataatacaaggtgcggtgtacattttagagggaacacagtattttcagaataactgtgaatgatttactgtatgttagcttcaccaactgtccatgtaatcttgagaaaagatcacaatgtacagcatctaggttaattactagtttaatgacttcttagcaactatgagttagattgacttcaagtcttggcaggaaagatgtcagtgttatcaaactttttctaagctttgaggcaaagcataccctagacaatctactggcttcttctaagccatgaatagacaggcaataacattaacaatttgagcctaatagtgaagagaagaggccctatatatataggattggaagagaatatgccgcaagttgttgcacctatcttgaccatatttcatagcaaatcatgctccactctgcagaacagaaaatattttctcctcagctccggtgcaccgtgaattttcgcatgatgcttccccaattcatcctaatctgttgctatatatcttagactgcatatctcatatatagttatgataacaaagatcacattcttgattcaaagcagccaagcacttagcctcaactgccattaaactaatcttgctcgcaatcccgacagaataacatggcaagctttcatactgtcgatcgattctcccatccaatgaactctggtttgtgatgcttcttcggtgatgcgttcatgtgagcattaagcaaagtgtttggcgtggtacgagataattatatggcctaaaagctggctagtggaaaggacttagaaaattaaagaagcattagcaaggggttaggctctagtatggaaggcaggcatttgcatctctgaccattaaaggacggcttaaggccattgatatggatccacttgtcggctcacagttgcatcctctgcctgtatttttcatcactggaatgttatttcttcgcgctgcgagaataaagcgattttcgcctttcctccgcgcctccttcttccctgtttctgctaatatatttttatgtccttgattcctgatgttttgagctcaagtttatcataatcatcatccgtagaccccctgaagtggatgctgataagcatggaaaaatccattggctgctgagacacactgcaatcctgttaattgccactgccagcaatctgaatgttggatccaacactgtctgcacatacaagcattgcacttggcctcagctctcattccctcctggcctatctcctgcttgattgccaggggccatacatatcaaaatggctcatcacctggggttctttctgtgacaccaacttctgctgatgacccctttttatgccggttaccgcacccgaagatcggcgacggagacggcacagggagataccctgctgaaatttcagtgtcaagaattagatgattctatcatagatcagtagatcacactgttatcacactgttactgcatgtgcatgagcacgagtgcagattagggagtgaaagctttctgtccaggatcttggaatgcactgcagcctgttggagtgaaatgggccaacagcatgtgcattccagcgttaggtgatagaattgacctgatgcgatgcagagaaatgacgcgggaaaaataaaaaggatccagacaattatctgatgcagtgatgcagccgctgaattggtgcagaggggtttatgcagctggggacatggtttgctttctgcaatgtgcgttgtctatctagttttggccttctgaaatgaccatgggggactgactggtgatgaagagaaaaagaaactgaagaatttctgccctgtccatgcatgggctttttcatggagagatttgagtccagatgttgtaagatgcaccatggataagtttgctgcaaaaatctcaaatgtctcagattacccaggacaggatggttactgcgtcattgcacaagatttgatggcattggagtctcagactctcagtggtggctctgacagacatttgggaaacagctcaacacaggttcagcatatgggtgtagtttgtacagttcaattgatgttcagatgattggaatgcactgttgaaaacaaaatgtccaacgccacaacgtccaagaagagtacgagagatgtgagtgaaaaatcagcaaagctccataggctaagatgaggatgatggaagcaatcaatcacatgaactaacaaattcaaaattatgaagtctatcaagaccaactgggattcatttttccaaagatgtttcagatattaacaggaggtaacagttgccgctgagtacctgttccctttgcctctacttcttggcagacatctcacttcccaaatttctattgcatcatgcataaggtgaaactgcagcataaatagtatccatgcatcctgacaaaaaacaaagggggcaatgggttcatcagaaaattcaatataacaacttatcactggcaaaaacaagacacccagtttccattctgcagaaatgtttgcataattctcatcatagagagaccaatagaaatgaaaagagagagaaatttcgtgaagtagagaagcttcgttgttagcctacttaccgggccttaccggccaatgcagctgaatcccctgcacacgggcgagccaggcaacgaagaggacgcggcggcgacctcgccggcgaacgggagtcggcagggggagcgccagcctccgcatctccgtctcacatcctggcctcggggaagcatcgcatcgccatgccatcgccgctgacggaggaaaaaagcagctggtggtgggacgccgggagctgcgggcgcgagcagcactgcggtgcgcccgcgccgccgcggtgtgcccgacatgccggtggtgtgcggccgcgagattcgggtggccctcgccggcgccgccgtcggggcctcgggcggccctgtgcctgtgaatgagtaggtgggccaaattcattttgtgggcccaattcattggtgagatatcgataggccaaattcagttgtgggccgaatttaccgacgagtgttaagtgggccaaattctggggtgggttgaatacgtcgacgagatagcatggcccaaattgatctgtggtctcaaattgttgaggggatttacttgggctgaattcctttgtggcctaaaaccgtttgatgggaatggaatatgatcacttgactccctcaactgaccaccgaatctaaatcgtatccctcaaccgcaataccagaaatcttgacccccgaacttacaaaaccggtgcaatttgactccctcggtggttttggagagtggtttcgctgacgtggcgcacacgtggcagtgttgacctagtctttgtaccacgtggcattgccgtggcgctgatgtggaattaaaataaaaaaaatatgcgggcccatttgtcattcacaaaaaaaaaattatgggacccacttgtcccacatgtcatcctcccttatcccttcttcctcctccctctcctcccttctctatctctccctctttcgcttcatgcgagagcggcgtccggatcggcagcggcgacggcgggcgatggacggagcggcgacggcggaccgagcggcgacggcgtatagtggggatcaaaccaccccacaaactttggcgagattcggaacacggcggaggagttcgccgtcgccgagatgccgcagccgccgccgtcggtgcgcacgaggagcgtcacctccgtcgcgctcccgacgcatggagatggcggcggctgccgcctcgtgccgctctccccattcgacgcgtactgggtcgcgctgctgcccgtccaccacgtcttcctcttcccgtccccgccgccgccgccaccaccaccgttcgaagacgtcgtccgcgcgctcagggactccctcgacgcctgaagctactccctcgtcggtgtgctggtctactcgccggaggaggaggaggaggagg
